(12) United States Patent
Zhou et al.

(10) Patent No.: US 9,976,191 B2
(45) Date of Patent: May 22, 2018

(54) RICE WHOLE GENOME BREEDING CHIP AND APPLICATION THEREOF

(71) Applicants: China National Seed Group Co., Ltd., Beijing (CN); Frontier Laboratories of Systems Crop Design Co., Ltd., Beijing (CN); Huazhong Agricultural University, Wuhan, Hubei (CN); Shenzhen Institute of Molecular Crop Design, Shenzhen, Guangdong (CN)

(72) Inventors: Fasong Zhou, Wuhan (CN); Haodong Chen, Shenzhen (CN); Weibo Xie, Wuhan (CN); Hang He, Shenzhen (CN); Huihui Yu, Wuhan (CN); Xiaoyan Tang, Shenzhen (CN); Jing Li, Wuhan (CN); Junli Zhou, Beijing (CN); Yuqing He, Wuhan (CN); Wei Chen, Beijing (CN); Qifa Zhang, Wuhan (CN); Xingwang Deng, Beijing (CN)

(73) Assignees: China National Seed Group Co., Ltd., Beijing (CN); Frontier Laboratories of Systems Crop Design Co., Ltd., Beijing (CN); Huazhong Agricultural University, Hubei (CN); Shenzhen Institute of Molecular Crop Design, Guangdong (CN)

( * ) Notice: Subject to any disclaimer, the term of this patent is extended or adjusted under 35 U.S.C. 154(b) by 52 days.

(21) Appl. No.: 14/650,762

(22) PCT Filed: Feb. 7, 2013

(86) PCT No.: PCT/CN2013/000131
§ 371 (c)(1),
(2) Date: Jun. 9, 2015

(87) PCT Pub. No.: WO2014/121419
PCT Pub. Date: Aug. 14, 2014

(65) Prior Publication Data
US 2016/0153056 A1    Jun. 2, 2016

(51) Int. Cl.
*C12Q 1/68* (2018.01)
*C07H 21/02* (2006.01)
*C07H 21/04* (2006.01)
*G06F 19/22* (2011.01)

(52) U.S. Cl.
CPC ......... *C12Q 1/6895* (2013.01); *C12Q 1/6837* (2013.01); *G06F 19/22* (2013.01); *C12Q 2600/13* (2013.01); *C12Q 2600/156* (2013.01)

(58) Field of Classification Search
None
See application file for complete search history.

(56) References Cited

U.S. PATENT DOCUMENTS 6,582,908 B2 * 6/2003 Fodor .................. B01J 19/0046
435/288.3

FOREIGN PATENT DOCUMENTS

CN    1675373 A    9/2005
CN    102747138 A   10/2012

OTHER PUBLICATIONS

Int'l Search Report dated Nov. 21, 2013 in Int'l Application No. PCT/CN2013/000131.
McCouch et al, "Development of genome-wide SNP assays for rice," Breeding Science, vol. 60, pp. 524-535 (2010).
Ganal et al, "A Large Maize (*Zea mays* L.) SNP Genotyping Array: Development and Germplasm GEnotyping, and Genetic Mapping to Compare with the B73 Reference Genome," PLoS ONE, vol. 6, No. 12, p. e28334 (Dec. 8, 2011).
Chen et al, "Development and application of a set of breeder-friendly SNP markers for genetic analyses and molecular breeding of rice (*Oryza sativa* L.)," Theor. Appl. Genet., published online Jun. 18, 2011.
Jaccoud et al, "Diversity Arrays: a solid state technology for sequence information independent genotyping," Nucleic Acids Research, Vo. 29, No. 4, p. e25 (2001).
Cook et al, "Generic Architecture of Maize Kernel Composition in the Nested Association Mapping and Inbred Association Panels," Plant Physiology, vol. 158, pp. 824-834 (Feb. 2012).
Zhao et al, "Genome-wide association mapping reveals a rich genetic architecture of complex traits in *Oryza sativa*," Nature Communications, vol. 2, No. 467 (Sep. 13, 2011).
Huang et al, "Genome-wide association studies of 14 agronomic traits in rice landraces," Nature Genetics, vol. 42, No. 11, pp. 961-969 (Nov. 2010).
Huang et al, "Genome-wide association study of flowering time and grain yield traits in a worldwide collection of rice germplasm," Nature Genetics, vol. 44, No. 1, pp. 32-41 (Jan. 2012).
McNally et al, "Genomewide SNP variation reveals relationships among landraces and modern varieties of rice," PNAS, vol. 106, No. 30, pp. 12273-12278 (Jul. 28, 2009).
Zhao et al, "Genomic Diversity and Introgression in *O. sativa* Reveal the Impact of Domestication and Breeding on the Rice Genome," PLoS ONE, vol. 5, No. 5, p. e10780 (May 24, 2010).
Thomson et al, "High-throughput single nucleotide polymorphism genotyping for breeding applications in rice using the BeadXpress platform," Mol. Breeding, published online Nov. 20, 2011.

(Continued)

*Primary Examiner* — Carla J Myers
(74) *Attorney, Agent, or Firm* — Panitch Schwarze Belisario & Nadel LLP (57) ABSTRACT

The present invention provides a rice whole genome breeding chip and the application thereof. The rice whole genome breeding chip of the present invention is Rice60K, an SNP chip manufactured based on Infinium technique. Each chip can detect 24 samples simultaneously and contains 58,290 SNP sites. The marker sites have DNA sequences represented by SEQ ID NO.1-58290. The chip can be used in molecular marker fingerprint analysis of the rice variety resources, in genotype identification of the hybrid progeny population, in identification of the variety authenticity, in analysis and screening of the genetic background of the breeding materials, and in association analysis of the agronomic traits, having wide application prospects.

7 Claims, 3 Drawing Sheets

(56) References Cited

OTHER PUBLICATIONS

Borevitz et al, "Large-Scale Identification of Single-Feature Polymorphisms in Complex Genomes," Genome Research, vol. 13, pp. 513-523 (2003).
Miller et al, "RAD market microarrays enable rapid mapping of zebrafish mutations," Genome Biology, vol. 8, No. R105 (Jun. 6, 2007).
Miller et al, "Rapid and cost-effective polymorphism identification and genotyping using restriction site associated DNA (RAD) markers," Genome Research, vol. 17, pp. 240-248, published online Dec. 22, 2006.
Zhou et al, "The Eight Amino-Acid Differences Within Three Leucine-Rich Repeats Between Pi2 and Piz-t Resistance PRoteins Determine the Resistance Specificity to Magnaporthe grisea," MPMI, vol. 19, No. 11, pp. 1216-1228 (2006).

* cited by examiner

RICE WHOLE GENOME BREEDING CHIP AND APPLICATION THEREOF

CROSS-REFERENCE TO RELATED APPLICATION

This application is a Section 371 of International Application No. PCT/CN2013/000131, filed Feb. 7, 2013, which was published in the Chinese language on Aug. 14, 2014, under International Publication No. WO 2014/121419 A1 the disclosure of which is incorporated herein by reference.

REFERENCE TO SEQUENCE LISTING SUBMITTED ELECTRONICALLY

This application contains a sequence listing, which is submitted electronically via EFS-Web as an ASCII formatted sequence listing with a file name "688936_1US Sequence Listing.txt", creation date of Jun. 4, 2015, and having a size of about 14 MB. The sequence listing submitted via EFS-Web is part of the specification and is herein incorporated by reference in its entirety.

TECHNICAL FIELD

The present invention relates to the fields of genomics, molecular biology, bioinformatics and molecular plant breeding, in particular relates to a rice whole genome breeding chip and the application thereof.

BACKGROUND

In recent years, there have made breakthroughs in DNA sequencing technology, the development of second generation DNA sequencing technology greatly increases the efficiency of genome sequencing and reduces the sequencing time and cost, thus highly facilitating the research on functional genome. In the case of rice, in 2010 the rice molecular biologists in China finished reseqencing of 517 endemic rice variety materials in China by using the second generation sequncing technology, constructed high-density haplotype map (HapMap) of the rice, and conducted association study on 14 important agronomic traits of indica variety by using research method of genome-wide association study (GWAS), thus determined relevant candidate gene locus associated with these agronomic traits and established a set of high throughput genotyping identification methods which are effective and quick, mature and stable, precise and of low cost (Huang et al., Genome-wide association studies of 14 agronomic traits in rice landraces. Nat Genet. 2010, 42: 961-967). Soon afterwards, the number of reseqenced rice varieties increased to 950, more sites related to the regulation of flowering time and grain yield were found by association study (Huang et al., Genome-wide association study of flowering time and grain yield traits in a worldwide collection of rice germplasm. Nat Genet. 2011). Scientists from Huazhong Agricultural University finished the genome-wide resequencing of Minghui 63 and Zhenshan 97 and the cross segregating populations thereof by Illumina sequncing technology, developed a method for high-throughput population genotyping, and constructed an ultra-high-density genetic linkage map of the cross segregating populations of Minghui 63 and Zhenshan 97 comprising 270,000 SNP markers in 210 recombinant inbred lines, which exhibits strong efficacy in QTL mapping analysis (Xie et al., Parent-independent genotyping for constructing an ultrahigh-density linkage map based on population sequencing. Proc Natl Acad Sci USA. 2010, 107: 10578-10583; Yu et al., Gains in QTL detection using an ultra-high density SNP map based on population sequencing relative to traditional RFLP/SSR markers. PLoS One. 2011, 6: e17595). Recently, a cooperative agreement was signed among Chinese Academy of Agricultural Sciences, Shenzhen Huada Gene Research Institute and International Rice Research Institute, a reseqencing project on 3000 rice core germplasm resources collected in the world was initiated, indicating a overall development of rice genome-wide molecular breeding. By the end of 2010, more than 600 rice genes had been successfully cloned, most of which are related to regulation of important agronomic traits including yield, quality, biotic stress resistance and abiotic stress resistance, and nutrition utilization efficiency, etc. Those genes have powerful potential in breeding (Jiang et al., Rice functional genomics research: Progress and implications for crop genetic improvement. Biotechnol Adv. 2011, 30: 1059-1070). Until 2012, over 800 rice genes hayed been cloned. Such research results involved in rice functional genome study provide important foundational data for rice molecular breeding.

Molecular marker technologies are impotent tools for molecular breeding. Conventional molecular marker techniques, such as RFLP (Restriction Fragment Length Polymorphism) and SSR (Simple Sequence Repeat), play an important role in the research on functional genome. However, conventional molecular marker techniques have many limitations such as low throughout, low quantity and complicated operation processes, and they do not meet the needs of large scale breeding for commercial purpose. In order to precisely regulate a target gene, efficiently select genetic background and accurately analyze and identify the varieties for breeding, there is a need for developing and utilizing high throughput molecular marker techniques. At present, there are mainly two platforms for high throughput molecular marker techniques, one is based on the second generation sequencing technology, and the other is based on gene chip technology. Molecular marker techniques based on gene chip mainly include: SNP array (McNally et al., Genomewide SNP variation reveals relationships among landraces and modern varieties of rice. Proc Natl Acad Sci USA. 2009, 106: 12273-12278), SFP (Single Feature Polymorphism) (Borevitz et al., Large-scale identification of single-feature polymorphisms in complex genomes. Genome Res. 2003, 13: 513-523), DArT technology (Diversity Array Technology) (Jaccoud et al., Diversity arrays: a solid state technology for sequence information independent genotyping. Nucleic Acids Res. 2001, 29: E25), RAD (Restriction site Associated DNA) marker (Miller et al., RAD marker microarrays enable rapid mapping of zebrafish mutations. Genome Biol. 2007, 8: R105; Miller et al., Rapid and cost-effective polymorphism identification and genotyping using restriction site associated DNA (RAD) markers. Genome Res. 2007, 17: 240-248), etc. Since SNP sites have the advantages of wide distribution and easy automated detection; among these array-based genotyping technologies, SNP array is most suitable for large scale of commercialized breeding. Currently, Illumina Infinium MaizeSNP50 chip has been used for identification of germplasm resources and association study in maize (Ganal et al., A large maize (Zea mays L.) SNP genotyping array: development and germplasm genotyping, and genetic mapping to compare with the B73 reference genome. PLoS One. 2011, 6: e28334; Cook et al., Genetic architecture of maize kernel composition in the nested association mapping and inbred association panels. Plant physiology. 2011), Affymetrix GeneChip Rice 44K gene chip is used for genetic diversity analysis of rice germplasm resource and genome-wide association study in rice (Zhao et al., Genome-wide association mapping reveals a rich genetic architecture of complex traits in *Oryza sativa*. *Nat Commun.* 2011, 2: 467), and Illumina GoldenGate SNP array with different densities have been used for rice molecular breeding (Zhao et al., Genomic diversity and introgression in *O. sativa* reveal the impact of domestication and breeding on the rice genome. *PLoS One.* 2010, 5: e10780; Chen et al., Development and application of a set of breeder-friendly SNP markers for genetic analyses and molecular breeding of rice (*Oryza sativa* L.). *Theor Appl Genet.* 2011, 123: 869-879; Thomson et al., High-throughput single nucleotide polymorphism genotyping for breeding applications in rice using the BeadXpress platform. *Mol Breeding.* 2011: 1-12).

Infinium SNP chip technology from Illumina Inc. is a genome-wide SNP detection platform, which is currently well developed and widely used, wherein the chips produced by laser confocal optical fiber bead chip technology and unique bead array technology can bear a huge number of beads, thereby coupling to a large number of SNP probes. At present, the human SNP chips produced by Illumina Inc. can accommodate several millions of SNP markers (http://www.illumina.com). When the chips are produced, each SNP probe sequence comprising 20-50 deoxynucleotides is coupled to specific beads, wherein the types of the beads depend on the number of the loaded SNPs, from several thousands to above ten millions. Each type of beads are coded and detected by their particular address sequence and SNP probe sequence. Each type of beads are repeated 15-30 times on average on each chip, so as to ensure the success rate and repeatability for each SNP to be detected. Illumina Infinium SNP chips have been widely used in the genome variation research on species including human and mice, etc. In the case of lacking stable and effective high-density genome-wide breeding chips in rice breeding field, the chip design based on Illumina Infinium platform according to the present invention satisfies the needs for large scale of rice breeding.

DESCRIPTION OF THE INVENTION

One object of the present invention is to provide a rice whole genome breeding chip.

Another object of the present invention is to provide use of the above chip for rice genomic breeding.

The present invention provides a SNP molecular marker combination for rice breeding, which is comprised of 58,290 SNP sites, and the nucleotide sequences thereof are respectively represented by SEQ ID NOs.1-58290.

The present invention provides a rice whole genome breeding chip, named as Rice60K, which comprises 58,290 SNP sites and has nucleotide sequences represented by SEQ ID NOs.1-58290. Most of the 58,290 sequences consist of 101 bases and have a base mutation at position 71.

The present invention has conducted genome-wide sequencing on 211 rice varieties by using Illumina sequencing technology, and 2.5 times of genome coverage has been obtained for each sample. Meanwhile, the inventors have downloaded sequencing data of 520 endemic rice varieties from public database (http://www.ebi.ac.uk/ena/, accession numbers of ERP000106, ERP000235 and ERP000236) and 1 time genome coverage for each of the samples was also obtained (Huang et al., Genome-wide association studies of 14 agronomic traits in rice landraces. *Nat Genet.* 2010, 42: 961-967). The genome sequencing data of 731 rice varieties are achieved in total. The genomes of 731 rice varieties related to the present invention are all obtained by conventional means. The SNPs are identified and screened by the following steps:

1. 3,791,687 SNP sites with high quality are selected from the sequencing data of 731 rice varieties. The SNP sites with high quality should meet the following criteria: SNP sequences are located in specific sequence regions, a SNP site has only two base forms, each of which has a specific proportion, and heterozygous genotypes in the varieties are most likely avoided. In consideration of a certain ratio of error in sequencing, the following conditions are set in the present invention: (1) when the ratios of every kind of base at a site are sorted in descending order, the frequency of the second base is not less than 5%; (2) the number of samples having the third base is less than 10, and the frequency thereof is less than 2.5% (these bases possibly are resulted by errors in sequencing); (3) the frequency of heterozygous genotype is less than 5%; (4) this SNP site is located in non-repeating region.

2. Genotypes of the above-mentioned SNP sites are extracted from 731 rice varieties, and SNP genotypes with missing values are imputed by LD-KNN algorithm (K nearest neighbors). Since the coverage of sequencing was low and a lot of SNP sites were missed, the missing values need to be imputed. It is stipulated in the present invention that the SNP sites after being imputed should meet the following criteria: (1) the ratio of the missing values is less than 50%; (2) at least one linked SNP can be found in the 100 kb region of the rice genome, that is to say, $r^2$ value (r is a correlation coefficient of allele frequency) of LD (linkage disequilibrium) is not less than 0.25. There are 3,679,919 SNP sites which can meet the above criteria.

3. 2,651,614 SNP sites are obtained after the first screening. For each SNP, the 50 bp sequences are extracted at both sides of the SNP sites of Nipponbare (TIGR rice genome anotation version 6.1, http://rice.plantbiology.msu.edu/), Zhenshan 97 and Minghui 63, and a sequence at any side of the SNP sites which meets the following conditions is retained: (1) the sequences of Nipponbare and Zhenshan 97, or the sequences of Nipponbare and Minghui 63 are consistent; (2) the identity of the sequences in any other region of the genome is less than 85%. This step is used for ensuring the specificity and conservatism of the probe sequences on the genome.

4. All the SNPs are divided into 125,062 linkage groups. The rice genome is divided into multiple regions, each comprising 100 kb, with 3,728 regions in total in the genome-wide. $r^2$ value of linkage disequilibrium for any two SNPs in each region is calculated, the SNPs are divided into 125,062 linkage groups by using a greedy algorithm on the basis of $r^2 \geq 0.64$; the SNPs in the same group are considered redundant and referred to as a linkage group. This step is used for ensuring that the selected SNP sites represent the genetic diversity of the varieties as far as possible.

5. 5 SNP sites which have the minor allele frequency (MAF) are selected from each linkage group and the SNP sites with the maximum allele frequency are provided for Infinium iSelect scoring system of Illumina (http://www.illumina.com/) for scoring, the sites with a score less than 0.6 are removed, and 283,451 SNPs are obtained.

6. The present invention defines a comprehensive scoring system, in consideration of Illumina iSelect scoring system scores of the SNP sites, MAF, and the average $r^2$ value of LD for other SNP sites in the same linkage group and the locations in genes. The weighting parameters of all the factors are as follows: (1) the weighting of A/T and G/C change SNP sites (Infinium I) is 0, the weightings of other types of SNP sites (Infinium II) are 20 (since Infinium I needs two kinds of beads to detect one SNP, while Infinium II only needs one kind of bead, and it is best to choose Infinium II in order to deploy SNP sites as many as possible on a chip); (2) the weighting of Illumina iSelect scoring system is 10 (the values of scoring reflect the success rate for probe designing); (3) the weighting of minor allele frequency (MAF) is 40 (the higher the MAF is, the bigger the possibility of polymorphism between any two varieties is); (4) the weighting of LD average $r^2$ value is 5 ($r^2$ values reflect the degree of linkage between SNPs); (5) depending on the location of a SNP in the gene region, the weightings of intergenic, intron, promoter, 5'-end non-coding region (5'-UTR) and 3'-end non-coding region (3'-UTR) are 1, 1.5, 2, 2 and 2.5 (scoring is based on degree of effect of regions with different gene structures on gene function) respectively, and the weightings of synonymous mutation, nonsynonymous muation and large effect mutation (eg. non-sense mutations) occurring in the coding region are 2, 5 and 10 (base mutation in coding region is directly related to function) respectively.

4,646 SNP/INDEL sites with high quality on SNP chip of Rice6K rice (Chinese invention patent No. 201210055775.X) and 1000 SNP sites on the cloned important rice function genes are directly used for synthesizing the probes for Rice60K breeding chip; and 58,290 SNP sites are obtained in total, the nucleotide sequences of which are respectively represented by SEQ ID NOs.1-58,290. Each of the above 58290 sequences consists of 101 bases and has a base mutation at position 71. It can be seen from the sequence listing that each of the 58,290 sequences has a SNP site at position 71.

After identifying and screening in accordance with the above steps, finally 58,290 tagSNP sites are obtained in total. Since 60,000 kinds of beads are needed according to requirements for designing of Illumina Infinium iSelect HD, the chip is named Rice60K. All the 58,290 tag SNP sites correspond to the Nos. 1-58290 DNA sequences in the sequence listing. These tag sequences are provided for Illumina for designing Infinium SNP chip.

The Rice60K gene chip in the present invention is an optical fiber bead chip made by Infinium SNP chip technology (U.S. Pat. No. 6,429,027) and can detect 24 samples simultaneously on a chip.

Further, the present invention provides a method for preparing the above gene chip, comprising the steps of: (1) obtaining genome sequences of plenty of rice varieties by resequencing, and, and analyzing and identifying SNP sites using Nipponbare genome as reference sequence in combination with resequencing data of other rice varieties in the public database, and selecting representative SNP markers to directly synthesize probe; the nucleotide sequences of the SNP markers are respectively represented by SEQ ID NOs.1-58,290; (2) preparing SNP chips using Infinium chip manufacture technology; (3) testing the accuracy and the application efficiency of the chips.

Particularly, the present invention provides the use of a Rice60K rice whole genome breeding chip in detecting rice DNA samples, comprising the steps of:

(1) extracting rice genome DNA: genome DNA is extracted from rice tissues including seeds or leaves in accordance with the requirement for detection. For extracting DNA from young rice leaves, it is preferable to use Promega or Qiagen plant genome preparation kit, and for extracting DNA from endosperms of rice seeds, it is preferable to use the complicated plant genome preparation kit from Beijing ComWin Biotech.

(2) detecting the quality of the DNA samples: electrophoresis detection is carried out using 1% agarose gel and the electrophoresis results are evaluated by gel imaging system to ensure that the genome DNA has a good integrity and the size of the genome DNA fragments is more than 10 kb in length. The concentration of genome DNA is measured by ultra-violet spectrophotometer, and the genome DNA is diluted to a working concentration of 10-50 ng/µl.

(3) detecting the gene chips: the gene chips are detected according to Infinium assay standard protocol, and scanned using Illumina HiScan chip scanner.

(4) analyzing the data: the scanning results from Illumina HiScan are analyzed to calling genotypes by using GenomeStudio software, and programmed by using R language to obtain a comparing result of genotypes.

Further, the present invention provides the use of the above Rice60K rice whole genome breeding chip in fingerprint analysis of rice germplasm resource.

The present invention provides the use of the above Rice60K rice whole genome breeding chip in identification of genotypes of rice hybrid progeny.

The present invention provides the use of the above Rice60K rice whole genome breeding chip in identification of rice varieties.

The present invention provides the use of the above Rice60K rice whole genome breeding chip in detecting rice breeding materials.

The present invention provides the use of the above Rice60K rice whole genome breeding chip in rice genome-wide association study.

As compared with other molecular marker detection systems, the present invention has the following advantages and effects:

(1) as compared with traditional molecular markers such as SSR, the present invention has advantages including high throughout, low cost for a single marker data, etc. It is difficult to develop 200 polymorphism SSR markers in rice genomes by traditional method. On the contrary, Rice60K breeding chip is used for detecting any two of the varieties, any two of the indica varieties, any two of the *japonica* varieties, or one indica variety and one *japonica* variety, and about 14,000, 10,000, 8,000 and 19,000 polymorphism SNP sites with high quality can be obtained on average, respectively.

(2) as compared with other genotyping systems based on gene chip platform, the present invention has advantages including good repeatability, high throughout, and simple data analysis, etc. The technological repeatability of detecting rice samples by using Rice60K breeding chip can be above 99.99%, and it is difficult for the other prior genotyping platforms to reach such a percentage.

(3) as compared with the genotyping systems based on the second generation sequencing platform, the present invention has advantages including simple data analysis and comparability between data from different laboratories. With the development of sequencing technology, the cost of sequencing is becoming lower, and the sequencing throughout is increasing. However, the requirement for sequencing data analysis is getting higher and higher, and professional analysis software and bioinformatics experts are also needed for the analysis, while the data analysis of Rice60K breeding chip platform is relatively very simple; since sequencing itself is random and it is difficult to directly compare the different batches of sequencing data with low coverage, and the cost of deep sequencing is still high; since most of the markers on the Rice60K breeding chip are fixed, it is convenient to compare different batches of detection data.

However, a great number of sequencing data generated by the second generation sequencing system provides important foundational data for designing a gene chip. Therefore, the second generation sequencing and the gene chip systems are complementary to each other.

(4) as compared with the previous patented Rice6K chip (Chinese patent No. 201210055775.X), Rice60K according to the present invention has a wide range of applicability. 1) the markers selected on the Rice60K chip involves more and wider range of rice varieties. The markers on the Rice6K chip were mainly selected from the sequencing data of over 520 endemic rice varieties, while the markers on the Rice60K chip come from over 730 rice varieties, including both the previous endemic rice varieties in China and the ones from rice mini-core collection of germplasm resources from all over the world, as well as the parents of rice hybrids which are widely planted in China. 2) the genetic diversity represented by the markers on the Rice60K chip is more abundant. Generally speaking, the difference between *japonica* varieties is less than the difference between indica varieties, and the latter is then less than the difference between subspecies of *japonica* and indica, the design of Rice6K chip is mainly focused on the difference between subspecies of *japonica* and indica, the proportion of polymorphism SNPs is low within subspecies, especially between *japonica* varieties. For the markers on the Rice60K breeding chip, it is desirable to select the polymorphic sites between the varieties within rice subspecies, especially between *japonica* varieties, such that the Rice60K breeding chip can be used well not only for detecting cross population between rice subspecies, but also for detecting cross population within rice subspecies (see Example 6); 3) Rice60K chip includes a large number of sites related to function genes. Firstly, the markers on the Rice60K chip are apt to select the SNP sites in gene coding region, especially the sites affecting the change of gene function, such as non-sense mutations, while this was not taken into account when the Rice6K chip was designed; secondly, the Rice60K chip includes about 1000 SNP sites in the cloned important rice genes, while the Rice6K chip has few functional gene sites. 4) the Rice60K breeding chip comprises all the SNP sites with high quality on Rice6K chip, Rice60K chip thus has more markers and the distribution density of the markers on the genome is higher.

BRIEF DESCRIPTION OF FIGURES

FIG. 2 is a genotype clustering diagram of 195 rice homozygous varieties. The distance is the ratio of the number of polymorphic sites between two varieties to the number of total sites, and the genotypes of 195 rice samples were clustered using hierarchical cluster analysis method. The ids of the samples are Nos. 1-195, respectively. The indica group is at the left side, the *japonica* group is at the right side, and the intermediate types are in the middle.

FIG. 4 are genotyping maps of representative lines from 4 segregating populations. Each line on the chromosome indicates one SNP site, grey parts indicate female parent (Zhenshan 97) homozygous genotype, and black parts indicate male parent homozygous genotype. Panel A is a map of a line of Zhenshan 97/Minghui 63 RIL population; panel B is a map of a line of Zhenshan 97/XiZang 2; panel C is a map of a introgression line of introducing Nipponbare into Zhenshan 97; panel D is a map of a introgression line of introducing ordinary wild rice (IRGC-105491) into Zhenshan 97.

SPECIFIC MODE FOR CARRYING OUT THE PRESENT INVENTION

Examples are described below to illustrate the present invention but not intended to limit the scope thereof. The alterations or modifications of the methods, steps or conditions of the present invention made without departing from the spirit and essence thereof will be in the scope of the present invention. Unless otherwise indicated, the technical means used in the following examples are conventional means well known to a person skilled in the art.

Example 1

Preparation Method of the Rice60K Rice Whole Genome Breeding Chip

In the present invention, genome-wide sequences for 211 rice varieties were sequenced by Illumina sequencing technology, and 2.5 times genome coverage data was obtained for each sample, see Table 1. Meanwhile, in the present invention, sequencing data of 520 endemic rice varieties were also downloaded from public database (http://www.ebi.ac.uk/ena/, accession numbers of ERP000106, ERP000235 and ERP000236), and 1 time genome coverage data was obtained for each of the samples (Huang et al., Genome-wide association studies of 14 agronomic traits in rice landraces. *Nat Genet.* 2010, 42: 961-967). In total, the genome sequencing data of 731 rice varieties were obtained. The SNPs were identified and screened according to the following steps:

TABLE 1

Names of 211 rice varieties

| No. | Name |
|---|---|
| 1 | Sadu-cho |
| 2 | Dom Sufid |
| 3 | Gerdeh |
| 4 | Lijiangxintuanheigu |
| 5 | AZUCENA |
| 6 | San huang zhan 2-1 |
| 7 | San huang zhan 2-2 |
| 8 | Swarna |
| 9 | MOROBEREKAN |
| 10 | CYPRESS |
| 11 | WH11 |
| 12 | Tainong 67 |
| 13 | N 22 |
| 14 | M202 |
| 15 | Dular |
| 16 | Laoguangtou 83 |
| 17 | Annong wanggeng B-1 |
| 18 | Annong wanggeng B-2 |
| 19 | Aijiaonante |
| 20 | Guangluai 4 |
| 21 | Xiangaizao 10 |
| 22 | Jinnante B |
| 23 | Funingzipi |
| 24 | Zhenshan 97 B |
| 25 | Qingsiai 16B |
| 26 | Weiguo |
| 27 | Dianrui 409B |
| 28 | Liaogeng 287 |
| 29 | Huhui 628 |
| 30 | 88B-1 |
| 31 | 88B-2 |
| 32 | Longhuamaohu |
| 33 | Lucaihao |
| 34 | Zhonglouyihao-1 |
| 35 | Yelicanghua |
| 36 | Shufeng 101 |
| 37 | Chengduai 3 |
| 38 | Sankecun |
| 39 | Gongju 73 |
| 40 | Jiabala |
| 41 | Taishannuo |
| 42 | Guichao 2 |
| 43 | Huke 3 |
| 44 | Teqingxuanhui |
| 45 | Huangsiguizhan |
| 46 | Xiangwanxian 3 |
| 47 | Hanmadao-2 |
| 48 | Zaoshunonghu 6 |
| 49 | Jinyou 1 |
| 50 | Chengnongshuijing |
| 51 | Pei C122 |
| 52 | Guihuahuang |
| 53 | Momi |
| 54 | Xiushui 115 |
| 55 | Sanbaili |
| 56 | Jindao 1 |
| 57 | Dandongludao |
| 58 | Liusha 1 |
| 59 | Bawangbian 1 |
| 60 | Dongtingwanxian |
| 61 | Yangdao 2 |
| 62 | WH62 |
| 63 | Geng 87-304 |
| 64 | Sugeng 2 |
| 65 | Hongwan 1 |
| 66 | Liushizao |
| 67 | Muxiqiu |
| 68 | Taizhongxianxuan 2 |
| 69 | Dangyu 5 |
| 70 | Youmangzaogeng |
| 71 | Laohuzhong |
| 72 | Nantehao |
| 73 | Esiniu |
| 74 | Cunsanli |
| 75 | Huangkezaonian |
| 76 | Benbanggu-1 |

TABLE 1-continued

Names of 211 rice varieties

| No. | Name |
|---|---|
| 77 | Benbanggu-2 |
| 78 | Qitoubaigu |
| 79 | Muguanuo-1 |
| 80 | Hanmadao-1 |
| 81 | Heidu 4 |
| 82 | Gaoyangdiandao |
| 83 | Chikenuo |
| 84 | Haobuka |
| 85 | Shanjiugu |
| 86 | Fanhaopi |
| 87 | Lixingeng |
| 88 | Nangaogu-2 |
| 89 | Tieganwu |
| 90 | Sanlicun |
| 91 | Meihuanuo-1 |
| 92 | Meihuanuo-2 |
| 93 | Xiangnuo-2 |
| 94 | Menjiagao 1 |
| 95 | Xiaohonggu |
| 96 | Jinxibai-1 |
| 97 | Jinbaoyin |
| 98 | Hongainuo |
| 99 | WH099 |
| 100 | WH100 |
| 101 | Babaili |
| 102 | Qiyuexian |
| 103 | Yuyannuo-1 |
| 104 | Mamagu-1 |
| 105 | WH105 |
| 106 | Hongkezhenuo |
| 107 | Mowanggunei-2 |
| 108 | Mamagu-2 |
| 109 | WH109 |
| 110 | Xianggu |
| 111 | Ximaxian |
| 112 | Jinnante 43B |
| 113 | Xiangzaoxian 7 |
| 114 | 80B |
| 115 | WH115 |
| 116 | Liming B |
| 117 | Jiangnongzao 1 |
| 118 | Gu 154 |
| 119 | Ninghui 21 |
| 120 | Shuiyuan300li |
| 121 | Xiangai B |
| 122 | Aituogu 151 |
| 123 | Taidongludao |
| 124 | Menjiading 2 |
| 125 | Jiefangxian |
| 126 | Hongqi 5 |
| 127 | Baikehualuo |
| 128 | Liuyenian |
| 129 | Aihechi |
| 130 | Xiangnuo-1 |
| 131 | Xuanenchangtan |
| 132 | Jinzhinuo |
| 133 | Muguanuo-2 |
| 134 | Wizidui |
| 135 | Xibainian |
| 136 | Zegu |
| 137 | Cungunuo |
| 138 | Lengshuigu 2 |
| 139 | WH139 |
| 140 | Wujuhonggu |
| 141 | Nangaogu-1 |
| 142 | Mowanggunei-1 |
| 143 | Qitougu |
| 144 | Huangpinuo |
| 145 | Zhenshan 97B-2 |
| 146 | Nipponbare |
| 147 | Minghui 63 |
| 148 | 93-11 |
| 149 | Zhonghua 11 |
| 150 | Balila |
| 151 | Nanjing 11 |
| 152 | 02428 |

TABLE 1-continued

Names of 211 rice varieties

| No. | Name |
|---|---|
| 153 | IRAT109 |
| 154 | Heigeng 2 |
| 155 | Erjiunan 1 |
| 156 | Chaoyang 1 B |
| 157 | L301B |
| 158 | Guangluai 15 |
| 159 | Zhuzhen B |
| 160 | Baoxie-7B |
| 161 | G Zhenshan 97 B |
| 162 | Nanxiongzaoyou |
| 163 | Zaoshuxianghei |
| 164 | IR661-1 |
| 165 | Nanjiang 11-2 |
| 166 | Gui 630 |
| 167 | 76-1 |
| 168 | Xugunuo |
| 169 | Taizhongzailai 1 |
| 170 | Xiangwanxian |
| 171 | Xinguo |
| 172 | Zhonghua 8 |
| 173 | Aimakang |
| 174 | JWR221 |
| 175 | Zhenxian 232 |
| 176 | Chenwan 3 |
| 177 | Maguzi |
| 178 | Aimi |
| 179 | Haobayong 1 |
| 180 | Wanlixian |
| 181 | Feidongtangdao |
| 182 | Hengxianliangchun |
| 183 | Leihuozhan |
| 184 | Baikeaohe |
| 185 | Haomake (K) |
| 186 | Sanbangqishiluo |
| 187 | Niankenuo |
| 188 | Yangkenuo |
| 189 | Putaohuang |
| 190 | Xiangdao |
| 191 | Younian |
| 192 | Wukezhan |
| 193 | Zhongnong 4 |
| 194 | Minbeiwanxian |
| 195 | Hongmisandan |
| 196 | Yuyannuo-2 |
| 197 | Maweinian |
| 198 | Zinuo |
| 199 | Beizinuo |
| 200 | Biwusheng |
| 201 | Yizhixiang |
| 202 | Xiaobaimi |
| 203 | Zaoxian |
| 204 | HD9802S |
| 205 | Y58S |
| 206 | Kongyu 131 |
| 207 | Guangzhan 63-4S |
| 208 | B5 |
| 209 | Daohuaxiang |
| 210 | Yuexiangzhan |
| 211 | X Zhenshan 97 B |

1. 3,791,687 SNP sites with high quality were identified from the sequencing data of 731 rice varieties. The SNP sites with high quality should meet the following conditions: (1) when the ratios of every kind of base at a site are sorted in descending order, the frequency of the second base is not less than 5%; (2) the number of samples having the third base is less than 10, and the frequency thereof is less than 2.5%; (3) the frequency of heterozygous genotype is less than 5%; (4) this SNP site is located in non-repeating region.

2. Genotypes of the above-mentioned SNP sites were extracted from 731 rice varieties, and the SNP genotypes with missing values were imputed by LD-KNN algorithm (K nearest neighbors). 3,679,919 SNP sites with missing values can be imputed by this method. Afterwards, these sites should meet the following conditions: (1) the ratio of the missing values is less than 50%; (2) at least one linked SNP can be found in the 100 kb region of the rice genome, that is to say, $r^2$ value of linkage disequilibrium (LD) is not less than 0.25, wherein r is a correlation coefficient of allele frequency.

3. 2,651,614 SNP sites were obtained after the first screen. For each SNP, 50 bp sequences were extracted at both sides of the SNP sites of Nipponbare, Zhenshan 97 and Minghui 63, and a sequence at any one side of the SNP sites which meets the following conditions was retained: (1) the sequences of Nipponbare and Zhenshan 97, or the sequences of Nipponbare and Minghui 63 are consistent; (2) the identity of the sequences in any other region of the genome is less than 85%.

4. All the SNPs were divided into 125,062 linkage groups. The rice genome was divided into bins (small region), each comprising 100 kb, with 3,728 bins in total in the genome-wide. $r^2$ value of linkage disequilibrium for any two SNPs in each bin was calculated, the SNPs were divided by using greedy algorithm on the basis of $r^2 \geq 0.64$; the SNPs in the same group were considered redundant.

5. 5 SNP sites which had the minor allele frequency (MAF) were selected from each linkage group and SNP sites with the maximum allele frequency were provided for Illumina Infinium iSelect scoring system (http://www.illumina.com/) for scoring, and the sites with a score less than 0.6 were removed.

6. The present invention defines a comprehensive scoring system, in consideration of Illumina iSelect scoring system scores of the SNP sites, MAF, and the average $r^2$ value of LD for other SNP sites in the same linkage group and the locations in genes. The weighting parameters of all the factors were determined experientially and they are as follows: (1) the weighting of A/T and G/C change SNP sites (Infinium I) is 0, the weightings of other types of SNP sites (Infinium II) are 20; (2) the weighting of Illumina iSelect scoring system is 10; (3) the weighting of minor allele frequency (MAF) is 40; 4) the weighting of LD average $r^2$ value is 5; (5) depending on the location of a SNP in the gene region, the weightings of intergenic, intron, promoter, 5'-end non-coding region (5'-UTR) and 3'-end non-coding region (3'-UTR) are 1, 1.5, 2, 2 and 2.5, respectively, and the weightings of synonymous mutation, non-synonymous mutation and large effect mutation (eg. non-sense mutations) occurring in the coding region are 2, 5 and 10, respectively.

4,646 SNP/INDEL sites with high quality on SNP chip of Rice6K rice (Chinese invention patent, 201210055775.X) and 1000 SNP sites on the cloned important rice function genes were directly used for synthesizing the probes for Rice60K breeding chip.

Figure 1:
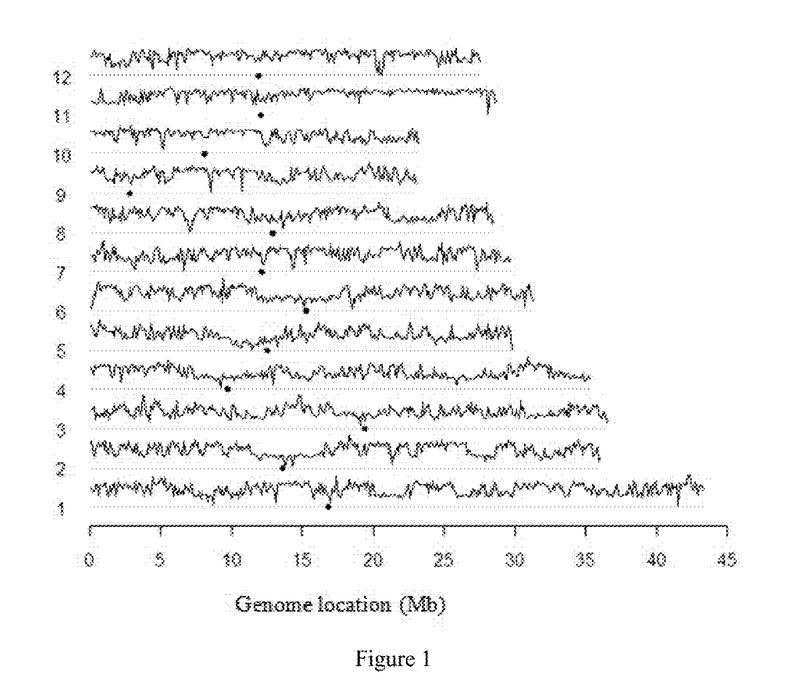
FIG. 1 is schematic diagram showing the distribution of 51,599 SNP markers on rice genome on the Rice60K rice whole genome breeding chip. Reference genome is Nipponbare (TIGR rice genome annotation version 6.1). The curve on each chromosome is the ligature of the number of SNP sites in each 100-kb region, the maximum is set for 25 SNPs/100-kb, and the dot on each chromosome indicates the position of centromere.

After identifying and screening in accordance with the above steps, finally 58,290 tag SNP sites (tagSNP) were obtained in total, and 60,000 kinds of beads are needed according to the requirements for designing of Illumina Infinium iSelect HD. All the 58,290 tag SNP sites correspond to the Nos. 1-58,290 DNA sequences in the sequence listing. These tag sequences were provided for Illumina for designing Infinium SNP chip. 51,599 effective sites meeting the requirements for detection were obtained by chip preparation, and the distribution of these sites on genome-wide was shown in FIG. 1.

Example 2

Application of Rice60K Rice Whole Genome Breeding Chip in Detecting Rice DNA Samples Extraction of rice genome DNA: genome DNA was extracted from rice tissues including seeds or leaves in accordance with the requirement for detection. For extracting DNA from young rice leaves, it is preferable to use Promega plant genome preparation kit (Wizard Magnetic 96 DNA Plant System Kit, Item No. FF3760 or FF3761, Beijing Promega biological technology Co. Ltd.), and for extracting DNA from endosperms of rice seeds, it is preferable to use the complicated plant genome preparation kit from Beijing ComWin Biotech (SurePlant DNA Kit, Item No. CW0555, Beijing ComWin Biotech Co. Ltd.).

Detection of the quality of the DNA samples: electrophoresis detection was carried out using 1-1.5% (W/W) agarose gel, and the electrophoresis results were evaluated by gel imaging system (Gel Doc XR System, Bio-Rad Co., US) to ensure that the genome DNA has a good integrity and the size of the genome DNA fragments is more than 10 kb in length. The concentration of genome DNA was measured by micro-volume ultra-violet spectrophotometer (Q5000, Quawell Co., US) or similar nucleic acid and protein detector, and the genome DNA was adjusted to a working concentration of 10-50 ng/µl.

Detection of the gene chips: the gene chips were detected according to Infinium assay standard protocol (Infinium HD Assay Ultra Protocol Guide, http://www.illumina.com/), and scanned using Illumina HiScan chip scanner (HiScan, Illumina Co., US).

Analysis of the data: the scanning results from Illumina HiScan were analyzed to calling genotypes by GenomeStudio software (http://www.illumina.com/), and programmed by using R language to obtain a comparing result of the genotypes.

Example 3

Figure 2:
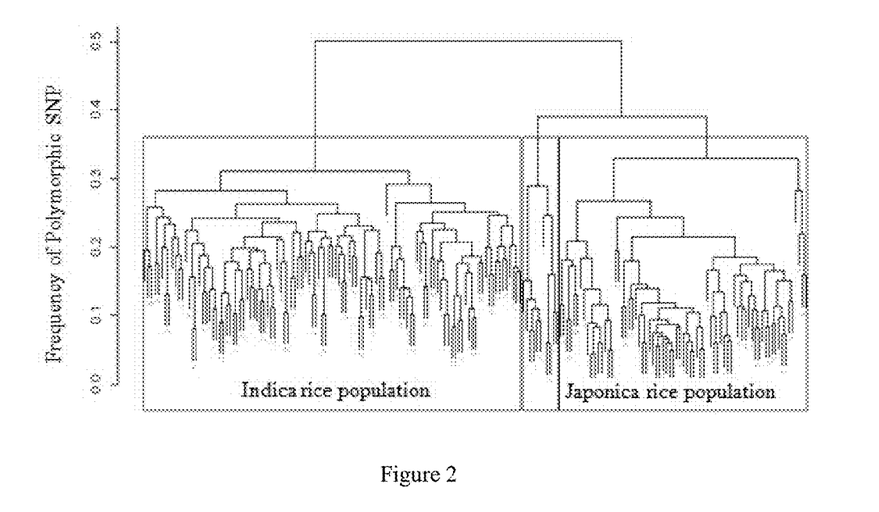
Figure 3:
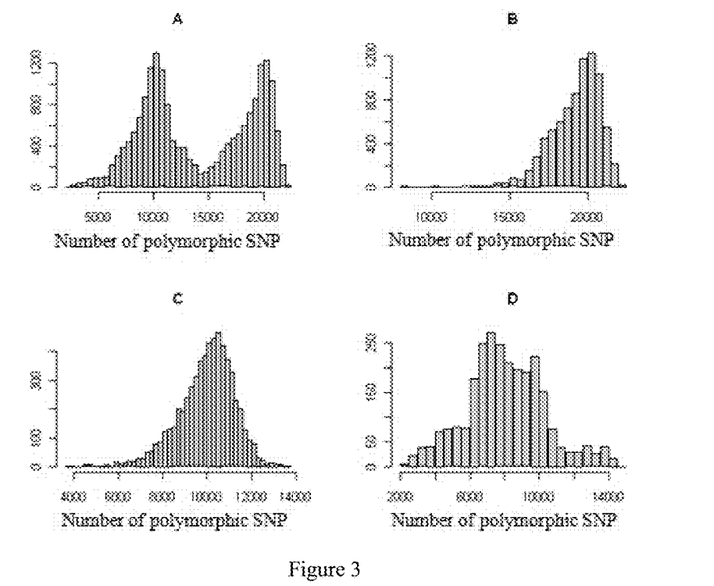
FIG. 3 are schematic diagrams showing the distributions of polymorphism SNPs among different types of rice obtained by Rice60K chip detection. The panels show the histograms of polymorphism SNP sites distribution between any two varieties. Panel A is a diagram showing the number distribution between random two varieties; panel B is a diagram showing the number distribution between two subspecies of indica and *japonica*; panel C is a diagram showing the number distribution between indica varieties; panel D is a diagram showing the number distribution between *japonica* varieties.

Application of Rice60K Rice Whole Genome Breeding Chip in Gene Fingerprint Analysis for Rice Germplasm Resource With reference to the method of Example 2, 270 varieties from the mini-core collection of rice germplasm resource (No. WCR001-270) from China National Seed Group CO., LTD., were detected by Rice60K breeding chip in the present invention, and among them, 195 representative varieties of self-pollinating homozygote were selected for analysis. The genotypes of the 195 representative varieties were detected by Rice60K breeding chip, and 195 varieties may be divided into three groups by cluster analysis: indica group, *japonica* group, and intermediate group (see FIG. 2), which was consistent with the classification results based on phenotype. Between any two of the varieties, between indica and *japonica*, between any two of the indica varieties, and any two of the *japonica* varieties, the average number of polymorphism SNP sites are 14,000, 19,000, 10,000 and 8,000 respectively (see FIG. 3). These results show that, SNP sites of the Rice60K breeding chip have applicability in a wide range, and they can even be used to detect and well distinguish *japonica* varieties which have small differences. Therefore, Rice60K breeding chip is particularly suitable for establishing gene fingerprint database for rice varieties, helping breeding scientists search and compare the genetic relationships between varieties and select breeding materials.

Example 4

Figure 4:
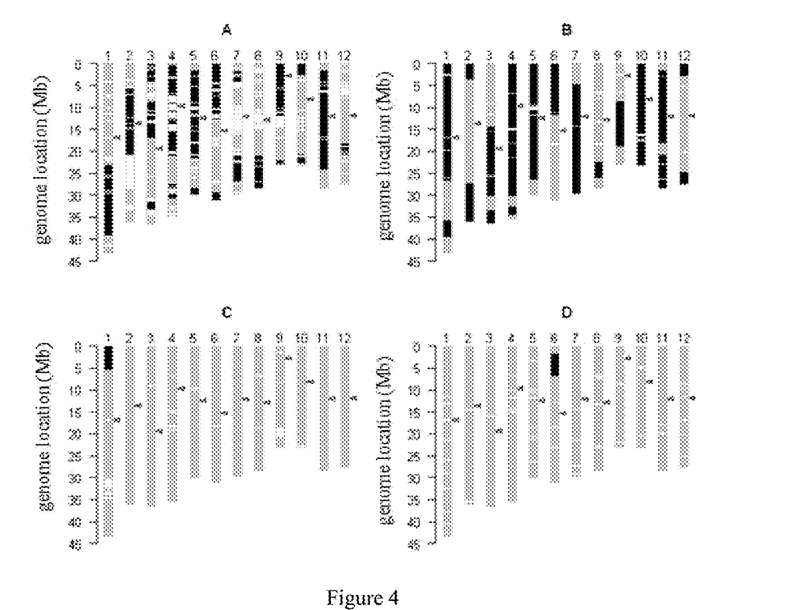

Application of Rice60K Rice Whole Genome Breeding Chip in Genotyping Rice Segregating Populations The genotypes of the following populations were detected by Rice60K chip in the present invention: 2 recombinant inbred line (RIL) populations, i.e., Zhenshan 97/Minghui 63 RIL population, Zhenshan 97/Zizang 2 RIL population, and 2 chromosome segment substitution line (CSSL) populations, i.e., a introgression line of Zhenshan 97, into which Nipponbare was introduced, and a introgression line of Zhenshan 97. into which an ordinary wild rice (IRGC-105491) was introduced (refer to the method of Example 2); the genotypes of one representative line from each of the populations are shown in FIG. 4. FIG. 4 shows that, Rice60K chip has very good effect on genotyping for different populations with advantages of high density of markers and clear recombinant breakpoints. Rice60K chip can detect the double crossover region which can not be detected by the traditional molecular markers such as SSR, furthermore, it has more accurate and reliable detection results due to the high density of markers. The results demonstrate that, as a molecular marker detection system, Rice60K rice whole genome breeding chip can genotype rice cross segregating populations well.

Example 5

Figure 5:
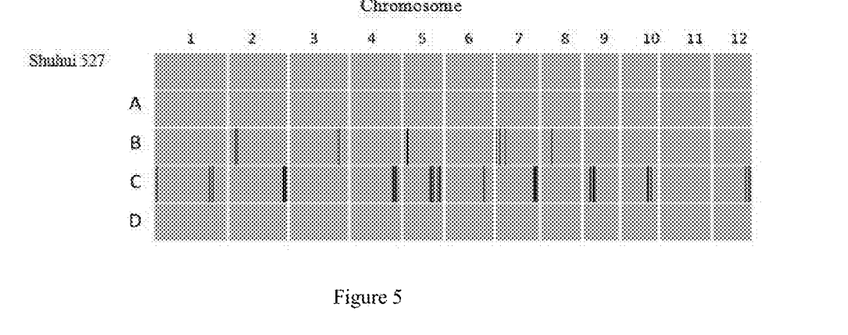
FIG. 5 is schematic diagram showing SNP genotyping comparison of five Shuhui 527 samples with different origins. Grey lines indicate SNP sites consistent with the standard Shuhui 527 sample, and black lines indicate SNP sites which are not consistent with the standard sample.

Application of Rice60K Rice Whole Genome Breeding Chip in Identifying Rice Varieties Four kinds of seeds (A, B, C, D) marked as Shuhui 527 were collected from the market, they cannot be distinguished from each other in phenotype; and standard Shuhui 527 material was collected from Sichuan Agricultural University, who is the breeder of Shuhui 527, and was used as a control. The 5 samples were detected by Rice60K rice whole genome breeding chip (Refer to the method of Example 2). With respect to the genotype, the 4 kinds of seeds of Shuhui 527 from the market and were compared with the control based on the detection results. Shuhui 527, which has been bred for many years, can be considered as homozygous parent. After removing the heterozygous sites and the sites with GenTrain Score less than 0.6, 38,310 SNP sites with high quality were obtained. Genotype comparison of the 5 samples is shown in FIG. 5. It can be seen from the results that, A and D are consistent with Shuhui 527 from the breeder, while 4% genotypes of B and C are distinctive from that of Shuhui 527, and it can be concluded that B and C are not Shuhui 527 varieties. These results demonstrate that, Rice60K gene chip can be advantageously used in identifying the authenticity of rice varieties, and the identification results are precise and reliable.

Example 6

Figure 6:
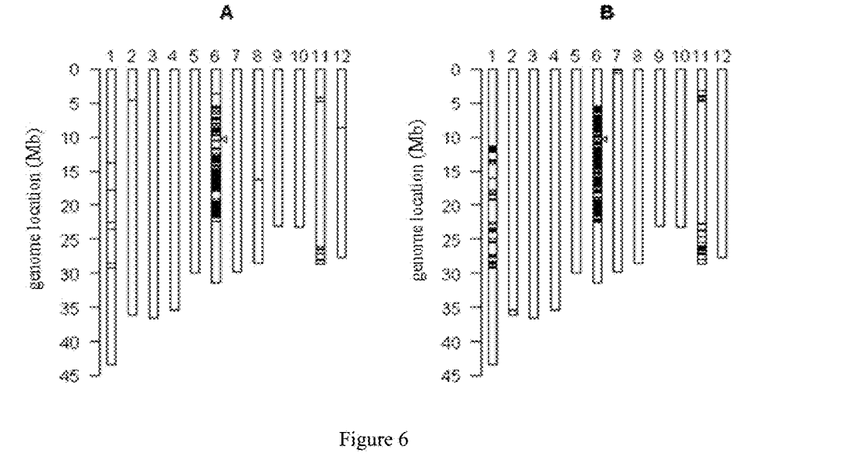
FIG. 6 are schematic diagrams showing the genetic background detection results of the improved line A8 from Kongyu 131 by Rice6K and Rice60K chips, respectively. For the chromosome regions without line in the diagrams, the background is recovered consistent with genotype of recipient parent Kongyu 131, and the black lines are heterozygous genotype SNP sites. The triangle arrows indicate the location of target gene Pit. Panel 6A is a diagram showing the detection result of Rice6K; and panel 6B is a diagram showing the detection result of Rice60K.

Application of Rice60K Rice Whole Genome Breeding Chip in Genetic Background Analysis of Rice Breeding Materials In order to test the application effect of Rice60K breeding chip in genetic background analysis of rice breeding materials, the rice varieties Kongyu 131 and improved line A8 thereof were detected in the present invention (Refer to the method of Example 2). A8 is a single plant of the BC4F1 generation, the target gene is rice blast resistance gene Pi2 (Zhou et al., The eight amino-acid differences within three leucine-rich repeats between Pi2 and Piz-t resistance proteins determine the resistance specificity to *Magnaporthe grisea*. Mol Plant Microbe Interact. 2006, 19: 1216-1228). As compared with the recipient parent Kongyu 131, the genetic background of A8 is shown in FIG. 6. It can be seen from FIG. 6 that, the plant has not only introduced Pi2 gene and the big fragment adjacent to Pi2 gene on chromosome 6, but also has combined at least 3 donor fragments on chromosomes 1 and 12. Both Rice6K chip and Rice60K chip can effectively detect Pi2 gene and the big fragments adjacent to Pi2 gene. However, the effect of Rice60K chip is significantly better than that of Rice6K chip when detecting the other background. The recipient parent Kongyu 131 is *japonica*, while the donor parent Pi2 gene and the adjacent regions are indica fragments, and the other locations are in *japonica* background. Since Rice6K chip is mainly designed for indica and *japonica* hybrids, when it is used for detecting the hybrids between *japonica*, the polymorphism is low; while Rice60K breeding chip can effectively detect the hybrids between *japonica* since it has greatly increased marker density and the polymorphism between *japonica* varieties was taken into account when designing the probe. It thus can be seen that Rice60K rice whole genome breeding chip has good effect in analyzing genetic background of breeding materials.

Example 7

Figure 7:
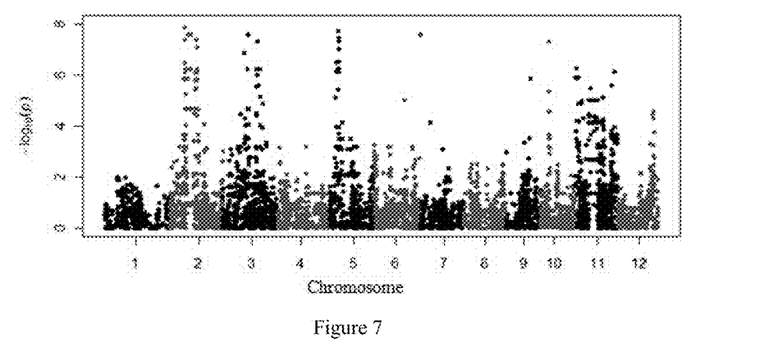
FIG. 7 is a Manhattan plot showing the association study for grain wide trait of Huanghuazhan lineage.

Application of Rice60K Rice Whole Genome Breeding Chip in Rice Association Study Huanghuazhan and its lineage varieties, a total number of which is 21, were collected to investigate an important agronomic trait, viz. grain width, and to analyze the relationship between genome change and gain width of Huanghuazhan and its lineage varieties. Quality control was given to the genotyping results from Rice60K chip (Refer to the method of Example 2), and genotyping information with high quality was obtained by screening. SNP sites of the samples with GenTrain Score less than 6 were removed, since these sites have poor reliability and can not be used for data analysis. The sites with a missing genotype rate less than 0.2 in these 21 varieties were further removed, since the missing sites can not be effectively used for further analysis of the data due to data loss, and finally 42,387 SNP sites were obtained. Association study was conducted on the basis of the grain wide traits of the collected rice seeds and the resulting SNP sites, obtaining a Manhattan plot shown in FIG. 7. Analysis shows that 5 sites on the chromosome have remarkable relevance, and mapping shows that Region 2 of the chromosome contains the known GW2 gene, Region 3 of the chromosome contains the known GS3 gene, and Region 5 of the chromosome contains the known GWS gene, while the QTLs on chromosome 6 and chromosome 10 are new potential regulation sites. Therefore, identifying genotype by using Rice60K SNP chip can obtain a more precise result of association study with high density of genotyping data.

The present invention has been illustrated here in detail by general description and specific embodiments, however, on the basis of the disclosure of invention it is obvious to a person skilled in the art that some alterations or modifications can be made. Therefore, the alterations or modifications made without departing from the spirit of the present invention will be in the scope of the present invention.

INDUSTRIAL APPLICATION

The chip according to the present invention is a SNP chip manufactured by Infinium SNP chip technology, which comprises 58,290 SNP sites and can be used to analyze molecular marker fingerprint of rice variety resources, identity genotype of progeny of cross populations, identity authenticity of varieties, analyze and screen genetic background of breeding materials, and analyze the association of agronomic traits. The chip thus has important economic values and prospects of application.

SEQUENCE LISTING (58290 sequences)

SEQ ID NO: 1 - DNA, 101 bp, rice(Oryza sativa)
  misc_feature (71): n=a or g
aggtattctggaaaaggattcttatcgtctttgcaaatttgctgtggcatatttcctccgcttacgtgggnacaccaaaggaatagcgactggagaggaca

SEQ ID NO: 2 - DNA, 101 bp, rice(Oryza sativa)
  misc_feature (71): n=a or c
ccaattgctaccattattggtaatatggccttacgcatgtgtatattagcattatgatttatgtccttatnctcctcctccctcctgtcctgtattcaaaa

SEQ ID NO: 3 - DNA, 101 bp, rice(Oryza sativa)
  misc_feature (71): n=a or g
cgccatggccgccgatccgtgtcttcccttgcggccttgcccttccttccttgatgatgaacaaagaaagnggaatggagtagaggtgggaggaagcggtg

SEQ ID NO: 4 - DNA, 101 bp, rice(Oryza sativa)
  misc_feature (71): n=t or g
gcgaggaagccttagcttatgggcacctggatccattatttcccaatctcaatagtcaatagtatacttcntctctccttttacacacatgcatgttgttg

SEQ ID NO: 5 - DNA, 101 bp, rice(Oryza sativa)
  misc_feature (71): n=a or g
ttttataatagaatttattgttgtttttgcttaaataaattacatccaattactaccgatattgcaaatcnaacggtcacgattacaaattcatagcttga

SEQ ID NO: 6 - DNA, 101 bp, rice(Oryza sativa)
  misc_feature (71): n=a or g
aaaaattcccggttgtaaacctggataggtgccggttttatagtcggcaacaattatatattcgtcaccantgacttgatagaattgatatttttgggctc

SEQ ID NO: 7 - DNA, 101 bp, rice(Oryza sativa)
  misc_feature (71): n=t or c
atatctggtcctggggcttacttctttctgcatatttctcaaagccatgattccttttccaaggatcgccnccattataatttttgaaagagcaaggcgaa

SEQ ID NO: 8 - DNA, 101 bp, rice(Oryza sativa)
  misc_feature (71): n=t or c
aaacagaaaaagcagtagcaggatttaggcaagaaaaatgagatcctgagacctgtggcatatgcttcttnttttttttatatcaggctggagaacgagca

SEQ ID NO: 9 - DNA, 101 bp, rice(Oryza sativa)
  misc_feature (71): n=a or c
aattaattaatactatgatgaataaaacagataatggcagtaaaaaaaaaggtaaggagagaaagacaganagaaagaaataaagaagatatagagaaaag

SEQ ID NO: 10 - DNA, 101 bp, rice(Oryza sativa)
  misc_feature (71): n=a or g
gccggagttgtaggcaagaaatcatctgttatccagtttgacaaattacatgagtataaatttgactccanaaaaaaacatgaacagcgcaggaaatggat

SEQ ID NO: 11 - DNA, 101 bp, rice(Oryza sativa)
  misc_feature (71): n=a or g
atccatcctgtagcgggagaactgcaggtacattacatacactatttgagtacccacaaatttcagcagcnacgttaacaagctactaatgaaattctgaa

SEQ ID NO: 12 - DNA, 101 bp, rice(Oryza sativa)
  misc_feature (71): n=t or c
ttacaagggttccccaacttagaagagcttacttcccttctcttcctggagttcggggttttccgagtgtngtcccttttcccggtgagcaaggtcctcct

SEQ ID NO: 13 - DNA, 101 bp, rice(Oryza sativa)
  misc_feature (71): n=a or g
caccgttggtcgtgatgatttttcttactcgcaagtactggaaaacaaggattgcaattgatgcagtcganaagttccttcggatgcaagatatgctaggc

SEQ ID NO: 14 - DNA, 101 bp, rice(Oryza sativa)
  misc_feature (71): n=a or g
cctgacttgagtttgctgcattcggatctgcatttcttcttcctccggccatttctagtagcagcatcccnaagctatacacatcagatttgcttgatatg

SEQ ID NO: 15 - DNA, 101 bp, rice(Oryza sativa)
  misc_feature (71): n=a or g
cgagtataagactcatcatggatttgagcgcagtaactccaagattcaaatagaaaaagaacaaatcgtanaaaagttacctttgttaattccaactagga

SEQ ID NO: 16 - DNA, 101 bp, rice(Oryza sativa)
  misc_feature (71): n=t or c
cactaacctgtaaacactattacatagtgctagtctgcaaataagaacagggagcacaacttcacttctangcagcagatatgcatatatgtatactgatt

SEQ ID NO: 17 - DNA, 101 bp, rice(Oryza sativa)
  misc_feature (71): n=t or g
tgggacctggctcgtgtagtcgtgaacttgggcgtggcagcagcagctctatcaatgcggatgctgagganggccgcctcgccgccgggcacgccgtgcag

SEQ ID NO: 18 - DNA, 101 bp, rice(Oryza sativa)
  misc_feature (71): n=t or g
tattgacggacatcgatcatatctgcaaggatcagttctgagtgcatggtgtgcacttgggccctggctgnccggtgaactgatccttgcagacgaagcga

SEQ ID NO: 19 - DNA, 101 bp, rice(Oryza sativa)
  misc_feature (71): n=a or g
ggagacacacacaggcagagaaagaaggagagagcaggtgagtgagtgatggagacgtttattactgaagnctgatgagtataggacgagcagcagcagcc

SEQ ID NO: 20 - DNA, 101 bp, rice(Oryza sativa)
  misc_feature (71): n=t or c
gaagggccagaaagaagaaacaaacttaccatatagaacataaatgacaacaaatgaaaactaaaaggggnatcatgaaatatgtagatctgcaacatatc

SEQ ID NO: 21 - DNA, 101 bp, rice(Oryza sativa)
  misc_feature (71): n=a or c
gctatcatggatgctgtcacacatttcccccttacacaattcctagtagtcccaactagctaatctacgtncaatactttctccatcccaaaatgaattta

SEQ ID NO: 22 - DNA, 101 bp, rice(Oryza sativa)
  misc_feature (71): n=t or c
gttatattctgcatcagtgcatcgacaaattcagccacgccttccccatagtagtcgttttctgccgtttngatgatgttgtcatcccaaacctgaacgac

SEQ ID NO: 23 - DNA, 101 bp, rice(Oryza sativa)
  misc_feature (71): n=t or c
ttttgagctatttcactttagcgttttgttgaaacacaataaattttgtgtggataagaacttggatcacnacttacgttaaaatcttttatttgctttct

SEQ ID NO: 24 - DNA, 101 bp, rice(Oryza sativa)
  misc_feature (71): n=a or t
gaattccaatccataactcggaaattctggttagggttgttttgtttatcaaataattccaataagaagtntttttttaagaaacgacggtaggagatcta

SEQ ID NO: 25 - DNA, 101 bp, rice(Oryza sativa)
  misc_feature (71): n=t or c
taaattttggtacctctagtgtaaagtttggtatctcaagataccaaacttttatgtgtaaaatgtggtanctcgaaataccaaatattggatggtaaaat

SEQ ID NO: 26 - DNA, 101 bp, rice(Oryza sativa)
  misc_feature (71): n=t or c
tcagcacccgtcaaggctactgagtggtgttttcctgctgctgtgattaaatgcttaaatgaatggttcanatgtgttaggtgctccatggagtaaggtgc

SEQ ID NO: 27 - DNA, 101 bp, rice(Oryza sativa)
  misc_feature (71): n=a or c
acgaggggttgaggcaaatacttttagtagaagaagtattacttggaccatttttttttatcatcctttanccaatgtttcactggtggagaaaccgtttg

SEQ ID NO: 28 - DNA, 101 bp, rice(Oryza sativa)
  misc_feature (71): n=a or g
cctgcgcggactatctttttatcggttcaacacacctaaaaggaatataaatggctggaaattgagggggnaaaacattttctgaacctaaccaaatgtgg

SEQ ID NO: 29 - DNA, 101 bp, rice(Oryza sativa)
  misc_feature (71): n=a or c
cgtcgcttgcacgtttgcatcttggaatcacatcctcactcctcagaatagttcattttcttctcccccgnctatctcaaaataagttttttttttcaaaa

SEQ ID NO: 30 - DNA, 101 bp, rice(Oryza sativa)
  misc_feature (71): n=t or c
caacttattccatttgttatgccttgtgtttaaccatttccgaagagcatcggaatacagatatagatacngaggtaaaaatctatcatccatattcatca

SEQ ID NO: 31 - DNA, 101 bp, rice(Oryza sativa)
  misc_feature (71): n=t or c
attcgatttagtaacgagctcaggtagctttctgaaccaacctaactcctgtatttctactctgaatttcngatggattacaactattcctaattattcat

SEQ ID NO: 32 - DNA, 101 bp, rice(Oryza sativa)
  misc_feature (71): n=t or c
aaatcttttattttgaaacttttctgctgcttaaaactctgttggtgttttatgaatcattgtgtctagtncctgtcctttttcttgagtttttgagggga

SEQ ID NO: 33 - DNA, 101 bp, rice(Oryza sativa)
  misc_feature (71): n=t or c
ctacatacgagagtcatgtattctgaattccaccataaatgtgctctacatatcaactcctgcaggtgttntacatagcaactcctaacaccaatccatgc

SEQ ID NO: 34 - DNA, 101 bp, rice(Oryza sativa)
  misc_feature (71): n=t or g
caactgagtaagatatcagtacaggtcactccctattgacattgaactctgctatgagttttcctaataancatgtacgatagtatttgttgtcattaatt

SEQ ID NO: 35 - DNA, 101 bp, rice(Oryza sativa)
  misc_feature (71): n=t or c
ttaaatctggaacaaatttgtggtcaggattgcagaatgtcatgacatggtattgcaacagagtaaagggnggtttaacagcagtatgtagttaaaaacat

SEQ ID NO: 36 - DNA, 101 bp, rice(Oryza sativa)
  misc_feature (71): n=a or g
caagacttgacaataggcagtgtatgtacaaaattagaacaccatttaatatgaataccatgcgaaagatnaggaggagacagaaatttgctttaacttct

SEQ ID NO: 37 - DNA, 101 bp, rice(Oryza sativa)
  misc_feature (71): n=a or g
cacagccagagtcacggtctgcattgagacgtcggccacagacgtcgccgcaggagtgggggaggatccangggtccggagctgggtctaccgtcttggag

SEQ ID NO: 38 - DNA, 101 bp, rice(Oryza sativa)
  misc_feature (71): n=a or c
caattattctaacagtcagatccccattggaattggttccctcaagaaacttgtcactcttgatttttccngtaattatgggttatattttgttaagccaa

SEQ ID NO: 39 - DNA, 101 bp, rice(Oryza sativa)
  misc_feature (71): n=t or c
actataagttagggaacactttaaccaagacagttcattcttttgagttaaccgaactaaggcagattttncatgtaatattgcgcgggctagattaaaat

SEQ ID NO: 40 - DNA, 101 bp, rice(Oryza sativa)
  misc_feature (71): n=a or g
atttgatttcattccattgaaaataagcagcttctttgacttcagaacacgcagaggtaaacagtacaaanaaaataatcaagaggggtatcaatgtcaag

SEQ ID NO: 41 - DNA, 101 bp, rice(Oryza sativa)
  misc_feature (71): n=a or c
caaaatcactgtagacgttatcgatgaagcccaccacaaaaaataaatagacgatcgatgaagcccaccanaaaaaataaatagataaatacaagtatcta

SEQ ID NO: 42 - DNA, 101 bp, rice(Oryza sativa)
  misc_feature (71): n=a or g
atccttttagacagtcgtctcttctatgtattttataactcggtgttgaagcagttttgtggtgattggantcagcttaaataggatgacttttaataaaa

SEQ ID NO: 43 - DNA, 101 bp, rice(Oryza sativa)
  misc_feature (71): n=a or c
agtcccaaccctgtgaagcttaacaggcaaataaaacgatagatacttccgtgtattgggtgatgaccttnatgaatcaagtatttaggtggcagagttct

SEQ ID NO: 44 - DNA, 101 bp, rice(Oryza sativa)
  misc_feature (71): n=t or c
catggcggcgccggcggcggcgagggtttggtgtttggtgcgcgaaagggtaaatcaaaggcgagagaggncgcaccacccgatcagttttcggcccgggg

SEQ ID NO: 45 - DNA, 101 bp, rice(Oryza sativa)
  misc_feature (71): n=a or t
agggcccaaggtcgggagtaccatatacttactatacctgctaagttttctgatacataatgtgatcagcngatctcattttgatcctattctcatttttt

SEQ ID NO: 46 - DNA, 101 bp, rice(Oryza sativa)
  misc_feature (71): n=t or g
atcgttctgtgtcccccgggatttcctaaatttcagaaatttcgagccaaatttcaatcaccgagaaaaanaaaaaaatattccatttgttcaaaaatata

SEQ ID NO: 47 - DNA, 101 bp, rice(Oryza sativa)
  misc_feature (71): n=a or g
cattgttgtgacgtttgagagctggtcctgggagaaagatggtgacagtttctctgctgcaaaaaaaaaanaaagagagagagagagagagagagagaaaa

SEQ ID NO: 48 - DNA, 101 bp, rice(Oryza sativa)
  misc_feature (71): n=a or g
atttgccaactacaagaaaacacaaactaatttgagaagggctcgaattccatcgagaaaggatggaacancctcatcttttcgcttatgcttatgcttat

SEQ ID NO: 49 - DNA, 101 bp, rice(Oryza sativa)
  misc_feature (71): n=a or g
cggcatctttccatgtgccgtcgggtaactcgcgtcctccgaaaaacactactctctccagcaacacatanggaggcctagggtttgccatggttgctgct

SEQ ID NO: 50 - DNA, 101 bp, rice(Oryza sativa)
  misc_feature (71): n=t or c
ctcgcaaaaacaaatctcatcaatttaacatcagtgtagggaaaggtaaaaattatataacgacagtatangaaaagtgtaagctcatgtattttttttct

SEQ ID NO: 51 - DNA, 101 bp, rice(Oryza sativa)
  misc_feature (71): n=t or c
cagatcaaacagcaagattcagatgtgccacacagaaactttagggcccgatcgattgactatgagctaantataagctaaaatggtttattagcgacgaa

SEQ ID NO: 52 - DNA, 101 bp, rice(Oryza sativa)
  misc_feature (71): n=t or g
tccccccaccatcttctcgccctcgactcctcgtcgatctcctcgccttcaattcgtcgcgagttcgctcngcggcggcggcggccgcctcgccgtgtctc

SEQ ID NO: 53 - DNA, 101 bp, rice(Oryza sativa)
  misc_feature (71): n=t or g
agtgaagaacttctgaaagcttgagcagagaccactctgttttctgttcaagttttcagaaactttttcanttactttagttagagcatacgagggggact

SEQ ID NO: 54 - DNA, 101 bp, rice(Oryza sativa)
  misc_feature (71): n=a or g
aaatcaaggcaatacccaagtattggctggagcttggcaactttgaaccttgcagaattgcagaggcatangataaccattacactaagagcaaaaggaat

SEQ ID NO: 55 - DNA, 101 bp, rice(Oryza sativa)
  misc_feature (71): n=a or c
cctcactcaccgcgagcccccaaaccgaaggacactgaccaatggtccccacagggaaaagtggcccacanggcagcgaccggatgaacgcgacgagaagg

SEQ ID NO: 56 - DNA, 101 bp, rice(Oryza sativa)
  misc_feature (71): n=t or c
gatgcagtggtaggacagtagcactccataatggtaaggtttttagctatagctcgttgtcggcacgcgantgattgatgattcagtcgcactaactgaac

SEQ ID NO: 57 - DNA, 101 bp, rice(Oryza sativa)
  misc_feature (71): n=a or g
cgcatcagaattggataggaagatatgtttgcacaaaattacgcagtgctccccacaaggaatctttaatncaggagatgatcatacacgaaaagaaaagg

SEQ ID NO: 58 - DNA, 101 bp, rice(Oryza sativa)
  misc_feature (71): n=a or c
gccccagtcatatttgatttttcggtatacgtacagctttttttgaaaactgtatacgtacagcttcgatnttttattctcctcgaatgcgcgtaggccag

SEQ ID NO: 59 - DNA, 101 bp, rice(Oryza sativa)
  misc_feature (71): n=t or c
cctcttactggaggtgcttcattagtaactggccacacaatacacaaatgatttcaaaacttgttttctcngtttgtttttttgttttgtttttgcgaaaa

SEQ ID NO: 60 - DNA, 101 bp, rice(Oryza sativa)
  misc_feature (71): n=a or g
atcattgccaggacactcggatttgacgttgtacatacatgatgcgcttccaaaattaagttacatcgaantgatgatctcaaccaaataatttttcttat

SEQ ID NO: 61 - DNA, 101 bp, rice(Oryza sativa)
  misc_feature (71): n=t or c
aaaaatgggcactgggaaactcttgaaactgcactctgcatgaaacacactaaactgaaatgtaaccttcnttttgttgccaagaccaaaaacagttaatt

SEQ ID NO: 62 - DNA, 101 bp, rice(Oryza sativa)
  misc_feature (71): n=a or c
attttagtgtcacattttgataaggttggaagcatttggtttgatgccttgctaataccttgtttcgttcntatttttttttctaaaaacgtcacgtcgaa

SEQ ID NO: 63 - DNA, 101 bp, rice(Oryza sativa)
  misc_feature (71): n=t or c
ccgttaatatatattttgagagaccatatcattgatagatacatgcatgcatcctactaattcgcccagancaacggccggtctcgagacgtactcgccgg

SEQ ID NO: 64 - DNA, 101 bp, rice(Oryza sativa)
  misc_feature (71): n=t or c
aaattttactttggcgtaccacatctgctatataagttggggtgatcatttggcgttcaaatatgggaagntgggcggcgtcgcggcggtgaccgaaaatg

SEQ ID NO: 65 - DNA, 101 bp, rice(Oryza sativa)
  misc_feature (71): n=t or c
gaatgctcaatttgctactcgatcagatgctgatgagctgactgattactaccgacgagtgagtatgaacngaattcaatgtggagaagaaggtgatatcg

SEQ ID NO: 66 - DNA, 101 bp, rice(Oryza sativa)
  misc_feature (71): n=t or c
ttaccagtaagaattttattcatgctttgccttttcattttgtgtgagatatctggcgaggtaactaaggntgcattcgttaccgggagttcccaactcac

SEQ ID NO: 67 - DNA, 101 bp, rice(Oryza sativa)
  misc_feature (71): n=t or g
cattctgaccaaagccaccagcttttcttcactcctcttgtagtctcccaatacaaatgcaggcccagtanttgtaccattgctgccacgccattggacgc

SEQ ID NO: 68 - DNA, 101 bp, rice(Oryza sativa)
  misc_feature (71): n=a or g
agttatgagatgggattaattaggatataaataggttggcctagctagtcaagtgtacataatttcaactnaataatactacctccgttttttaatagatg

SEQ ID NO: 69 - DNA, 101 bp, rice(Oryza sativa)
  misc_feature (71): n=a or g
cctagaggcgctgagctggatcattttgggcaggggcggtgggaacgctggcccacgagttgggaggtggnccccccgggtcaggcccacacgtgatgggt

SEQ ID NO: 70 - DNA, 101 bp, rice(Oryza sativa)
  misc_feature (71): n=a or g
ttttattttttgaatctgaatgaaatctgaattatttgaaggagccaaagattttcgaattgttgcggttntcggatactccttcaaacataaatataatc

SEQ ID NO: 71 - DNA, 101 bp, rice(Oryza sativa)
  misc_feature (71): n=t or g
caaacttagaaaatctcagcacctatctcagtctcaatgagggcagctagcaatattatgtggtgattttnatatatatatcagatgatgaaagatgactc

SEQ ID NO: 72 - DNA, 101 bp, rice(Oryza sativa)
  misc_feature (71): n=a or g
acgcagtttagcatggcagttgttccaccacaatctgcaatattatttgagtttactgaaccatatatagntggtgttgggattcagggactaaactttag

SEQ ID NO: 73 - DNA, 101 bp, rice(Oryza sativa)
  misc_feature (71): n=a or g
ctaaatgtgagcttggttagaggttttgcaggagacgggcggcgtggacaggtcatggcctttcatgttcnagggcatggccgccttcaggacgacgacga

SEQ ID NO: 74 - DNA, 101 bp, rice(Oryza sativa)
  misc_feature (71): n=t or c
aaacttgacataagtgctcggatttacgactaatattttttcagtagtaatcggcgtacgtactcgtcganagcgagacatatccatggtgacttcattaa

SEQ ID NO: 75 - DNA, 101 bp, rice(Oryza sativa)
  misc_feature (71): n=a or g
accaggcagaagcaggaaatgtcaggtatcaagcagtttcatcctcggatgatctggaggatgattggganctcttgtaaatcttcagaaagctccatatc

SEQ ID NO: 76 - DNA, 101 bp, rice(Oryza sativa)
  misc_feature (71): n=t or c
ttgtgaagctggaaattaaaattaaagttagtattatataaggaatataagttttgaaagttacactgcanagtagctacttcattcgtcgcaaaatataa

SEQ ID NO: 77 - DNA, 101 bp, rice(Oryza sativa)
  misc_feature (71): n=t or g
ctgcaaccgaacaggccgtatgtatatatagggtgtgttcgctggttctggttctcatctggaacagtgtncacgaaaaacagaacgattcattagcgcat

SEQ ID NO: 78 - DNA, 101 bp, rice(Oryza sativa)
  misc_feature (71): n=a or g
gatagataccttgagtaacgattgaagaatattcatgctgctcccgtttccatcatagcctgtgcacttcnccgtttacagtggagactagatttgtttag

SEQ ID NO: 79 - DNA, 101 bp, rice(Oryza sativa)
  misc_feature (71): n=t or c
caccgggcaaaacgagttaaaatcgaaccgtgcagtgtacgagcggtacgtgtggaagatcgagcatgcanctaggcaacgtttggaaaatggatctggga

SEQ ID NO: 80 - DNA, 101 bp, rice(Oryza sativa)
  misc_feature (71): n=t or c
tatgcttttaacaagtaaatcaggaattttcaacgggcatggaaattattacaagcgctctattgttatangtatgcgcgtgtgctcttgttatatactat

SEQ ID NO: 81 - DNA, 101 bp, rice(Oryza sativa)
  misc_feature (71): n=a or g
acctcacaggagatgagattaggagagtaattaatcagtagaggagagaaggcaacacgaggtagagccanaagcgtgctaagctaatccctcgccgaagc

SEQ ID NO: 82 - DNA, 101 bp, rice(Oryza sativa)
  misc_feature (71): n=a or g
ggcaatatgcaacgttgccctgcgctagagtgaagctcaaatagagaaaatttaccttgttttttcacgtncatatatacttttcgaacggttaaataatg

SEQ ID NO: 83 - DNA, 101 bp, rice(Oryza sativa)
  misc_feature (71): n=a or g
aacaggaaatattattttttttcacttcggtagtcgaatttcgaatttcaaattacttagattttcttctnaagcatctcattggctaaaaatatatagat

SEQ ID NO: 84 - DNA, 101 bp, rice(Oryza sativa)
  misc_feature (71): n=a or c
gttatatatccagtgtctgatgcatgcaccggggacgaggtagccgccgtgttttttttaataaattggtnatttttaaaaacttatttcgaaactagtcc

SEQ ID NO: 85 - DNA, 101 bp, rice(Oryza sativa)
  misc_feature (71): n=t or c
agaaatcttttcatgacaggcattcgggaagatttgagtgaatcctatgaagcttcagtgactaccagctntgcggaaagaaccgattcagctaacggaga

SEQ ID NO: 86 - DNA, 101 bp, rice(Oryza sativa)
  misc_feature (71): n=t or g
aatttgtttgtggttgggagttttgtcacaactgttgctgaatcccaaactagctaatgacattgtctatncttgatgtataaaatactttattcgtgcta

SEQ ID NO: 87 - DNA, 101 bp, rice(Oryza sativa)
  misc_feature (71): n=t or g
tgttactggtgttaatggatgcttgccggccggtagagctactagctagtactactactcctaggtgcggngaaaggctcgtcttttcaagcgagcgatcc

SEQ ID NO: 88 - DNA, 101 bp, rice(Oryza sativa)
  misc_feature (71): n=a or g
tgatcgtcgtgtcactctccactggagctagattactgctgacagcaaccggataggccaatttggctgcntgggcttcatgtcttgtccttctgctgtta

SEQ ID NO: 89 - DNA, 101 bp, rice(Oryza sativa)
  misc_feature (71): n=a or c
cgaggcgagaacgaatactaccttcaaaatttcgaatcgggccgcgaggtgggggcgccggtgggatgagncggccgcgtcgccgcccccggcgaacccgc

SEQ ID NO: 90 - DNA, 101 bp, rice(Oryza sativa)
  misc_feature (71): n=a or g
gatagtgtctaaaacgtcaagtagaagtattataatagcatcgactagctaggtaccacatcccatatacntacgtatcttcagaaattatgcacgcttac

SEQ ID NO: 91 - DNA, 101 bp, rice(Oryza sativa)
  misc_feature (71): n=a or g
cggaaatcttctcatttcacgtaatctagacgagaagttggattgtatgaagtagtttcgaattatgaganaaaatgtgtagctgccagaaactcccgccc

SEQ ID NO: 92 - DNA, 101 bp, rice(Oryza sativa)
  misc_feature (71): n=t or c
attaacatgcagcatacgaatctgatcggctcgaccagctgatgaatagtatcgtcagatcatatcaggcngtcgaagtactcctcgacggtgacgtactc

SEQ ID NO: 93 - DNA, 101 bp, rice(Oryza sativa)
  misc_feature (71): n=a or g
attaactcttgtcttcccctccgtcacgacgacaagactgtctctgtttgtatcttgttactccatccgtnctaaaattaaaaaaatctaaacacccaaaa

SEQ ID NO: 94 - DNA, 101 bp, rice(Oryza sativa)
  misc_feature (71): n=a or g
cagtgggttatcgagtgagccccatcgatcagaatgattatttgtggctgcaggtggggccggcattcggnggtttcttccattcgaaaccgaagaagctt

SEQ ID NO: 95 - DNA, 101 bp, rice(Oryza sativa)
  misc_feature (71): n=a or g
cttggcgacttcatgctttcaactcgaatttcacgcctcatctggtgatgttggagtagaacctttgcgcncattctagtcaaaattttgatcaattgttt

SEQ ID NO: 96 - DNA, 101 bp, rice(Oryza sativa)
  misc_feature (71): n=c or g
atgaccttgtgaacatctcttgattgatcaactctgtttctctgaagtttcgaagtttccatatgatcgangcaattaaagatagaattgtatcgagaacg

SEQ ID NO: 97 - DNA, 101 bp, rice(Oryza sativa)
  misc_feature (71): n=a or g
gtaataaaaagtggcccaaagtaaaaattactctttttcttttattttttcctcttcggtaagaattgccncgttgcaagagcactggtagtgtttagggt

SEQ ID NO: 98 - DNA, 101 bp, rice(Oryza sativa)
  misc_feature (71): n=a or c
cctgacgatgccgtggctgcggcaaatcctcttcaaaacgctggtgcaaacacctgcaaatcccccccccncccaaaagttcgttcagctgctgcgcggcc

SEQ ID NO: 99 - DNA, 101 bp, rice(Oryza sativa)
  misc_feature (71): n=a or g
ctacatataatacaatacatcatgaacagtaccttggcacaatacgttttactttttatactgtatctacngtaaataactgcaaaattaatattttatat

SEQ ID NO: 100 - DNA, 101 bp, rice(Oryza sativa)
  misc_feature (71): n=t or c
aaaattcatgtggtttatatattcttgtgttccgaatgcttcatagcatcaaattccttttcctatcctgngatccgaacaagccctaaattctgaggatc

SEQ ID NO: 101 - DNA, 101 bp, rice(Oryza sativa)
  misc_feature (71): n=t or c
ttgtttttttgaattcaccatcgtacttgccagttttatagagaggttttcttactcggcgctctttctgncacttgtatctcgcaacgtgtcgctcaact

SEQ ID NO: 102 - DNA, 101 bp, rice(Oryza sativa)
  misc_feature (71): n=t or g
ctgattcaaagtttgaaattcaagatagaaataatttcaacattaggctacgatcagttgagccactgttngcaacatgtagaaaaaccaacaaaatatta

SEQ ID NO: 103 - DNA, 101 bp, rice(Oryza sativa)
  misc_feature (71): n=t or c
tttgaagaagtaattaatataggccatcaaggggatgtaaagccctgtactgaattcaccgtgtatatggntgtacttaaaaataagactagtagtgtata

SEQ ID NO: 104 - DNA, 101 bp, rice(Oryza sativa)
  misc_feature (71): n=a or t
tcaaattcacgtgttcaccttattgtttcctcgaacacgtgtaaattgttctattttattggctttttttnaaaaaaaaagggctaaaacagctattacac

SEQ ID NO: 105 - DNA, 101 bp, rice(Oryza sativa)
  misc_feature (71): n=t or c
aagacaactattatggagcagagttaatatgatgcaaacacctagactggtacatctcataagaattattnagatgaaatcatcaaagcgtgaatgcccat

SEQ ID NO: 106 - DNA, 101 bp, rice(Oryza sativa)
  misc_feature (71): n=a or g
ggagagagatagaaagggaaccaacagatccgccgtttttttctctagatcggcggcgggggcaagagggnattacctcccggtctgcttgagcatgtcga

SEQ ID NO: 107 - DNA, 101 bp, rice(Oryza sativa)
  misc_feature (71): n=a or c
gggggagagccgcgaccggcgagtggggaactgcctcttggaactctctatctaataacaagaaaaacatnttaaaaacaagtaaaactagttgggtggcg

SEQ ID NO: 108 - DNA, 101 bp, rice(Oryza sativa)
  misc_feature (71): n=t or c
ttttgttttttttttaattttgacacattttagctggttttggttgctagtttgctaccgcttgtcgaagncgacaattagcgggacgagcttgtgagttg

SEQ ID NO: 109 - DNA, 101 bp, rice(Oryza sativa)
  misc_feature (71): n=a or g
ttcaattaattttggattatctctgtggatgcggactgatttcacagaggtggcggtgttgggaaggtgcngagtcggacggaggtaggggacgacactgt

SEQ ID NO: 110 - DNA, 101 bp, rice(Oryza sativa)
  misc_feature (71): n=a or c
ccacacgccactggttaggtacaaacaaaatcccgttgactcccatccccccaacattctcaccggcgacnccctcacgaccccgcttctaaatcccactg

SEQ ID NO: 111 - DNA, 101 bp, rice(Oryza sativa)
  misc_feature (71): n=t or g
cattctatacccctgaattctctaaaccagacgatttacccccttaatcacaattgccgctgcctttgcanagctcgtcgtggagcgaagcaatgagatct

SEQ ID NO: 112 - DNA, 101 bp, rice(Oryza sativa)
  misc_feature (71): n=a or c
tatgtcattttcctctctccttaaaccttctcttgatagccacaagaagaaacccatgaagaaaaaaaaancaaaaaaaaagaagcaatcaatttttttct

SEQ ID NO: 113 - DNA, 101 bp, rice(Oryza sativa)
  misc_feature (71): n=a or c
ggtggtgcgctcctcctccttgtcccccctccctcctctcgaaactcgaacgcctcgcctctccacacacnctctctctctctctcttgtaggaggagaag

SEQ ID NO: 114 - DNA, 101 bp, rice(Oryza sativa)
  misc_feature (71): n=a or g
ctccccgccaaaaaaaaaaactgggaagctactgcaatcagaatgaactggggagttaaagatctccaaanaaaagtgaggcaactgggaagttgaatgca

SEQ ID NO: 115 - DNA, 101 bp, rice(Oryza sativa)
  misc_feature (71): n=t or c
gtagcaagttcattattgtctcaccccataatttagagttcatcatggtcacgctggttcgaagatgcctngagcttctgttccaattcctgttacattag

SEQ ID NO: 116 - DNA, 101 bp, rice(Oryza sativa)
  misc_feature (71): n=a or g
ttgaatgccccaaggatggaggactcagcgccggcactgtaggcccattgcacaactaccgtatgctgaantctacgagggtgtttagatcaggggtgtaa

SEQ ID NO: 117 - DNA, 101 bp, rice(Oryza sativa)
  misc_feature (71): n=t or c
tctgcccttccttgctattttttttcctttttaagtagcctttttccttagtatcagtcttctcctttttnggttttttctttctttattctccaataatg

SEQ ID NO: 118 - DNA, 101 bp, rice(Oryza sativa)
  misc_feature (71): n=t or c
ccctccgcccgccgtgtggatcttcgtggacagcgtcatttccttggctcatctccgccaccatagacctncattgtatcctccgccagctacaccgtcaa

SEQ ID NO: 119 - DNA, 101 bp, rice(Oryza sativa)
  misc_feature (71): n=a or g
gtataatataaagttaaaaccgataactacccgtaaaaaaattggatagagtaacagagttttcactacanaagtaaacatatgctcactattttctctca

SEQ ID NO: 120 - DNA, 101 bp, rice(Oryza sativa)
  misc_feature (71): n=t or c
tccattacctcttgtttcggctaactgttttgtagggcaggggatttaggagcggtcgaggtccaataatngggagccatgcgttgtgcgtgcgaccaatc

SEQ ID NO: 121 - DNA, 101 bp, rice(Oryza sativa)
  misc_feature (71): n=a or g
tcagggtgacacgtactagctaacaaaaagctactacaggaaataaaatactctactaaaaagctaaagcntcacatgataaattatatgcttataaaaga

SEQ ID NO: 122 - DNA, 101 bp, rice(Oryza sativa)
  misc_feature (71): n=a or g
tactctagactactaactctacctttgttcctatctgggtcaccccataccacttattgagcacatcaacngtcttgagtacatggttagagaaaagagtc

SEQ ID NO: 123 - DNA, 101 bp, rice(Oryza sativa)
  misc_feature (71): n=t or g
cctgctcaaaaacttttagatttgtgactatcggattacctcaagatttatatatgatgaagaaaagaatngatagaaaaataatttcacacatgttacac

SEQ ID NO: 124 - DNA, 101 bp, rice(Oryza sativa)
  misc_feature (71): n=t or c
ataaaacatttaagagagcacgcacaaaatgttgagagaagttttgggtttttgacaaggggggcaaagcncgtcaatatggttaacttatattagctagg

SEQ ID NO: 125 - DNA, 101 bp, rice(Oryza sativa)
  misc_feature (71): n=a or g
cttgtaggttagcctttaaatccaagaacaaaggaagaacaccatataagtagggtattatgtctagtatngcccaaatgtgtataaccaacattggccta

SEQ ID NO: 126 - DNA, 101 bp, rice(Oryza sativa)
  misc_feature (71): n=a or g
aagatgagatcttttacctgtgacagaccatatctctaagcctcatctaaaatgagtttcagtttaacccnttagagatgaagtcattagtgataagtcag

SEQ ID NO: 127 - DNA, 101 bp, rice(Oryza sativa)
  misc_feature (71): n=t or g
aacaaaacggcatcgtactagcatgtgttaatctaaagttaatctcggatgggtcgttttcaatcagcagngcagatactgttctcatctcgcagttttct

SEQ ID NO: 128 - DNA, 101 bp, rice(Oryza sativa)
  misc_feature (71): n=t or c
gtggtagtcgtaaaagaaacttactatacgtgcgagactatttcttgcgtacagctacggcattctcatcnacctattgtatacgtgtacacagaattgct

SEQ ID NO: 129 - DNA, 101 bp, rice(Oryza sativa)
  misc_feature (71): n=a or g
acatacaaaagtgataatgcttagatatatgaacgtggaaatactctctcatggacaagattttccgatcnctagaaactaattatcggtttagtgtaatt

SEQ ID NO: 130 - DNA, 101 bp, rice(Oryza sativa)
  misc_feature (71): n=a or g
agagcctaggacttgatgttgctttcgcttggacttgcggcagctgattgagcctccgattggggagaagncaacatgtggtggcgttagctgcgagttcg

SEQ ID NO: 131 - DNA, 101 bp, rice(Oryza sativa)
  misc_feature (71): n=a or g
tcctctcctctccctctctttgtcttcctctcctctccacttttttctcaccgaccagtaaaagagaagcnccaggtgccacatggtgctgccgggagcgg

SEQ ID NO: 132 - DNA, 101 bp, rice(Oryza sativa)
  misc_feature (71): n=a or g
aaacttttagacccattaaagatggccctcattgtatcgcgaaccaagaccagcccgtggcaaattaatanacggcccgataagtgttgcggctggcgtgt

SEQ ID NO: 133 - DNA, 101 bp, rice(Oryza sativa)
  misc_feature (71): n=a or g
tggagcaggagtaacaggcgaaaaaggtttctgctctactccacggtagctgccatcaccgtgatggaaangaaaacaggggcagccgcgttgtttgacga

SEQ ID NO: 134 - DNA, 101 bp, rice(Oryza sativa)
  misc_feature (71): n=t or c
gacggccggggagaggggaggggagaggagaagaggtgagggacttagaaaaaatttaggcccgcctgttnatttatattaagtctattttcgcaggcgca

SEQ ID NO: 135 - DNA, 101 bp, rice(Oryza sativa)
  misc_feature (71): n=t or g
gtcgtttgcatatggataagggagggaaggagagaaataatttgtctcctgctctatgattagggtttgtnggagtaaagattatcttttgacctaataga

SEQ ID NO: 136 - DNA, 101 bp, rice(Oryza sativa)
  misc_feature (71): n=t or g
ttttctctcgtgttgctgttggttcggttgttttaatgtgttttgctcgatgatcttgtttgctcgtgttnctattagtcaatatactattacatgactat

SEQ ID NO: 137 - DNA, 101 bp, rice(Oryza sativa)
  misc_feature (71): n=a or c
agtggcagtggccagcccaccaaatttgccgcccgggcaaacacgccacaactctcccgcatgtgctcacntgtgaccaacggtggagctcaacgtcgctt

SEQ ID NO: 138 - DNA, 101 bp, rice(Oryza sativa)
  misc_feature (71): n=t or g
caaaacacggatataataatgctagctagggggtgattatcaatagaagaatgaatcatggccccaagagntacaaccatacttttgcataattgctgaat

SEQ ID NO: 139 - DNA, 101 bp, rice(Oryza sativa)
  misc_feature (71): n=a or c
cacctcaaatctcgccggttcctccacctccgttgcatcgatacctcgattcgcctccaccaccgcttccnttccctcccctctgcgcagccactctccct

SEQ ID NO: 140 - DNA, 101 bp, rice(Oryza sativa)
  misc_feature (71): n=a or g
cgaaatgacagggtcctcccctccgccaaatctagcaggaggggagacggtgactcaacagcagcctagcngcgggaggtggcatgcagcggcggaagggt

SEQ ID NO: 141 - DNA, 101 bp, rice(Oryza sativa)
  misc_feature (71): n=t or c
atacgtgatgtccacaaagcgagctaaattgcttccatgtgtacgtactatactagctaattaactactcncacggttttatcttacaagtcgttttgact

SEQ ID NO: 142 - DNA, 101 bp, rice(Oryza sativa)
  misc_feature (71): n=a or t
tgaccactgccaacacgtacgggaggatcttctattcagaaatgcaccatttggtactctctttttttttnaaaaaaaatagagttgcttttcatatcacg

SEQ ID NO: 143 - DNA, 101 bp, rice(Oryza sativa)
  misc_feature (71): n=a or g
aaaaaaagttgctctgttttttcttagtacgcaatagccctatatactgtagtatgtacaggacgctcatntcatggtgtggaccaatgttgacaacaatg

SEQ ID NO: 144 - DNA, 101 bp, rice(Oryza sativa)
  misc_feature (71): n=a or g
ataataacaccaacgttaagctagctctgtagtttcaaacatttatacgtaagtaaataactgttcgaganagttgtaggtgaagaatagtactgcaagtt

SEQ ID NO: 145 - DNA, 101 bp, rice(Oryza sativa)
  misc_feature (71): n=t or g
tttcaagcaccctcgtaactacttgctgctgacagtagtggcatgtcgattgtatgaatgtccctgcaaantttgtttcaaactatatattacggaagaat

SEQ ID NO: 146 - DNA, 101 bp, rice(Oryza sativa)
  misc_feature (71): n=a or c
aaatttcaataaaattttcaatacaagtacccttacagaagacatggctgttgcaaaaggacactcacctnaacaaaagcataaccaggaggtcttggagg

SEQ ID NO: 147 - DNA, 101 bp, rice(Oryza sativa)
  misc_feature (71): n=t or c
tgactgtgaatcttttatattcattcttgcatattgaaattgtgtgtttcttcaaattcacccaacgaggnactggtggagaaaccatctttcgtcggtcg

SEQ ID NO: 148 - DNA, 101 bp, rice(Oryza sativa)
  misc_feature (71): n=t or g
cgaaaatcaacagaaggcaaattcattttactagcagttttcggaaattctgaaaaaaatttcagaattanttttcggagctgctacagtactttcggaat

SEQ ID NO: 149 - DNA, 101 bp, rice(Oryza sativa)
  misc_feature (71): n=t or g
ttttctttataatttttcattatagtgttgtaagttcatcatgccccgtaaaagaagttcatcgtgcatantgacagttttttgaggcatttcgttttgaa

SEQ ID NO: 150 - DNA, 101 bp, rice(Oryza sativa)
  misc_feature (71): n=a or g
cagggacaatatattttcgagaccttgaacttgttctaggtatcatataggcctaaacgaattctaacccnctttatgtgctatcgtgcactggtggagaa

SEQ ID NO: 151 - DNA, 101 bp, rice(Oryza sativa)
  misc_feature (71): n=a or g
accaactttcagcactcaaaggtgcatatccacacctatcaaaatttgcgatccataaaggtatacgccanaatcaatctcaactatggccaaaggatgcc

SEQ ID NO: 152 - DNA, 101 bp, rice(Oryza sativa)
  misc_feature (71): n=t or c
gtgggtattatatctgctggttcttacatataatcgacacacatatatccttggtttgttggaaccatgcnactttaattttgtaaaatttgagatatgcc

SEQ ID NO: 153 - DNA, 101 bp, rice(Oryza sativa)
  misc_feature (71): n=t or c
cagggccctagttgaagacacatgatctcaacagcagaaaatgagtgaacttttggatgtcatgatggagnagtaacaaacggttcatcattgcattgcat

SEQ ID NO: 154 - DNA, 101 bp, rice(Oryza sativa)
  misc_feature (71): n=a or t
aggaagggagatgccaggagggacgcggcgagcatggacacaacagccatgcggaggagggtaagcacagngtcgtcaaggatggcgaggggaacaacgga

SEQ ID NO: 155 - DNA, 101 bp, rice(Oryza sativa)
  misc_feature (71): n=a or c
tttcccaattgatcagatcagccactcagcaaaacctgttggggcctgggttatttgaaggaaggaaaaanttaaggtgttaaatatctagttcaatagtt

SEQ ID NO: 156 - DNA, 101 bp, rice(Oryza sativa)
  misc_feature (71): n=t or g
tctctattacaatcactgtgttagaaacaaaatacaaccatgaatcaaaaaaataaaaggaacagaagaangtattaccatactccctccgtcccaaaata

SEQ ID NO: 157 - DNA, 101 bp, rice(Oryza sativa)
  misc_feature (71): n=a or g
atgaccagtttcggttgagctccagtagctgctcacttctcaaggaaaaatgagtgtacaggaaagcttcnaaagaagaaaaagtataataaaaaaattaa

SEQ ID NO: 158 - DNA, 101 bp, rice(Oryza sativa)
  misc_feature (71): n=t or c
ccgtgtattttttttttgtttttattgcttcctttttaagcaactcacctggaaattatagttttgaatgnacacaggtgaagggtttaggtattggcaaa

SEQ ID NO: 159 - DNA, 101 bp, rice(Oryza sativa)
  misc_feature (71): n=a or g
tatgatgggagaatggtagtagaaaaaaccttagacggcggaggttggcaccaaattgacttgccccgagncagtgataacatgtcgaacaaggatatatc

SEQ ID NO: 160 - DNA, 101 bp, rice(Oryza sativa)
  misc_feature (71): n=a or g
tcacatttcgtcgattccacgatgcacatcacatacacaaatttggggatgttcttccgacatgtgaagtnttcttccgacaaaatttgaaactatctgaa

SEQ ID NO: 161 - DNA, 101 bp, rice(Oryza sativa)
  misc_feature (71): n=t or c
aggcggggcaagggaagggaagggagcggagggagctatcacctggtgttgatccatcgggctttgcttcntcgcccactccgcttgagttcttccgctgc

SEQ ID NO: 162 - DNA, 101 bp, rice(Oryza sativa)
  misc_feature (71): n=t or c
acgccaagaacacatccaccaaatctttgacccccgggagagaccatgccaagaaccacactccccaacanggacagaacacagaagatgcccctcggcaa

SEQ ID NO: 163 - DNA, 101 bp, rice(Oryza sativa)
  misc_feature (71): n=t or c
tttttcttgcaacggcaacagcaaaagctcaccaaatcctcggcccacactcctctgcttcctccaccagngcaccttgttgcatgcgctagcctctacct

SEQ ID NO: 164 - DNA, 101 bp, rice(Oryza sativa)
  misc_feature (71): n=a or g
atccaaacaccctctaagatcacttgtgcgtgcaaaaacgctgattgcggccagtcacacgcgccctatcncgcgcgattggacacgtgtcacgtgcggag

SEQ ID NO: 165 - DNA, 101 bp, rice(Oryza sativa)
  misc_feature (71): n=t or g
gccaatatattactcctgacgtatactttttggactcctgtatgggatatacgagactgagcatcttggcntatacacgtacaggcgtatatagctgatag

SEQ ID NO: 166 - DNA, 101 bp, rice(Oryza sativa)
  misc_feature (71): n=t or g
cccccttcaatcgaattcaccctcgaattcacccaaccataatctagaacactgggtattacaactcaagngcacggatggctgtggcagaggggctgcgt

SEQ ID NO: 167 - DNA, 101 bp, rice(Oryza sativa)
  misc_feature (71): n=t or c
cacatacctgaaagaagctgtagcttatgctcagcttgtggttgctgtggtgagctgtgctgctctgtgcntactttttaagttgcagtgaaaaatagaac

SEQ ID NO: 168 - DNA, 101 bp, rice(Oryza sativa)
  misc_feature (71): n=a or c
agctgcattgcatgcacacacatgccgtcagtgccgctgctagtgctgcctgcaggctggagcttaagagnaagtttaatagccagctactagcttcaaat

SEQ ID NO: 169 - DNA, 101 bp, rice(Oryza sativa)
  misc_feature (71): n=a or g
caacagaggaaatcctactttcttacccatcccaatcaaccccacttctccactcacctagacaccacacngagcgccacctcttggcattgcctgacgag

SEQ ID NO: 170 - DNA, 101 bp, rice(Oryza sativa)
  misc_feature (71): n=a or g
ggtaattcaagatcaaatttaacttcatttgaccaaaaccaaacggacgtgaacccaggattatcttcatngacacagtttttctgataccagcaatgttc

SEQ ID NO: 171 - DNA, 101 bp, rice(Oryza sativa)
  misc_feature (71): n=a or g
gtgattaagggcaactttgtcatttatgttttttcttgggctagatcgatacatggttatccattgtactngcatcgctcatattccattagaaaagtcaa

SEQ ID NO: 172 - DNA, 101 bp, rice(Oryza sativa)
  misc_feature (71): n=a or g
caacgcaaccccggagccatattgctgtttgggttgaagtatccggaaacgcatgccatttccaatcacangagtgatcatgccgagacagaaaacagcta

SEQ ID NO: 173 - DNA, 101 bp, rice(Oryza sativa)
  misc_feature (71): n=a or g
gtgtgggtgaagaccccgtattaattcactaccattacaatcactaatatacaggctctaaactcctattncttacacacatcagtgtttataaatgatag

SEQ ID NO: 174 - DNA, 101 bp, rice(Oryza sativa)
  misc_feature (71): n=t or c
ccatccgtctcgcacacctccctccctttgtcgcacatcagcgctccgctccaccccactagagaccggangaaaccccgtacgtcatacccctgcagcca

SEQ ID NO: 175 - DNA, 101 bp, rice(Oryza sativa)
  misc_feature (71): n=t or c
tcaagccaggtgtatttccttgcatagcattcaaagctcttgcgatctgaccaatggttattggttttgcnatggaactttccctcaaattcatatattgc

SEQ ID NO: 176 - DNA, 101 bp, rice(Oryza sativa)
  misc_feature (71): n=t or c
atactgcgcggctgtgaagatcacagcggatggccttctggctgccatggcgaccaacctgggagtggagncggaggtgatcgcagagagatgggtgggtg

SEQ ID NO: 177 - DNA, 101 bp, rice(Oryza sativa)
  misc_feature (71): n=t or g
tctatctgctgatggaccgttttgatcactgaaagtaagagaataagctacatccttatgcagggatgttnaatccaatcagagcatcagagttatttctt

SEQ ID NO: 178 - DNA, 101 bp, rice(Oryza sativa)
  misc_feature (71): n=a or t
tggacaaacccgggacaggttaattaggaagcacgtaagggtatgaataatataatgccaatggtgtgatntatatcggcatacgtataaggagaatattg

SEQ ID NO: 179 - DNA, 101 bp, rice(Oryza sativa)
  misc_feature (71): n=a or g
aactaagtgtggctcgttttcagtattcctttcgttgaatagctaacttttcaatctctgtgaccgtttgntttattgtctgaaaccatgttcctgagtcg

SEQ ID NO: 180 - DNA, 101 bp, rice(Oryza sativa)
  misc_feature (71): n=a or g
tgttttgaggcccctgtcccctacacgagggcccgccttccataggtcgattcttaatacatgtttttatnaggggccaaggagtaacttttttaactagg

SEQ ID NO: 181 - DNA, 101 bp, rice(Oryza sativa)
  misc_feature (71): n=a or g
tactattttactcagcaagcaaaagatggtaaacccagttcaaacactcaaatgtggcgtaaacatacctntatcagccaaagatgaaccaaaatggagat

SEQ ID NO: 182 - DNA, 101 bp, rice(Oryza sativa)
  misc_feature (71): n=t or g
ctgaacggtttggaagttggaacagatatcttcatatataatcaacgggtgagacgacggttgggttgggntgggtcagagaaaatgcaggcatcgccata

SEQ ID NO: 183 - DNA, 101 bp, rice(Oryza sativa)
  misc_feature (71): n=t or c
tgatatggctcttttccataaagtccaaacaaatggctcttttctagtcacaactaaatccaaacaatggntcttttgcagctaataatccagaaaaaata

SEQ ID NO: 184 - DNA, 101 bp, rice(Oryza sativa)
  misc_feature (71): n=a or g
gttgttgcagattgtggaaaattctatcaaatatgagcatgctatgtcaccaaaccgacccatatatctcntcggggactcatttggaggatgcctagcac

SEQ ID NO: 185 - DNA, 101 bp, rice(Oryza sativa)
  misc_feature (71): n=a or c
tccgcctggcttataagttggcttccccgtttaatgttcaaacatgaggcaactttactcatgaaatcatntgttttctctgcctcgtcagtatttaacgg

SEQ ID NO: 186 - DNA, 101 bp, rice(Oryza sativa)
  misc_feature (71): n=t or c
aaatcccatgcaatacaatgaagtctgcctcaactagtccagcatctcccctgaagcaagcagatgaccancatgtgcatatagattctgatatggaaaat

SEQ ID NO: 187 - DNA, 101 bp, rice(Oryza sativa)
  misc_feature (71): n=t or c
tgcgattgaaacaatcctcctttgaacgatattataaagggatgggtatctattctgaaaggaataatttnctacccatttgtcttcctagaatcttagtt

SEQ ID NO: 188 - DNA, 101 bp, rice(Oryza sativa)
  misc_feature (71): n=t or g
atacatacatatgaaaaattactgaaaaaaacagctggagaaattcagttacgtttcgctcgacgtgctcngggctgttctgctcgccggcgaggaagtcg

SEQ ID NO: 189 - DNA, 101 bp, rice(Oryza sativa)
  misc_feature (71): n=a or g
acttgtgacttcgggaacgttctagtgttgtttccaattaaacacattttgtacatgttggcggtatgtcntgagacccttcgaccggtcctgctgaaacc

SEQ ID NO: 190 - DNA, 101 bp, rice(Oryza sativa)
  misc_feature (71): n=t or c
cagggaggccgtggctgctagatctagtgagcatggtcatcccttcacaggaaagggaaggggaagtgganggtgctcactattataaattggcataacgc

SEQ ID NO: 191 - DNA, 101 bp, rice(Oryza sativa)
  misc_feature (71): n=a or t
agagaagcagacagggataggcagcggagacaccattctaaggacagaagttcaggtattgccattgattnttctgctttggctctttttataagcatgtt

SEQ ID NO: 192 - DNA, 101 bp, rice(Oryza sativa)
  misc_feature (71): n=t or c
agaggagaggggaggcgacgagagatggattctcgaagggttggaggctttggggcggtggttgcgtcttngttggctacggtagtttgggtacacctggc

SEQ ID NO: 193 - DNA, 101 bp, rice(Oryza sativa)
  misc_feature (71): n=a or c
ccgtgaagaaggcgtgaacaccgtccagccagtgcagcttccgcttgtttagttgcttcaacacatgtctntcttcttccgttaggtcttcaactcgttgt

SEQ ID NO: 194 - DNA, 101 bp, rice(Oryza sativa)
  misc_feature (71): n=t or g
atactggtgacttgtgaccgaaattatcctgtgaatgttttactatataagtgtatactatgtgctgtagngctgctgtgttatgttatcgatacctgtct

SEQ ID NO: 195 - DNA, 101 bp, rice(Oryza sativa)
  misc_feature (71): n=a or g
tcgccgccgagatcgatctcgatctcctcggcatcgtcgagtcagtcttcgcgtcgtccagtcaagcacangaacaacatgccgtcggtttaccgtcgatg

SEQ ID NO: 196 - DNA, 101 bp, rice(Oryza sativa)
  misc_feature (71): n=t or g
ttataaaaaatataaaaataaggtcaactccacctcccccctgatgtgctatccaatcatatattgtttancaaacatgcaaaactacattagatatataa

SEQ ID NO: 197 - DNA, 101 bp, rice(Oryza sativa)
  misc_feature (71): n=t or c
ctctgctcatctttatagagcagcttcttccaagacttatgaggcttggcatgccctaggatgaagtcccnagcagtgaggccgggcagaaatccctcagc

SEQ ID NO: 198 - DNA, 101 bp, rice(Oryza sativa)
  misc_feature (71): n=a or g
aggtcacggatcctgtgattcgacagaagctgcgtgagaagatcacccagaaggttatcccattgtaccgnatgtacttggagagctactcggacaagaag

SEQ ID NO: 199 - DNA, 101 bp, rice(Oryza sativa)
  misc_feature (71): n=a or c
ttttaatagtatatatatggacctgcacaccaggaagggagagatgtttttttggcgaaaatgggggatgnaatttctcaatgattgtaccctttcttgat

SEQ ID NO: 200 - DNA, 101 bp, rice(Oryza sativa)
  misc_feature (71): n=a or g
atttgcgtgagtttgagcaattgtgcttatgcctgacaataacggacatgacataagaaaccttaaagtgnaaattgtttcacttctctcttacagagggg

SEQ ID NO: 201 - DNA, 101 bp, rice(Oryza sativa)
  misc_feature (71): n=a or g
tttacctatatatttaaaatatgtagtgtttttgttgtttgtcgttgtctagcatacatcaacggttttcntgttcctgcattgtcgccataacagcacgt

SEQ ID NO: 202 - DNA, 101 bp, rice(Oryza sativa)
  misc_feature (71): n=t or g
gtcttcattgcgagagtgtgaaatccctttgtgggtttctcttgtaaagtttccgttcgcccacaagatgnggtgtttattctttgttccatctaaatcag

SEQ ID NO: 203 - DNA, 101 bp, rice(Oryza sativa)
  misc_feature (71): n=t or c
aaattcttgttccacctctattccagcccttacctcttagaccaccatgacttgggcctaggggtgaaaanggagcggatattatccgatccgatccactc

SEQ ID NO: 204 - DNA, 101 bp, rice(Oryza sativa)
  misc_feature (71): n=t or c
gtcgtgaccattcatgcatggaattcagatcaactgagcaagtgtggtcagctgttcagcagtaccgatcngcatccactgcagtttttttctacctacat

SEQ ID NO: 205 - DNA, 101 bp, rice(Oryza sativa)
  misc_feature (71): n=a or g
gctatgcatgcaaccaagcattggctgctgctcggttagggacatcaggcggtcggtcttacctggccatntggtgacaccgtctgctgccgagcggcaac

SEQ ID NO: 206 - DNA, 101 bp, rice(Oryza sativa)
  misc_feature (71): n=t or c
catatgatgggtagattttttctaattgtaattaacattcaacaaatatccatgctcagtatgttagattngtgtggtccataatattgtagttaaggatt

SEQ ID NO: 207 - DNA, 101 bp, rice(Oryza sativa)
  misc_feature (71): n=a or g
aaataaattataattgatgggtatctagctagttctattagaaaactgcaactcaactggaaatgagatcntttagcaagttggtctcaaacagggccaac

SEQ ID NO: 208 - DNA, 101 bp, rice(Oryza sativa)
  misc_feature (71): n=t or c
tacgagcaaatggaaccagctcccagaaacaccacaacaggtaaaatttcattaattttttcagggttagnctgatcataattttcagtataacgctctca

SEQ ID NO: 209 - DNA, 101 bp, rice(Oryza sativa)
  misc_feature (71): n=t or c
acaaggactctaagcaagaaatcgaagtagttcactcaatgtatcactacttttgactggtgagtctctangatcatctctgtacattatacaatcatata

SEQ ID NO: 210 - DNA, 101 bp, rice(Oryza sativa)
  misc_feature (71): n=t or c
agagaagaaatcaagagtttaggggtggaagaacaggaaaaaaactcgagaggaagaagcagtagagagangagtttggggatagtttgatagttcataat

SEQ ID NO: 211 - DNA, 101 bp, rice(Oryza sativa)
  misc_feature (71): n=t or c
atgtcttgtgtgtatatatatacgtgcagcgatggcattctattttttacacactccagtttcatatctcnatgccgttacaccgctggacgtcgaccgta

SEQ ID NO: 212 - DNA, 101 bp, rice(Oryza sativa)
  misc_feature (71): n=a or g
cgaagtagatcctttgaagtccactccactatctttccagtttttgatctgcctttagtgaagaaaaaggncaatgatattccatacagtcaaaagtgata

SEQ ID NO: 213 - DNA, 101 bp, rice(Oryza sativa)
  misc_feature (71): n=a or g
aatttcttgagtaatattcagacgttacaggtactcttgttcgcatatatgcatttagtatctatacacanaatacagaaacttcttttgcattttggagg

SEQ ID NO: 214 - DNA, 101 bp, rice(Oryza sativa)
  misc_feature (71): n=t or c
atgacaaaccagcaaatgaaatgtttatcataatgttggtgagtagaaatgtgtcatggtacttgcattgntgaccaaaatgtgtagttgatatgtgcctg

SEQ ID NO: 215 - DNA, 101 bp, rice(Oryza sativa)
  misc_feature (71): n=t or c
cctattttcactccatagaagaatggagtgaaaacaacaacctcatgagtgtcaggagttaggaaggcctngtcgcacgctggacgtcatccgatgatctc

SEQ ID NO: 216 - DNA, 101 bp, rice(Oryza sativa)
  misc_feature (71): n=a or c
agttgctatattttagggacagaggtaatagctagcagggtggcactattcaacctttagcatttgacggngatgctatgcactacagcagatgccaatgg

SEQ ID NO: 217 - DNA, 101 bp, rice(Oryza sativa)
  misc_feature (71): n=t or c
ttctcgataaaaaatatttctttattaatttaattgatttgcctttctatattcctaggctccagaggctntgcaattttcttcagtttgtcacaatctca

SEQ ID NO: 218 - DNA, 101 bp, rice(Oryza sativa)
  misc_feature (71): n=t or c
ggtattgcgtagttcatgtcaagggtaagaaacctgaaactacaaaatacacctgatcaaaggcctctcangagtgctgtggaatcaaggtagttagtgga

SEQ ID NO: 219 - DNA, 101 bp, rice(Oryza sativa)
  misc_feature (71): n=t or g
ccgcactgtaacaattcatctagagagtatttggcacacatgacggaccaattgactacctcaacatgtancaatttgcgtggttagacttggtcaaaacc

SEQ ID NO: 220 - DNA, 101 bp, rice(Oryza sativa)
  misc_feature (71): n=t or c
ttgctacttgctagagaagagttgtataaatggggtttggcaagggctaagggcattcttgcccttgtgcngaacactgaatagtgtttgcttgtagtagg

SEQ ID NO: 221 - DNA, 101 bp, rice(Oryza sativa)
  misc_feature (71): n=a or g
aaaatgagaaagtgagagttgagaagaccttgacccgagcacaaaattgagtagaatatacgataatattncctacatgggcatattaatatttgttccat

SEQ ID NO: 222 - DNA, 101 bp, rice(Oryza sativa)
  misc_feature (71): n=t or g
acgcgggcaacataactgactgcatgagaaacttgcaattttataaattgaatagaaaaaatgcccatacnttacaacgggtaaaaatatttttggatcac

SEQ ID NO: 223 - DNA, 101 bp, rice(Oryza sativa)
  misc_feature (71): n=t or c
aaaagtatgccgaatctaattcgtacccttatcagaaaatcaagtaggatggctcccataactattgaaancggtgtaatttaaccctctcagcggttttg

SEQ ID NO: 224 - DNA, 101 bp, rice(Oryza sativa)
  misc_feature (71): n=a or g
gagagcgactccacagtagtgtaggccagataaagaagagcattcttatagaattcagcgaattcttggcnagccttatggtactgagatgatatccaata

SEQ ID NO: 225 - DNA, 101 bp, rice(Oryza sativa)
  misc_feature (71): n=t or c
ctttacccgatcatgaaaattgcagggattcctatttcgcgtgcacactggctacggaagtaacgcgcagncacgcccccctcgacgccctgcgcggttag

SEQ ID NO: 226 - DNA, 101 bp, rice(Oryza sativa)
  misc_feature (71): n=a or g
tagcattgttatctttgtccatgaaaaaattatgttcccacctctgtagggtagagccttagttattaatnagcctatggtattgagtagaatttaggatt

SEQ ID NO: 227 - DNA, 101 bp, rice(Oryza sativa)
  misc_feature (71): n=t or g
tttttgtgtcggcactccaccaccatcaccgggatcgaagtccaagcgggtggtgactgactggtaaacgngttaggtacttggaggacccgctacacagt

SEQ ID NO: 228 - DNA, 101 bp, rice(Oryza sativa)
  misc_feature (71): n=a or g
tggcaacgcttatagcatgtttataccatcttattatacttacttgctctaatggtggcaacgtcgaactnggttgctggtgaatatggtgagaatctcaa

SEQ ID NO: 229 - DNA, 101 bp, rice(Oryza sativa)
  misc_feature (71): n=t or c
caggaggtcgtggcttgttaactcgtactgctcgtgataaattcggttcggtttggctcgtttaatttttntaacgacctgagctgttattttagctcgtt

SEQ ID NO: 230 - DNA, 101 bp, rice(Oryza sativa)
  misc_feature (71): n=a or c
ttttttatgaaacaaagtgttttttattatacgaaggacatagttgtaatgggtagttacaggttaaaacncatatgcttgttcacaaccatacctagccc

SEQ ID NO: 231 - DNA, 101 bp, rice(Oryza sativa)
  misc_feature (71): n=a or g
caactgtgttggaaggtaaatgtagctcaagtaaaggatattcctgacatgttccaggcttggattatttnttaactcccagtcgagctggtcatgtattc

SEQ ID NO: 232 - DNA, 101 bp, rice(Oryza sativa)
  misc_feature (71): n=a or g
ttgccttttccatcggatgtctgtgacatagagagaagaagaaaccagagcaaaagggtataattaatctncctgtgatcgaaatgccgttttgaccccat

SEQ ID NO: 233 - DNA, 101 bp, rice(Oryza sativa)
  misc_feature (71): n=a or g
atgatgattttttacagctaaaagatgaactagataatctctctctgaatgatgtgattggagataattgntctttcatctgtaataattcagtctactca

SEQ ID NO: 234 - DNA, 101 bp, rice(Oryza sativa)
  misc_feature (71): n=t or c
aataattaaaacggttctgttttgattataacctatccagaccagatgtcctgctctggtccttgtgcggntgctagatactatagtatttcgagctgaga

SEQ ID NO: 235 - DNA, 101 bp, rice(Oryza sativa)
  misc_feature (71): n=c or g
tcctcccctctgcctcctctcgctccccacaagcttcatcctcgtttctcctccttactgattttactctntgtgttgtgtgtgtgtgtgtgtttgttgtg

SEQ ID NO: 236 - DNA, 101 bp, rice(Oryza sativa)
  misc_feature (71): n=t or c
caacggaaaggatggagaggggataccgacaagtggtgggcggcatccctcatcgtcgatctagtgggccnggtaagatgcggaggcagtgctgcatagcg

SEQ ID NO: 237 - DNA, 101 bp, rice(Oryza sativa)
  misc_feature (71): n=a or g
attcaaattttgtttgaatattttgttcaaaattgttaaaataattccggaatttgtgaaatatttccgtnccccttgaaaatttcccctttttaaatact

SEQ ID NO: 238 - DNA, 101 bp, rice(Oryza sativa)
  misc_feature (71): n=a or c
aacgttaccaggggtacttttgtctttctcaaatttactgacaagctaacaggaggatctgttagaaaatntaacggtaggggtatagaagggatcaaagc

SEQ ID NO: 239 - DNA, 101 bp, rice(Oryza sativa)
  misc_feature (71): n=t or c
aaatattgcactcaaataaaatagaagatctttattttggaattcacatataaactccctccaaatataancccatctatcaattctactcaatctgggcc

SEQ ID NO: 240 - DNA, 101 bp, rice(Oryza sativa)
  misc_feature (71): n=a or c
atacaccttaaataccctaataaagcatatcaaaacaataagcacacccattaaaggtagctctctctctntctatctatctctctctcatgtggaacaat

SEQ ID NO: 241 - DNA, 101 bp, rice(Oryza sativa)
  misc_feature (71): n=a or t
agttctatttcacaagtaccggtgaagaagtagaaatttcattcacatcaacgtaccaaaattttctaacnttgcaaatcccataaacaaatagaaattta

SEQ ID NO: 242 - DNA, 101 bp, rice(Oryza sativa)
  misc_feature (71): n=a or g
tcttccagtagatttctcattttaaatgcttcctcaaggtaattatcctgcacaacagagaatataagatnaactactaagtgggacttattttacacaga

SEQ ID NO: 243 - DNA, 101 bp, rice(Oryza sativa)
  misc_feature (71): n=a or g
agcatataaaatcaattatcttgcaccatattttatcattgtggtacagtattcacgcagcaatgcacagngttttcatctaatgttataggaaatgaaat

SEQ ID NO: 244 - DNA, 101 bp, rice(Oryza sativa)
  misc_feature (71): n=a or t
tggatgtgatgagatgtcattatttggtttgttacagcaaatggtgaaatgggatggttgcttgcaggagntgttggtccccatcggttgcccacttctta

SEQ ID NO: 245 - DNA, 101 bp, rice(Oryza sativa)
  misc_feature (71): n=t or c
cattttcacccgttctattgtcatatagccacgttttggttacaatgcacgtgcacgtaccctttttaaangtttccaaagctctcggccgattgcattct

SEQ ID NO: 246 - DNA, 101 bp, rice(Oryza sativa)
  misc_feature (71): n=t or c
agagtcaacatctgggttgaaacaacgaaatcttgtaaagaacgagtatgaggagagcccagtacccaatnttcttgacgaatctatggagaaggaggtag

SEQ ID NO: 247 - DNA, 101 bp, rice(Oryza sativa)
  misc_feature (71): n=a or g
catgtacacactcataatacgcacgcactcatctctatgaaccccaataaatgcacacaagcacaccctantcctatgaacacctccgaatgactaggccg

SEQ ID NO: 248 - DNA, 101 bp, rice(Oryza sativa)
  misc_feature (71): n=a or g
atcgcgtcagaccacctatatcctaaatcccagatccgccactagtcgatcgccacttttttggtggtccngggaccacccggaccaccctttacatccgc

SEQ ID NO: 249 - DNA, 101 bp, rice(Oryza sativa)
  misc_feature (71): n=a or c
tgccgacttatttattttattaagtcaggatggtcatatgttttgataatgttggtcttggactgaaaatnaataaatctaggtcttgtattgtatttctt

SEQ ID NO: 250 - DNA, 101 bp, rice(Oryza sativa)
  misc_feature (71): n=t or c
tcctttcacaacctaagtaggttggcaagattaaaaaaaatttgggatttctccttgtaggatggagtccntgaacttgaagaggatcaatggaattgcaa

SEQ ID NO: 251 - DNA, 101 bp, rice(Oryza sativa)
  misc_feature (71): n=a or g
gctgtatctcaacatgagctaatgagcagcacttccatcttcaaattagcagagattgcaattgaagcttntaaaagcagattaccaattaatcacagcac

SEQ ID NO: 252 - DNA, 101 bp, rice(Oryza sativa)
  misc_feature (71): n=a or c
acttgatcacgatagtaagcccttcataaatgattaatttttaagttctgtcggagtacctctgaaatctnttttgttctgaaactagaatttgactagtt

SEQ ID NO: 253 - DNA, 101 bp, rice(Oryza sativa)
  misc_feature (71): n=a or t
gttgaattgttgcaacactgtatttgagttgtttcttgaagaaactattttttcctgcttgtttttttttnaaaaaaatattgcattacatcaatctcttg

SEQ ID NO: 254 - DNA, 101 bp, rice(Oryza sativa)
  misc_feature (71): n=t or c
atgcataggatatccgttgaatatgtacttcagctcctgctggccaagatattaatggggctctttttttnttttctggaagatcctttgattcatctcag

SEQ ID NO: 255 - DNA, 101 bp, rice(Oryza sativa)
  misc_feature (71): n=t or c
taaatatctctagcaagatatggcaatgaaagtatagatgcatattctagacttcggtccttttggccttntatatattcatcaatcgtcatggtctgatt

SEQ ID NO: 256 - DNA, 101 bp, rice(Oryza sativa)
  misc_feature (71): n=a or g
tggctccattattgcctcaacataatattgttccttgatccatgagtcaccatcatgtagacataatgagngggacacgcatggaatactctttgattata

SEQ ID NO: 257 - DNA, 101 bp, rice(Oryza sativa)
  misc_feature (71): n=t or c
tatgcatgtataatgtttctcatcatcattctttcattcctcaattaattctcatgcacaagcgagatgtngaccctgacatgtgagaaggacaagatcat

SEQ ID NO: 258 - DNA, 101 bp, rice(Oryza sativa)
  misc_feature (71): n=t or g
ttctcttgttcaccagctgcagaacgcagccctactttaaggctattggtttgcagtttgctttatatttntttgtcagtcttttctcttattctgtagat

SEQ ID NO: 259 - DNA, 101 bp, rice(Oryza sativa)
  misc_feature (71): n=t or c
tggcgctcgacaaaccctgatctaggttgccatgatgatcatccaagccctcaccaattggatccaagttntcgccttggtttatcccgtcagcccccgaa

SEQ ID NO: 260 - DNA, 101 bp, rice(Oryza sativa)
  misc_feature (71): n=a or g
tagtgttaactgcacaaaacaccaaactcaatatacactttctctgatgttgctgtaaagaaatgcaatgngaacttacttgtatgcctgtttgcagtctt

SEQ ID NO: 261 - DNA, 101 bp, rice(Oryza sativa)
  misc_feature (71): n=a or g
ttgtttttacgtgccttgaaacatgaaaggaacaatttgctaaggcgctgaataagatggattggcaaatnttcaatggaactcagagtcagaggtagaac

SEQ ID NO: 262 - DNA, 101 bp, rice(Oryza sativa)
  misc_feature (71): n=t or c
cgctgaacttggcaagcgctacattctgcttgacgaaggtcacaccggcctcgtccaacacggtggccganggtattaattatttgcatattcatcgcctg

SEQ ID NO: 263 - DNA, 101 bp, rice(Oryza sativa)
  misc_feature (71): n=a or t
taacctaccatttatcctcaaaccaaacccaccctaaacttaaattaatagattcacaaaatgttgattanataaatattaagaagtatgtttatggaaaa

SEQ ID NO: 264 - DNA, 101 bp, rice(Oryza sativa)
  misc_feature (71): n=a or t
cttaggagtccaagcttattagtataaccgaaatacacaattgatcacgaatgatccggtgatgacacagnggcacaattgatcacgaatgatcgcttcag

SEQ ID NO: 265 - DNA, 101 bp, rice(Oryza sativa)
  misc_feature (71): n=a or g
tcggggacatcttgcgcccagcagcctcatcggtgtagaactggagcattgtgctggcaccgcctccaccngtgccactgctggtggttctacgcctgcgc

SEQ ID NO: 266 - DNA, 101 bp, rice(Oryza sativa)
  misc_feature (71): n=t or g
catcataattacgctggccagtacgaatgtttagcttcttctagctgctgatgtacagtgtcaagctagcntagctactgtagcagagggccggcagcatc

SEQ ID NO: 267 - DNA, 101 bp, rice(Oryza sativa)
  misc_feature (71): n=a or g
atttttatcaattaattgttatgctctttaagctacctagatgttgacaaagtgtatgaaggaccgcagcncattttcttgtgttctgtttgattgatcat

SEQ ID NO: 268 - DNA, 101 bp, rice(Oryza sativa)
  misc_feature (71): n=a or g
acgctgtttacttagttgatgctattgagggtgggaaagaacttattgaagcttgcaaaccagcacttgantcagaatatgtcaccaaagttattcatgac

SEQ ID NO: 269 - DNA, 101 bp, rice(Oryza sativa)
  misc_feature (71): n=t or c
agaaaggaatgcctagaagctgcgaataccctttattttaactagtgtatccaagtcgatctctgtagcgnccgttccgtcgtggcgcctaacgggaaaat

SEQ ID NO: 270 - DNA, 101 bp, rice(Oryza sativa)
  misc_feature (71): n=a or g
aggatgatgggtgtagactaactaggaagtctcgagttcaaatcctatacaacacacagatgcatctttcntgtagaaaaaagatggtgtggggagttcaa

SEQ ID NO: 271 - DNA, 101 bp, rice(Oryza sativa)
  misc_feature (71): n=a or g
ttcttctgcacagaggattaaattaaacacagttagaatcgattcatcgtaacacaagaatgcgctatgcngaacccgcaaaataaaacaaaacggatact

SEQ ID NO: 272 - DNA, 101 bp, rice(Oryza sativa)
  misc_feature (71): n=t or g
gatctcacctctttgctcttgtttgaaatcatgaagaactcatcactaatctgctcaaaatcttttttgcngctacttcagatcgacccgcgccaccgcta

SEQ ID NO: 273 - DNA, 101 bp, rice(Oryza sativa)
  misc_feature (71): n=t or g
tgtttgtttcttggcttttgtgagttattatcagtgtactttggttgtgtggaaaatacctattagaaaanattgcctctgatagatttctgatttttttt

SEQ ID NO: 274 - DNA, 101 bp, rice(Oryza sativa)
  misc_feature (71): n=t or c
cataatgataatcattgagaaataggtactccctctgtcgaagaaaaacccaacctattataaaatgaganataatctagtacaatgaatctgaataggag

SEQ ID NO: 275 - DNA, 101 bp, rice(Oryza sativa)
  misc_feature (71): n=t or c
taaaaatatgtacaatatctacttccttgtttattctcaatgatataaacaatttccaatgacctcacganaagataattgagctattgccaccaaattat

SEQ ID NO: 276 - DNA, 101 bp, rice(Oryza sativa)
  misc_feature (71): n=a or g
ttccctctagcacggcactgaagccgcgacgtggagacattacagcccgcatatgctgcagatgtgtcgcntcccaaatcgaccttaaaatacatcctcta

SEQ ID NO: 277 - DNA, 101 bp, rice(Oryza sativa)
  misc_feature (71): n=t or c
tttagatccctctatttgttgcccagtctaattttcgtcctgaaccacaaaaccggatatcggatatgacnctcccccaacttacgaaaaccaggcaaacg

SEQ ID NO: 278 - DNA, 101 bp, rice(Oryza sativa)
  misc_feature (71): n=t or g
cctagctctttatttgtttatttattttgcaaaacaccaagctagctttttatctaccttataagagcaantataatagtatattataagctagctaaatg

SEQ ID NO: 279 - DNA, 101 bp, rice(Oryza sativa)
  misc_feature (71): n=a or g
gccgtaccccgggccgtacaggtacggcgactacctggactactaccagggcaccaagttcggcgacaagnccgctaggttccaggccgtcaagaagctct

SEQ ID NO: 280 - DNA, 101 bp, rice(Oryza sativa)
  misc_feature (71): n=a or g
cagtgtaataacttagtactaaacaacctatgatatccataggtccagaacacagatgagcaaaatgatantgtaaacctaattaacaagcttacgcatgc

SEQ ID NO: 281 - DNA, 101 bp, rice(Oryza sativa)
  misc_feature (71): n=a or g
cactaggggtattatgcccaattccaaaggggtattatgccaaattccaaagtttggttgaaattggaacnatatgatggaaaagttgaaagtttgtgtgt

SEQ ID NO: 282 - DNA, 101 bp, rice(Oryza sativa)
  misc_feature (71): n=a or g
agatagatataaagtcgaagcggaatccaagatggagatcgttccacaaatagagcaagaatcgactaaantccgaatcggttgcgaccagaatcagcaga

SEQ ID NO: 283 - DNA, 101 bp, rice(Oryza sativa)
  misc_feature (71): n=a or g
cggtggcggaatatccccaggaacgcggcttgtcggaggcggcgaggcgatctcatgttaaggcacgtcgnaggcagcggaggaggatttccggccgacgc

SEQ ID NO: 284 - DNA, 101 bp, rice(Oryza sativa)
  misc_feature (71): n=a or c
atgtctcgctttaaaaattgcctctacatgacttttttgttgttgtcgttgtgtttatggataaaaatgcncccgacatgcgacaaaataaacctccgggc

SEQ ID NO: 285 - DNA, 101 bp, rice(Oryza sativa)
  misc_feature (71): n=a or g
ctgtttcaagagagagtatcagagcagtcaaaaaactagatcggctaaaggttttggttccctcaattatntctctttttttttgctacgtttatccccaa

SEQ ID NO: 286 - DNA, 101 bp, rice(Oryza sativa)
  misc_feature (71): n=t or c
ttacattataaaacaaataactgctgcagccacacagatggagtcaaaagcttaaagcctctctagattgnagtaaaactttaagattgaactgaagctgt

SEQ ID NO: 287 - DNA, 101 bp, rice(Oryza sativa)
  misc_feature (71): n=t or c
gtgcaacatcatcatctgacagattcccaactgtacgcttaagaaaaaagtgtacctgaaagtacattaancgatttcaatttaatcactgaaaggaaagc

SEQ ID NO: 288 - DNA, 101 bp, rice(Oryza sativa)
  misc_feature (71): n=a or g
cacccacctgaacctaagcacctaatcatccacaagctcgatcgctttacatgatataagcaacaacatgnaacaatcatgagtcgatcaaatgatccatg

SEQ ID NO: 289 - DNA, 101 bp, rice(Oryza sativa)
  misc_feature (71): n=t or c
cgcgacgccgccgttgctgctgcattctctcttctcagtcttctctccactccctccgcgccgcccctcgncccctcctccctcgcagtcgcagcctcgcg

SEQ ID NO: 290 - DNA, 101 bp, rice(Oryza sativa)
  misc_feature (71): n=t or c
acaggctcacgacgaggctctactggcgagtgagctaggttgcagtcttgcaggtgcattcgacgggctcngtggcgagtgcacggggctgccatgcgatc

SEQ ID NO: 291 - DNA, 101 bp, rice(Oryza sativa)
  misc_feature (71): n=a or g
gttcactttaggtccctcaatttgtcgccgagtctgaaatttattcgtaaactgaaataccaaatataacnggtcactcaatttacaaaaggaatcacccg

SEQ ID NO: 292 - DNA, 101 bp, rice(Oryza sativa)
  misc_feature (71): n=t or c
cagtgggccttccgtctaaaaaaactttgtaccctcgttttgtaaaatctacatcgagagacctctcgttntagtcctatcgcacgacgctaattccctcc

SEQ ID NO: 293 - DNA, 101 bp, rice(Oryza sativa)
  misc_feature (71): n=t or g
attttataaaagtgtattaatttggttaagcatttgtgtacttgggatatttttataacaaaattgattangtggatggacatttgaaacaaaatgactta

SEQ ID NO: 294 - DNA, 101 bp, rice(Oryza sativa)
  misc_feature (71): n=t or c
ggggaacgaagcagagactaaaagggcaagaaggacatttttcctacccagccccacatgtcagagctccnaaacagttaaagccaaacagaatagcgacg

SEQ ID NO: 295 - DNA, 101 bp, rice(Oryza sativa)
  misc_feature (71): n=a or g
tcaccgacatagcggtagtgcaaaaaatcctgatgatatgaatttctttcgtaatatattatcaacgactntggaattaatatcatagaaaatacttttaa

SEQ ID NO: 296 - DNA, 101 bp, rice(Oryza sativa)
  misc_feature (71): n=t or c
aaaaaatcatgaaaaaaatatgatttcaaaaataaaagccaaaccctaaccctgccacccgctccatcatnggcgtcggccgagcaccatgccgctgctcc

SEQ ID NO: 297 - DNA, 101 bp, rice(Oryza sativa)
  misc_feature (71): n=a or g
cgcgtttccatcctcccccctgccttttccgtcttctttcactgttgttcacttcggcaaggttagcgccnggagccggacgtatggcacgcggcgctcgc

SEQ ID NO: 298 - DNA, 101 bp, rice(Oryza sativa)
  misc_feature (71): n=t or c
acacacaaacctccaacttttccgtcacatcgtttcaattttgacgtggaactaaggctgtgtttagatcnaaagtttggatccaaacttcagtccttttc

SEQ ID NO: 299 - DNA, 101 bp, rice(Oryza sativa)
  misc_feature (71): n=a or c
aagggcacagttcaccacctagtggttaccctaataaatttggcacgaacactaatgttcttgggatagtnaaaaaaaatttaaaaaaaagatctcaccac

SEQ ID NO: 300 - DNA, 101 bp, rice(Oryza sativa)
  misc_feature (71): n=t or c
cgccgccacgcgcagcagcagccgagtccttatatacataattaacaggttgtcaatacgtaaaaatcctnctaaatttgtatggattgagacattcttta

SEQ ID NO: 301 - DNA, 101 bp, rice(Oryza sativa)
  misc_feature (71): n=a or g
tacccttctgctcccatctgtttcttgattaactattccactcttatttgtttcttgattaactagtaacntactcctacattgtaatgggtcatgcttat

SEQ ID NO: 302 - DNA, 101 bp, rice(Oryza sativa)
  misc_feature (71): n=a or c
acgctcattgcctcatcgatagaaaaaaaccgccttgataattatagaacaacttggcccctgaacatgcncgcttgacagtttcagttcacagcgaattt

SEQ ID NO: 303 - DNA, 101 bp, rice(Oryza sativa)
  misc_feature (71): n=t or c
tcgcgggagaaaccgtggggcccacctaaaacgttcgtaacgtcggtctcgcagtctcctcctcctccacnaccagtcaccagaccgccgccgccgccgga

SEQ ID NO: 304 - DNA, 101 bp, rice(Oryza sativa)
  misc_feature (71): n=t or g
tcccctgtatacgcaagggggttgcgcatctcttctgtacagtagcagtactaagagggtgttagattcanggcgtaaagttttagcgtgtcacatcgggt

SEQ ID NO: 305 - DNA, 101 bp, rice(Oryza sativa)
  misc_feature (71): n=a or g
ggagaaatctgaagaaaacaggggttgacgaatgcagttaccctaagcgcgtgcagccatggaggcgtcgngttgcggcgccgctgcgctccgcccacgag

SEQ ID NO: 306 - DNA, 101 bp, rice(Oryza sativa)
  misc_feature (71): n=t or c
cgaatttgtggactctaaaatcctcacgtgtaggacggttctcaaatatgaattcagtaagatcccagganatagtagtactagtaatttgttattaggta

SEQ ID NO: 307 - DNA, 101 bp, rice(Oryza sativa)
  misc_feature (71): n=a or g
aaatgggacagcagcttgctggtgtttggaaagggattcttctatcagttgttgctatgtacacttgtcangagggaccccatcgatcgtcgtcgcctcgc

SEQ ID NO: 308 - DNA, 101 bp, rice(Oryza sativa)
  misc_feature (71): n=t or c
ataagtgtggccttttgttctgtagctgaaaaagtggaagctatgtaaggaatgttagctagcatatgatnagagtgatctaaggtttcagtctgttggat

SEQ ID NO: 309 - DNA, 101 bp, rice(Oryza sativa)
  misc_feature (71): n=a or g
cccatatcgcttggagcggatccaccatatgtaatgcaatattggtgtcttacggtaccaatgactccttnctaatctctttattaatatactttagaaac

SEQ ID NO: 310 - DNA, 101 bp, rice(Oryza sativa)
  misc_feature (71): n=t or c
aaatggggtggtggtaaattcgcagccaacatcgctatctttttttaaagtaggtgatatcccgcgctttnctgtggaattgatggagggatatataaatg

SEQ ID NO: 311 - DNA, 101 bp, rice(Oryza sativa)
  misc_feature (71): n=t or g
gacatgccaacttatgtacctatgatattcaacctgtatcgatgccaactttttctgctgacctgttggtnttattttaatgtgcaaatacttctcaaaca

SEQ ID NO: 312 - DNA, 101 bp, rice(Oryza sativa)
  misc_feature (71): n=t or c
tctgaataggaggatggaagctacacaacaacggtttaaagtgactgcattttgacaaggtgatgcacttnttttttttttgccgaaactccacctttctg

SEQ ID NO: 313 - DNA, 101 bp, rice(Oryza sativa)
  misc_feature (71): n=t or g
aggagtaattcctagtggtcgtatagtacgataacggtgtatgagcttttcattccaaaagcttgaaagcntactaggttgcacttcatagtggccccgtt

SEQ ID NO: 314 - DNA, 101 bp, rice(Oryza sativa)
  misc_feature (71): n=t or g
tgattagtcacacgaaatggtcatatgcctttttccttaagtcgatgcatccagatgatcaacaactcctngctagtgtgtatacacatataaacggtcgt

SEQ ID NO: 315 - DNA, 101 bp, rice(Oryza sativa)
  misc_feature (71): n=t or c
tgcaacacaacaaccaaaactggatttcacctcatcagttgttgcattaagactcacagccagcgcacaantggattcctgtaggaagcgttttatctgtg

SEQ ID NO: 316 - DNA, 101 bp, rice(Oryza sativa)
  misc_feature (71): n=a or c
gcgagaccacacatgacatcatggcacgaaagcgcagaaaagaccccgggtgggcctgccgctacacgatnagacggacgccgaagcatgccacgtgatgc

SEQ ID NO: 317 - DNA, 101 bp, rice(Oryza sativa)
  misc_feature (71): n=t or c
ctctcctgatagtctcccctctcctttgcctatattggtgacgagcttcgctacatctatatttttacaanaatttgattaaacgatatgctgttttataa

SEQ ID NO: 318 - DNA, 101 bp, rice(Oryza sativa)
  misc_feature (71): n=a or g
gcatttccgtggtagtaatctacattgcagacttgcgtatttctcgtagtaaaagttctattgccgttgcntcaaagggtaaaactgatacggccatacgg

SEQ ID NO: 319 - DNA, 101 bp, rice(Oryza sativa)
  misc_feature (71): n=t or g
acgcatgtcacgacacgcgcacgttagctgccattccagcgctcggaacccacacttgttccggtcgatcnatctgtcgatctcgacacgggatttttctc

SEQ ID NO: 320 - DNA, 101 bp, rice(Oryza sativa)
  misc_feature (71): n=a or g
caagctgtgatcgacggatcgacataaaaatggatcacttctcttctctgcgtgcagacgagcactacctngcaaaaccctgagcctgatcctcatcggca

SEQ ID NO: 321 - DNA, 101 bp, rice(Oryza sativa)
  misc_feature (71): n=t or c
acacagacaacacacgtattctcaacagtcccaaatcaggagagtaaaacgcacatttccttatttcaacnatttaccgtacatgcataacaactatatag

SEQ ID NO: 322 - DNA, 101 bp, rice(Oryza sativa)
  misc_feature (71): n=a or g
ctggtttttgatcgatccatcccggaccagtattgcagttgtcgcagtgctgcactagcatgactgacctnaccaccgcagtcagtttctgtacctttctg

SEQ ID NO: 323 - DNA, 101 bp, rice(Oryza sativa)
  misc_feature (71): n=a or g
agggcctatagtgtgaagttcgcctagggccctcgaaaatgttgagccggccctgtccaatggcatataanagaagagccaattttgtgtggcatattagg

SEQ ID NO: 324 - DNA, 101 bp, rice(Oryza sativa)
  misc_feature (71): n=t or g
aatacaacatcccttatttattactgctgttattttttgggattaattctcgagtcgctagtatggttttnctaaatagattgctggagctctttgcattc

SEQ ID NO: 325 - DNA, 101 bp, rice(Oryza sativa)
  misc_feature (71): n=a or t
ttctgaaaataaatgtaaaggaaagttcaacgcgacgagcccgacgcatgcagatgctccacggtgtgtgngtgtgtcactctctgaacgccaacacagta

SEQ ID NO: 326 - DNA, 101 bp, rice(Oryza sativa)
  misc_feature (71): n=a or g
gcgggcgtctgcttgcctgagagtgcttgctgtggaggagatgggcctagggtaagttggaacacatgctntgggcttggcaggtgatgagtttggcagga

SEQ ID NO: 327 - DNA, 101 bp, rice(Oryza sativa)
  misc_feature (71): n=t or c
tgtttttcatgcaacatgtaaataaactcccagcatactaaatataattgtagcatgctatgacaacaaangtaatgcataggtagaaaaatgtgagaaaa

SEQ ID NO: 328 - DNA, 101 bp, rice(Oryza sativa)
  misc_feature (71): n=a or g
aaaataaatgctttccgtttcacttaaaaaagagagcggagcatgttatagtattctcataaaatgaactntagagatcctactctataacttcacgcaaa

SEQ ID NO: 329 - DNA, 101 bp, rice(Oryza sativa)
  misc_feature (71): n=t or c
ttcggtgtaacaccccgcacgcgctcgctccatccatcgatcgatcggtcgctggtctcgcgtaaactcancgtgtcgcgtcgcgcattattgatcgatcg

SEQ ID NO: 330 - DNA, 101 bp, rice(Oryza sativa)
  misc_feature (71): n=t or c
tctcaagtaactttatacaatttgagcaccgtggacctgtccacctttgcaaatactaatttacactgcanatacttagaaatcatagtacatcttacata

SEQ ID NO: 331 - DNA, 101 bp, rice(Oryza sativa)
  misc_feature (71): n=a or g
catccaacattggtagggaagacctgcagggagcagtataacaatatttgattgaagtgatttatacaggnaaaaaaaaacgtttcaagtactgtgaggcg

SEQ ID NO: 332 - DNA, 101 bp, rice(Oryza sativa)
  misc_feature (71): n=t or c
gtgtctgtcgccgccaccgccgctaaggccgacgccgcgcacgtttgtgttttttctttcctctttttttnccttcattttcccctcttttccaatgggtg

SEQ ID NO: 333 - DNA, 101 bp, rice(Oryza sativa)
  misc_feature (71): n=t or c
gcacacgttctaatactatgaatttgtctacattacgaatctagacaggctaatactttacattttattcncttagtcccataaaaaattaatctagtatt

SEQ ID NO: 334 - DNA, 101 bp, rice(Oryza sativa)
  misc_feature (71): n=t or c
gcaacgttaagaggttcaaagcttagaacttagaagtgcattacaacaaacttgacaagcatccttcgtgnatcatctgcatttcccctgtcatcatcctg

SEQ ID NO: 335 - DNA, 101 bp, rice(Oryza sativa)
  misc_feature (71): n=t or c
gttgactttttctcatggttatactcctagccaatagaatgaagatccataattccatattttgcgatgcngtttagcctgttccattaagtgaattcata

SEQ ID NO: 336 - DNA, 101 bp, rice(Oryza sativa)
  misc_feature (71): n=a or g
aaactatagattatctttttttaaccttgtaggagtattccatatagggatttggttgaagagttcatggncttctaactatatgtcaaagaaagaaatgt

SEQ ID NO: 337 - DNA, 101 bp, rice(Oryza sativa)
  misc_feature (71): n=t or g
tttttactatgatgttttaccctttatttggatttatttggaagatgaattgttgttttccctttgtcctngtcctcctggaatactcctgcctctccccc

SEQ ID NO: 338 - DNA, 101 bp, rice(Oryza sativa)
  misc_feature (71): n=a or g
ctgtgcgcgcatgcatacggcggtttcgcacattcgtggcgcccgtgttgccttgcggcgtgggagaacgngcgagaacgcagccgtggttaggtggtaga

SEQ ID NO: 339 - DNA, 101 bp, rice(Oryza sativa)
  misc_feature (71): n=a or g
atctaaaactaatttagttagttaggccaaaatgctcccggaaactggtgacgcgcgcgaaaaaaaagagnggaaaatcgagagagaaaaaacgtacatga

SEQ ID NO: 340 - DNA, 101 bp, rice(Oryza sativa)
  misc_feature (71): n=a or g
tggcactgggggtagcggcggggatgtggggtttaggagtggcggagaggaagggtttcggggggaggagngggcggaggaaggaggcggccatggcggat

SEQ ID NO: 341 - DNA, 101 bp, rice(Oryza sativa)
  misc_feature (71): n=a or g
tttagttttgtacaattttcctctcttttctttacccccagggattgtactatttttaatgaaatagcacnctctcgtgctgattcctttaaaaaaaacag

SEQ ID NO: 342 - DNA, 101 bp, rice(Oryza sativa)
  misc_feature (71): n=a or c
atgaggcgagggacggttggggcaccgctcatttatgatgttggacagcgcctcctgctccgcccactcancccgccacgtggtggctgggtgagggcctc

SEQ ID NO: 343 - DNA, 101 bp, rice(Oryza sativa)
  misc_feature (71): n=a or g
ctgttagtgtaatgccaatttttagtggacttgtagtgcacgtccaaattaagctcgatcatataggacantagagtaggtaactaaattctcttgaatat

SEQ ID NO: 344 - DNA, 101 bp, rice(Oryza sativa)
  misc_feature (71): n=a or g
gccgattgccgaagggtctctcacactctcacagcagcatcgcacggtcgcgcagaatgggcagaagagangatgtcgtcgaagtcgaagccaaccaaaac

SEQ ID NO: 345 - DNA, 101 bp, rice(Oryza sativa)
  misc_feature (71): n=t or c
ttgaatccgccaacaaagcgcaattcctgtctccattaacatgaaccacagaatggttatctgagcatccnagcagctcatctaaatttcatccttcgtac

SEQ ID NO: 346 - DNA, 101 bp, rice(Oryza sativa)
  misc_feature (71): n=a or g
ggccaaaaacaccacacacattaatagtagtactggtactacgcttcgatcgatatatcatactccctccntttctaaatatttaacattgttaattttta

SEQ ID NO: 347 - DNA, 101 bp, rice(Oryza sativa)
  misc_feature (71): n=a or c
aatcttttaacccccatggtatataaccacaccatgattgcattctgccagttttaaacctgaaatatccnccccccccacgcgcgcacacacacacaacc

SEQ ID NO: 348 - DNA, 101 bp, rice(Oryza sativa)
  misc_feature (71): n=a or g
tgcctcatggcttggttttcaccaccatggatgccagcgatggcgtcgggttgaagactctgcccacgctncggctcggggcgatgcctgtggcggctacg

SEQ ID NO: 349 - DNA, 101 bp, rice(Oryza sativa)
  misc_feature (71): n=a or g
tactggtacgaatcaagccgacatcacaggaaaacgatggacggctcaatgactcgagagtatggaatcanactgggtataggtgaaagcattaggcatcc

SEQ ID NO: 350 - DNA, 101 bp, rice(Oryza sativa)
  misc_feature (71): n=t or g
cccgatctgtacagctacttcatacgtgttgcttgttaaggcggtgaacgtgtcacgaaattcctttcccnttagatggcgactgccacatagacgagaaa

SEQ ID NO: 351 - DNA, 101 bp, rice(Oryza sativa)
  misc_feature (71): n=t or g
gacgggtgaacttaacggatgacacaatatgagattatccttccttcattttagtatcaatagttaaaaanattttattggtcttgatgaattacattttg

SEQ ID NO: 352 - DNA, 101 bp, rice(Oryza sativa)
  misc_feature (71): n=a or g
cattacgtcgcaaaatcatgcagtgtatccattggcatatacccaatcttgtaagaaacctgggatcctcntgttctgagatgctggctattattcataac

SEQ ID NO: 353 - DNA, 101 bp, rice(Oryza sativa)
  misc_feature (71): n=a or g
ttagaccttaaccaaaaatctagccatgttgaaggatttttttgtgcgaaagcatgaatgatgtattgttnaatactatatacatgaatacatccaactat

SEQ ID NO: 354 - DNA, 101 bp, rice(Oryza sativa)
  misc_feature (71): n=a or c
cttcatcttcattttcatcttatcttgattgcctgatccgatggctatcaagaccattttagaccttaacnaaaaatctagccatgttgaaggattttttt

SEQ ID NO: 355 - DNA, 101 bp, rice(Oryza sativa)
  misc_feature (71): n=a or c
cataatctctattttataagatatttttttaacttcttttgtggtactcctacctaatactctcattactncctgctccccccccgggcggaggagagtaa

SEQ ID NO: 356 - DNA, 101 bp, rice(Oryza sativa)
  misc_feature (71): n=a or g
tggattttttttcttaataattttgggtttaccatgtattcagttctagagtactacagcgtagacatagncgtagtatatttaaagaagataaatggatg

SEQ ID NO: 357 - DNA, 101 bp, rice(Oryza sativa)
  misc_feature (71): n=a or t
gcaaaaatcaagaccagagcagcatgcacacagttaatagcgtgtcttcggttgtcacgacgaactaaaanaaaaaactgtgtttgatgttgttcgatctt

SEQ ID NO: 358 - DNA, 101 bp, rice(Oryza sativa)
  misc_feature (71): n=a or g
tttccaactcaacaaaaagtgagggatataaatggacttattccttaatgggcctcacatacaaaaacaangggtttgttcagttcattgcaaaaaagacc

SEQ ID NO: 359 - DNA, 101 bp, rice(Oryza sativa)
  misc_feature (71): n=a or g
tggggtgacagcataacacaaataatttgaactttgaaacatagatggaaaacataattcgatggggagcntggcgcatgagcatcatcagatgatcagtt

SEQ ID NO: 360 - DNA, 101 bp, rice(Oryza sativa)
  misc_feature (71): n=c or g
aggagggaggcagttccacaggccaaggaacttacgtgacctccaaagtcagaggtcggaatctcccttcnttccagccatggcccaccacccttgcggct

SEQ ID NO: 361 - DNA, 101 bp, rice(Oryza sativa)
  misc_feature (71): n=a or g
agcgccggcgcttccgtggttggctcgccattccagagctcgaggtggagatcgcggggagaggaagcganacaacgataggaggaagcgagacaacgaga

SEQ ID NO: 362 - DNA, 101 bp, rice(Oryza sativa)
  misc_feature (71): n=a or g
accatgcttgtcccagctgtctagcattgcaaacggctgtcgtccagatctctagcgatgacggtggcggngtactcctaattgttgcgccgcatctaggt

SEQ ID NO: 363 - DNA, 101 bp, rice(Oryza sativa)
  misc_feature (71): n=t or g
ttaacaaccacttttgtgaattgattacctatctcaacaccacccactttctctcttggattactactcanaaaagtagcatatgccacatgttctttgtt

SEQ ID NO: 364 - DNA, 101 bp, rice(Oryza sativa)
  misc_feature (71): n=t or c
gtgttgtacagatcatccgaggcgacgtttctcgattcgatcatggccaccaagatgttccgcgccgccgncgtcgtcgtcgctgccgcggtgtcttgcct

SEQ ID NO: 365 - DNA, 101 bp, rice(Oryza sativa)
  misc_feature (71): n=t or g
caaaggccatatatatgaccagatcatcggaaacgatatataagtatatcgcatcgcacaatcaataatgntatatactcctatctacccaattaaacgag

SEQ ID NO: 366 - DNA, 101 bp, rice(Oryza sativa)
  misc_feature (71): n=a or c
gttcgtttggttcttatgtctagatgtatatgagtataagatctatgttagaaatatgagatgggataaanccctagctgtttgtatggctggctatggct

SEQ ID NO: 367 - DNA, 101 bp, rice(Oryza sativa)
  misc_feature (71): n=a or g
atatagttgctaaatatttgtcaagaggaagtgcgggaggagtaaaatttaccgtgcgcgcatgggaattnaacccccgacgtcccattcacatgcctcac

SEQ ID NO: 368 - DNA, 101 bp, rice(Oryza sativa)
  misc_feature (71): n=a or c
ctaggatcgtttaattttttggaaaaaaagagagtagaccattataacagtaaaatgctagtgctactgancaaccacggcttacataaaaattagaaaaa

SEQ ID NO: 369 - DNA, 101 bp, rice(Oryza sativa)
  misc_feature (71): n=a or g
atttaccatgattgaatcatgcaaactatggagctaaatttggtgtgaaatgtcctgctatcaacgtgaanctctggcatcatatttccaagatatggaaa

SEQ ID NO: 370 - DNA, 101 bp, rice(Oryza sativa)
  misc_feature (71): n=t or g
aaacggtagtgcactgaagatatgctccaaattcattcaagtgtttttttatcggaacacgaactagtgangatttttatggtactctatactaagtatat

SEQ ID NO: 371 - DNA, 101 bp, rice(Oryza sativa)
  misc_feature (71): n=t or c
ctaggctatcagaatgtgacaaattttgagtaatgatagcaaaaatgttcacagggagttcatggtattantctattgatcccagaagaaacacaactgtt

SEQ ID NO: 372 - DNA, 101 bp, rice(Oryza sativa)
  misc_feature (71): n=a or c
attgttctccccgtattcttgtgctaaaaaaaaccggctgtagtaagtatccttaccaacctagctcaaanctgtctgtctgtctgtctgtctgttgtagt

SEQ ID NO: 373 - DNA, 101 bp, rice(Oryza sativa)
  misc_feature (71): n=t or c
tctgtttattcattaattagtatctaaaataagatatgtgtccatcctttcattcttataatcgggtctcntataaaatcgttgttgatttgtcaaaacac

SEQ ID NO: 374 - DNA, 101 bp, rice(Oryza sativa)
  misc_feature (71): n=t or c
gccatcgcacgttgttggtgggtagtagtagaagctttaatctaagctaagttcacaactatgggtctatntggtagaggctcaactcctaaatttagttt

SEQ ID NO: 375 - DNA, 101 bp, rice(Oryza sativa)
  misc_feature (71): n=t or c
ggaataaagtagaagcctacgaagagctataaataaaaacatgcgcataatacaattctcggtcactcagnttttgtcttttgtgtggaaaaaaagcttgt

SEQ ID NO: 376 - DNA, 101 bp, rice(Oryza sativa)
  misc_feature (71): n=t or c
ttttgaaattcatatggaatgatatagatccaacctcttacaaaaatttcctttgagtatattctctcgtncaatttatgtgtttttcctgtaatacaatc

SEQ ID NO: 377 - DNA, 101 bp, rice(Oryza sativa)
  misc_feature (71): n=a or g
aagtaagaaccgaacaatcctaataacagtaggggcagcaacctggcacacacttttcctgacagtcaaancaactacattacgacaaccaatccagcagg

SEQ ID NO: 378 - DNA, 101 bp, rice(Oryza sativa)
  misc_feature (71): n=a or g
ccgttgccgcagatcgccgccgcacctaaccctagggtttggaggataggggatcatcagactgaatgggnaatgggtctgttcaaaccaactacagcggg

SEQ ID NO: 379 - DNA, 101 bp, rice(Oryza sativa)
  misc_feature (71): n=a or g
cttggctgcttcgagttctcaattctcgcagtcacagtcgcggagtcggtagcatcggggcgaggacttgnaggcgacaatggcgtgctctctcctgccgc

SEQ ID NO: 380 - DNA, 101 bp, rice(Oryza sativa)
  misc_feature (71): n=t or c
taaaattagcgaattctgccatctacttgtcaacaagaagcatcaatgtttattctttagcggaaggtcangtagtctagtggttgcagtaacctgagtag

SEQ ID NO: 381 - DNA, 101 bp, rice(Oryza sativa)
  misc_feature (71): n=t or c
atgcgtcggctcggccgtctcaaacccgaagagaaaagaagtcgtcaagccgtcgacttgttcggttgttngccttgcccaccgagcctcccgcagctgtc

SEQ ID NO: 382 - DNA, 101 bp, rice(Oryza sativa)
  misc_feature (71): n=a or c
ggcctaacattcgttaccgttcgtatatatatttgataatatttggtcccatttctatatccgatcgactncgataccaacccaacaaaatatgaaacgga

SEQ ID NO: 383 - DNA, 101 bp, rice(Oryza sativa)
  misc_feature (71): n=c or g
taatggtggtgggagtatgtcgcatgctgtcttgtccacagcgaaaggaaatccctggaaaattcccgttntctctccaaaattacccttgatcatccccc

SEQ ID NO: 384 - DNA, 101 bp, rice(Oryza sativa)
  misc_feature (71): n=t or c
attggttccacgttcacagcgcgtcaaaaagatagtgtcaagggagcaaatacgattttatagatagcaanataaactacaagaatgtatcttgtaaaatg

SEQ ID NO: 385 - DNA, 101 bp, rice(Oryza sativa)
  misc_feature (71): n=a or g
gggctcgtctgggattagacgggccgccgagtttgctggggttactaatagtggaaataagttcattttcngttcctcaagtggccgagtttgaatgtcat

SEQ ID NO: 386 - DNA, 101 bp, rice(Oryza sativa)
  misc_feature (71): n=a or c
tctagacatattcgctacctatgatgttgttcatattttgatagtagtactcctatgcctttactagcttnttttatataaaaactagcatagtggctcgc

SEQ ID NO: 387 - DNA, 101 bp, rice(Oryza sativa)
  misc_feature (71): n=a or c
gttggccacgagcccacgaccatcttcaattaaacggccatttgaaaaaaacatggcaagcttctcttctnttcttatctttgtttactttccttttttaa

SEQ ID NO: 388 - DNA, 101 bp, rice(Oryza sativa)
  misc_feature (71): n=t or c
ttgggtgtaccttttcccctgggctaaacataacaaaatgagaagaaaacaaatcttgggctgaatagttntcggtgcagcccaagagcaattgagttcag

SEQ ID NO: 389 - DNA, 101 bp, rice(Oryza sativa)
  misc_feature (71): n=t or c
gaagttccgggccctattatgtgagtaatggcaagttttttgggggcttgtgttttttaagcccctccacnctctcctttgtttgctgctgactttgggta

SEQ ID NO: 390 - DNA, 101 bp, rice(Oryza sativa)
  misc_feature (71): n=a or c
actccaatagtacttatggctccaaagttcatcaaaatgtaaatcagaaaattcctgtggtcattattttnggtataataccatgttgatataaacattag

SEQ ID NO: 391 - DNA, 101 bp, rice(Oryza sativa)
  misc_feature (71): n=t or c
ggaactacaaggccattaggctgagaagtactccaaattccaagtgtttatatatgttaaggataacatgntagaccttgttttcacatgtttatccatgt

SEQ ID NO: 392 - DNA, 101 bp, rice(Oryza sativa)
  misc_feature (71): n=a or g
gccattttatatacaccgttgtgcatttccctcgcgtaggtgtggccatgtctcccgctatgctgcaggcntcgtcgctgtgcgtatccgcggcgctgtca

SEQ ID NO: 393 - DNA, 101 bp, rice(Oryza sativa)
  misc_feature (71): n=t or g
atcttacaaacagaactaggagtacgcagcacagcagcgcggagagcagttgcaagtgtttaaacccggcnatagggggtgtttttttccgggtgaaacac

SEQ ID NO: 394 - DNA, 101 bp, rice(Oryza sativa)
  misc_feature (71): n=a or g
tacactaatacaatagatatttgcgtatattatttttcatctattgacatcgtcaagaaacatgtgtctcntcaaactagaatcagaagatgaatgatgtc

SEQ ID NO: 395 - DNA, 101 bp, rice(Oryza sativa)
  misc_feature (71): n=a or t
cattaagttgagatcataacatctcactatctatatgatggaagctacaagcggaagcagcaaccaagcanctgtgaaagtttctgggccatttgttcgtt

SEQ ID NO: 396 - DNA, 101 bp, rice(Oryza sativa)
  misc_feature (71): n=a or g
gggtatcatgtactactcatgtagtcatgtgggttgggtttgccgactgtaccaattgcatacgttgtccnaagctcctgccgatctgcgccactacaaaa

SEQ ID NO: 397 - DNA, 101 bp, rice(Oryza sativa)
  misc_feature (71): n=c or g
gtagcaaatgcaactgggatgagtttgtacataattgaaatgaccaaaatttgcataccgtcttgcattangaagagatataaagcccaagtaaaaaaaat

SEQ ID NO: 398 - DNA, 101 bp, rice(Oryza sativa)
  misc_feature (71): n=a or g
ctagccacctaccttgcggtccagccaatgccaatcagcgtcctaacaaaaaggcggggtcgttaatgctngcgggcgcggaacaaaagaggtttggtggg

SEQ ID NO: 399 - DNA, 101 bp, rice(Oryza sativa)
  misc_feature (71): n=t or c
agcaaatccagcgttccaaacatggcctagtgttcatataaatatatatgatggaattaatttccatttgngtggatttgttttttactccctccatttta

SEQ ID NO: 400 - DNA, 101 bp, rice(Oryza sativa)
  misc_feature (71): n=a or g
tttcaacaactttagaaataaacaaatcacaacacaacatgataattgccaactaggcccaagtgcccaanttgaattttggattctctggcccacttttt

SEQ ID NO: 401 - DNA, 101 bp, rice(Oryza sativa)
  misc_feature (71): n=a or g
cagagacaacggttcaggggaccaattcgatcgtgaagtttcgtatgggctaacaagcccattttgatgcntccacttcctgagctgcggtctgggcccaa

SEQ ID NO: 402 - DNA, 101 bp, rice(Oryza sativa)
  misc_feature (71): n=a or g
taatagatatattgattaaaagttaggactaccacatttgctcaatatatagttaaaagttttagtagctntggtatccattcccacaccacccttgccac

SEQ ID NO: 403 - DNA, 101 bp, rice(Oryza sativa)
  misc_feature (71): n=t or g
gttcattcttccatgtcatgctacgcagccccgcctcaaacatgctattgaccgtgcctctctcttaacanaatggatcggtcaaagaaaagatggtttgg

SEQ ID NO: 404 - DNA, 101 bp, rice(Oryza sativa)
  misc_feature (71): n=a or t
tattatctttgggtgtttggacgacagagaaataagtggtataaaacatgttcatttctacttcactgganttttgatgtggattatttgttccacacctt

SEQ ID NO: 405 - DNA, 101 bp, rice(Oryza sativa)
  misc_feature (71): n=a or g
gcaaacttaagatgcttgtccttttgttttaggtatgccattcaaagataagacatggttgtgtgtgtgtntatatatgcctctgtatatacatgtgtaca

SEQ ID NO: 406 - DNA, 101 bp, rice(Oryza sativa)
  misc_feature (71): n=a or g
catgcgatgttactcctaattaattaggtgttgttgtgtgtgtaatgattgggtagctagctagctaggtngatcgaggactgacgatgggaggatgagct

SEQ ID NO: 407 - DNA, 101 bp, rice(Oryza sativa)
  misc_feature (71): n=a or c
gaattcaggtgggaaaactctatccctcggtgatttggtaaaaagaaaaaaattgtttgtgtcacacgagnaaattttatctcttctcttcttattcggta

SEQ ID NO: 408 - DNA, 101 bp, rice(Oryza sativa)
  misc_feature (71): n=a or g
cgcgaggcttgtccgcattgcgtcgatcaactcctgtgcacgcaacgaacactataggcgtcagtcgcggnaaaaaaaaaaagaagggcggagcccgcgca

SEQ ID NO: 409 - DNA, 101 bp, rice(Oryza sativa)
  misc_feature (71): n=a or c
ctgctgtcttgctgagaagcagtggacacacattctattcttgctatcaaactcgtatggctgcatcattntctctctctctcttctgaagaaagcattgt

SEQ ID NO: 410 - DNA, 101 bp, rice(Oryza sativa)
  misc_feature (71): n=t or g
attctgccattgccttaacctcattttttatggtctcgcatggagatcacctgttgcacctctgttcaacngtctaacctcttgaagcacgagctcagaca

SEQ ID NO: 411 - DNA, 101 bp, rice(Oryza sativa)
  misc_feature (71): n=a or g
ttaccttatcggtcccaaaatagatccctccaccaccatccacaacgaacagctagagggtcataggaacnaaagaatctacgaatcaggctgccgggttg

SEQ ID NO: 412 - DNA, 101 bp, rice(Oryza sativa)
  misc_feature (71): n=a or g
aagacgacagcagtcatgtcaacaggggaaaaagaaaataggaaagcgtatacctattttctagtaatacnttcatgctaattattgaccatttatgtata

SEQ ID NO: 413 - DNA, 101 bp, rice(Oryza sativa)
  misc_feature (71): n=a or g
taaagcaaccaatcaacttaaccttccacatcaaacaggtcccccaatccaaatcaaaccgctacatctcnccccaaccattgaactaccctaaaaattga

SEQ ID NO: 414 - DNA, 101 bp, rice(Oryza sativa)
  misc_feature (71): n=a or g
ttgagctgaaagtgtgatgggtaatgagatgggcaacaacaatgtcaccggtcaacaaggtatgcactatnttaaattttatcttctatctagacatgact

SEQ ID NO: 415 - DNA, 101 bp, rice(Oryza sativa)
  misc_feature (71): n=a or g
gggttcagtgggccgctgaacaagccagggaccaccggatcgaagatgcgccagaacgcaatcattggccngccttgtgggacgggaccgacgttgatgat

SEQ ID NO: 416 - DNA, 101 bp, rice(Oryza sativa)
  misc_feature (71): n=a or g
taggctccatctctgtgtgtgtgtgttttagtacgcacattatatttatgtctagtttaacaccagaatanttcaaacacgtagaattcaaccgtattcaa

SEQ ID NO: 417 - DNA, 101 bp, rice(Oryza sativa)
  misc_feature (71): n=t or c
aaaaaaggagtgggaaacttctaggggtattttttgcaatcgggtgagataagagtcccgcatgtgaaaanacccttattttcatgtgcggatattttaag

SEQ ID NO: 418 - DNA, 101 bp, rice(Oryza sativa)
  misc_feature (71): n=a or g
cgcgcgctggatcctgtgacttcgccttcacactgagttttgtttgcataacactgagttttgtatgattngatataagttaattacaatgttattatact

SEQ ID NO: 419 - DNA, 101 bp, rice(Oryza sativa)
  misc_feature (71): n=a or g
aaaaagagcattagaatgaccaatcataaaattcagaattcaacataagcacgccactcttactagtaacntactccctccatcccataatataagggatt

SEQ ID NO: 420 - DNA, 101 bp, rice(Oryza sativa)
  misc_feature (71): n=a or g
cggtggcagtagcgagagagtgggagacggcgacatgaatcatgatgcatccagcgttcacaattccaacnaaaactggtcgaattctgtgaaatttcgac

SEQ ID NO: 421 - DNA, 101 bp, rice(Oryza sativa)
  misc_feature (71): n=a or c
actgcataacggacttgattttagctcttcttcaggcacccagagctccacttatccgaaacaacaacaanaaaaatacctgttcaaactgagtagccgga

SEQ ID NO: 422 - DNA, 101 bp, rice(Oryza sativa)
  misc_feature (71): n=a or g
gattgctggataatactacagttatacgagtacactagtgatatgctatgccccttccctttaggtttggnagttgacctgaccagaacaaaccatctccc

SEQ ID NO: 423 - DNA, 101 bp, rice(Oryza sativa)
  misc_feature (71): n=a or g
tttagccctactgatgaagatgggcgatgggagtcatgtaaaatcaccatacgttacgtatctaaaggttngtttatttcctcatccctgataaaaggatg

SEQ ID NO: 424 - DNA, 101 bp, rice(Oryza sativa)
  misc_feature (71): n=t or c
gttttagtcccatctaaacagggccacaggcctgctgctaatggcagcctgttcgagtagagtattaggtngtgtttagttcacactgaagtttggaagtt

SEQ ID NO: 425 - DNA, 101 bp, rice(Oryza sativa)
  misc_feature (71): n=t or c
ggcggggtagggtagctatttatagcagttgccaccatgggcggaccttccaatatagcatgccatggcgnccgccatacctacttgccggcgagagtaca

SEQ ID NO: 426 - DNA, 101 bp, rice(Oryza sativa)
  misc_feature (71): n=t or c
cccgcagcagctgcattttctgcaaaaagattatccaatcgtggacctgatgggcattgctgttccggctnccatacgctctacttgttgagtccaaaaac

SEQ ID NO: 427 - DNA, 101 bp, rice(Oryza sativa)
  misc_feature (71): n=t or g
agatgtctcaccgtctcacgtgtgcattagtggtaactggtgcaaaatgagcaaagattaattatggctgnagggcgcaatcagtttctgctcctgccacc

SEQ ID NO: 428 - DNA, 101 bp, rice(Oryza sativa)
  misc_feature (71): n=a or g
tggtgggtaggttcaagattttctccactaaccaagtgggcaacctgctacttgttattggtggttacatnagaggatacatattctatatcaaccgaggt

SEQ ID NO: 429 - DNA, 101 bp, rice(Oryza sativa)
  misc_feature (71): n=a or g
agaatcaatctatctatacctaataaaaaaatacgtaaggcttccagttgttattttcgtccgtcgccccnatatggttgccaaaatccgttttaatccgc

SEQ ID NO: 430 - DNA, 101 bp, rice(Oryza sativa)
  misc_feature (71): n=a or t
tatattcatctatattagagtattgagaccaaagggcattggtgagagcattgcttatgctgacagttatnacagtaacaaaatggttttatttaatgata

SEQ ID NO: 431 - DNA, 101 bp, rice(Oryza sativa)
  misc_feature (71): n=a or c
ctatctcaatcaattattttttaaaaaattctataatatatatttatgcgacatgcatgtaagaaaaaagntctcgagatccgaaaatcccatatgctatg

SEQ ID NO: 432 - DNA, 101 bp, rice(Oryza sativa)
  misc_feature (71): n=a or g
ttccagataaaacaagtcacaaatgatatatcaaaattcagcaggctatacattttaaaacaggggactanctcctattggcctttacttggttccacctc

SEQ ID NO: 433 - DNA, 101 bp, rice(Oryza sativa)
  misc_feature (71): n=a or c
agttatgccacaattttttagatatgtgtttggtttgttacggtaattgtgtcatgccacactttcgtagncttaggacccatatgtcatactctcaaatt

SEQ ID NO: 434 - DNA, 101 bp, rice(Oryza sativa)
  misc_feature (71): n=a or g
cgagccgctctgcggtctcgccgccatgacaaaaagcaagcaactgcttcaagggcgcacccgcacggccngcgtgctcgtcgtctcctacttcgccgcct

SEQ ID NO: 435 - DNA, 101 bp, rice(Oryza sativa)
  misc_feature (71): n=a or g
gggtacatgcgacgaaaactgatatgttggttcaggtcagtccacatatatatattctacctcggtttctnttaacacgctttttaaattactgaacggtg

SEQ ID NO: 436 - DNA, 101 bp, rice(Oryza sativa)
  misc_feature (71): n=a or g
atatgtgaaacaaatagcagattgtagtgttcaagaaaaatattaagtcaaatattctttcactatcccanaagtattcaatctcacagttcaacgggcta

SEQ ID NO: 437 - DNA, 101 bp, rice(Oryza sativa)
  misc_feature (71): n=a or c
aatacaatgaatacaaatctaccataataaaaatttatactaataaaacttgcgtaaagtttgacactacnaataaaattggtagagcagataatcaaaac

SEQ ID NO: 438 - DNA, 101 bp, rice(Oryza sativa)
  misc_feature (71): n=t or g
gttcgtccttaggcttttacgtaagagtatttgctttcgtattttcagctcatggtccgatgaatcatacntttgatccgtagccacatgcacgcgcgtgt

SEQ ID NO: 439 - DNA, 101 bp, rice(Oryza sativa)
  misc_feature (71): n=a or t
cttttttgttcttgtccttgaaattgagacacatgggtaagatcttcttcctgtgaacaattctttttttnaaaaaaaaacattgaggcatctagagaaat

SEQ ID NO: 440 - DNA, 101 bp, rice(Oryza sativa)
  misc_feature (71): n=a or g
taataaataatttatataattatattgatggataggcacgtggcattgaaggaataaaatttctcaatttncaggtcgatgataagaaggtaaatattaat

SEQ ID NO: 441 - DNA, 101 bp, rice(Oryza sativa)
  misc_feature (71): n=t or c
tcatcttaattgattatcagatttattttctacttctcaaactattttgtttctttcttttttacttatcnccagccaataaccgtctggccggttgcctt

SEQ ID NO: 442 - DNA, 101 bp, rice(Oryza sativa)
  misc_feature (71): n=a or g
tttacaacgcatccatacactcttgtggtgctcctcccttgtgcactcccgacggtgaagcgacgacatcntcctcgaccacattacccttctagaacgtg

SEQ ID NO: 443 - DNA, 101 bp, rice(Oryza sativa)
  misc_feature (71): n=a or c
tgttaacaaatattagaacgtcattacataattgcacacagaaaggaagaagcggtagcaaaaggaagganagaaaggggagcagttaaaccgaacccgct

SEQ ID NO: 444 - DNA, 101 bp, rice(Oryza sativa)
  misc_feature (71): n=t or c
tgttctgagggctagcagttgtggacttgtggtttattgatccctccatgcaaaagtgttgagtatatttnattttttgagttttttttcaaaagagttgg

SEQ ID NO: 445 - DNA, 101 bp, rice(Oryza sativa)
  misc_feature (71): n=a or g
aactagtagaaaaaaacatcattctttaactgagaactagctcaaattagactcacccaatacaatatttngataatgagtaatactacttcctccatttc

SEQ ID NO: 446 - DNA, 101 bp, rice(Oryza sativa)
  misc_feature (71): n=a or g
atgacgtgaggaaaaagaaactgtcagatatgataggctctgccagtgatactacttcagggacaggttanaactgctgctagactgctactctctctgtt

SEQ ID NO: 447 - DNA, 101 bp, rice(Oryza sativa)
  misc_feature (71): n=a or g
gcccacccagctcggagaagacgggtcggcggcaagcttgatgggagcctaccctttggccaagcttgggnacagagggggtcggtggtgagctcgacatg

SEQ ID NO: 448 - DNA, 101 bp, rice(Oryza sativa)
  misc_feature (71): n=t or c
aaaggtctaataggcaaccagaggtaattccctcagttcttctgcacccaagcagtcgttttatatcaaangagttgttttattactacaattaaagcaaa

SEQ ID NO: 449 - DNA, 101 bp, rice(Oryza sativa)
  misc_feature (71): n=a or g
gaaacacaaacagccaaaaggacgagccaactactagacaatacaaaaagcaacagtcgagctcgatcacnagttgacctcgaggcagttgacacgattac

SEQ ID NO: 450 - DNA, 101 bp, rice(Oryza sativa)
  misc_feature (71): n=t or c
aaaattactatcttggtcataaaatggtactgatcgatagaatattttttagcataacaaattcggacagngagtaatattttaggacgaagaaaatactg

SEQ ID NO: 451 - DNA, 101 bp, rice(Oryza sativa)
  misc_feature (71): n=a or g
tttatttctataatatattctcatagtaaacaataaaagaacaacctagatgattgaaaccaacaagagcncatattatatcatttcttaatatgtcattt

SEQ ID NO: 452 - DNA, 101 bp, rice(Oryza sativa)
  misc_feature (71): n=a or c
atatgatcttgactcttgaatcttgagctactgcagccaaaatcaataatgtattgtactccctccgtccnaaaaaaaaaggcaaaccctgggtttccgtg

SEQ ID NO: 453 - DNA, 101 bp, rice(Oryza sativa)
  misc_feature (71): n=t or c
tgacggttacagtgataacagtatcttttgccagcggtttctccggatcgctttcgccgtcgctgtctgcnggcataattctagaactttcttaactataa

SEQ ID NO: 454 - DNA, 101 bp, rice(Oryza sativa)
  misc_feature (71): n=a or c
atgggacactaattaactgatttacacttatcacctggagtcctggaagtcttagtcggacattaaatgcngcatagcaaaagaacaaatgtcccttccct

SEQ ID NO: 455 - DNA, 101 bp, rice(Oryza sativa)
  misc_feature (71): n=t or c
tgtataactaaagtcgtccacattttacgaacagacaatgtttgactttttgagagcaaaatgatcctttnatcccttcgtcagtttaactggaaatggtt

SEQ ID NO: 456 - DNA, 101 bp, rice(Oryza sativa)
  misc_feature (71): n=a or c
cacatgcctggcacgaagcgaatccgcggacatggcagcagcaacaaaggagctatagctagcttagctancgcggggaaaagcgggaagagaaaaaggtt

SEQ ID NO: 457 - DNA, 101 bp, rice(Oryza sativa)
  misc_feature (71): n=a or c
tgtcccattcaattgacggattaacggattggtagcggtacgaaatggaatgtctgtctttcaaactcgangcaaaagctaagtaaagtaacaacctaatc

SEQ ID NO: 458 - DNA, 101 bp, rice(Oryza sativa)
  misc_feature (71): n=a or g
tttgggactatcatccctcgcattgcaccgctggtaattgaactacttatttgcatggcaagaacgttgcnctgttggtatttgagtaacttctagccaag

SEQ ID NO: 459 - DNA, 101 bp, rice(Oryza sativa)
  misc_feature (71): n=a or g
tgaggatcgacttgaaagcatattgtaaaagatagtcctaaatgtaaaatccttatctttgtcagtgcccnagctacgtcatttgtaccatgaacttaaat

SEQ ID NO: 460 - DNA, 101 bp, rice(Oryza sativa)
  misc_feature (71): n=t or c
tgggatgggactctacaagtgctgcagttacagaaacaacaaggaagccaaaagccaaggaccagctttcntcaatgaaaccgaatgactggaagtaatgc

SEQ ID NO: 461 - DNA, 101 bp, rice(Oryza sativa)
  misc_feature (71): n=t or g
ttaattactaattagcatcgcgtccctgaattacatataatgcatatatacttcagatagtgagcacgcangcgtgcaatatatatgtgcttattataatt

SEQ ID NO: 462 - DNA, 101 bp, rice(Oryza sativa)
  misc_feature (71): n=t or c
gtggccatgcaaccttcccagagcaaattaggcgtcaagtggctaaaagacttgatgcatggaaaggagtntaatctacagaccatgggtcgagattctca

SEQ ID NO: 463 - DNA, 101 bp, rice(Oryza sativa)
  misc_feature (71): n=t or c
aaacgagagagaggggttgggaaaaggggataccgaacagagccttagtactactggtagttcagtaaggntgtgtttagttcacactgaagtttggaagt

SEQ ID NO: 464 - DNA, 101 bp, rice(Oryza sativa)
  misc_feature (71): n=t or g
cagagcacttatcagtatctcttttccaggatatttagggtttcgtttggagaaacaaagggaaatataancttggcagttcgttatcaaacaagatccgt

SEQ ID NO: 465 - DNA, 101 bp, rice(Oryza sativa)
  misc_feature (71): n=t or c
cgcaagaatatcccttaccattttcaggtaaaacgctgacagtaacctgacaagactccctgtccataacngtttggcccctgcctactgcaggtagtgcg

SEQ ID NO: 466 - DNA, 101 bp, rice(Oryza sativa)
  misc_feature (71): n=a or c
cgcggtcgatcgagtacgtacgccaataataatgcgcgcggtgtgtacgatccggaggagagaaaaaaaanccagccagatcgcctgtactctgacgacgc

SEQ ID NO: 467 - DNA, 101 bp, rice(Oryza sativa)
  misc_feature (71): n=t or c
ccacacccagtgccccagtctttacaactcggctcagtgctaaccacccccgctgataaaaaaaaaagttntcttagaactctgttcacgtgcactccaag

SEQ ID NO: 468 - DNA, 101 bp, rice(Oryza sativa)
  misc_feature (71): n=a or g
gctgcatatagctcagggattattgctgggggcagcagcagcagccagcaagggtaggttaggttgacgangatggcagtggtggtggctggcagcagggg

SEQ ID NO: 469 - DNA, 101 bp, rice(Oryza sativa)
  misc_feature (71): n=c or g
tgtttttaagagagcggctaaagtttagccctgcatagaactatagaagtactattcaaggttgcggcagncggcagtcgagtccagagatggtggcggag

SEQ ID NO: 470 - DNA, 101 bp, rice(Oryza sativa)
  misc_feature (71): n=t or c
gctagtctaacgtctaaacatatccaaatagtctgtcagttatccaaacatgtcgaccaaaaacatgagtngttgtaacttgtatatgcctctggtagcta

SEQ ID NO: 471 - DNA, 101 bp, rice(Oryza sativa)
  misc_feature (71): n=t or c
cagccaggctttggaattgaccgcatattaagtggcttaagctactttgctgtcgctggttatgtctcatntcccccccccccccccccccccggaaagtt

SEQ ID NO: 472 - DNA, 101 bp, rice(Oryza sativa)
  misc_feature (71): n=t or c
atataaaatagattacctctaatacactagctccagtataatataattttttatttgcatccaatttacantggtctctcgagtctcaattttctccctta

SEQ ID NO: 473 - DNA, 101 bp, rice(Oryza sativa)
  misc_feature (71): n=a or g
gccggcatgtcacgccgccctgcaatttgctgattgatatgcagctttgttgctggataatcattgttgtngctttattctatatccgactgcttgcttcc

SEQ ID NO: 474 - DNA, 101 bp, rice(Oryza sativa)
  misc_feature (71): n=a or g
aggaaaacaaatttctttgagagtattcgcaaatgatttattttccaaaagtaaaggtcgccatatggaanttagaaacattttatggatgacctttgcaa

SEQ ID NO: 475 - DNA, 101 bp, rice(Oryza sativa)
  misc_feature (71): n=a or g
ataggatattacaatacttaatactagtcaagactaagctttacgcttcttcatggtcacgaaagagtganttatgtcttcctcacttacatcagagaaga

SEQ ID NO: 476 - DNA, 101 bp, rice(Oryza sativa)
  misc_feature (71): n=t or c
aagctaaaaatattcaactgtaacaaaaaaaattggatccagagctatatccaagagggcctacatctgcngtaaactttaaatgccaaatgaattgttta

SEQ ID NO: 477 - DNA, 101 bp, rice(Oryza sativa)
  misc_feature (71): n=a or g
tttaaacataaaatattattgatcagaggtagtaatcatggttccccttaccgtttttggcgcagttactncactcccgcggtaaggcggttaccgcgtga

SEQ ID NO: 478 - DNA, 101 bp, rice(Oryza sativa)
  misc_feature (71): n=a or g
aatgtcacaattcagtacacgacaaagctcaaagcaacaaaacaagtaaaagctttatggcgcacaccacnaacataaatttggtcggaataatcgcagaa

SEQ ID NO: 479 - DNA, 101 bp, rice(Oryza sativa)
  misc_feature (71): n=t or g
tctatacaatgtagcacgcgtcacaaaggcaaatgggagtttgggagagagttaggaatcagatagtaagntggtgtttggatccagagacttaactttag

SEQ ID NO: 480 - DNA, 101 bp, rice(Oryza sativa)
  misc_feature (71): n=a or g
tgaatccccactcggaccattttctcttattttctgtctactattcggtcatccatgcaagcctttgtcanttcaacccgatttttggagccggttttcat

SEQ ID NO: 481 - DNA, 101 bp, rice(Oryza sativa)
  misc_feature (71): n=a or g
ggccgtgttgcacatgtaaaaagggattagtaatatctgatatgatctgagccccctggtgaacttgtgcntgggtgcagaagttctgcgcatacagccca

SEQ ID NO: 482 - DNA, 101 bp, rice(Oryza sativa)
  misc_feature (71): n=t or g
gttggattagggcaactagcacggaattgcatagcttgatgtgaactccgcactagctgaattgaatgaanctggccccccttatcattccattccatttc

SEQ ID NO: 483 - DNA, 101 bp, rice(Oryza sativa)
  misc_feature (71): n=t or g
tgtaacagtgcaataaaaggggatcaagttcctaagccgaaaggattctactaaagcctagcataaaatcnggaaatatcattctgcgtcaaatcaatatt

SEQ ID NO: 484 - DNA, 101 bp, rice(Oryza sativa)
  misc_feature (71): n=a or g
gtagccttcagtgtcctcgtccctatgtgacgatctacgattccaggggagataaatagcctcgctctctngtcgaggtagtaccagttcaaatgaaccaa

SEQ ID NO: 485 - DNA, 101 bp, rice(Oryza sativa)
  misc_feature (71): n=a or g
aggttctgtggcaaaatatgatgctgtccaaagagttcctcggagtcggagactacggttaaaatatactnatgtgcaaacaactgtacggtcaactcttt

SEQ ID NO: 486 - DNA, 101 bp, rice(Oryza sativa)
  misc_feature (71): n=t or c
tcaacacatgctcctacacatcactgtgctacatatatactcaaatatccgtttcataatgtaagtcattntatcattttccacatctatattatatggat

SEQ ID NO: 487 - DNA, 101 bp, rice(Oryza sativa)
  misc_feature (71): n=a or c
tctgacacggccttatttcgaagcagctctacgtacaaggctactaggaaaaattgtaccgaaggtcctcnacttgttagcggtataaaaaacgttctcaa

SEQ ID NO: 488 - DNA, 101 bp, rice(Oryza sativa)
  misc_feature (71): n=t or c
ttgcgtcctctcctctggttaagaaactttattaagatgtcatatactgtgcgtgcatggtagagcctgcnatgcatgcagcatgcatcgctggatcagtc

SEQ ID NO: 489 - DNA, 101 bp, rice(Oryza sativa)
  misc_feature (71): n=a or c
acccttcttttttcccttttcagagtctacgtggtgttgaatagagctgagtctttttcaactctattatngtgatgttgcataaatacattcatcctaaa

SEQ ID NO: 490 - DNA, 101 bp, rice(Oryza sativa)
  misc_feature (71): n=a or g
cgcggcattgacctttcaccatcaatggcgtcacaccgtttgtttcattgtttgagcatgtgaaaaactcngtactcgtgttggttttcagctaattagct

SEQ ID NO: 491 - DNA, 101 bp, rice(Oryza sativa)
  misc_feature (71): n=t or c
agccctgtcatttgatcccatccactgagttcacaacgagcaatataatccaagcattactgcaagtggcnataataataaggaaaaattggaatcatacc

SEQ ID NO: 492 - DNA, 101 bp, rice(Oryza sativa)
  misc_feature (71): n=a or t
ataaaatgtgctctatattcatagatcgtacgtacgcgatgagcgcatacgtttatacgttttattttttntaaaaaaatcatcgactttccgaggagatc

SEQ ID NO: 493 - DNA, 101 bp, rice(Oryza sativa)
  misc_feature (71): n=a or g
aacagaggatatgaaaaccaacctcctatcatagtatggggcgactttaatagcacggtgatcaaaacatntcagttcaaaatattatgggggcttcaacc

SEQ ID NO: 494 - DNA, 101 bp, rice(Oryza sativa)
  misc_feature (71): n=t or g
ccgggggtgggggagctagctagcgaagctaggggaccatgctaacatgttactggtacaaactcagcgtncccacacttgccttgcaatgcaatctttgg

SEQ ID NO: 495 - DNA, 101 bp, rice(Oryza sativa)
  misc_feature (71): n=a or g
ttgattaaatgaagaattagtttgatctgtctttctcttttggcagtttggacctgaactaaaagaaatcnggaggagtattagaatatgcatggatataa

SEQ ID NO: 496 - DNA, 101 bp, rice(Oryza sativa)
  misc_feature (71): n=t or c
aatttaatgattcgatgccctattcattatcatctgagttaacgtggatttttcaagtaatcgaaacacgntaagtgagtataattcaatttattagattt

SEQ ID NO: 497 - DNA, 101 bp, rice(Oryza sativa)
  misc_feature (71): n=t or g
aaattcagaagaggttagaggagattcaccaaccaggagatagagaacgccggaggccacgacggcgcggngccggccgatccacgagtcggcggcgagcg

SEQ ID NO: 498 - DNA, 101 bp, rice(Oryza sativa)
  misc_feature (71): n=a or g
gaaatgatggatgaatttaggttgaaatattgtctggaaatgatgtgaggaatgataatttagcttgtttntatatatatgctgagttgcataatgtaatt

SEQ ID NO: 499 - DNA, 101 bp, rice(Oryza sativa)
  misc_feature (71): n=t or g
ctcctcttaatattgatttagcactctggctttactcaacagtcaacagcagcatattcaagttttcaggnttttttttttcaatggttcaaatcactctt

SEQ ID NO: 500 - DNA, 101 bp, rice(Oryza sativa)
  misc_feature (71): n=t or c
cagcaggtggtcaacacagtagttcatctctcgttatgattggggagacaaaaataagttgctcactgtgngggtactgtgatgttgctaagatcacagtg

SEQ ID NO: 501 - DNA, 101 bp, rice(Oryza sativa)
  misc_feature (71): n=a or g
tcaaaagccagagagagaaatcatgtccatttcaggctcaccgtttgctttttggttacttgccgcagtcnaaaagttaaattttgatttgattttaagga

SEQ ID NO: 502 - DNA, 101 bp, rice(Oryza sativa)
  misc_feature (71): n=t or c
tagcggagacgctgtaaataataaacgcaggggagagtgacaagagttgttggatatagatatgggcgtcntgtcttgtcctcgtttgtcgctggtagtag

SEQ ID NO: 503 - DNA, 101 bp, rice(Oryza sativa)
  misc_feature (71): n=a or g
gcgaaaaaagaggagggggcggtggcgacactggcgagagagagagggcggcgaaaaaaagagggggcggnagagagattaggggtagggtagtaaaaata

SEQ ID NO: 504 - DNA, 101 bp, rice(Oryza sativa)
  misc_feature (71): n=a or c
cataaattttatgggccggcacggtaaggagaagatgacctctgctccttgttacagtagtaacaaagatnaaaaaaaggtttagtgtattatcagattgg

SEQ ID NO: 505 - DNA, 101 bp, rice(Oryza sativa)
  misc_feature (71): n=a or c
ttctccaacaatcactggaaaacagcactgaatactgtcaatatcacactgataagtattagcatgaatanttacttatatttagaaattttgacttactt

SEQ ID NO: 506 - DNA, 101 bp, rice(Oryza sativa)
  misc_feature (71): n=a or g
atagtaaatgaataaataagcaaaagataaagagagaaaaaattttattgggatttaagaaaacaagggtnttatgtttttattgattttgtatcagtatg

SEQ ID NO: 507 - DNA, 101 bp, rice(Oryza sativa)
  misc_feature (71): n=t or c
gggagaacgcggattaggggagggggaatgcggggcgccgagtagcaagaagagagaccccgaattggagntgcgcatgaagcagaaggcggcggagtggc

SEQ ID NO: 508 - DNA, 101 bp, rice(Oryza sativa)
  misc_feature (71): n=t or g
tttgttgattggctgagtgttagtaaaatactactacagaagagatgaataaggcagttaggttaactgangatgctttctgaaataatacattatcaacg

SEQ ID NO: 509 - DNA, 101 bp, rice(Oryza sativa)
  misc_feature (71): n=t or c
tatcgaagcagaactttcagctgcatgtacaattgcaggtaacagggcagacacagaagaacatatagtgngaggtagacaaacacaactagttctccata

SEQ ID NO: 510 - DNA, 101 bp, rice(Oryza sativa)
  misc_feature (71): n=a or g
gctgctgctgatcgccgccggcagcggaagccatcgaggaattctgcaggtagccgccgcaaggcttggcngcgtggagctgctgctgctgctgatggtgc

SEQ ID NO: 511 - DNA, 101 bp, rice(Oryza sativa)
  misc_feature (71): n=a or t
tgcaactttacactgtcgatatgagggcattattcgggaccctggatctgtggtaaatataccattttttnaaaaaaaaagaaaatcaaatttgaaacaaa

SEQ ID NO: 512 - DNA, 101 bp, rice(Oryza sativa)
  misc_feature (71): n=t or c
agtgtatgatttaaaaaatagtaatttaggagaaaagaggtgcaaattaattgacatgtatgcatgcacgncttatattatgaaacacctttaaaaagtag

SEQ ID NO: 513 - DNA, 101 bp, rice(Oryza sativa)
  misc_feature (71): n=a or c
attttgcttcctctaaagcatgcacacctgctaatcttcttacacttggtgtaacagcttctaaaggggcnctacctaacatgctggctgctgaattttcc

SEQ ID NO: 514 - DNA, 101 bp, rice(Oryza sativa)
  misc_feature (71): n=a or c
cagacatcagagtctctgagacgagaaagggttgaagcctcccccgtctgaattctgaggatacattgatntgcagttctgcacaacgataacgaaacgta

SEQ ID NO: 515 - DNA, 101 bp, rice(Oryza sativa)
  misc_feature (71): n=t or g
gtacactggaaggcccagccaattggattacgagcccaaaggcccatttaagcggcccaaacaagaagacncgagtgaggtttcgtcttcgtctccgtata

SEQ ID NO: 516 - DNA, 101 bp, rice(Oryza sativa)
  misc_feature (71): n=t or g
ctctggtttttaaccaaataaagtataaatacacaacactggctacgaagtactctctctgttctgaaatntctgatggttagctcatatttgaactaacc

SEQ ID NO: 517 - DNA, 101 bp, rice(Oryza sativa)
  misc_feature (71): n=a or c
aaaccaaaaaactttaagccaaacgggtcactaccctctttttttctatctccaaaagattctccactggnccaccactatatcactagctatatagtcaa

SEQ ID NO: 518 - DNA, 101 bp, rice(Oryza sativa)
  misc_feature (71): n=a or g
acctttcctcgaccggaagcattatgatagttttcttcggctagaaaaggaagactcatagtcgcagccgnccaatggctagaacaagtcagttcaagctg

SEQ ID NO: 519 - DNA, 101 bp, rice(Oryza sativa)
  misc_feature (71): n=t or c
tttatcttggtaattgcaccccttgcctccctcccatccgcctaaaactttgaccgtcaaagctaaccccnctctctctctctctctctgattaagcaaat

SEQ ID NO: 520 - DNA, 101 bp, rice(Oryza sativa)
  misc_feature (71): n=t or c
tatggcttgacaggacatggaagccaagccagtgaagacgatgacatgagatcaaaaaggaagaaaatgcnacaggaggcaagacagtgattcgagggccg

SEQ ID NO: 521 - DNA, 101 bp, rice(Oryza sativa)
  misc_feature (71): n=t or c
tgaagacacggatctgaccacatgctgtttgaaatgatgaagatgaaagattaaatcgacacacataaaangaaaaaaatattagtatataataaattaag

SEQ ID NO: 522 - DNA, 101 bp, rice(Oryza sativa)
  misc_feature (71): n=a or g
catatagatggcccgcataggatctctatcggtaccaggctgacttctccagcccgtacggtcaagaagcngcccaagtaaccagggtcacgtaggcggca

SEQ ID NO: 523 - DNA, 101 bp, rice(Oryza sativa)
  misc_feature (71): n=a or c
ccgatagagatcctatgcgggccatctatatggcccaaaactcgcctatgtcccgtgtccgtaaaggaacnagtcccactttaactcccttaaaaagtgac

SEQ ID NO: 524 - DNA, 101 bp, rice(Oryza sativa)
  misc_feature (71): n=t or g
tttcccagtactcactgtataacagtataagagaatcaggataaaaccaattaatcacctatttagaaganatatgaatatactttcatactataagagag

SEQ ID NO: 525 - DNA, 101 bp, rice(Oryza sativa)
  misc_feature (71): n=t or c
gggccacacgagtagtaggcggcacatagttctcgtgggctctcggcatcggcacccagatcgcatctccnctactcttcccccccccccccccccccccg

SEQ ID NO: 526 - DNA, 101 bp, rice(Oryza sativa)
  misc_feature (71): n=a or g
tatacgtggaaaaaaaagcaaaagttatactcaagtattttatactttaaatataacttggtattcaatcntataaaaatgatctgctaatttcttgtaag

SEQ ID NO: 527 - DNA, 101 bp, rice(Oryza sativa)
  misc_feature (71): n=c or g
ggatagcggagctgcccaggagaaggtgctaaatgcagaagcaaagagtaaggatcagcctaaggatgatnaagacctactgaagtatcggccgaaccctg

SEQ ID NO: 528 - DNA, 101 bp, rice(Oryza sativa)
  misc_feature (71): n=t or c
gaagaagcagccaaaggcagtaatggagcgcaggcggagaagacgagcgagagattttctctgtatggaangcgctaggcacggccctattcgcgtctgtg

SEQ ID NO: 529 - DNA, 101 bp, rice(Oryza sativa)
  misc_feature (71): n=t or c
agcaccatttccaaaggtggaactagctgacattctgcatgtgatagttcgaaagaacatcagaccctatnattttgtgagccacataagacatgaatatt

SEQ ID NO: 530 - DNA, 101 bp, rice(Oryza sativa)
  misc_feature (71): n=a or c
aaaactgcgcattcttttggtttccgcctcgccgatttcaaccatcgagtccgtccccttcattgcgacgncgcgccgccgccggcgaccgatccgtcctc

SEQ ID NO: 531 - DNA, 101 bp, rice(Oryza sativa)
  misc_feature (71): n=t or c
ggttgctcccgccatccgaggccaccgctatcacacccaccgtcttcggactgggtagatcttccactccnatgggcactggcggcggatctgcccagtcc

SEQ ID NO: 532 - DNA, 101 bp, rice(Oryza sativa)
  misc_feature (71): n=a or c
cactcttatagagatgttaattagataaaagtttttaagattatctctctcgttttatttatgtgtttgtnttgtggcctaatcaaacggtaattcatatg

SEQ ID NO: 533 - DNA, 101 bp, rice(Oryza sativa)
  misc_feature (71): n=t or c
tatttcgcagataaaccaaacgatgcggctcttagtccataagatttcaagtgctacgacactctaactcnttttcttttctttttctatttcagtgtttt

SEQ ID NO: 534 - DNA, 101 bp, rice(Oryza sativa)
  misc_feature (71): n=t or g
gggtacttttataatgtgtaacttgcttgatgttaaactatactaatttctcagaaactaatggttaacgntagaaatgttttaattaagataaatatcct

SEQ ID NO: 535 - DNA, 101 bp, rice(Oryza sativa)
  misc_feature (71): n=a or t
gacgccaacaatcgaatcattctcgcagaatcgcgccagggaggaccatagtcacttgaccattttttttnaaaaaaaaaaactcggtctcggccttgttt

SEQ ID NO: 536 - DNA, 101 bp, rice(Oryza sativa)
  misc_feature (71): n=a or g
aagacttcttatctgtggtgctagattgaatcgttgatcagaacttgagcatccatcttaatacttactgnttacatacatgtgtatagttccttaatttt

SEQ ID NO: 537 - DNA, 101 bp, rice(Oryza sativa)
  misc_feature (71): n=a or c
gttctgtttaattttgtgctctgttgtatggttctgtacttctgtgttagttcatgacagtagcaatctgnaatcttcagtttcatataccatgtttctta

SEQ ID NO: 538 - DNA, 101 bp, rice(Oryza sativa)
  misc_feature (71): n=a or c
ctatctttttgacgacggcttgcaggtgcaagaggctgaatgggctggggcgccatgacatggtcttcgcnaaggcctcgccggcgtcgctcgccgtcaag

SEQ ID NO: 539 - DNA, 101 bp, rice(Oryza sativa)
  misc_feature (71): n=t or c
ggagtaattgtctggctattcttaattgtactcgatcgttccaaccaattttgttttttaaactgttaaangttttaaataggaaaattgctttagaaaat

SEQ ID NO: 540 - DNA, 101 bp, rice(Oryza sativa)
  misc_feature (71): n=t or c
ttctcctgtcttgttcatgataaaaaaccaacagggaagagacggtagtgctccttcttgatgcaggtgcngcagctggtgcactgtcagacccaacagca

SEQ ID NO: 541 - DNA, 101 bp, rice(Oryza sativa)
  misc_feature (71): n=t or g
atagaatacacacctaaatctaaaagtcttctaaagaagacggcaactagaagtggcctatttctaaaganggcacaattatgataaacttgaagaaccct

SEQ ID NO: 542 - DNA, 101 bp, rice(Oryza sativa)
  misc_feature (71): n=t or c
agcaataaccagctcataatatgatagattgacccagacattattaggtgatcatcatatgatatgatacnccactgccacctaatcatcatgccacgcgt

SEQ ID NO: 543 - DNA, 101 bp, rice(Oryza sativa)
  misc_feature (71): n=a or c
cctacgagggcggcaccttcgtcatcgacatccgcctcccaggtactcaatccccacccctcttcctcgcngccgccggcggattccttccgttcgtgttt

SEQ ID NO: 544 - DNA, 101 bp, rice(Oryza sativa)
  misc_feature (71): n=t or g
gtatatagggtagattagatgaactgaccagaccttgtcttgcgtgagatggaacgtggcgacgctgccgntgtagaagatggtcaggggcttcacctccg

SEQ ID NO: 545 - DNA, 101 bp, rice(Oryza sativa)
  misc_feature (71): n=t or c
gctttcccagttagccgttgctaagtcgcaacctcctgcctaaccttcccgctaaaacccagataatcatnataggagcgcttcgccatcatccagcgacg

SEQ ID NO: 546 - DNA, 101 bp, rice(Oryza sativa)
  misc_feature (71): n=a or g
ccccaactctgcatccgtcgcgtataaaatgcagaccaaaccccagctcaactctgcatcatcatcatcanctcgatagaaaaagaaagaaattaaaaaga

SEQ ID NO: 547 - DNA, 101 bp, rice(Oryza sativa)
  misc_feature (71): n=t or c
ctgcatgcatgtttctgatttctgaacatgttcagtatcattcagaaaatggatatgctatcatctgcgtncagagataatgctacctgctacatagttgg

SEQ ID NO: 548 - DNA, 101 bp, rice(Oryza sativa)
  misc_feature (71): n=a or g
cgactttctttacgagtatggagggagtatatacttggtgttttattggttgatgagttattactgtcttnttacgaataaaaagctgtagaaataaaata

SEQ ID NO: 549 - DNA, 101 bp, rice(Oryza sativa)
  misc_feature (71): n=a or g
agagtcgcgttgatgtgaaagtcgaatctttttaactttgtatttgtacgaatgggtgaaaaatagagatntttttaagaagggtgatagtactcccccgt

SEQ ID NO: 550 - DNA, 101 bp, rice(Oryza sativa)
  misc_feature (71): n=t or c
ccaatgcggcccatgtacgatgacgtgtaccctattgtcttctactagctctctccccctctactaccttncttactctgcccgtgaagagagagagagag

SEQ ID NO: 551 - DNA, 101 bp, rice(Oryza sativa)
  misc_feature (71): n=t or c
gcttagttttgtgcaataaattataaacattttattctccacatctgacttcacataaaagagagaagtgntttattttgttggaatttggaaacaccttc

SEQ ID NO: 552 - DNA, 101 bp, rice(Oryza sativa)
  misc_feature (71): n=a or t
ccttatgattagataagtatgtgtcaccaggaataataggctttgttcgagagagtttccgacagatgcanccaattcgataatcttgagttcttacaaac

SEQ ID NO: 553 - DNA, 101 bp, rice(Oryza sativa)
  misc_feature (71): n=t or g
gtattctaatgagcctactatgacgaagaaacacgcggctagacagatgtaaattagggaggtttcaagangtgatgaggcaccacctgttcttcttgtct

SEQ ID NO: 554 - DNA, 101 bp, rice(Oryza sativa)
  misc_feature (71): n=a or g
cactgttctcaaatgattgcataaatcagatacagatataaatcaaacataaactgaaatatgagcacganccataaaagacatggtaacgattaatgtta

SEQ ID NO: 555 - DNA, 101 bp, rice(Oryza sativa)
  misc_feature (71): n=a or g
acacccctttatatacaagtttcagtgtctagccagttaggcacattaatttcctcacatccacggcccangtgcgtgcttacagctagctgctacgttgc

SEQ ID NO: 556 - DNA, 101 bp, rice(Oryza sativa)
  misc_feature (71): n=a or c
gagagattgaattgcttgagaggaattaattgcttgttgattagcgaacacaattactagttgattagcantagattaacgcagcatgcaagataagagga

SEQ ID NO: 557 - DNA, 101 bp, rice(Oryza sativa)
  misc_feature (71): n=a or c
ttattcttccaaaaaaattgctaacctttataacacgatgaatgaggtgcacgaagcttaaatggttacancagacatgaaaaagggagcgactaagacga

SEQ ID NO: 558 - DNA, 101 bp, rice(Oryza sativa)
  misc_feature (71): n=t or g
tttctatctaaattgatttattttgtgatggagatatggagggactatccgaagcttaatttccctgacantttcctttccttcaacttttatccaacttt

SEQ ID NO: 559 - DNA, 101 bp, rice(Oryza sativa)
  misc_feature (71): n=t or g
tcccggaagatcagaatatgtttcagcgaaaacctacaatggctggagtaggagagcatcttaaaagaaancaaataagaagtaaactcaaaagtggaaga

SEQ ID NO: 560 - DNA, 101 bp, rice(Oryza sativa)
  misc_feature (71): n=a or g
caattccttcagagaaaactggctgctgtagaacgagatgttgtcgagagaagcttctctccatcttgaancatagggcttggtgtagaagcctcccttgt

SEQ ID NO: 561 - DNA, 101 bp, rice(Oryza sativa)
  misc_feature (71): n=t or c
tatagaggccctgaggaggaaaaaggtcatcttgggtccacttcccagattagtagatgagtcggttcacngaaaatgggattgattgatcgcgaaagagc

SEQ ID NO: 562 - DNA, 101 bp, rice(Oryza sativa)
  misc_feature (71): n=t or c
atatatgtgtagttcaaatgagttctcttctgtttgagccccacagaaaagggaacgaagggcttagcacnaaacaagtagattttaatattgctcaataa

SEQ ID NO: 563 - DNA, 101 bp, rice(Oryza sativa)
  misc_feature (71): n=a or c
agacttctcttgcacggtgacacgtggaaaatatatgtttgatatatatcctctcctccattcagacaaangggggccgtgtttagtttccccaaaattct

SEQ ID NO: 564 - DNA, 101 bp, rice(Oryza sativa)
  misc_feature (71): n=a or t
gttcagactttttgtttccggtatctgtatcgggtgccgatatgatgatattttcgaaatttcggttcaanttttttgaaattttaaaaatatgttattca

SEQ ID NO: 565 - DNA, 101 bp, rice(Oryza sativa)
  misc_feature (71): n=t or c
gttttatttatatgcatcattttttatacatgtaagtcatagatgttgcataattagtaggaaatacatanctaaataaatgtgtatttgattacccattt

SEQ ID NO: 566 - DNA, 101 bp, rice(Oryza sativa)
  misc_feature (71): n=a or g
aatcaaaacaatgcatatctttagaagcatcaagtgtagtcaggagaaccacttatggtcggctaattctntaggtaactcctaaagatacacttattaat

SEQ ID NO: 567 - DNA, 101 bp, rice(Oryza sativa)
  misc_feature (71): n=t or c
catcggagagttcatcttccccaacaagtttcatgtggtaagaatcctctaccaactcagtattaggttgntgtgacaagtgctgaaattagacagacata

SEQ ID NO: 568 - DNA, 101 bp, rice(Oryza sativa)
  misc_feature (71): n=t or g
gggaatggattttcttattggaccttgtctggttgttggttgacactcggatatatggtcttgtgatggtngttctgtttcaggattattgaatgttttga

SEQ ID NO: 569 - DNA, 101 bp, rice(Oryza sativa)
  misc_feature (71): n=a or g
agacatgataagcctggaatgttgatgcatgtgcttctttcccctcatttgctctctcactgcaaaaggcnttttctctcttcaataaccaaccttatttg

SEQ ID NO: 570 - DNA, 101 bp, rice(Oryza sativa)
  misc_feature (71): n=a or g
gaactagtgaacaaaggggatttctgtagctgcatgctaggtagctacaacatcagtaatctcgatatacntacagtactacaagatagtgcctcgatctg

SEQ ID NO: 571 - DNA, 101 bp, rice(Oryza sativa)
  misc_feature (71): n=a or g
aattatttaaagatgacatgtaaacaacgaggagaatagtttctcctcgagtgtttagaatagtttcgccntatatatcaactatgaagtatatactacta

SEQ ID NO: 572 - DNA, 101 bp, rice(Oryza sativa)
  misc_feature (71): n=a or g
caaaactctcttgtcttcatgcattctactaatagaaatagaaatgggatctggccccttgataaaaaaanagagaaaaacataagatttcaacagagata

SEQ ID NO: 573 - DNA, 101 bp, rice(Oryza sativa)
  misc_feature (71): n=t or g
cacacttgtttttactcccaaaatattccggctatcgaacgcgtttgagcgacggagagagttgcatatanagagagagagagagagaatgatggattagc

SEQ ID NO: 574 - DNA, 101 bp, rice(Oryza sativa)
  misc_feature (71): n=a or g
atcccgatccggcgaagacgaagatgagcatagagatgaactcggcgacggcggccttggccgtgtccggntgggacagctcgccgggggcgcccaccgcg

SEQ ID NO: 575 - DNA, 101 bp, rice(Oryza sativa)
  misc_feature (71): n=a or g
atagatagatacctgcctttatgctcaatcctgttgctaatagtaagttcttgactttgttgcaggtggcnaatccaataaccaaatatccttggtgcatc

SEQ ID NO: 576 - DNA, 101 bp, rice(Oryza sativa)
  misc_feature (71): n=t or c
ttccgattggatgaaaacttcctaatccaactcatgtcaggagtttactctgctttctgtgattccggagnacaaaccatagtcagggggaaggcccattc

SEQ ID NO: 577 - DNA, 101 bp, rice(Oryza sativa)
  misc_feature (71): n=a or g
ccagcttagacaattaaaaattgatacatgatgcatacgtaacacacgtacacgacttaattataaaatgnttttcactggtcttcggttgctgacggcgc

SEQ ID NO: 578 - DNA, 101 bp, rice(Oryza sativa)
  misc_feature (71): n=t or g
aatttgtgtttgtggtgttttcgctctttgtcgttgataggctagcaggcattccttactagtcaacattngtcgattttgaaatttgtggccaaatcatt

SEQ ID NO: 579 - DNA, 101 bp, rice(Oryza sativa)
  misc_feature (71): n=a or g
acatgtcacctgtttagcaccattcgttgaaccaactcttggtcaatcacagtttgcacagccccgcaaantcaaaacccgacgacgaactgacgaacaag

SEQ ID NO: 580 - DNA, 101 bp, rice(Oryza sativa)
  misc_feature (71): n=a or g
tccctgatctccctgcctgctgccagaagctagccatgcttccaggaaatcccaggtgcagcgtcgcatcnatgtgcccgacatcgatccccagctcaaga

SEQ ID NO: 581 - DNA, 101 bp, rice(Oryza sativa)
  misc_feature (71): n=t or c
gatttattcatgaaaactacacattttcctgaaaaaaggtttcggtatcacactgcactgcatgcacatgncactggtggagaaaccatctttactcccgg

SEQ ID NO: 582 - DNA, 101 bp, rice(Oryza sativa)
  misc_feature (71): n=t or g
gcgaatgtgagattgtgagaggtgctccactatggattatggaaagacaagatttggataagcccgacatncttttgatgcaggctgcagggacagaacag

SEQ ID NO: 583 - DNA, 101 bp, rice(Oryza sativa)
  misc_feature (71): n=a or g
tttttttcctttgtgatgttctcaaacacgataagccgtaggaaaataaacaaagcaataagaatagttcnttaataaaagtgaatgctggaaaatagaac

SEQ ID NO: 584 - DNA, 101 bp, rice(Oryza sativa)
  misc_feature (71): n=a or g
ttttttttgttcgaaatatagtacagacgaaaatgcttatataacacgcacacattcgctcttagggcatntacaatggttatcaacagtggtctctcagc

SEQ ID NO: 585 - DNA, 101 bp, rice(Oryza sativa)
  misc_feature (71): n=a or g
ttcagagttctgagttcaacaagtcacatgataaaaaggacaggcacaacagaaaggaaaagggatagctncaaaacccatatgctgaatttgaactgcag

SEQ ID NO: 586 - DNA, 101 bp, rice(Oryza sativa)
  misc_feature (71): n=a or c
acatgtctctctgacacgcaccaccaccccccacacagccaccccaaagattattttagaaaaaataaaanattaaaaaaaaacttctctttctcctccag

SEQ ID NO: 587 - DNA, 101 bp, rice(Oryza sativa)
  misc_feature (71): n=c or g
gacctaggagagacagcagcatgctgctcaaactcagcctcggcatcctgacccctgcagttacccacagntgcacttccttgacgatagcttggatgagc

SEQ ID NO: 588 - DNA, 101 bp, rice(Oryza sativa)
  misc_feature (71): n=t or c
gcttcaatttccagtatactgtttatctttctttgtgtttaattgagggatcatttgcgaggaagacatgnatgtgagaaagggtttttcggctagctcca

SEQ ID NO: 589 - DNA, 101 bp, rice(Oryza sativa)
  misc_feature (71): n=a or g
cacagtgttcagcaccctcttgcttcttggagtacagagatttggggtgcgcaaagaatttctcagacttntatgattgtcagatgaattacactgagaat

SEQ ID NO: 590 - DNA, 101 bp, rice(Oryza sativa)
  misc_feature (71): n=t or c
ctttaattaccaattccagggcctagcaccagaaggaccgaataggattttatagaggtggttatactatnaggattacgctaagcacaccaacctttaat

SEQ ID NO: 591 - DNA, 101 bp, rice(Oryza sativa)
  misc_feature (71): n=t or c
cgaacctcgcaacgatcactggccaagaccccagcaccggaacatgcagattcggtatcatgatcgaggtngactcggccttctcgtggaagctgcagcat

SEQ ID NO: 592 - DNA, 101 bp, rice(Oryza sativa)
  misc_feature (71): n=t or g
gacgatgtttcagatgtcgcgcaatcgacatggcttctgctcttatctgaaatttctgaaatctggaactncattcttggtgttctgaagaataaaggtgt

SEQ ID NO: 593 - DNA, 101 bp, rice(Oryza sativa)
  misc_feature (71): n=a or g
atgagctgaagagagtttgcaatgtgaatactgcgttattggttcaagctacttcacaggtagcaagaacnatgttcgagtccacttttgatctatatctg

SEQ ID NO: 594 - DNA, 101 bp, rice(Oryza sativa)
  misc_feature (71): n=t or c
gaaggaagcggagggaatcgaggtgaagatggaaatgaagggtttgattaccgctgcccatggaggctttncccctgttttggttttctattagggtttag

SEQ ID NO: 595 - DNA, 101 bp, rice(Oryza sativa)
  misc_feature (71): n=t or g
atttccgggtaattcgatcaaggtcccttgagaaccgtgcctatgaggtgtttattttcatggaggcccanatattccgtgcaaagaaaagaaaaatcgtg

SEQ ID NO: 596 - DNA, 101 bp, rice(Oryza sativa)
  misc_feature (71): n=t or g
tgcttcgctgctgcagtgggaaagcccgaccgaggccaggaaacgcggacgccgctcttcttttttttttnttttttttttcactctctctcgtctctccc

SEQ ID NO: 597 - DNA, 101 bp, rice(Oryza sativa)
  misc_feature (71): n=a or g
agggattacctagcgaagtgacacggacgatgatgccattgctgccaagctccatgtctgctactactagncaccagatttaccaccgtcgagctccatgt

SEQ ID NO: 598 - DNA, 101 bp, rice(Oryza sativa)
  misc_feature (71): n=a or g
caatgcgcagcaaaactccatccttgccaagcttcaaatcaagagttactgtaaatgttttttttcaaacnaccaaacagattggttggtgttatatttat

SEQ ID NO: 599 - DNA, 101 bp, rice(Oryza sativa)
  misc_feature (71): n=t or c
taagtgaaattgtgctattccttggaatactctctgtcttttcaaacaggaaattggatcctatacctccnttgggaagatgtatagatgctccctcttta

SEQ ID NO: 600 - DNA, 101 bp, rice(Oryza sativa)
  misc_feature (71): n=t or g
gagtaaaaaacaaacaaaattttcctctgaagacttcagaacaaggagaaaactttctgaacctgaagacngcagaccgagacacggacacacggccaacg

SEQ ID NO: 601 - DNA, 101 bp, rice(Oryza sativa)
  misc_feature (71): n=a or t
aatatatattgccgaatctttccgtcaaaaaatatatgttgccgaatcagacacgaaggacagtaactcangtagatgaggataaagatgaagattaagtg

SEQ ID NO: 602 - DNA, 101 bp, rice(Oryza sativa)
  misc_feature (71): n=t or c
agagagccgcaaggcccgcaacgcaacggctacacaaacccacgagtccatgcgactcgtctcgtctcgtnctcgtgtgtggatagcgcgggcgcggcaac

SEQ ID NO: 603 - DNA, 101 bp, rice(Oryza sativa)
  misc_feature (71): n=a or c
gctccgacatcgccgtctgcgtaagccacaccacagccacctatcccattttctgtagcagtatgcatgtnaacttgtcatttgatagccgacgatctctt

SEQ ID NO: 604 - DNA, 101 bp, rice(Oryza sativa)
  misc_feature (71): n=a or t
ttcacagtttcacacttctgttaggggctgctcattttgattttggcatgtatcccaacacttcctttttnaaaaaaaaaataaaagtgaggttttggcat

SEQ ID NO: 605 - DNA, 101 bp, rice(Oryza sativa)
  misc_feature (71): n=a or g
cagcacacagatttgcattgtcactgaattggccaacaggtgattgtgtgcgtttttagctgctccctctntcccataatataagggagtttaagttttta

SEQ ID NO: 606 - DNA, 101 bp, rice(Oryza sativa)
  misc_feature (71): n=t or c
agtactagtcaatctctctgcacatggggatgctgcttcttctattgcaaaacatgaattaaaccacagtntctatttatatggtggtacaaaacattgga

SEQ ID NO: 607 - DNA, 101 bp, rice(Oryza sativa)
  misc_feature (71): n=t or g
ttctgttctgctatattctgatgttccggtaacactgacatcgtttttgtttctgtctctactcttttganttcgtttttgaggaaaaaaatgtttttcca

SEQ ID NO: 608 - DNA, 101 bp, rice(Oryza sativa)
  misc_feature (71): n=a or g
aaccaatggcccctcttggcgatacagcatctgatgcttaatcttctttaataaatgatccttcctcattntggttcaacacgcactgtaacaactgtagt

SEQ ID NO: 609 - DNA, 101 bp, rice(Oryza sativa)
  misc_feature (71): n=a or c
tcctctcctctcctcacttggcaatgcatgccatggaaaaagcctgcttacaaagacctgcttctttggantggtcccacttctgcaattataggggggca

SEQ ID NO: 610 - DNA, 101 bp, rice(Oryza sativa)
  misc_feature (71): n=a or g
agcaactccattctccttatggtccactttataaatgctgttctaacttgttttttcttcaggttgcgccntttggcggcgtcaagcaatctggccttggg

SEQ ID NO: 611 - DNA, 101 bp, rice(Oryza sativa)
  misc_feature (71): n=t or c
agccctatagtggttctctcgaatatgtgcagcaacgttcaaatatattgtacttcactaataggtaggtngcatatagtagaatggaacataaggacatc

SEQ ID NO: 612 - DNA, 101 bp, rice(Oryza sativa)
  misc_feature (71): n=t or c
cactttattgctttaccaagcagtgtaatgatatgccatattgcactccaggttccagtacaattcaaaangcataagtttagtggtaaaaagtgtcatgc

SEQ ID NO: 613 - DNA, 101 bp, rice(Oryza sativa)
  misc_feature (71): n=a or t
atagtgtgtgttgaaaattaaggctctatagtgtcttgttctctttataagtaaccgcacttgagaaatgnccaggggtcttccagctagcttcacaaggt

SEQ ID NO: 614 - DNA, 101 bp, rice(Oryza sativa)
  misc_feature (71): n=a or c
tcaacggcgtcacacattaaaatacggagggagtatgaatgaagcagaaaaaagaataatctatgcataanattttatatttttattgtttattgtttaaa

SEQ ID NO: 615 - DNA, 101 bp, rice(Oryza sativa)
  misc_feature (71): n=t or g
tctcccacctagttccttacaagctagcactagacaatgcatgcaatgcaagttgcaacatattcccttcnttctaaaatagaccaacttctagtgtttga

SEQ ID NO: 616 - DNA, 101 bp, rice(Oryza sativa)
  misc_feature (71): n=t or c
aaacgaaaccctagcggagcaggactcaatggctacctcgcatctacattggtggaaaccctagcaaaaantctccatctccccactaacgaaagctacac

SEQ ID NO: 617 - DNA, 101 bp, rice(Oryza sativa)
  misc_feature (71): n=a or g
atgcacatttttcaacttctggacgaaaatagttcagatcatcttgttttggagaaataacagcagaaacnttgatgaaaatatggaattagtaaaaactc

SEQ ID NO: 618 - DNA, 101 bp, rice(Oryza sativa)
  misc_feature (71): n=a or g
aagaagcgaagggaatgagcttggcttctgctcctccacgcttctttgggcctgtttgaggtagcttctancagctgcagcttcttccagagtcagaagct

SEQ ID NO: 619 - DNA, 101 bp, rice(Oryza sativa)
  misc_feature (71): n=a or g
tcatgctgtgatgtttcttgagaagtaaatagaccacacatgttttcctagttctgtaggcagttgtacangataatcgatcgatcgaacgaacgaaccat

SEQ ID NO: 620 - DNA, 101 bp, rice(Oryza sativa)
  misc_feature (71): n=t or c
aattgttgtaaaacaactcacaacagaataaataaaacgaatggtagtatgatgctggaattcatatgtantattcttctctgtatttgagcttttctgtg

SEQ ID NO: 621 - DNA, 101 bp, rice(Oryza sativa)
  misc_feature (71): n=t or g
tacgaattatttcatatgattttttgattaatttcaatgaaccgaaaagtagttgtaaacttgtactggtngcattgcatggaatggaatggaagcagttg

SEQ ID NO: 622 - DNA, 101 bp, rice(Oryza sativa)
  misc_feature (71): n=a or g
catgtcaaaagcgaggtggttgtctctgcgaagtgatttctccacaccaaccacaccagaaaaaatcaccncgagccgcatcagttgtcctaataagtcaa

SEQ ID NO: 623 - DNA, 101 bp, rice(Oryza sativa)
  misc_feature (71): n=t or c
gcacaatagtcatctgtctttgtgaagacaatgtgattttcaatagcctcatattccggctgtatgctttnttttgtgttcataccttccaattatgattt

SEQ ID NO: 624 - DNA, 101 bp, rice(Oryza sativa)
  misc_feature (71): n=a or t
cccgttgaacagcatatctaagttacaacaaggaggttttctattttgttcatggcccactacgttctttnaaaaaaaaacgtgtgaactggaaacagttg

SEQ ID NO: 625 - DNA, 101 bp, rice(Oryza sativa)
  misc_feature (71): n=t or c
gaggcctcaccattatcgacaaagagatgcttttctccctgcttaattaattaatttaatcccgtagcaancggggcccactccctctgacaggtgggcca

SEQ ID NO: 626 - DNA, 101 bp, rice(Oryza sativa)
  misc_feature (71): n=a or g
ccgccaaaaccgtcgcatcatgtgccagcgcttatcacgtgccacgacaccagtttcatgaaaaaaaaaanaaaaaaaaggagaaaaaaaatgagcaagct

SEQ ID NO: 627 - DNA, 101 bp, rice(Oryza sativa)
  misc_feature (71): n=a or c
gcaaaaaggtatggtgcattgttaaattcatcaaagcttggtcttcaggtgctcttgctctgacttgattnattctaattatgtcccctactgttcttaaa

SEQ ID NO: 628 - DNA, 101 bp, rice(Oryza sativa)
  misc_feature (71): n=t or c
cccctaagatcttcagaatgaagaaaggaaacatcaaatgagttacttgtgttataaagaaagacaaaacngaagcataacaattgtttctgattgcatat

SEQ ID NO: 629 - DNA, 101 bp, rice(Oryza sativa)
  misc_feature (71): n=t or c
aaccgtttaaaattattagagaaaatgtggataatcgatgaggctttaggctgcgttcggaacggagcagngattagcacgtgattaattaagtatttgct

SEQ ID NO: 630 - DNA, 101 bp, rice(Oryza sativa)
  misc_feature (71): n=a or g
atcaggaccagtactcacaccctgatcagacataatgtggcccgaatgttcaagttgagactgagcaaaanaacacttataagctttctcaaacaaaacaa

SEQ ID NO: 631 - DNA, 101 bp, rice(Oryza sativa)
  misc_feature (71): n=a or g
tccgccggcgagggcggcggcgtgcggggtggtttccaggaggagggcggtgtcggagatggcgattcttngcggcgccgccgcggccgcggcctcctgct

SEQ ID NO: 632 - DNA, 101 bp, rice(Oryza sativa)
  misc_feature (71): n=t or c
tttttcgataatgaaattcgttctggcctttgctgaaagaagctacggccaactataattcagcaatttantacgaagaggagttagtttggtgagttcaa

SEQ ID NO: 633 - DNA, 101 bp, rice(Oryza sativa)
  misc_feature (71): n=a or c
ttagtactaaaattaagatattgtagatttcaccaacaaatttagcaatataatttttatttgaacaatcnatatattaaatagttcaagacatgctgccg

SEQ ID NO: 634 - DNA, 101 bp, rice(Oryza sativa)
  misc_feature (71): n=a or g
taataataaaaaacaagaaagatttaccacgcgtgcatatttctagagtaaatccaagaaagattcaatgngcagataagcatgtaaccagagatgcaaat

SEQ ID NO: 635 - DNA, 101 bp, rice(Oryza sativa)
  misc_feature (71): n=t or g
ttggatttggccatcttttttggtttcaatctcatctcccccaatcgggaatgctgcaaaacctagcgggntttttttttttttggcgttgtagctcgggc

SEQ ID NO: 636 - DNA, 101 bp, rice(Oryza sativa)
  misc_feature (71): n=t or c
tccttcctatccaaaattttagccagtctatttgtaatctataaaaaagtcacacttcatttgagctctgnttgatatctattttttttggtctatactga

SEQ ID NO: 637 - DNA, 101 bp, rice(Oryza sativa)
  misc_feature (71): n=t or c
ctttcacgcggccgaagcttcacgagcctcttttaagtgagcactttacattcttatattaatcattacantaactatattaattagtagtatttgtgtgg

SEQ ID NO: 638 - DNA, 101 bp, rice(Oryza sativa)
  misc_feature (71): n=a or g
tcggtcttatgaaacaaccgctatcaattttatgttttggttatgacaatgttctcctattaaatatgagnaaggaggtgctagcaacaactgtgcacaat

SEQ ID NO: 639 - DNA, 101 bp, rice(Oryza sativa)
  misc_feature (71): n=a or g
cggagatggcctgtttgcacaagggaacaacaatttgagcacttcttgtatacttttccaaaaaaaaaaanaaaaaaaaggaaggcttgtgctttgaataa

SEQ ID NO: 640 - DNA, 101 bp, rice(Oryza sativa)
  misc_feature (71): n=a or g
cactcctagccagtgtagcctttctgcccagtaaaactgatccagcaggaaaggacatgaaatctgcatgncaggattgtgtgagcaatctgaaaccatct

SEQ ID NO: 641 - DNA, 101 bp, rice(Oryza sativa)
  misc_feature (71): n=a or g
aaaaatttacataattaccgaccaacaatcggtccataaaatttgggttgccaatcatccgttggggttgnttaaaaagttataccgaccaactgcctatt

SEQ ID NO: 642 - DNA, 101 bp, rice(Oryza sativa)
  misc_feature (71): n=a or c
ccatcgtcgtctctgggtttttactctactgatttaaatataattgacagagctcctgcttgtttagttcncaaaaaaaaaaaatggcagattactcacat

SEQ ID NO: 643 - DNA, 101 bp, rice(Oryza sativa)
  misc_feature (71): n=a or g
atcaattcggttttaacgagagcgaattcattcgatgttaatcatgtgattaattacgcagattgaatccnagtgttatccttgcgctacaattcctctca

SEQ ID NO: 644 - DNA, 101 bp, rice(Oryza sativa)
  misc_feature (71): n=a or g
cacttgtttatgggaaatttgctagaataacaaataagctgaaacggaggaagtaacacctactagtctcntgtttcgtagatcgtgtcgatacacgaaaa

SEQ ID NO: 645 - DNA, 101 bp, rice(Oryza sativa)
  misc_feature (71): n=t or g
cacgctgtcatcaggcatgccattcacacaattttcgttcaaattttgtcggaattcgtattatgtttaantttttgttcgaattttgaactagctttctt

SEQ ID NO: 646 - DNA, 101 bp, rice(Oryza sativa)
  misc_feature (71): n=a or g
ttctaatttattagatcgtcaaaaggcatcttaagaacatttgtaaaatgcgacgtgacagtttgagagcntttgtagggagttcaatgaacttttaactt

SEQ ID NO: 647 - DNA, 101 bp, rice(Oryza sativa)
  misc_feature (71): n=t or c
ccgcaacccgactaagagtcagctcgagggcaaccgacaaggcaacgcatggtgcgtcgacgaggtggcangatggaggagcggcgacgcggcatgacgat

SEQ ID NO: 648 - DNA, 101 bp, rice(Oryza sativa)
  misc_feature (71): n=a or g
ttcatatgcacttttaaccagttggtgcagagagtcaggatgtagttttctttggtatggtaaaggatganctgcagatgttattctagacctattttgat

SEQ ID NO: 649 - DNA, 101 bp, rice(Oryza sativa)
  misc_feature (71): n=a or g
gttcaccagacccctcttcaagggcagcccacaagtcctcagtcttggcatttgaatatgcgaacttttcnatgtatgcggccagagatttctagcaaaaa

SEQ ID NO: 650 - DNA, 101 bp, rice(Oryza sativa)
  misc_feature (71): n=a or g
ataggtgaatgggggacggggggcgagaatttttggcaccatagaccatttttgaccacctagaaaaaatngtttttctagtagtgtatgatgctcggatt

SEQ ID NO: 651 - DNA, 101 bp, rice(Oryza sativa)
  misc_feature (71): n=a or g
gagattaatagaaatcacatataatgaacagagaagagtcatgtatagtttgtggggtcttgcggtatttntatattcttagaaaaacataagtgcgcaga

SEQ ID NO: 652 - DNA, 101 bp, rice(Oryza sativa)
  misc_feature (71): n=a or g
ttcgtgacatgctttaaaaaacttgagaaatgaacgaatgagtgtaaaaacttgtgggtacagttttagtncaataacttaaaaaaagtgatgtgacaact

SEQ ID NO: 653 - DNA, 101 bp, rice(Oryza sativa)
  misc_feature (71): n=a or c
tacataatgctacttcatttaattaatgaaattatctattccatccaaaaaaggaataacaccaaggcgcnttccggctagctccacaaggtgatgggcta

SEQ ID NO: 654 - DNA, 101 bp, rice(Oryza sativa)
  misc_feature (71): n=t or c
caagtttcggatcgctccagaagactacaccctccaatttcatactccctctatctactagtcatattttnaaatctgaaaaaattatttttatagatata

SEQ ID NO: 655 - DNA, 101 bp, rice(Oryza sativa)
  misc_feature (71): n=t or c
tcagatcagccagtgatgggccactcaggatttccaaaatatgcctgaatagaaacccggaagtccacatngatgctagagatttcttttccatttctcta

SEQ ID NO: 656 - DNA, 101 bp, rice(Oryza sativa)
  misc_feature (71): n=a or g
ttttcgtctcgcaaactaaacagggcctaagaacctgattctctaaagtagatatttttttgagcgactcncacgagacgatgcgaagttctattgataaa

SEQ ID NO: 657 - DNA, 101 bp, rice(Oryza sativa)
  misc_feature (71): n=t or c
gcgcatcatgatgtgtatatattggaaagctaccaacatgcatccatagtgtcaaaacacaaatatgtgcnggttgagaaacccccttagctactggtttt

SEQ ID NO: 658 - DNA, 101 bp, rice(Oryza sativa)
  misc_feature (71): n=a or g
accgcatttttatgtataatagtatatagttttatatatgtataatagtagcagtagtaccatgttggctncaatacggactggccttttattgtccaaaa

SEQ ID NO: 659 - DNA, 101 bp, rice(Oryza sativa)
  misc_feature (71): n=a or g
aatcccggcgaagcatgaggacgcggcttcaggccgccgttcaaataccgcgatgcagaacttccgccacnagagctaattcgggcgcgcgcgtttttagg

SEQ ID NO: 660 - DNA, 101 bp, rice(Oryza sativa)
  misc_feature (71): n=a or g
ggcgaatatgccacgtcaacctgaaattatcccttgcgcgaacatccgtgtaccttgacttgggagggatngggcggtggttaggggatgagcggaggaaa

SEQ ID NO: 661 - DNA, 101 bp, rice(Oryza sativa)
  misc_feature (71): n=a or g
gcacggtgtacgactgtacgagttcttgaggcattgccccccaagtgagcagcactgatggatctgatgcngcagagcagaagaaatgcctgagtgccctt

SEQ ID NO: 662 - DNA, 101 bp, rice(Oryza sativa)
  misc_feature (71): n=t or c
tttttgtatgaaatttgttaatcatttagtcttagttttgttctcttgaagtttctgtaaaaacttctatnttgaatggtttatttttatttaaatttctc

SEQ ID NO: 663 - DNA, 101 bp, rice(Oryza sativa)
  misc_feature (71): n=t or c
aaatttcgggatttcggtgacccccgatcaaaagccctaagccgatatagtgaaccctggcttccagatcnggatgtggggagctccgtgacatggtacgg

SEQ ID NO: 664 - DNA, 101 bp, rice(Oryza sativa)
  misc_feature (71): n=t or c
tggtgtgcggccacgggcaagggcgacgccaatttgcaatctcttttttttctcttcatccacacacaatntacaaatataaaataacaatcctaggtcac

SEQ ID NO: 665 - DNA, 101 bp, rice(Oryza sativa)
  misc_feature (71): n=t or c
tttattccccacctatcaactcttctactatttatcctcccatctatcaccttttttactattttatcctnccatcgatacttttgtactatgaaatgtat

SEQ ID NO: 666 - DNA, 101 bp, rice(Oryza sativa)
  misc_feature (71): n=t or c
agattttgtaaagaaaacttttctatatatttctttaaaagaagaatgtgccatttaacggttcagaaaangtgcacatgaaaaagcaaatattttttttc

SEQ ID NO: 667 - DNA, 101 bp, rice(Oryza sativa)
  misc_feature (71): n=t or g
taaatttaaaaccatgtaggtattttccacatattgtgtgagacgcgccgtgtgtgtgttgtggtggtggngggggatatcgcaaagggactgagatcctc

SEQ ID NO: 668 - DNA, 101 bp, rice(Oryza sativa)
  misc_feature (71): n=t or c
acatccattgtggttcatattggaatacccaacccacggaatgaaagttgtaacctttgtagaatagaaanaccatcaactattttggggttaattgcatc

SEQ ID NO: 669 - DNA, 101 bp, rice(Oryza sativa)
  misc_feature (71): n=a or g
aaaaaggataaagacaattttgtatcattactgagtttatggaacataagacagaaatgtcaacaggaagngaccaaacacaacatccggttccatagtgt

SEQ ID NO: 670 - DNA, 101 bp, rice(Oryza sativa)
  misc_feature (71): n=a or g
cctctgctcctctttcccttttgcattgcctcttcgttacgagcattctaagtcattttgatgcatcactntgtgtgtattggtgtatgtcatgcaggatg

SEQ ID NO: 671 - DNA, 101 bp, rice(Oryza sativa)
  misc_feature (71): n=a or g
aaattatacgcttaattgggtgagcttgtggggtgcaagattttttgtatgtgtaatatttttcaatgtgnggaaaaaaagtactccctccgtccaaaaaa

SEQ ID NO: 672 - DNA, 101 bp, rice(Oryza sativa)
  misc_feature (71): n=a or g
aaattgataggttagttcagttttttgaagtagactagactagcaaagttgcccgaattttgtcatacctntgaactctctcctaaataaggatgacaact

SEQ ID NO: 673 - DNA, 101 bp, rice(Oryza sativa)
  misc_feature (71): n=a or c
ttaaaaaaaaagaaaaaaaaactttgtttaaagcgaaagtgcctaccacttttctcttagaaacttctatntttatttttttcaattgcacagaaaacgtg

SEQ ID NO: 674 - DNA, 101 bp, rice(Oryza sativa)
  misc_feature (71): n=t or c
cactaaaaaagtcacagttcccgagcttaattagaccgggaagggcgagcgcgggcaacaatgacaaaganacgacagtgataatgcagccatcagcgatg

SEQ ID NO: 675 - DNA, 101 bp, rice(Oryza sativa)
  misc_feature (71): n=t or c
cttcttccctctccttctcccacatgtgcaatgcgtacatgctcctgagtaacaaccggtcattctacccngtcccctattatatagacctgacccgttat

SEQ ID NO: 676 - DNA, 101 bp, rice(Oryza sativa)
  misc_feature (71): n=a or g
aagaataaagttgtcaaagttgtaccttgtttggctttgaaaagtccaaaacaacattatattttattggnggaaataacttttacacacccccccactaa

SEQ ID NO: 677 - DNA, 101 bp, rice(Oryza sativa)
  misc_feature (71): n=a or g
cgtagtagttcagtttggctctttcgtccgagagttcacgagagttctcatcactcgtgttaattcgcatnttctttatggtctaatcaacacattcgatc

SEQ ID NO: 678 - DNA, 101 bp, rice(Oryza sativa)
  misc_feature (71): n=t or c
tacacgtcataaaagccctgagcttaggcagttcttcagacatttaagaagtaaaacagacataattttanatggtttagcgaaatgcaattgatgaaggc

SEQ ID NO: 679 - DNA, 101 bp, rice(Oryza sativa)
  misc_feature (71): n=t or c
cccttgccacatcatcaatatcaccaactcttgttgtctgatgaaagctacttcttctgcataacacccangaactaaatcctgcatacctctgctcatta

SEQ ID NO: 680 - DNA, 101 bp, rice(Oryza sativa)
  misc_feature (71): n=t or c
actaggaccaatggaaccacctgggttctttatgacaagtgctttaagattagaaggtggttgaagacctncaagaacatcagatcttgtggtccgttgca

SEQ ID NO: 681 - DNA, 101 bp, rice(Oryza sativa)
  misc_feature (71): n=t or c
atcactgaatatgagtatatgcattggtttggtgactatatatgacaatgtgtaattgaagcgtgtatcgnttcttcttgtttttttttttgttacacact

SEQ ID NO: 682 - DNA, 101 bp, rice(Oryza sativa)
  misc_feature (71): n=t or c
gaaagctgttgaatacttgaattgcagagtaagctcccgatcatcctcgatctgataagaaactaaaattnagtcgttgcgatagttggcttggccggcta

SEQ ID NO: 683 - DNA, 101 bp, rice(Oryza sativa)
  misc_feature (71): n=t or c
cttaaccatccaatgctgcaccaacaaatgcatgcatacggctatcacaattcacaagtggctatgttttntactccttttcttgcagctaccgttctgct

SEQ ID NO: 684 - DNA, 101 bp, rice(Oryza sativa)
  misc_feature (71): n=a or g
taacttttatttttcacttcttatcttgttctttttgttcttttttctttaaaacgtgaatattagggaanaacctaatatcaaatacttagaagggtgag

SEQ ID NO: 685 - DNA, 101 bp, rice(Oryza sativa)
  misc_feature (71): n=a or g
tgagctatttcatatataggaatttcatagaattgttggagtcccaatctttgtttcaaaggaccaagcangaaaattttatataggatttaaatcataca

SEQ ID NO: 686 - DNA, 101 bp, rice(Oryza sativa)
  misc_feature (71): n=t or c
gaaatgccatgccaaatgattgcaaaatgaaataactatttactacagagtgcataaatacatggcatctnaaacctgatttgactgcttgagaaacaaca

SEQ ID NO: 687 - DNA, 101 bp, rice(Oryza sativa)
  misc_feature (71): n=t or c
ttagctcaaacgagcaatatataaggaaatgaaggcgtattttgtttatttagttgatcgtgaagactgtnagctaaaaacggtatttaatcaagccaatc

SEQ ID NO: 688 - DNA, 101 bp, rice(Oryza sativa)
  misc_feature (71): n=t or c
gtacgtacgtgtcgccaccatgagactagtcctccagcgtacgaggattagacgtacctaccgtcgatcangcacctctagggtcgctgccgatcaccgtc

SEQ ID NO: 689 - DNA, 101 bp, rice(Oryza sativa)
  misc_feature (71): n=a or g
aataagctcactggatccatcccgccatcgataggtaatcttacgaacctaggattccttgagctttctancaattatttgtcacaagggatactcagttg

SEQ ID NO: 690 - DNA, 101 bp, rice(Oryza sativa)
  misc_feature (71): n=a or g
aagtttgaccacatggccaaaacagaaaaaggtttgcagattacaaatcaaatgaaagccacaaagagtgnagagcatcttcagcagagcacctaaattaa

SEQ ID NO: 691 - DNA, 101 bp, rice(Oryza sativa)
  misc_feature (71): n=a or g
taggcacccaccaattgaatcttccgtacttgtacacatggaatcgtatgcttattactacaataacaacnaaattttcttaattctaattgtccgtgtct

SEQ ID NO: 692 - DNA, 101 bp, rice(Oryza sativa)
  misc_feature (71): n=t or c
ccccaggtttgaagacatttcttttccatcatgtatggcgaaatcctcatcataattttgtgttcaattangccatctagctggcttcgacgatatcgata

SEQ ID NO: 693 - DNA, 101 bp, rice(Oryza sativa)
  misc_feature (71): n=a or g
agccaacatggtagcggtaggcacacagtgaattcatactccaaggctagatcgataagagaagcaaaaanctttctttatttttctttcttgaaacagag

SEQ ID NO: 694 - DNA, 101 bp, rice(Oryza sativa)
  misc_feature (71): n=a or g
tatttaaatatactgcagcgacgcgcgacagtaccatttgcggtgtgaccgcactatttctttatgagaanttttattacgttaacgaggtatgttataga

SEQ ID NO: 695 - DNA, 101 bp, rice(Oryza sativa)
  misc_feature (71): n=a or g
tggttaaacagcctatagattctgaagcctaaaccaccacatctttttggttttattaaacagttttcttnataagccgttttggcttattagaaaatata

SEQ ID NO: 696 - DNA, 101 bp, rice(Oryza sativa)
  misc_feature (71): n=a or g
ctcgcttacgagggttacacgaccagtatctaccagtgcaggaacggtagcatcctcctcttcaaggagangcatgatcggcgcgagctcaaatacgcggt

SEQ ID NO: 697 - DNA, 101 bp, rice(Oryza sativa)
  misc_feature (71): n=t or g
acacagcgacaaagggcttatttagcggcttacggccgtccacaagaaaataaaaaggaaaaagtacaccnaaggtccctcaacttgtcatcgagttacaa

SEQ ID NO: 698 - DNA, 101 bp, rice(Oryza sativa)
  misc_feature (71): n=t or c
gagaagaagagtcggttcgaacatgtgggcccataattttttatgttttccttagggacaattgctcatgncactctgtaccgaagcaatttaaccctagt

SEQ ID NO: 699 - DNA, 101 bp, rice(Oryza sativa)
  misc_feature (71): n=c or g
gttacacagcagcagaggccagaggctgagggcaagtagcggtttctccttccttcctcccgctctccccncccgcattaacctccacgagcacacgcact

SEQ ID NO: 700 - DNA, 101 bp, rice(Oryza sativa)
  misc_feature (71): n=t or c
tatacttgtcttgactgcttatacacccacataagaatgatttcttggcctactgctctgttgttctgttnaaccacttaaattattttcttgatccacca

SEQ ID NO: 701 - DNA, 101 bp, rice(Oryza sativa)
  misc_feature (71): n=a or c
taaagaatgcgtaggctgttgtttcagtatggagttggttgatgggtgaatttccctagcattcaataccntatatatatatatatatatatatgtatgtc

SEQ ID NO: 702 - DNA, 101 bp, rice(Oryza sativa)
  misc_feature (71): n=a or g
gatggtcggcggtggcgtcttgtttgctctctcttggggtatcacgcctggtactcaggtaccaagttctnatatctagctaccaactcgatactagggta

SEQ ID NO: 703 - DNA, 101 bp, rice(Oryza sativa)
  misc_feature (71): n=t or g
agctaaatgtaacacattggtgaatgacatctgttccaggcatcatatttgtgcgcattccctggaaaaanaaactattatcaatatagatgcctagatgt

SEQ ID NO: 704 - DNA, 101 bp, rice(Oryza sativa)
  misc_feature (71): n=a or g
taaggttgtttgtattagttgagttgggcaatattctagttgggttggggactacattttgatatgtgggntctgttaataccactcctgtgtttctcatg

SEQ ID NO: 705 - DNA, 101 bp, rice(Oryza sativa)
  misc_feature (71): n=t or c
tcgtactgtcaggacctgagtagcgaaccacggtaccttgttacttttacagttggaattacacagaaggntaatattgatgctgctgtcaaaaaggtaac

SEQ ID NO: 706 - DNA, 101 bp, rice(Oryza sativa)
  misc_feature (71): n=a or g
tgtgagaacacaccatcgtgcattcacttctgctacatcagctccaaaatggcacaccacaacagccctcngagagggtatgggtaaaattgtttgtgtgt

SEQ ID NO: 707 - DNA, 101 bp, rice(Oryza sativa)
  misc_feature (71): n=a or g
cttgaatgttaagctctataaagtaataaatcatagatgatatggatacttccattagctttaagatgtantattgctaatggatgattatgtggcatgtt

SEQ ID NO: 708 - DNA, 101 bp, rice(Oryza sativa)
  misc_feature (71): n=t or c
ctaataaatatcttcacagcatataaaaagaaaataaatatcttcacagtacgctaacctaaacttctacnccctccgtcccgaaataagtgtagttttac

SEQ ID NO: 709 - DNA, 101 bp, rice(Oryza sativa)
  misc_feature (71): n=t or c
gatccatctatccatcatcatcatcatccacacgctattctctgtagagatatcacgcgcatgatgctacngtattactagtgcaagtattactaacctcc

SEQ ID NO: 710 - DNA, 101 bp, rice(Oryza sativa)
  misc_feature (71): n=t or c
tacgccttccattaattagtcatttagaaagtacctccttttcctcctccgtttccttctggatcttcacntcatccattaacatgtgttcataatgcctg

SEQ ID NO: 711 - DNA, 101 bp, rice(Oryza sativa)
  misc_feature (71): n=t or c
aactgagaaatggtgattctttttcttttttgagatggataaaatggtgatgcactactactactactacngtgtattttcacgtgtactgaaacactctg

SEQ ID NO: 712 - DNA, 101 bp, rice(Oryza sativa)
  misc_feature (71): n=a or g
gttggagtaggtccatcccgtcggtgtgtgtcggagggggggatggagagaaggggaaacacagactcctngggatagagtggcgagcgtcatcggcggcg

SEQ ID NO: 713 - DNA, 101 bp, rice(Oryza sativa)
  misc_feature (71): n=a or g
tgcaacttttgcatggctgcatgtcaaacccgtaacagtccccttccttatttaaaataaaagagaaaaangaaaaagaaaatgtgaataaatctgcaacg

SEQ ID NO: 714 - DNA, 101 bp, rice(Oryza sativa)
  misc_feature (71): n=t or c
tatgtaccggtacatccgtactttttacttgctgttatatttggacatcgccacttcaatacacttaaggntgaaaaacagacagcgacagcagcagcagc

SEQ ID NO: 715 - DNA, 101 bp, rice(Oryza sativa)
  misc_feature (71): n=t or c
taatttataaatcctgaaacgaaaatcaggctgtgacaacaaccaccacatggcgcttgggggccaagaantggcacctataacaatatataggtgtcggt

SEQ ID NO: 716 - DNA, 101 bp, rice(Oryza sativa)
  misc_feature (71): n=t or c
tgtaaaggccaacaattagttgtcagaaaatacagattcgatttcctcaacgcggagaaggttgtatattngttttgctatttaaaaaaaaaacaattgaa

SEQ ID NO: 717 - DNA, 101 bp, rice(Oryza sativa)
  misc_feature (71): n=a or g
catctagcgttgtccttaatccacctttaactaacacactactacagaaaagaagataggtgtcggttggnaaccggtcataggtgctgaattttccaacc

SEQ ID NO: 718 - DNA, 101 bp, rice(Oryza sativa)
  misc_feature (71): n=t or c
gaatcaactaaatatgaacaaggaccagtacagtaattcaacagagaatctcttgtggaattttcctagtnaaatatactatatatggacgggcttggtag

SEQ ID NO: 719 - DNA, 101 bp, rice(Oryza sativa)
  misc_feature (71): n=a or t
agacatttggatgcatgtgtcatggaagtgcttatactattaatatgaacatgtattttggtttttttttnaaaaaaaaaaactggcacatgattgtcaat

SEQ ID NO: 720 - DNA, 101 bp, rice(Oryza sativa)
  misc_feature (71): n=a or c
gccgtagtactactcgtgcgtgcaacggcgcaactaatagtggcggaagcacccacccatcgtgcacgcgngcgcgctatccatctgcactgcactgcaaa

SEQ ID NO: 721 - DNA, 101 bp, rice(Oryza sativa)
  misc_feature (71): n=a or g
ggaaatagctgtgatgggtgaagatgaggaggtaggtagagctatatttttagaacaaatttcgtattcanaaggtacctatattttgagataaatacttg

SEQ ID NO: 722 - DNA, 101 bp, rice(Oryza sativa)
  misc_feature (71): n=a or c
cagttgtactacttgacaaactagggaaaacaaatgtaagaaactgaagttgccatggcccatggagaacnaaatccatcgatgttctgcacaaaactaaa

SEQ ID NO: 723 - DNA, 101 bp, rice(Oryza sativa)
  misc_feature (71): n=t or c
agttatatcatcaagactccaacccaaattcccttccccgaacctgaagactgcgccaatatctacgtgantacacagctagtggtagctggtttatctaa

SEQ ID NO: 724 - DNA, 101 bp, rice(Oryza sativa)
  misc_feature (71): n=a or g
cttggcgagtgacatcatgtcttcgtattggagccaagacatcacttcagctaggagaattactcatacancgtgatttctactccctccgtaccatttta

SEQ ID NO: 725 - DNA, 101 bp, rice(Oryza sativa)
  misc_feature (71): n=a or g
atccgctcgctctctttctcctttttctgccgacgatatccctaccactgccgcttgcgaaatcgacagcnagcagcggctgcggtgctcctgccggcgtc

SEQ ID NO: 726 - DNA, 101 bp, rice(Oryza sativa)
  misc_feature (71): n=a or g
actaaacacactttcctaaagataaacggaaactaacaatttttttctaattaatagataaacttatgccnccatgccatagtctttacgattctttcttg

SEQ ID NO: 727 - DNA, 101 bp, rice(Oryza sativa)
  misc_feature (71): n=t or c
ataccaccgggatggggcacttcacagagctgataattaatatgtagagaaatgaatactccctccattcnaaaatataaggcataaccacccttaaccca

SEQ ID NO: 728 - DNA, 101 bp, rice(Oryza sativa)
  misc_feature (71): n=t or c
tccgctttttttgccagatcaatccgatccatctcacgcgcttcccgtcaccattggattttgtgaaaaangaaaagaggagatcgatgaaaaaggaaaga

SEQ ID NO: 729 - DNA, 101 bp, rice(Oryza sativa)
  misc_feature (71): n=a or c
tgctgccagtgccagccaagccaacggacggatcgacgatccctctccccgtccgcttggtccctttcgtntccgggggccagggcaacacctccactttc

SEQ ID NO: 730 - DNA, 101 bp, rice(Oryza sativa)
  misc_feature (71): n=a or g
cctgtgaaagggtgtaattggagaatccatgcatcacgctcggctgataagaaatcaattgaggtaacctngatggtcttatgttttttttgtgtgatgat

SEQ ID NO: 731 - DNA, 101 bp, rice(Oryza sativa)
  misc_feature (71): n=a or g
cggcggctggcgcactcgatggctgtctacggtctaggttagggaagttgacgcggctaaagttgtgttcnggaggaggggttgggaaccctcctccccgg

SEQ ID NO: 732 - DNA, 101 bp, rice(Oryza sativa)
  misc_feature (71): n=t or c
tacttatgatcatcatgaattgaattacaatcaaattgctaaacccaaaccctagagatgacgacgggtantgatatatagagtttagggttgtgcaaaca

SEQ ID NO: 733 - DNA, 101 bp, rice(Oryza sativa)
  misc_feature (71): n=a or g
tagaagacagaaagtggttttcccagcttttctagattttcactagttggattccaaccagctcttctcgnaatctaaacctcctctaaatatgccccctc

SEQ ID NO: 734 - DNA, 101 bp, rice(Oryza sativa)
  misc_feature (71): n=t or c
atcctcctcccattctacaataactgggccattataaacattagcttttcaaaccgaataatccatactcnaataatcgagagaaaaaaacaactaatagc

SEQ ID NO: 735 - DNA, 101 bp, rice(Oryza sativa)
  misc_feature (71): n=a or g
cggtttctgagaaggcaaaatgaccttcctgccccacaaccgccatcagcgagcaatcctggatgtccacntgtaaggccgggctgagccgtcgccactag

SEQ ID NO: 736 - DNA, 101 bp, rice(Oryza sativa)
  misc_feature (71): n=t or c
tgctaccctaccacaattttggtagggtaacgtttggcaagaaaacaagttggcgatcagtcgcgcgcccncctccccgcgtgactggacacatgtcgcgc

SEQ ID NO: 737 - DNA, 101 bp, rice(Oryza sativa)
  misc_feature (71): n=a or g
agacaatccgatgcagccagtctcgaaagatggtcctgcaaccatcatcgggatcaatcaaagcacttcangggcattgccacggaaggattggagtccag

SEQ ID NO: 738 - DNA, 101 bp, rice(Oryza sativa)
  misc_feature (71): n=a or g
ggaaaaaaacataatatttgctactttgtgcaaaactgcaaattaaaccatgttgatgagcaaacgaaatnagccacaaccgtgtacatgcaccgtgaagg

SEQ ID NO: 739 - DNA, 101 bp, rice(Oryza sativa)
  misc_feature (71): n=t or g
cgcaaaattagcggccatctgttggaaatcgcaaaaataggctcctatcgaatgggggaggaacgacaagnggcttatcgaacatccagccttcgattggg

SEQ ID NO: 740 - DNA, 101 bp, rice(Oryza sativa)
  misc_feature (71): n=a or g
taaactaggacggaggggagtagaagtttaggttcatggattaatttgtgagacatgtaactttgcgttcnttcgcgttttattcccgttcgttcgcggtt

SEQ ID NO: 741 - DNA, 101 bp, rice(Oryza sativa)
  misc_feature (71): n=a or g
ggataaatcatcggcatggtgagaagagtatggaacgcgaaagagatggggattaccctggcttatttacnagtacgatagtcgtcttcttcgcggccggc

SEQ ID NO: 742 - DNA, 101 bp, rice(Oryza sativa)
  misc_feature (71): n=t or c
ttgccttgattgctcacaacgtattcgtgatccactatgaggaagaacaaatcttttagaactgcacctangtttgcacgacaacgcaaagtaaacaaact

SEQ ID NO: 743 - DNA, 101 bp, rice(Oryza sativa)
  misc_feature (71): n=a or g
ttttggatatattaacagacgaaatggcttgataccgacagtcaatagccacgtaccagcacatgattcanaaatgcttgcaatcatagcttgggcgcaat

SEQ ID NO: 744 - DNA, 101 bp, rice(Oryza sativa)
  misc_feature (71): n=a or g
cattgcctaaacctatttttgatgtggtaagtactgaagaggtatcaacttctatccaacaataaatagtnagtacaatagatttattcattgctacttta

SEQ ID NO: 745 - DNA, 101 bp, rice(Oryza sativa)
  misc_feature (71): n=a or g
caattcatctccactgatggtgtctagcaggctgcatcgtgaaagaggaaaatttaaaagaaaaggaaagncgtaatagtcattcttacctccaaaacaac

SEQ ID NO: 746 - DNA, 101 bp, rice(Oryza sativa)
  misc_feature (71): n=t or g
aacgatagcgcgccgtgagctacggtggtctaagggtgtggttggttaaaaagatatccctagatatggtnagtttttgggtttgtttggttggtgggtaa

SEQ ID NO: 747 - DNA, 101 bp, rice(Oryza sativa)
  misc_feature (71): n=a or g
atactaacaaaaagatattcgagatctcctaattaatccagctttatcgatgggaaaaagcgcctacactngtggagaaactatctttcgtcggtcggcca

SEQ ID NO: 748 - DNA, 101 bp, rice(Oryza sativa)
  misc_feature (71): n=t or c
acgacgacaccgacgccattaggagccgttctcctccttgtaggtgtcgttatggcactgacccctttttncccaacaccaactgcgtgcaacagtggcca

SEQ ID NO: 749 - DNA, 101 bp, rice(Oryza sativa)
  misc_feature (71): n=t or c
tgcggcccaagtcgtccgtccgttccgcccgcgttttctcaagtttccccccctcctttccacatttatcncacccagaccagacgtgccgtgcttctcgt

SEQ ID NO: 750 - DNA, 101 bp, rice(Oryza sativa)
  misc_feature (71): n=t or c
cgatcgaaggagcaggtcaagtgtttgaggcccatggtacgggcacatatataggggaggtccaagcaccntttttttttttttttaattggggtttagga

SEQ ID NO: 751 - DNA, 101 bp, rice(Oryza sativa)
  misc_feature (71): n=t or g
gcccctgacattgttaaggatggggaggtgggtacgacctctggtccgcctagcacagactacatcacttnctttgtcttcagcgcgttgtcgcgcacctt

SEQ ID NO: 752 - DNA, 101 bp, rice(Oryza sativa)
  misc_feature (71): n=a or g
ccatgctaactcactgcgccaagctgaacatgttatggctatctctgaaaatgatcctatagctgattggntttagcacatcaatgaacaattaagtgggc

SEQ ID NO: 753 - DNA, 101 bp, rice(Oryza sativa)
  misc_feature (71): n=t or c
attcgggggtatataatggaatgagcataactcaagggacataaaagggattggtaaaatttcagaggtangtaggggattttctctatattttacatagt

SEQ ID NO: 754 - DNA, 101 bp, rice(Oryza sativa)
  misc_feature (71): n=t or c
ggttgagagccaccagcgccgtggcgttcgacagcgacgccgggatagggtgggcagaataaaaccgaacngaagaaccaaaccgaaaagaccggacgaaa

SEQ ID NO: 755 - DNA, 101 bp, rice(Oryza sativa)
  misc_feature (71): n=a or g
cggaacggcggcggcaagatcttggccgcggcagcaagaagagtggtggtagtggcttgatttgaggtggnagagaaggggtaaatgggtaaaatggattc

SEQ ID NO: 756 - DNA, 101 bp, rice(Oryza sativa)
  misc_feature (71): n=t or c
ccatatgcatagcattatcaatagttatgacatgccggatttgtgcagccatgccatcacctccacttgancctcaccacgttgccagacctgcacgcgcc

SEQ ID NO: 757 - DNA, 101 bp, rice(Oryza sativa)
  misc_feature (71): n=t or c
gcgggccgctgcctgcttgcacagctactcgccgccgccacctcctcttagctaggggagaaagagcttgncattttaaaattctctctccactttgtcat

SEQ ID NO: 758 - DNA, 101 bp, rice(Oryza sativa)
  misc_feature (71): n=t or c
acaaatagaccataaaaacactaaagagaaatggaccttaacttcagccacgaatcttggcgttgaggtcnaacgtcttagcgccaagggttgtggcgcct

SEQ ID NO: 759 - DNA, 101 bp, rice(Oryza sativa)
  misc_feature (71): n=t or c
ccctgatcctactggatgccttcaacctcccttctcgctctttccctaaccgattccacatgggtcgcccncccccccccctcctgctttgttgttgctga

SEQ ID NO: 760 - DNA, 101 bp, rice(Oryza sativa)
  misc_feature (71): n=a or g
ttttttagtgaccaacaagcactcctcgattcatgtctgtatatgtagagctgaccattaaaaagagaaanagagagggggggagggggggttaaggttga

SEQ ID NO: 761 - DNA, 101 bp, rice(Oryza sativa)
  misc_feature (71): n=t or c
gtagcctatcgctgcgctggtcactacctttgccgatcgcaccacgacactcctgcggcaccaccactgcngccaccggccaagcctcctcatgccgcagc

SEQ ID NO: 762 - DNA, 101 bp, rice(Oryza sativa)
  misc_feature (71): n=a or c
tgttgaggtaggggagccagcttgatttgctggagaggtgatcataacagcagacgttttgatctggggtntttatatgtatcattatggtgattgccttc

SEQ ID NO: 763 - DNA, 101 bp, rice(Oryza sativa)
  misc_feature (71): n=a or g
tcggacctgatacacatgtatcaggcctatactgttccaaccatcctggtctccctctatcacttgagtgncaagggttacgaactattaaacataaagga

SEQ ID NO: 764 - DNA, 101 bp, rice(Oryza sativa)
  misc_feature (71): n=a or c
ctgaagatcattttcttaattaagggtcaattcgcttggtacacttgtaggaatcacggagaaaaaaaaanccaccacacgtatcattaagggcacccgca

SEQ ID NO: 765 - DNA, 101 bp, rice(Oryza sativa)
  misc_feature (71): n=t or c
gttgcctagtgaaagatatatctcaagtgaagaaaattgctaatttgttttaggtcaagatatttcaaacnagatgtgctctgcaaatcaaacaccagaag

SEQ ID NO: 766 - DNA, 101 bp, rice(Oryza sativa)
  misc_feature (71): n=a or t
ggttgtggaaaccatgtctatgaccattgctaatggggactacctatatataagcaatgtctttgtaatgntatgaacgcgtatgggaaagaagtgattat

SEQ ID NO: 767 - DNA, 101 bp, rice(Oryza sativa)
  misc_feature (71): n=t or c
atttacgttaggttaattccgttagtcagagcgtgttccattttaaaatttcctttgaagtataaagccangagtacattacacaattaaaacattaacag

SEQ ID NO: 768 - DNA, 101 bp, rice(Oryza sativa)
  misc_feature (71): n=a or g
attggcagctttgatgaccatcgatcctcttggtagtgctattggtggctgcgccgatggcgcacgggtangtggcacagcaccgaagatgatcactgccg

SEQ ID NO: 769 - DNA, 101 bp, rice(Oryza sativa)
  misc_feature (71): n=a or g
caagaaattacgtatgatctctccgaaaaaaatttgttttgaagtttcctaaacttggaaataggtagtcnaaaaattgatctctctaaaagaaaacctaa

SEQ ID NO: 770 - DNA, 101 bp, rice(Oryza sativa)
  misc_feature (71): n=a or g
cagaacagagaaagagagaaattatgtgtcggggaggaaaggggaaagggaaaaaaactatttcaatcacntggaaactcgtgtaacttattcgaatgatt

SEQ ID NO: 771 - DNA, 101 bp, rice(Oryza sativa)
  misc_feature (71): n=a or c
aaataaaatggagggaactttgctagccataagtaaaaacaaaagagcaatattcatcaaatacaacatgnaaacatggaacatgttttttaagaatatat

SEQ ID NO: 772 - DNA, 101 bp, rice(Oryza sativa)
  misc_feature (71): n=a or c
tactcactatgaatttgcggcaaactcacaagatatatatcatccaaaagtaacctcaaatcccccccccnaaaaaaaaaaaacactcatgccaataatat

SEQ ID NO: 773 - DNA, 101 bp, rice(Oryza sativa)
  misc_feature (71): n=a or g
ttcaggagagccaaccagactagagacaacacatcaagcaacacaactaaaaaattagcgcgcctctaacntgttcactacttaaatcctgcgtatcagct

SEQ ID NO: 774 - DNA, 101 bp, rice(Oryza sativa)
  misc_feature (71): n=t or g
agagtggcctggtcaatcaagctctagctgcagcattgagggcattcctctcggtatagatggccaaaagncccgaggcccgacagcctggcccatggcac

SEQ ID NO: 775 - DNA, 101 bp, rice(Oryza sativa)
  misc_feature (71): n=a or g
cgtgtggaggatttctgtggaattttggaggacggattggagcgaatcgatgaaccctaagggtgtgtttngttgaagggttttcttgggtcgggttgggt

SEQ ID NO: 776 - DNA, 101 bp, rice(Oryza sativa)
  misc_feature (71): n=t or c
aactatttagatgacatgcaaataacgaggggatgtgatccggtgaccctaacctccagacgaccagatcnagtggcctgcccactagagaggggctacca

SEQ ID NO: 777 - DNA, 101 bp, rice(Oryza sativa)
  misc_feature (71): n=a or g
cacatcagcctctaaatacacctttctttctcctctttctctcctcttcctcttctctcgacactctacancgcagaggctggcgacggcggcggtggctc

SEQ ID NO: 778 - DNA, 101 bp, rice(Oryza sativa)
  misc_feature (71): n=t or c
gggaagaggacctccgccagtgcaggaagaagaactcgttggtagatgtggggaggaggagcttcgccagngcgggaaggaagagctcgccggcatgtgcg

SEQ ID NO: 779 - DNA, 101 bp, rice(Oryza sativa)
  misc_feature (71): n=a or c
aatgcatacctcctttttagtttaaaagagttacattaggaaactcattggtgggaagatcccatactacnatgtaaatattgtgcattgtgcagatcaag

SEQ ID NO: 780 - DNA, 101 bp, rice(Oryza sativa)
  misc_feature (71): n=t or g
gggtaaaactatgttcaatgcatcaatttggtttagactattctatttccactagttttgtcgcatcttanctattttgcaggtaccactcaaataatgaa

SEQ ID NO: 781 - DNA, 101 bp, rice(Oryza sativa)
  misc_feature (71): n=t or c
cactgtgaatggcctaagattaaggtaatgtgaaagctatgggtcccactgttaattactccctccatccnaaaatgtttgacgccgttgacttttttaaa

SEQ ID NO: 782 - DNA, 101 bp, rice(Oryza sativa)
  misc_feature (71): n=t or c
atccccaaatacaagggattctaggttatttgaggtaaattaattatagagaaaaaagacaaaatgcctcncattaaataaggatatgtatggagtggggg

SEQ ID NO: 783 - DNA, 101 bp, rice(Oryza sativa)
  misc_feature (71): n=t or c
aagctccagtgccagcccctattcctgctactaggcctgcacctgctgctagacctgcacctcccaaaccngagaagcaatctcctgcccctccggctcct

SEQ ID NO: 784 - DNA, 101 bp, rice(Oryza sativa)
  misc_feature (71): n=a or c
ttgcaatataaacaagcatcttcctgtgtccagaacgttcagcaacccagaaaatcaaaaatagaacaganaccacagccacacatgaataaacaataaaa

SEQ ID NO: 785 - DNA, 101 bp, rice(Oryza sativa)
  misc_feature (71): n=t or c
ttaagggtgtgtttggttgctcgtatctgtctagcctggctcatctcccttatccaggttgagcttatccnaattaatgggatacacatgcagtcgtttgg

SEQ ID NO: 786 - DNA, 101 bp, rice(Oryza sativa)
  misc_feature (71): n=a or g
tagtatatgtgaactaccattaccagttcacatttcccacgcaactccactttaagcaccaaccgaacctnaacgaaattaaattaagctaactgcaatgt

SEQ ID NO: 787 - DNA, 101 bp, rice(Oryza sativa)
  misc_feature (71): n=a or c
atggagtcagatgttcatatttagcctagtcatgccaatttaggtgataatttgaccagcttatcttaccnaaaaaaaaaaaagtaaaaacgtgttactct

SEQ ID NO: 788 - DNA, 101 bp, rice(Oryza sativa)
  misc_feature (71): n=a or g
tagtaaataggatgggatggtcggttcggttcgtatcacgcaaatggggtggtaggaatcataaaagtganataaaaatctggaggaaacgagcgggcaag

SEQ ID NO: 789 - DNA, 101 bp, rice(Oryza sativa)
  misc_feature (71): n=t or c
taccaatacactccacagctactggtgttcgataaaaaaatgtttcatgaatttgagggcaaagagacacnacctccgcattcagtgattcagtgcaaaga

SEQ ID NO: 790 - DNA, 101 bp, rice(Oryza sativa)
  misc_feature (71): n=a or c
gattcgtgactacggatagccatgcttataggtataaatagatacggaattgagactcaaagtaaggcaanttttagagagaaaagttagagtttcctttg

SEQ ID NO: 791 - DNA, 101 bp, rice(Oryza sativa)
  misc_feature (71): n=a or g
agttttctgtgcatcaatcagagtacgtgcagaatgggaaatgcgtgcataccttggagagcaacgagganaggagatcgtcttcttcctcctcgtgatct

SEQ ID NO: 792 - DNA, 101 bp, rice(Oryza sativa)
  misc_feature (71): n=a or g
ttattttatacgtatatctggcactttattccgggggtatttcagtaaacctcgtctcagtgggtaacccnctgctgtggttggcttaaccgaaccccagg

SEQ ID NO: 793 - DNA, 101 bp, rice(Oryza sativa)
  misc_feature (71): n=a or g
gctagtttccagatgacactcactcccaattcaagctagaaataatcccagagagagggcttaccgggganaaggtcaggagccatccgagccggcgctcg

SEQ ID NO: 794 - DNA, 101 bp, rice(Oryza sativa)
  misc_feature (71): n=t or g
aggcgtagaaagagagctccacgatatgcacgcgcgttcgtacgcatgtgcagcacaacagctcggcgggnggcgccggccggccaacgcaagcggacaca

SEQ ID NO: 795 - DNA, 101 bp, rice(Oryza sativa)
  misc_feature (71): n=a or g
cgaggagggtgtcattaattagcgccacaatcattcagctgtggcgcaatgataccggtcttgccaagccnaagctaatctgcgtctcacacttcacgcac

SEQ ID NO: 796 - DNA, 101 bp, rice(Oryza sativa)
  misc_feature (71): n=t or c
atatgagaaatactatgttaactgaattcatttccggaaagtttccgatggatagtagccttattatattngtttccgtttccgaaagtttccgaaaaaat

SEQ ID NO: 797 - DNA, 101 bp, rice(Oryza sativa)
  misc_feature (71): n=t or c
tctgagagatggaattcaatctaaatctttttgtggcaatagactggaagaatttagtgttctcctctccnaacaacatccatctgtttgtacatcttttt

SEQ ID NO: 798 - DNA, 101 bp, rice(Oryza sativa)
  misc_feature (71): n=a or g
gatcattgactcaaactgtgccctacaagtgtacatgttagcatgttaattagagaggtgtccagccaacnacacaccttggacagctagctactccctcc

SEQ ID NO: 799 - DNA, 101 bp, rice(Oryza sativa)
  misc_feature (71): n=a or g
tttgatatggaaggagtattttatgctgcttctattaatatcgtgtgactcggcttataaacagtggacanaaaaaaaaaataaaagcggcttgaaagtaa

SEQ ID NO: 800 - DNA, 101 bp, rice(Oryza sativa)
  misc_feature (71): n=a or g
cgcccacgcgtacgcagtagagaggaggatagagctagctcgctctggtcaacacgtgcacgtccatggcnccggccggtcatggcgagcggcactggaga

SEQ ID NO: 801 - DNA, 101 bp, rice(Oryza sativa)
  misc_feature (71): n=a or c
cccaaattatatgcagcctctttttgtggagatatcttcatgtcatctcgtggaaaagcttcagtaatganagcgaaagacgtagcctttcaaggcagaaa

SEQ ID NO: 802 - DNA, 101 bp, rice(Oryza sativa)
  misc_feature (71): n=a or g
gcgccgccagcggcgagaggccaatcggtgcgaactctgatccctcaagctctggcatcgcagattgcccnggttgaagtccaaatcctcaacggcaacaa

SEQ ID NO: 803 - DNA, 101 bp, rice(Oryza sativa)
  misc_feature (71): n=a or g
ctagtgatttcatcctgttgttttaattacatgatccatcatccatgggatcatctctaggaaattgcacnaactcatgttttattcttatgaaccatttt

SEQ ID NO: 804 - DNA, 101 bp, rice(Oryza sativa)
  misc_feature (71): n=a or g
ttccttttctctcctcttccctttctttctcctccttttccccgcccgctttaataattttatcgtttagngcacccgcaatggtaaagtaaagtgctctc

SEQ ID NO: 805 - DNA, 101 bp, rice(Oryza sativa)
  misc_feature (71): n=t or c
ttaaggtaggagacgacgagcacattcgtgagagcggagaaccccagcctcgccatgggttttgtcgattngctagccgctcaaactcctccccctagaca

SEQ ID NO: 806 - DNA, 101 bp, rice(Oryza sativa)
  misc_feature (71): n=a or g
attaatgcgaagagaaaatgaggacgacgaggagggagcattgctggttcaatggctaaacaagaagaagnatattgaagttgtattaaaaatgtctaatg

SEQ ID NO: 807 - DNA, 101 bp, rice(Oryza sativa)
  misc_feature (71): n=t or c
ccatggaactcccgagcggttgtggttgtacctgtacttgcagaaatccgtgtcccgcccagcaagaaaanggctgcgcattattttactaacgcgcgacg

SEQ ID NO: 808 - DNA, 101 bp, rice(Oryza sativa)
  misc_feature (71): n=t or c
gcaataacaacactcctctcataagtttctcatgaaaccctaatacaaagtgttatcaactctctaatctntcaaacttagcttaccctcaaggcatagcc

SEQ ID NO: 809 - DNA, 101 bp, rice(Oryza sativa)
  misc_feature (71): n=a or c
acggcttggaatctcggggaacgaattaaacaaacgccattagcttccaaattaagcgacaatccaaccancccgtcctgtcactggcactgtcactgccg

SEQ ID NO: 810 - DNA, 101 bp, rice(Oryza sativa)
  misc_feature (71): n=a or g
ctgtttcaaaataaatcaatctggaatgtgaaaaatctggacagagaatatgttcaaatttattatagatntatcacattctagtcaaggttggcttgttt

SEQ ID NO: 811 - DNA, 101 bp, rice(Oryza sativa)
  misc_feature (71): n=t or g
caaaacacacaccaaattaactatgagaccaaatgaaccctttcccctttaatttgctcttcttttactgncaaggtagcacatcaaagaaaggagaaaaa

SEQ ID NO: 812 - DNA, 101 bp, rice(Oryza sativa)
  misc_feature (71): n=t or g
gcttagcatgtgtatattgttacatactgcatttctgaatttggttgttcaatggcagtcattggcctggntacaacatcttctgttttgctatgattcta

SEQ ID NO: 813 - DNA, 101 bp, rice(Oryza sativa)
  misc_feature (71): n=t or g
aaagggcccagcgccgacgcgcgctcgcgtcatcccacctttttttttcttttatttaccgattttttcgntttttttcacacttttttctgattattttt

SEQ ID NO: 814 - DNA, 101 bp, rice(Oryza sativa)
  misc_feature (71): n=t or g
acctgcaaaatagttgcaaccatcccagaccaactcttctcctattatcttcttctcgactttcattgctngtagatattattcatatgtatctatatgat

SEQ ID NO: 815 - DNA, 101 bp, rice(Oryza sativa)
  misc_feature (71): n=a or c
gccaccgagtcaagaaaatgcaagaaaatcttggggattagaagaggagaatcgtttgtaggtaaaacaanaagaaattaaagaaataaaaatcaatagaa

SEQ ID NO: 816 - DNA, 101 bp, rice(Oryza sativa)
  misc_feature (71): n=t or c
ttgaactcacatccagtgtcgctgagattttttttatttcaaatgtttgtcattgatttctattggtatgnaggctctttatgcttttgtgtcaaaagtaa

SEQ ID NO: 817 - DNA, 101 bp, rice(Oryza sativa)
  misc_feature (71): n=a or c
gacattataaatttttagcttgtcaataaagttaagcatggctacaatccaggtccatacttgagtagtanactacagtatcgtcacgactgaatttctag

SEQ ID NO: 818 - DNA, 101 bp, rice(Oryza sativa)
  misc_feature (71): n=a or g
ctgatcgggacggcttccacgtgtgccgtgctctagatactcaactggggcggtagggaaaggggagaggnggtggcggcgaggccggaggaggcgagggc

SEQ ID NO: 819 - DNA, 101 bp, rice(Oryza sativa)
  misc_feature (71): n=a or c
ttggttccaatgtggcccaagaggaatgtaacctcctaaaaaaggaataaaagtccacttcaggtccctcnatatagcttcagtattaaaacgtgcaattt

SEQ ID NO: 820 - DNA, 101 bp, rice(Oryza sativa)
  misc_feature (71): n=a or g
ttagatagaatattaatgtcgacagtgtgggaacaaaaaaattccactgtccatagtgtttgctttcaatngagacataactaattacacttctttacttt

SEQ ID NO: 821 - DNA, 101 bp, rice(Oryza sativa)
  misc_feature (71): n=t or c
tttttagggagaggtggaagagctctgtgtattctcttatcaggccatttgtaactgctagcgctggaatncaatgcgctcacggggttaaattgagagga

SEQ ID NO: 822 - DNA, 101 bp, rice(Oryza sativa)
  misc_feature (71): n=t or c
gtttgatggcctctaagaataaataaaacatggaataagagaaaagtattcaaatcatatcataatgtgangaaggagtgataactgaacgaaaagatata

SEQ ID NO: 823 - DNA, 101 bp, rice(Oryza sativa)
  misc_feature (71): n=a or c
gtttagagtttttgtttgatgataactaatttcagtcaagagtagaatgacacacgatggtaaaaaaaaanaaaaaaaaaggagattgagtagaatgacat

SEQ ID NO: 824 - DNA, 101 bp, rice(Oryza sativa)
  misc_feature (71): n=t or c
gtttcttgtgaaagattccctatttatttgtttttctgttacataaaagacatgtacacgtgcacaccacnatacacagtcacgagtacatccttaacatg

SEQ ID NO: 825 - DNA, 101 bp, rice(Oryza sativa)
  misc_feature (71): n=a or c
gtaatatgcacagagagcagaggaaatgctgcctgacacggtgcaaataaacctaagaaaaatatctgttnagaaaacaattgttaaatatactccactgt

SEQ ID NO: 826 - DNA, 101 bp, rice(Oryza sativa)
  misc_feature (71): n=a or g
cgtaatcaaattacacatagcaacattttgggtatacagccttagacagaaaaacaaaggatttagctgcnatctagccatagaactaaaattctatataa

SEQ ID NO: 827 - DNA, 101 bp, rice(Oryza sativa)
  misc_feature (71): n=t or g
gcaaaactgatacgtgtacacatggatggaattttgcttgtgggacccaccaaacatcaacgtagactttnttttttttttttgcctggtttagttcccaa

SEQ ID NO: 828 - DNA, 101 bp, rice(Oryza sativa)
  misc_feature (71): n=t or g
gaaaccatattaccaattccccaagcattgcagcagcttgtttaatttgctgcaaatttatgcttctgggnttttttttttagtttgttttgatcgcactt

SEQ ID NO: 829 - DNA, 101 bp, rice(Oryza sativa)
  misc_feature (71): n=t or c
gccgggtcagatcgatggtagcactagcttctggggcagccactccacgatgtttccggtgccaccgccgnatggggagggagggggtggttgtgggttct

SEQ ID NO: 830 - DNA, 101 bp, rice(Oryza sativa)
  misc_feature (71): n=a or g
aaaatatgggctttttagggaattggatatagtgtgatgagaagttgcaactgttagaagctccccaaacntatcctaattatttaattccctcaatcaat

SEQ ID NO: 831 - DNA, 101 bp, rice(Oryza sativa)
  misc_feature (71): n=t or c
acgagattttggataggaattggtacctcttcagcacctaccgaatcaaaagtagatttaggcaacggtcnaggcttgagaaccacaggtcttggtgcacg

SEQ ID NO: 832 - DNA, 101 bp, rice(Oryza sativa)
  misc_feature (71): n=t or g
caggttaggtgctacgccacctgtctgtcaaactgctttcctccccctatctatacttgtgtacggttttntgctgcgtctagagactgttcgtgcaatta

SEQ ID NO: 833 - DNA, 101 bp, rice(Oryza sativa)
  misc_feature (71): n=a or g
agcaaattctctcaaattccaaacttcaaattattcccttagtttatcctattaatagtgagaatttgctntacttcaaaccctagtgaaacccctccaaa

SEQ ID NO: 834 - DNA, 101 bp, rice(Oryza sativa)
  misc_feature (71): n=a or g
gctataggattggctgttagtctactctattgccaattaggaatttaatgtctgcattagagatggcaacngggaattaactgacgaggaatgtatctccg

SEQ ID NO: 835 - DNA, 101 bp, rice(Oryza sativa)
  misc_feature (71): n=t or g
aggactactcaagcagatgattttagccgttgtctcctatttgtcttgagaaacaatcggtcttctttcancttaaatttgaattttaaaactgaatttta

SEQ ID NO: 836 - DNA, 101 bp, rice(Oryza sativa)
  misc_feature (71): n=a or g
cacataaaatacaaaaaaaaagacatacccaaatcaatgtgggtaaaataaagacacccaaatcactgctngagaaaggggcttcagacccggttgataac

SEQ ID NO: 837 - DNA, 101 bp, rice(Oryza sativa)
  misc_feature (71): n=t or c
aaagtattatagcaacaattagtaccagaaaaactagctagcgcgcaccgccagcgcgcgcttcgacgaantaatttataactaactagttagttaaggat

SEQ ID NO: 838 - DNA, 101 bp, rice(Oryza sativa)
  misc_feature (71): n=a or c
aagattagacaaccgtgaaatgtcagtttggaactttggctttggctgctgatgacttctgcacctctcantccaattaccaggacgaacttaagtaactt

SEQ ID NO: 839 - DNA, 101 bp, rice(Oryza sativa)
  misc_feature (71): n=t or g
acctggcggagatagctccggcgcggtggcgcggggcgttcacgagcatcttccacttcttcctcaacgtngggatgttcgtggccgacctggtgaactac

SEQ ID NO: 840 - DNA, 101 bp, rice(Oryza sativa)
  misc_feature (71): n=t or c
gattagattttacgattatactatggctcttaaagtcataattgctataaattgaggttgctccaccctancaatatcactattggttttgtgcatgaatt

SEQ ID NO: 841 - DNA, 101 bp, rice(Oryza sativa)
  misc_feature (71): n=t or c
actaggttgctggatggtatgtgatcatatatattcttccatgaccacgacatctagcgaaatttgttaantagtgggttaaattttaaagttattttaat

SEQ ID NO: 842 - DNA, 101 bp, rice(Oryza sativa)
  misc_feature (71): n=a or g
atgggaatttttagaatgtggattgagtgagtctgttgatccatgattcaacgggatcgatccattatgantccattatattaatcgttaatccatagata

SEQ ID NO: 843 - DNA, 101 bp, rice(Oryza sativa)
  misc_feature (71): n=a or c
gaggaacgaagtggttcgcacgcatgcatgacgcgcgttctgtggtgtggtgtggtgttcgacgtacgtgnagatgaagagcagctgacgaacgggttcct

SEQ ID NO: 844 - DNA, 101 bp, rice(Oryza sativa)
  misc_feature (71): n=t or g
ttcttagaactggaaactgagttcacagcagagtagttctgatttggtttatttgtgtttaatagtatccntgttgtctcaggtatttgggttgattggta

SEQ ID NO: 845 - DNA, 101 bp, rice(Oryza sativa)
  misc_feature (71): n=a or c
acgcatacacagaatacaaaaagaagcgacacacactacgtacataattaaattggatttacgaatccacnaggggccgcaaaacggaaggttcgaagcta

SEQ ID NO: 846 - DNA, 101 bp, rice(Oryza sativa)
  misc_feature (71): n=t or c
aacatatataacataataatccacaacaaacatacataacaatttaacatatacatatatgagaagaattnaattatgtaaacggagacctacgtacgtac

SEQ ID NO: 847 - DNA, 101 bp, rice(Oryza sativa)
  misc_feature (71): n=t or g
aaaataaaagaactctagataatggtggaagcacatataacgacttgatgctatatgttgacaattctttntttttttttttggaacattgtgtctggata

SEQ ID NO: 848 - DNA, 101 bp, rice(Oryza sativa)
  misc_feature (71): n=t or c
aatggatcggcactggcagttggcaaatgctagctaaaatgctgtattatcactggcctttggtctctggnggtgtcacctgctgcttgtgaaaacctatt

SEQ ID NO: 849 - DNA, 101 bp, rice(Oryza sativa)
  misc_feature (71): n=t or c
cttttcttttatcctctatctgtacataaacacaagcaattttgttcatcctatagcacctatttctcttnggttaataggccgcatgctttattgcatgt

SEQ ID NO: 850 - DNA, 101 bp, rice(Oryza sativa)
  misc_feature (71): n=t or c
atttgtaataaccaatattctgaataagaaataaaaaatagtgaaagaatggtccgagtagaacccaatangagattaattaaaattcataataaaagtta

SEQ ID NO: 851 - DNA, 101 bp, rice(Oryza sativa)
  misc_feature (71): n=t or c
catacataaattctcttgcaaacttgttacgaacactgacatggagccacatcgtggctgtgtcttaattnttcattaaatcaaaatcttgatatttttgt

SEQ ID NO: 852 - DNA, 101 bp, rice(Oryza sativa)
  misc_feature (71): n=t or c
gctctggttgtttgcaaacagttagctgagaccaaacaccaactgcattatacatgtgctttctgtagtgnacagcaaatatatcaaatgacaggaggatg

SEQ ID NO: 853 - DNA, 101 bp, rice(Oryza sativa)
  misc_feature (71): n=a or g
atattgatatgtatctcttcatcctctccccatcgtcctcgatgaaaatatctatttcatcgtgagatgantcacaaaaagttccataaaaggtgattttc

SEQ ID NO: 854 - DNA, 101 bp, rice(Oryza sativa)
  misc_feature (71): n=t or c
ttgtgccagctcggtacgctgataaaccaatagcatgtgaatggctcgatagcccaacaaacacaaggccnaggctgcgaggtcaccccggccagctcacc

SEQ ID NO: 855 - DNA, 101 bp, rice(Oryza sativa)
  misc_feature (71): n=t or c
acagcctcctcatcctcagcagatagctgctcacccagagcagcatttatctcctgcaatcaatattggtngataagtaaacaatataaggaggtccatgc

SEQ ID NO: 856 - DNA, 101 bp, rice(Oryza sativa)
  misc_feature (71): n=t or c
ggaaaaaaatggggtgcccgcggagccgtccgatctcatcacgcgcgttctactgtcaggatcttccccgngtcacccgttgccagggtttcccttaccgc

SEQ ID NO: 857 - DNA, 101 bp, rice(Oryza sativa)
  misc_feature (71): n=c or g
acatcgacaccgaggacgtcttcaccttcatcaacagcgacgacacgttcggcatcaacagcgacgaggtngagctcgatcccaacttcaggcccaagcct

SEQ ID NO: 858 - DNA, 101 bp, rice(Oryza sativa)
  misc_feature (71): n=a or g
ccttgtcaaccacagttttgagctcttctttctttgggagctgggataatcaaaacattttactgttagtnacttgctacctttgctcaagacatgcttac

SEQ ID NO: 859 - DNA, 101 bp, rice(Oryza sativa)
  misc_feature (71): n=a or g
ctccgtctatgccgagacgtcctcctccgttgccgccgacacttttgtttaaaccccacgggatatatttntattaaagtagagggaaacgctgtacaata

SEQ ID NO: 860 - DNA, 101 bp, rice(Oryza sativa)
  misc_feature (71): n=t or c
acaagatgtttgaatcaagatggaggacaattgaaaagaagctggcttccattgccacagaggcgcacgtngaggttgacagggctgactcaaagaggagg

SEQ ID NO: 861 - DNA, 101 bp, rice(Oryza sativa)
  misc_feature (71): n=a or g
gcggctgccagcgacgttcggccaagggttgctgtaactctgatatatacgctgtaatatgttggatcggngatgtgtacccgttatcagtgcctcgggga

SEQ ID NO: 862 - DNA, 101 bp, rice(Oryza sativa)
  misc_feature (71): n=a or t
cctgtccgttcttgctgttgagtgccagcgagcagtgttactctgtttttcatgaaagtacttttcattcngtagatgtttacatccatagatgtatgagt

SEQ ID NO: 863 - DNA, 101 bp, rice(Oryza sativa)
  misc_feature (71): n=t or c
tgttagcaagatattctgcatgaatgataatggtgttcatgagttttacatacttcaactgcaaagttatntgtctggcatttttttttcttcacaaagcg

SEQ ID NO: 864 - DNA, 101 bp, rice(Oryza sativa)
  misc_feature (71): n=a or g
ataggtggagtcatgcatactacaccttaaccaaaatcaccgtcaatgcttctccttggttttaaaaatcnagggtgaaaaataaccgatattgtagttct

SEQ ID NO: 865 - DNA, 101 bp, rice(Oryza sativa)
  misc_feature (71): n=a or c
ggtggacaattggacatattagaagaatattacttcgatatggactctattgtatatgttagaggagtttntatagagagaggcacggtaggatcttagac

SEQ ID NO: 866 - DNA, 101 bp, rice(Oryza sativa)
  misc_feature (71): n=t or c
ttctttgggaaagaatagcttagatggtcaaataccagccaacttaggaaatcttcggcagctagatcgtntcaactttagttacaacaatcttcatggta

SEQ ID NO: 867 - DNA, 101 bp, rice(Oryza sativa)
  misc_feature (71): n=a or g
tattgaactttcaagttaatttttctaaacaaatcgatcacatgagaaaagtgaattcataaaattgcaanatcatatcgtactcactaggaccatataaa

SEQ ID NO: 868 - DNA, 101 bp, rice(Oryza sativa)
  misc_feature (71): n=a or g
tgtagagtagtggtgtggatatagtcaattaaaggttttgggttagatcggaccagtttattctcgacacntagatcgtttatgaccgtccagttagaaat

SEQ ID NO: 869 - DNA, 101 bp, rice(Oryza sativa)
  misc_feature (71): n=t or c
caactttgccatactaaatagcaccatgtctattctgctccccacattgagatactcatatcagtaccagntgggcatccatagatttgaacaagaccact

SEQ ID NO: 870 - DNA, 101 bp, rice(Oryza sativa)
  misc_feature (71): n=a or c
taattgcgagtgaatcatgctcgtggttatcttcaatttgacacacctcaaactccaaatcaaccaggacngctttcgggatagcaaaaattgtcagatca

SEQ ID NO: 871 - DNA, 101 bp, rice(Oryza sativa)
  misc_feature (71): n=a or g
tcagctagtaatctatcatctctactcggctgctcctagaattgcaagtttgcaacatgtcaaaaagaacnttgttgaatgttattaaagttgcagcagta

SEQ ID NO: 872 - DNA, 101 bp, rice(Oryza sativa)
  misc_feature (71): n=t or c
agagcacatgaaacggtacattggtacagtacaacaagccaaatgctcgcctcttcttggctgttttcacntccacagaactgatgtctgatgcagagtct

SEQ ID NO: 873 - DNA, 101 bp, rice(Oryza sativa)
  misc_feature (71): n=a or c
gccccctcgcacaccattttttttttacacgcagagaagaagagacattatcacattaggcacgggcttanttatctagcaacaaattagctacagaatga

SEQ ID NO: 874 - DNA, 101 bp, rice(Oryza sativa)
  misc_feature (71): n=a or c
ttcaatgtttcaaagcagcattcaaggattctcctgatattattgctccggttcagtggtcaatgcacttnttttagaagcttctattatttcgatatgat

SEQ ID NO: 875 - DNA, 101 bp, rice(Oryza sativa)
  misc_feature (71): n=a or g
actagtggttgtaccaaagagagagtgacggtggatgcttaatgctgttctagtaggcataggaaggaggnggagggggggggggttgagagtaagagagg

SEQ ID NO: 876 - DNA, 101 bp, rice(Oryza sativa)
  misc_feature (71): n=t or g
tggcctacatgcacctttgatcgatacgcataggacaagacacaggtcgttgcaaattacaaaagcctacnactatagtagagaaactgccgctttggcgg

SEQ ID NO: 877 - DNA, 101 bp, rice(Oryza sativa)
  misc_feature (71): n=a or g
atcccgattggtccccgtggcgcagcgtggcgtgagatcttgttatactagtatttaattgggatttgggngggggggggtgcgtatgcgtgcgtgtgcgc

SEQ ID NO: 878 - DNA, 101 bp, rice(Oryza sativa)
  misc_feature (71): n=t or g
ttgtggggaaaatgtgtattagtgatgtttgtagcacatatcatgtcaataccaactaaatgaactgactnatgatacataaccatggataaattgagaga

SEQ ID NO: 879 - DNA, 101 bp, rice(Oryza sativa)
  misc_feature (71): n=t or c
tgtactatttctcgagagaatgaagatgataaacacgacatatttgtttagtattactgtcattttcattngtgtactgtaaaattttttactacgattaa

SEQ ID NO: 880 - DNA, 101 bp, rice(Oryza sativa)
  misc_feature (71): n=t or c
ttttcgcaatcctgcgatttaaatggtccttagtgtacgggtgcatttatatggtgaatgtaagctgtgtngttagcggtaatgtgtttaaaaagaagaaa

SEQ ID NO: 881 - DNA, 101 bp, rice(Oryza sativa)
  misc_feature (71): n=a or g
gcagcggttggatcctagttaggcacggggtgctaacgctacgctgtccatgatcgtgatctctcacgaanagtgacagaatactgctgtatcagtagtac

SEQ ID NO: 882 - DNA, 101 bp, rice(Oryza sativa)
  misc_feature (71): n=t or c
cttggagctgaaactagctccttgaaaatattaaatatgtatatggtcctttcaaaatacgatgctatctnctttatgattttgtttagcgtaattatgta

SEQ ID NO: 883 - DNA, 101 bp, rice(Oryza sativa)
  misc_feature (71): n=t or g
gagagtatcagcggcaacatcttttcaccgtgatccagaaaatctatatcgcatattacaccagtacaatncttttgttctttgaaacccatgcattcatg

SEQ ID NO: 884 - DNA, 101 bp, rice(Oryza sativa)
  misc_feature (71): n=a or g
accgatcgggcgagcaaatatggcaggaagggggacaagattgcacagggcatcaaagaacatggtaagancaatcatctttgattttttcaacacggaag

SEQ ID NO: 885 - DNA, 101 bp, rice(Oryza sativa)
  misc_feature (71): n=t or c
acaatttttactgcttgctgagccaccgtcgcagggatttttacccgtcacatcgcaacgtgtgggtatgnagtaccgtcgggcgtcggcagtctcgttga

SEQ ID NO: 886 - DNA, 101 bp, rice(Oryza sativa)
  misc_feature (71): n=a or c
cgcagtagttggactgttggagtgttggatcttggaggcgccatgcgatgcaagactcctctcgtcacganctcccggtgtggacgtgtggtcatccatgc

SEQ ID NO: 887 - DNA, 101 bp, rice(Oryza sativa)
  misc_feature (71): n=a or g
gacgctttctggccgtatttttctgctcaatggctgcttagctttgctccgcgatcaagacatgtcaaagntgtggtagggatgtactcccccgtcccgaa

SEQ ID NO: 888 - DNA, 101 bp, rice(Oryza sativa)
  misc_feature (71): n=t or c
tgacatgcaaggatgtttgcaatcaagcgagtacaattctttcttcttttctttaacttttggttatgtanaaaccctcttctattaatatagggttaatt

SEQ ID NO: 889 - DNA, 101 bp, rice(Oryza sativa)
  misc_feature (71): n=t or c
gcacggggtgttttgccacattcaggtatttaacacgccgcaaggaccagtgcatttcctaaattaccgtngtgaaaactaaattcaaatgtgtgaccgta

SEQ ID NO: 890 - DNA, 101 bp, rice(Oryza sativa)
  misc_feature (71): n=t or c
gttgaagtttagaactcagtcaattgtgtgcactcgtttgatagtgctatttaccactactataaagaggngatcaaacaggcactaacacgtactctgtc

SEQ ID NO: 891 - DNA, 101 bp, rice(Oryza sativa)
  misc_feature (71): n=a or g
ccacatgaaaaccgtaggattctggttactataggattcggcactgtagtgtcctttgattatcaggattnaggtacaataaagttgaaggaaattttcct

SEQ ID NO: 892 - DNA, 101 bp, rice(Oryza sativa)
  misc_feature (71): n=t or c
accagatccttctggctcctacctgtccggccccgcaactcgaaaagccgaggatcccaacttcccaagcnccaccctgttcactccaagcaccaaactac

SEQ ID NO: 893 - DNA, 101 bp, rice(Oryza sativa)
  misc_feature (71): n=t or c
aaaaagctatacatactcattttcttttaccaacaaaattcttactaacactaatttatcatgttatgagngtatatagattttttataatttttatctat

SEQ ID NO: 894 - DNA, 101 bp, rice(Oryza sativa)
  misc_feature (71): n=t or g
catttgcctcgcatcgcatgtgcatcgcgccacattcctatgcccttgatgactcagccgggagcaataanttacgccggccttgtcacggattttaggcc

SEQ ID NO: 895 - DNA, 101 bp, rice(Oryza sativa)
  misc_feature (71): n=a or g
gccacgtcaacactacaaagaacaaatacttcggtcaacaacgccacataggcgtcacgttagcaaaaccntcctccaaaaccatcgagagagtcaaattg

SEQ ID NO: 896 - DNA, 101 bp, rice(Oryza sativa)
  misc_feature (71): n=a or g
gctcaggggcagcaagcccgtgcatgtctcctgcagcatcgtgaccggcggtggcggagacgaagggctcntcgtcgtgatgcccgacgacggcgctgggt

SEQ ID NO: 897 - DNA, 101 bp, rice(Oryza sativa)
  misc_feature (71): n=a or g
tatatcttgatgtggaagttcaatcctcatgcaagtgattctacaactactgcatcttaatttgtacagtntgactctacaactactgcagatgacctgat

SEQ ID NO: 898 - DNA, 101 bp, rice(Oryza sativa)
  misc_feature (71): n=t or c
taccacataagtgcacttgtggaccaacctcctttagccaaaagaaaagggagaagataagaaatgttacnaattgcccatatccatgatatagtccttaa

SEQ ID NO: 899 - DNA, 101 bp, rice(Oryza sativa)
  misc_feature (71): n=t or c
tttagggaaacatattattttcttgtgttcttcctagcatcacaggcagtcatggattgcactgaacatanactacctccgtccgttttttaatagacgac

SEQ ID NO: 900 - DNA, 101 bp, rice(Oryza sativa)
  misc_feature (71): n=t or c
gatagatagatagatagatagattatcttagccagaaaagggacatggcttccaaatttcctggtacaaancaaatctaatgcaaattgatcttatcaatt

SEQ ID NO: 901 - DNA, 101 bp, rice(Oryza sativa)
  misc_feature (71): n=a or g
ttgagcactaacatgtgggtatccctttccggtaaatctggggcaggcaattggttgctagttgaattttnagatttatttttaatccatgcaaccagcgg

SEQ ID NO: 902 - DNA, 101 bp, rice(Oryza sativa)
  misc_feature (71): n=a or g
accctcacccttgccaacgtcaacgttgctcacatattagtacttactctattttttaattgagaacaccnttgacttttaaaaacatatttggtcatccg

SEQ ID NO: 903 - DNA, 101 bp, rice(Oryza sativa)
  misc_feature (71): n=a or g
agggactattatatttttagatgaaattgtcgagaggtagtatcgaggccttggattcagggtgtgtttanttgggaaaaaggaaatttttagatgtcaca

SEQ ID NO: 904 - DNA, 101 bp, rice(Oryza sativa)
  misc_feature (71): n=a or t
aatttttcgacaaacatacagaccggtctcttttaacgtagaaacacataatgtaatacttcttttttttnaaaaaaaagccctcataaagaacaaagcgc

SEQ ID NO: 905 - DNA, 101 bp, rice(Oryza sativa)
  misc_feature (71): n=a or c
ctttggacctcgaagtccccaaaaccatcaaattagtcccctaggaaggacagacaacggcgaccatggangccgccgcggccgatctcgaggcgcggcag

SEQ ID NO: 906 - DNA, 101 bp, rice(Oryza sativa)
  misc_feature (71): n=a or g
catagtgtaacctattcgactaagtctgtgagattctaaatggtggaccttggcgatatggtcggtggctnggctttgggattccttcgaatatcaaatcg

SEQ ID NO: 907 - DNA, 101 bp, rice(Oryza sativa)
  misc_feature (71): n=t or c
tccgatacaccgtcttaagtaccagagcctccagttccaggaataaatttctctctctatctctctccccnttttttttatttgcgatgagaaatagtaaa

SEQ ID NO: 908 - DNA, 101 bp, rice(Oryza sativa)
  misc_feature (71): n=a or g
aaacaaactggtgttttcaccctctgaagaattccatttggcctgcagatcggtaacctggagtggcagtngtgaagagccgagacggcgacttcaggaca

SEQ ID NO: 909 - DNA, 101 bp, rice(Oryza sativa)
  misc_feature (71): n=t or c
tttggtgaggaaaacaataccatgagaagaaaatatagtacgcatcgcgaaaacgattatgctacagacgngctaagcgcaactacatttagatgtagaaa

SEQ ID NO: 910 - DNA, 101 bp, rice(Oryza sativa)
  misc_feature (71): n=a or c
agcagttcagcttatcttgccacattttcacaaacctgtaaaagatggctataagacttttcttttgacanaaactagatttgaagataatatgaaatgca

SEQ ID NO: 911 - DNA, 101 bp, rice(Oryza sativa)
  misc_feature (71): n=t or c
ctaatccacgtgaaaccgaaatagccacggaggttggtggggcccgcgcgatcttgtttaacggaagccanactgaccgaggaagggccccgcgggccagg

SEQ ID NO: 912 - DNA, 101 bp, rice(Oryza sativa)
  misc_feature (71): n=t or c
gaccatcagatcatctcaaaatttatgcatgaagaaaaaatactataaaaaaatcttcacacgtatcatgngtaagatcacagtactatctaaccaaagca

SEQ ID NO: 913 - DNA, 101 bp, rice(Oryza sativa)
  misc_feature (71): n=a or g
tagcagattattaatgccttacaattttcattcactgcaatgatacctagtcagggtgcaatgagaaaaangccatctttatttttagcattaacaccaat

SEQ ID NO: 914 - DNA, 101 bp, rice(Oryza sativa)
  misc_feature (71): n=t or c
gttgatgaccaaaaaatcaaacacatcaattcacacaaccggtgtggtgtgggcagcgtgacagtgtgtcncccccgcctcgccacctaaaaccccacacc

SEQ ID NO: 915 - DNA, 101 bp, rice(Oryza sativa)
  misc_feature (71): n=a or g
gccggtgcaggtaccgtcttgcttttctttctttttggttttaattttgagttgatcttcagggaccttcngggttctctttccagcagagctctggctga

SEQ ID NO: 916 - DNA, 101 bp, rice(Oryza sativa)
  misc_feature (71): n=t or c
acatggatcatgagatgcacaatatctgtctgcgggtggcatctgtgtcgagtgaccaactgaccatgcanggtcaagttcgggagtcctgctgctagagt

SEQ ID NO: 917 - DNA, 101 bp, rice(Oryza sativa)
  misc_feature (71): n=a or g
ttggcttttcttgattaatcttacccaatttgcaaggtgggttcagagtccatggccgcggagtgtggcgncggctgcacgtatgcggcgccattctccac

SEQ ID NO: 918 - DNA, 101 bp, rice(Oryza sativa)
  misc_feature (71): n=a or c
agctagctagctcactgtcactgacacctcttcttccctggaccacacccggccggccagctatctctctntctctctctctctcgatctcacacacacaa

SEQ ID NO: 919 - DNA, 101 bp, rice(Oryza sativa)
  misc_feature (71): n=a or g
gcctcacgtgtcacctagactaagaacaatattagctacttgttttcacagtgcaagttgtctatagtggntcctactagtactaactttatcactttacc

SEQ ID NO: 920 - DNA, 101 bp, rice(Oryza sativa)
  misc_feature (71): n=a or g
gaatataaacaaattagttttttctgataatactccactcagaattattcatccagaaactcaagcacganaaagacaacatacataccggacattagctc

SEQ ID NO: 921 - DNA, 101 bp, rice(Oryza sativa)
  misc_feature (71): n=a or g
atcaacgtgcattgcacatgcacgctcactagtaattatagcttaagacagttttcttatggcaaaatttnctaaaggacacttcaaaattgtgtaattag

SEQ ID NO: 922 - DNA, 101 bp, rice(Oryza sativa)
  misc_feature (71): n=a or g
ttaacggacttcagggagagacagattcaattcgtctgcttcagttcagtacgccagaaaattcatagacntgcagggcgcgttggcgtgtcgaatggtcc

SEQ ID NO: 923 - DNA, 101 bp, rice(Oryza sativa)
  misc_feature (71): n=a or c
tctaacgagaccatatatgaattgaagtgatttgttctttaaaatttagaccagtacagaccggttttgcnataattacgtacactacaaattttgaaatg

SEQ ID NO: 924 - DNA, 101 bp, rice(Oryza sativa)
  misc_feature (71): n=c or g
agccaacctgatattcagaactcagtttcttcaccgataagcccaagaaaggataacccaactcaagtgtntgtgatcttctttttgcagctttacctttg

SEQ ID NO: 925 - DNA, 101 bp, rice(Oryza sativa)
  misc_feature (71): n=a or c
gttacaaaaaataataacacacgtgggacccacatgtcatctctctactccctcttctcctctatatacgnccggagcagaggggcggaagcgggcggatc

SEQ ID NO: 926 - DNA, 101 bp, rice(Oryza sativa)
  misc_feature (71): n=a or g
acaatttttttaattttggtttgtcgtgtactctatgtacttccctcttgtgccttgatatatatccggcngtctcaatattattgggaacttgtcattgt

SEQ ID NO: 927 - DNA, 101 bp, rice(Oryza sativa)
  misc_feature (71): n=a or g
gctggcatccggatgcaatgccctcggaggatggagcaccccttcttagcctcctagggcctctgcaacgnaggcttatgctatgagctggacggccgtag

SEQ ID NO: 928 - DNA, 101 bp, rice(Oryza sativa)
  misc_feature (71): n=a or g
catgctcaaagccagcacagatacacacggtccacgcacggaaatactggatattttaagacggaaataantaatatttgcccttgatatttatagtgaca

SEQ ID NO: 929 - DNA, 101 bp, rice(Oryza sativa)
  misc_feature (71): n=t or c
tgttgatttttttaacggagagggtatatcataattgtactaaccaagtgtcaggcaaagccctaccgccntacctactcatatgtatatattccctccgt

SEQ ID NO: 930 - DNA, 101 bp, rice(Oryza sativa)
  misc_feature (71): n=a or t
gtctgtcaactatcatggatcctaatacctagtgtgccttatgagttatggtggtcattacactctaaaantctaaggataaatggggatcaagaaggtgc

SEQ ID NO: 931 - DNA, 101 bp, rice(Oryza sativa)
  misc_feature (71): n=a or g
gctcaccatcatgcccatgacatgaggccaggatcgactacaccagaatcacatcatgtcattagcagcgnagtcttcacgtgctacggtgctaggatgct

SEQ ID NO: 932 - DNA, 101 bp, rice(Oryza sativa)
  misc_feature (71): n=t or c
ggtctggtcgatcttgaggttgctggccgggttcaagatgttctgttatctcatcccagtatgggttgcangtcattgtgatgaagtaatctggcctccca

SEQ ID NO: 933 - DNA, 101 bp, rice(Oryza sativa)
  misc_feature (71): n=t or c
caagaattatgctcataagaataacatacattattggcactgttcattcctttcgcaagcagatcatccanaactgcttgccacaccctagcacctctgta

SEQ ID NO: 934 - DNA, 101 bp, rice(Oryza sativa)
  misc_feature (71): n=t or c
agctccgtgagacctaacccttccatcttgaccacgcagcccattgaattttgttacgttcctgatgaaanttgtaatgtcaacgtaccagatgacacgac

SEQ ID NO: 935 - DNA, 101 bp, rice(Oryza sativa)
  misc_feature (71): n=a or t
cataccatttcagctggcagaccaatcgtcaagtctgtcttgcattcagacgatggcatgatttttttttntaaaaaaagggtcttgtgagaatttttttt

SEQ ID NO: 936 - DNA, 101 bp, rice(Oryza sativa)
  misc_feature (71): n=a or g
tatttttgtgtcggtaagttccagtgatgagaagcagaagcatatggtgagagatcgtttaaaggcttatntaaagtgcagggcaatttccaacatagtgt

SEQ ID NO: 937 - DNA, 101 bp, rice(Oryza sativa)
  misc_feature (71): n=a or g
tatttataactcaaacttaccagccaagggtattggatttcctgatcacgttgactaacaatatcagcctntcatgatatgtggtgcattgagaaaaataa

SEQ ID NO: 938 - DNA, 101 bp, rice(Oryza sativa)
  misc_feature (71): n=t or c
gtcatgggaattggttatcgcatgttctcactgccaagatagatgatatcataggaagagggtgatcccgnaattctggtttggtgttattacgtgatcct

SEQ ID NO: 939 - DNA, 101 bp, rice(Oryza sativa)
  misc_feature (71): n=t or c
gcctttattagactctgcgccgccgcctcctcttttctattttacctctcgtctctctcctcgcggtcgcntctcgtctcgtcccaatctactcctcctcc

SEQ ID NO: 940 - DNA, 101 bp, rice(Oryza sativa)
  misc_feature (71): n=t or g
ttcattgcagctgttccccaaatctcagtacgcgtttagtttcggtggagagcaaagactgtcagcttgcncacattggtttgtttgcaaaccaggatgta

SEQ ID NO: 941 - DNA, 101 bp, rice(Oryza sativa)
  misc_feature (71): n=a or g
tctcgaaagaaaaagaaaatatcacaacagaacagaacagcatgccttagggacaaaggcaaagagtccancatagatattccttagccgcgtaagccaga

SEQ ID NO: 942 - DNA, 101 bp, rice(Oryza sativa)
  misc_feature (71): n=t or g
cctatacatccgatcttaattgattttacaattaagagatgtgaatcaaactcggtctatcggtagttaanagaggtaaaatggatattttccttttttaa

SEQ ID NO: 943 - DNA, 101 bp, rice(Oryza sativa)
  misc_feature (71): n=t or c
tgagacgtacaagccttagtagcattatagttcttgccagagtcatttgggcttggaagttgtattcaccnagtaggctattacgtccttcaactataagc

SEQ ID NO: 944 - DNA, 101 bp, rice(Oryza sativa)
  misc_feature (71): n=t or g
gtctcggatgcgtcaccgatgcactgcccccataccatcatatctatcctaaacaacacaacaaatcttgngcaactttgcaacacggcctctgcctacga

SEQ ID NO: 945 - DNA, 101 bp, rice(Oryza sativa)
  misc_feature (71): n=a or g
cagtttaaaagatcagaaatcaaataagatgtatagacacctttgactttgactggtagaataatatgccnatatgtacagtgtctgaataactggatacg

SEQ ID NO: 946 - DNA, 101 bp, rice(Oryza sativa)
  misc_feature (71): n=t or c
aagtattgctgcatatactataatatacctgagaaagttgagctgagtcatcagattcaggatggagaagnagctgcatcagaaaacaacaatgcaatatc

SEQ ID NO: 947 - DNA, 101 bp, rice(Oryza sativa)
  misc_feature (71): n=a or c
caaagtaagcttataaatactgcattatccataatggaatggagatccttatgcttattgtggtcgatggnccttttgggctgatcaccaccattcgcagt

SEQ ID NO: 948 - DNA, 101 bp, rice(Oryza sativa)
  misc_feature (71): n=a or g
aatctaaaatgtcaagtacgaatattacttttttggactaaaagagttcaaagaataacctatgctattcnggcacgaagtgccctataggtgagatgcta

SEQ ID NO: 949 - DNA, 101 bp, rice(Oryza sativa)
  misc_feature (71): n=t or c
agtacaagtaggttagcacaatagttgacagtctcatttgatgcagtgtacgagacaaagtttctctctcnctctctctctctctctctctctctctctct

SEQ ID NO: 950 - DNA, 101 bp, rice(Oryza sativa)
  misc_feature (71): n=t or c
aacttttcgatccggccatccaccactttcgcgtgatcagggctccggggcacaaaccaacggcccagggnctcatcgtttggcttttttcgtaacaagcc

SEQ ID NO: 951 - DNA, 101 bp, rice(Oryza sativa)
  misc_feature (71): n=t or c
agctttacaaggaaaggaaaaggaaagcggccgcggacgccagccgccattccaatccaccctatagaagngcctccaactgcagtgccaggtgggccccg

SEQ ID NO: 952 - DNA, 101 bp, rice(Oryza sativa)
  misc_feature (71): n=a or g
cagcccaacaaacaattgtgtctctttaagtgcaactaatgggctataaacctgtgggctagccggatatncattgtagcccatctaataattttctgacg

SEQ ID NO: 953 - DNA, 101 bp, rice(Oryza sativa)
  misc_feature (71): n=a or c
gttggattaaaagatcctattactccaatgcggcggcaacggcgcaggtaggaatggacacacggaggtgngacgagacggcataccagcggcggcggcgg

SEQ ID NO: 954 - DNA, 101 bp, rice(Oryza sativa)
  misc_feature (71): n=a or c
ctcgcctccaactccgcccctctcctcctccatcagatctgccactccactctcctcctccccctccctcncgagccgcgcctcccatggcgaccccgacc

SEQ ID NO: 955 - DNA, 101 bp, rice(Oryza sativa)
  misc_feature (71): n=t or c
aaaatttactgataaattgatgtcatagttaatgttgttttgtttgggcttatgagttactccctccgtcncaaaataagtgcagttttgcactattcacg

SEQ ID NO: 956 - DNA, 101 bp, rice(Oryza sativa)
  misc_feature (71): n=a or g
acatgccaacactgtcacctgcatgtccttcgttgcagggaatcattcaaccatttcatcatgtaggcganagcgacagagcaggacgaccactgatttca

SEQ ID NO: 957 - DNA, 101 bp, rice(Oryza sativa)
  misc_feature (71): n=t or g
tgatgcatgtgtgtgtgtacactgcatgcatgcgtggagggtcaaacagagtcaagactcttgtggtggtntcaataagtctctagtgacaatataagttg

SEQ ID NO: 958 - DNA, 101 bp, rice(Oryza sativa)
  misc_feature (71): n=a or c
acgagtacatccaggtcactcgaaaagaagaaaaaaacctaaaactgatctgatctgatctgataatcatnagtgcttgcagaatcatccggcaagaaaat

SEQ ID NO: 959 - DNA, 101 bp, rice(Oryza sativa)
  misc_feature (71): n=t or c
ttctgtgagggtgaggacaacacgggagaggaggaggacccgtcaggtgactagctagctctgtagccgangactccaaagaaaaatgacaggaaccaacc

SEQ ID NO: 960 - DNA, 101 bp, rice(Oryza sativa)
  misc_feature (71): n=a or c
gggataaggaagctgatgcagccaattgtagaaccaaatgcaattgcaaccttgtggcttttagattttgntggcatcagagtacctattgatagaaggcc

SEQ ID NO: 961 - DNA, 101 bp, rice(Oryza sativa)
  misc_feature (71): n=a or c
ttcacaggattcaaaccgatttggaatatcacacatggcacaactattgtttatacggattctcccttttnaattactgaaaaaccccaaaaaaaaaacga

SEQ ID NO: 962 - DNA, 101 bp, rice(Oryza sativa)
  misc_feature (71): n=t or g
aggcccagatcgaggagggggaaatggtgggggaaaccgccaagaatccgagcttttcttgagcagaggangagggggagagagagggggagatcaaaagg

SEQ ID NO: 963 - DNA, 101 bp, rice(Oryza sativa)
  misc_feature (71): n=a or c
ttgcgaaactgtaacgacgttcctgatgtgatgtttcgtcggacactccgtacagcaaggctgcctggtgnacagtattctgagatggtgttcaagctgaa

SEQ ID NO: 964 - DNA, 101 bp, rice(Oryza sativa)
  misc_feature (71): n=t or g
ccgagtggacattgggttgctgaagtactctaccgtgcagtagcaccgggcggatggacattgatcgtttnattgtgtagctgaacaacattctatggcag

SEQ ID NO: 965 - DNA, 101 bp, rice(Oryza sativa)
  misc_feature (71): n=a or g
cggacataaggtgaaatacaccacttaatttgcattcatgctaataaattacatctatggttaaccacaanacctataacatcaaatacctagagttgcaa

SEQ ID NO: 966 - DNA, 101 bp, rice(Oryza sativa)
  misc_feature (71): n=t or c
tttctctcggacacttttaccactcgaaaaataggagtaaccaacatacaacacgtcaacacagcatatgntacactcgacgtccgaaagttaagtagcac

SEQ ID NO: 967 - DNA, 101 bp, rice(Oryza sativa)
  misc_feature (71): n=a or g
cgataataatatattcacaaccctgacaagcaaaagcaaacacactatctaaattacagaagggaagaagncaaggtcctccagcctatacaaccacaacg

SEQ ID NO: 968 - DNA, 101 bp, rice(Oryza sativa)
  misc_feature (71): n=c or g
caaaaatgcttgtatagccaagcgctgagagaagacaggaaacaggtaagaaaatgaaaagtagtgggttntacaacatgaggtgacactcaggacaacaa

SEQ ID NO: 969 - DNA, 101 bp, rice(Oryza sativa)
  misc_feature (71): n=t or c
acccgacgtcgtgtaggagactgcacggcctacgtgcacacacagctacacatgcaacactacgttcacanccacgcgaatacgtctcctaacacatgcag

SEQ ID NO: 970 - DNA, 101 bp, rice(Oryza sativa)
  misc_feature (71): n=t or c
caccaatgcctgacgaatattcaatccacttgccagtcaagacatcaagggttgtgcctacaagatttagngaacttctcatgctccacaacttacgaaga

SEQ ID NO: 971 - DNA, 101 bp, rice(Oryza sativa)
  misc_feature (71): n=a or g
caatgagcttttgctggtatcatttctcagcgacttcggcatccaatgagcttgtatgtgcttgcttctcnccttaaacgacctgctttgtttatcacctg

SEQ ID NO: 972 - DNA, 101 bp, rice(Oryza sativa)
  misc_feature (71): n=t or c
aaaattgtaacagtataaattatgataatacaagtcactacacaacacatgccagtctaaattcgatctanatatgaagaaaaaacaataaattatatttg

SEQ ID NO: 973 - DNA, 101 bp, rice(Oryza sativa)
  misc_feature (71): n=a or g
tgcaagagaagagtaccgtctctctctccctttcatttgggtgggcttcgtcttcacaatgccatttggcngctgttagtactgtgaaaaaatagtgatag

SEQ ID NO: 974 - DNA, 101 bp, rice(Oryza sativa)
  misc_feature (71): n=a or c
ggaaggacgcccggccagcctcatcgtcgtcctccacgacgacgggatcgcacctgtacagcctcgccggncgccggcggagcaacttcaccaccgcgctg

SEQ ID NO: 975 - DNA, 101 bp, rice(Oryza sativa)
  misc_feature (71): n=a or g
caaccgagttgagcacaatttgttccgcccgaaagggattacccctcccctcttccttgttcggtttgaangggcttgaaggagattagaggggtttgagg

SEQ ID NO: 976 - DNA, 101 bp, rice(Oryza sativa)
  misc_feature (71): n=a or g
aggatcgtttcgagagcggcaatcgagacatggagccgccgacccaggcacaattagaagccgaggtcganggcaactactgccgctcaggagtgcccgaa

SEQ ID NO: 977 - DNA, 101 bp, rice(Oryza sativa)
  misc_feature (71): n=t or c
caaatagatgcagatgcaaagtgtggggcccaatgcgcatatcaatatatgggctaataaattttcgggantacctatacatttatcgacaaattttctcc

SEQ ID NO: 978 - DNA, 101 bp, rice(Oryza sativa)
  misc_feature (71): n=t or c
caagaacatccaagttctttaccaccaccttgaggaaagatccggatccggaacccattccgccgctcgtnctgctcccggtctcaagctgcgaagtgcga

SEQ ID NO: 979 - DNA, 101 bp, rice(Oryza sativa)
  misc_feature (71): n=a or g
gatagaacaagcattggccacgaagctagagcaccaagacaatctaaggagtctagaattcttcatatgcntttgtattatagcaagtgcaaaaacaacag

SEQ ID NO: 980 - DNA, 101 bp, rice(Oryza sativa)
  misc_feature (71): n=t or c
gactagaaaaaaatcaaagcgacttataatatgaaacagaagagtggatatcttatacatactaactacangaatgaatgtcacgctttggtaaaattaac

SEQ ID NO: 981 - DNA, 101 bp, rice(Oryza sativa)
  misc_feature (71): n=a or g
aggacccgccctcgccgcggcgctcgtccatcaggctcagcctgtggaaggagcaggaggagtgccttcantggctcgacggcaaggaggctggctccgtc

SEQ ID NO: 982 - DNA, 101 bp, rice(Oryza sativa)
  misc_feature (71): n=a or c
tccctccactcctccgccttcctcctcatctccttccccttctgaccttccatgagctcagcgatgaggcncgcgacggcgccgcgcttgacgttgctgtc

SEQ ID NO: 983 - DNA, 101 bp, rice(Oryza sativa)
  misc_feature (71): n=a or g
attatcctactaagtacaacgtaaggaagcgggctggagaccggacggaatggtatacctgcagtactggnccttctcaaaggccgtgttaccagccgaca

SEQ ID NO: 984 - DNA, 101 bp, rice(Oryza sativa)
  misc_feature (71): n=t or g
tttgatacggtaaatcatatctcgtgcggtgcttgcagtaaccttccgaagttacggtaaattatttggcngtaattctcgtgcggcagagggacccatcg

SEQ ID NO: 985 - DNA, 101 bp, rice(Oryza sativa)
  misc_feature (71): n=t or c
actctagttcacaacttagatcacacatctacaccctatagaaatcacatctcacgtgatgacgcactggncagttagtaggaagcaacatcgtcgaggtc

SEQ ID NO: 986 - DNA, 101 bp, rice(Oryza sativa)
  misc_feature (71): n=a or g
ctcgggcctttactgtaatgggctgtattttaacctttcgagatctaatatacctacctcgggtccccgcnagtcacccgcgggtgcattttctcccccgt

SEQ ID NO: 987 - DNA, 101 bp, rice(Oryza sativa)
  misc_feature (71): n=a or g
acttttttttaattttcttatagaaggcatagaaaaaatatgaacagctgccagattgatttttttttcgnggacaactggcagattgattaattattagt

SEQ ID NO: 988 - DNA, 101 bp, rice(Oryza sativa)
  misc_feature (71): n=a or g
tcctagtaagaaaaccttacctttataaaactagtttctaagtgtcctagtgtgggcaaataggatccganaaacttggtgttcggagatggggtcaaaag

SEQ ID NO: 989 - DNA, 101 bp, rice(Oryza sativa)
  misc_feature (71): n=a or t
tttcggtacgccagtgtcctgcctacttgtcataggcttgtttagactcaattttttcttcgaacttctantttttccgtcacgtcaaatgtttggacata

SEQ ID NO: 990 - DNA, 101 bp, rice(Oryza sativa)
  misc_feature (71): n=a or g
tgatggattagcgatccaggattattccaggcagctagggccacaatgttttactaatttgtttctttgcncgagtgagagcaccatgcacacagatatct

SEQ ID NO: 991 - DNA, 101 bp, rice(Oryza sativa)
  misc_feature (71): n=t or c
tcttggttgatattttagatttcttgtgatataaacatttagtagttctgtttttgtaggccttttcatanggaaaagaggccttgcatttacgcaagaag

SEQ ID NO: 992 - DNA, 101 bp, rice(Oryza sativa)
  misc_feature (71): n=a or g
aagcgtgtgcctgtttggtgttaaatctcatgcaacctcatggtatcagttggtacatctatagatattancagttcgtagggctccgtttttctctgttt

SEQ ID NO: 993 - DNA, 101 bp, rice(Oryza sativa)
  misc_feature (71): n=t or c
atctctccctttaccatcatacctctaattagtcggagatgtaataatgtaaatggtagaagagcgtgtgnaattaatactccctccgtttcagattacaa

SEQ ID NO: 994 - DNA, 101 bp, rice(Oryza sativa)
  misc_feature (71): n=t or g
aaaaatggcagggattcttggaagaggatcctatatataccatctcatgtatgctatattgttgttctctntttctgattaattctagctagacatgaact

SEQ ID NO: 995 - DNA, 101 bp, rice(Oryza sativa)
  misc_feature (71): n=t or g
ttctagagggaccatggctggtgatcgacttgatgatatatctttggaattcttgagactggagctgaatngcacgtatgatttttggccgcaataatccg

SEQ ID NO: 996 - DNA, 101 bp, rice(Oryza sativa)
  misc_feature (71): n=a or t
gtggcaaagcctgtgtcgggtctgtgctgttcacaccactggctggctgaatcttcaggagaaaaaaaaanaaaaaaggtgcacatcttgtgttactttta

SEQ ID NO: 997 - DNA, 101 bp, rice(Oryza sativa)
  misc_feature (71): n=a or c
agaattgttctactagaggctttgacatctggattctggagtttgagcctcagcttcttgccttttacacnctccgacttactacctccgttttaattata

SEQ ID NO: 998 - DNA, 101 bp, rice(Oryza sativa)
  misc_feature (71): n=t or c
tgctattcgatatattatcttttggcgattttcaagccgtactgcaaaactaaaatggaccattgcctgtnttagttttttttggtttttctacctcaaac

SEQ ID NO: 999 - DNA, 101 bp, rice(Oryza sativa)
  misc_feature (71): n=a or t
taatgcttccataccattgtcacatcatgagattaacctaaatgtttcagaaactgattctgtgaaaaaanatttcatgtttaataataatcataataatg

SEQ ID NO: 1000 - DNA, 101 bp, rice(Oryza sativa)
  misc_feature (71): n=t or c
tcccaggcatacgatagtgaattgagatgtctttccgccgcactgactatcgtttgaaccttactccctcngtcccaaaaaaaggcaaaccataggttctc

SEQ ID NO: 1001 - DNA, 101 bp, rice(Oryza sativa)
  misc_feature (71): n=a or c
ttgatcaatggattgaagagttgaactattgcgactagtaggaacaaaaaagatcggaaacacacggaaantagctatttgtattcgttttcattttttaa

SEQ ID NO: 1002 - DNA, 101 bp, rice(Oryza sativa)
  misc_feature (71): n=a or g
atgtactgtacgacactgtacatacagacacaatgtcgactataatgcgcccgctaggtcttgtaaaaagnaaaaaaaaaggctatatacatgtatgacgt

SEQ ID NO: 1003 - DNA, 101 bp, rice(Oryza sativa)
  misc_feature (71): n=a or c
ttttatatgacaaagggagtaagtcgaaaggaagagattgcaaatcctagttaaaaagctactactccccnaaatgaatgcaaaaacaacagccgaaagct

SEQ ID NO: 1004 - DNA, 101 bp, rice(Oryza sativa)
  misc_feature (71): n=a or t
ctttcagtcgccagagaaaaccaaggccaaacatctcaacccggttggatttacgccttccgttttttttnaaaaaaaactctaaatatgaatctagacaa

SEQ ID NO: 1005 - DNA, 101 bp, rice(Oryza sativa)
  misc_feature (71): n=a or g
cacggcgttttgctctcgaaaagacgctatactacctctttacaactcacattggctgccaaatgacaacncagtgacatacattgatagccagcgcccat

SEQ ID NO: 1006 - DNA, 101 bp, rice(Oryza sativa)
  misc_feature (71): n=a or g
cgcaaaagccccctccattttaaccaaacccaccacaccgtccacaccacaacatcacggaaaaaaattcngtggagaccggatgtaaccggcctcttata

SEQ ID NO: 1007 - DNA, 101 bp, rice(Oryza sativa)
  misc_feature (71): n=t or g
atcacagagagctagccatggatgttggatggaagggataaaaacagtaagaaatggtagcatctctacgnaaccgatttttaagggatcaactacaatta

SEQ ID NO: 1008 - DNA, 101 bp, rice(Oryza sativa)
  misc_feature (71): n=t or g
agtactcccaatactccaaacattaatccattaattaaggtgcaattaattatatttttctccatttactncttggtttggtgaaaaaaacacgaatatta

SEQ ID NO: 1009 - DNA, 101 bp, rice(Oryza sativa)
  misc_feature (71): n=a or g
cgcgtgcaaggtgttcgagcaggacatggggttcctgtcgtcgcagaacgaggtgctgctccgggagaagntgccgaccaaggagctctacctcaacctcc

SEQ ID NO: 1010 - DNA, 101 bp, rice(Oryza sativa)
  misc_feature (71): n=t or c
atttccaattccgttggctcgatcagttcatatgaatatcactgctttatgtgctgcattttggtttaggntgtgtttagattaggggtgtaaagttttga

SEQ ID NO: 1011 - DNA, 101 bp, rice(Oryza sativa)
  misc_feature (71): n=a or c
tcaatgttttctggttggaatttgttcttctagtctagttgcagcatgatcaccagagtacaaaacggatnactgcgaggcgagatgatcgatcttgatct

SEQ ID NO: 1012 - DNA, 101 bp, rice(Oryza sativa)
  misc_feature (71): n=t or g
aacggtggtgaatgacacgtgtcgggctttcgttggatgatttgggttggtgattagatgctaattgatgntgaaggcagtagtggggaaagggaggtcag

SEQ ID NO: 1013 - DNA, 101 bp, rice(Oryza sativa)
  misc_feature (71): n=t or c
ttttttttttcttcaggaaaggacaaagaaagaaggggtttaagattagaaaaaagaagtatagactatgngctagggacgagcaaggtacatgggcttgt

SEQ ID NO: 1014 - DNA, 101 bp, rice(Oryza sativa)
  misc_feature (71): n=t or g
attctctgtactgcaaccaaccaatgttcaactttctagctagcacactgcttgatttctcatctccatgnacagactgagggagttgcacacgctcaagg

SEQ ID NO: 1015 - DNA, 101 bp, rice(Oryza sativa)
  misc_feature (71): n=t or c
tgctgatatctaggtcaattggttcatataaataaggagcagaacataccagtccatgaaacaagtgcttntagaaggccgacaaaacaagaccccatttg

SEQ ID NO: 1016 - DNA, 101 bp, rice(Oryza sativa)
  misc_feature (71): n=t or c
atgctgaattggcacgcttgaagttgagtcgcatatggcattgatgcagtcctctttgttcgaggccaatngactctcaaatgattccagcttccgtttgt

SEQ ID NO: 1017 - DNA, 101 bp, rice(Oryza sativa)
  misc_feature (71): n=t or g
taaatcactacttggtgacatgattccttttccaacatccatttaaaaaaaatattcttccttaggtagancaccaacactaatttattcttatgtttctt

SEQ ID NO: 1018 - DNA, 101 bp, rice(Oryza sativa)
  misc_feature (71): n=a or g
gcatgatcacagggcacgcatcgaacgcgcggaaggaagcattaactatatctatgtattaacattacacntgctcaacgtggaatatgaaaccgtatatt

SEQ ID NO: 1019 - DNA, 101 bp, rice(Oryza sativa)
  misc_feature (71): n=t or c
tttctgcatcctcttaaaattcaggcaactcaagattcacatctgttatacacttgagtctgaaactttgngcgttataatgttcattgcattatgtctgg

SEQ ID NO: 1020 - DNA, 101 bp, rice(Oryza sativa)
  misc_feature (71): n=t or c
cggttaagtctgtccaggctgtagctgtagatcgatcacagctagcgagcacagatattccaatatatacnccacgtacgtacgcaacggccaagatctac

SEQ ID NO: 1021 - DNA, 101 bp, rice(Oryza sativa)
  misc_feature (71): n=t or g
cacacggacacacacacacagctccacctgctctctctgtcaggtcaggtcacaaggcgcatcagctgctnctgtctcgtcgaccggtacacgacgctcgc

SEQ ID NO: 1022 - DNA, 101 bp, rice(Oryza sativa)
  misc_feature (71): n=a or g
cttttaagtttttttttttttaccaacgctgcatgttacccctcatggatggatgataatgccctttctgntttcatcagtacaatgtacagtacagtact

SEQ ID NO: 1023 - DNA, 101 bp, rice(Oryza sativa)
  misc_feature (71): n=t or c
catgtggcgcagctgtgcttgcatgctgtgctgcctgtgcaggacaactcttgttgttgatttgtgtgatnagtacttctctgtttcaatatacttatcgt

SEQ ID NO: 1024 - DNA, 101 bp, rice(Oryza sativa)
  misc_feature (71): n=c or g
tcgtagccggcctcctccacaacttgaagccacaccaacgaattggattcgcgcagatcggcacagccggncgatcgatcggcggactagaggcgatctat

SEQ ID NO: 1025 - DNA, 101 bp, rice(Oryza sativa)
  misc_feature (71): n=a or g
tgtcaaacacgtagctaggggataaaagttgcagtttaccgataaaataatttcctatcgctgcagttttntgaaaattttagctaaagtagtagcaaagt

SEQ ID NO: 1026 - DNA, 101 bp, rice(Oryza sativa)
  misc_feature (71): n=a or c
acagagtagaagaccagtgtcttccatttaatcgagggagaaaaatcgactaaatccctttgaatcagtcncggatgaagagttggtgcatcaataattca

SEQ ID NO: 1027 - DNA, 101 bp, rice(Oryza sativa)
  misc_feature (71): n=a or g
tagctatagcttgttctctttgtctcttacgattacgatcaaatttcccatcaatttttatacatgtttanaatttaacttatttcattccatatcaacat

SEQ ID NO: 1028 - DNA, 101 bp, rice(Oryza sativa)
  misc_feature (71): n=a or g
ggcttatatgccaacactcacctctacgcgaggttccctcaaacctcgagacgagactgaaatagaaatgngctacaattattgatttaattgtgcatctg

SEQ ID NO: 1029 - DNA, 101 bp, rice(Oryza sativa)
  misc_feature (71): n=t or g
gccaagctcacctcctcccttggagtctcaaacatggggcttcccgtaaacagataccaggtgggttctgntaactccgaccgtgccgtgccgttcggttt

SEQ ID NO: 1030 - DNA, 101 bp, rice(Oryza sativa)
  misc_feature (71): n=a or g
cacgctcgtgtcatcagtagtgtagaaagtgttatttgctgtactcctacaattaatttgttccgcatatntttctagtgtgtgtgtgtgattgttgtcca

SEQ ID NO: 1031 - DNA, 101 bp, rice(Oryza sativa)
  misc_feature (71): n=t or c
gctatctatgttgcaacggatttccatccagcaaacatctatgagttcagcaccttcttcgaatctgttgnaaagaaagggtttaaacacgtagtaacaaa

SEQ ID NO: 1032 - DNA, 101 bp, rice(Oryza sativa)
  misc_feature (71): n=t or c
gccagtgcttctaccaatctattattcagtgcatttatggctgctgctgctttctttagattatctgcttntccacaatcatcgtgtcactcataacatgg

SEQ ID NO: 1033 - DNA, 101 bp, rice(Oryza sativa)
  misc_feature (71): n=a or c
tttggggatgattgctgttagaacattgccgtgattttgttgaataagcgcctctttgtcatgttttctanagtagaagttctgcactattaccattagac

SEQ ID NO: 1034 - DNA, 101 bp, rice(Oryza sativa)
  misc_feature (71): n=a or g
ctaaaggtccgattggatgtaaaattttcagcctctcctgtacgacagttaggaatgaaaaaattagtttnttttttatattttattcctccaaaccgaat

SEQ ID NO: 1035 - DNA, 101 bp, rice(Oryza sativa)
  misc_feature (71): n=t or c
cagagtatatttcgtgccacggccgcccaagctcttcttcaagaagagtcattgcaagatcatcggagaangaaggaaccttcacatagcggtagatcaac

SEQ ID NO: 1036 - DNA, 101 bp, rice(Oryza sativa)
  misc_feature (71): n=a or g
aagcccaggagtgtagcatcttccatgcgtccatagctttagttctagtacaactgggaccaagtgtttcngtgacgaaaagtttctagaagccatgccct

SEQ ID NO: 1037 - DNA, 101 bp, rice(Oryza sativa)
  misc_feature (71): n=t or c
tgagaactggtacccgcattttgttaatatttatcgaacgcgactagtaagaatctaacatgtcgatctanagcagtgacaacctcatctgaaatgaccat

SEQ ID NO: 1038 - DNA, 101 bp, rice(Oryza sativa)
  misc_feature (71): n=a or g
tttttaaagttttggcgcgctagctagcttagctagcttcgtggagtccgcttgtttggtttctccgatgncgggaaggacgaagtcatggacggctgcat

SEQ ID NO: 1039 - DNA, 101 bp, rice(Oryza sativa)
  misc_feature (71): n=t or c
tatacagtttaaattaaacatttcccatgcgtgcatgctcagtctctcgatgactcgatcgatcgatcacncgtgtcaccctaacggccatgcttgcgctc

SEQ ID NO: 1040 - DNA, 101 bp, rice(Oryza sativa)
  misc_feature (71): n=c or g
tgggaataggtttagccagaagcatcggaccaatgatcagatcacccatgacgaaaggagactgcactagnggcattgcccgcacggctggagcgggcagg

SEQ ID NO: 1041 - DNA, 101 bp, rice(Oryza sativa)
  misc_feature (71): n=a or g
tactccattgaacaacacttcaatagtttaaagaaaagcatgtgtgcttgtgatatataccaatcgaacancattatttcatcatgaatgggccggccaat

SEQ ID NO: 1042 - DNA, 101 bp, rice(Oryza sativa)
  misc_feature (71): n=t or c
ctgcaaaaacatattctgccatgggatcctcatcttccaatggcttcagtgaaatgaccactccgacctcngtgaaatccaacccggtaagttgtatttac

SEQ ID NO: 1043 - DNA, 101 bp, rice(Oryza sativa)
  misc_feature (71): n=a or c
acctcaagccctccaacgtcctcctcggccccgacttcgaatcgtgcctcaccgattacggtctggtgccnacgctgctcccctcccacgccgatctcgcc

SEQ ID NO: 1044 - DNA, 101 bp, rice(Oryza sativa)
  misc_feature (71): n=t or c
agggtaggaaggttactcatgttgagctcctttattaaagtatcttgtgctatatggtcgtcaaccactgnaaaaatcttctgtatgacgctgcaatttat

SEQ ID NO: 1045 - DNA, 101 bp, rice(Oryza sativa)
  misc_feature (71): n=a or g
aaattaagaaacaagagctttatttgatgaaaagcaaatacatccagcgccaatagtccatcaaaggcaanatctgtagcaccatttactaatgctgaaaa

SEQ ID NO: 1046 - DNA, 101 bp, rice(Oryza sativa)
  misc_feature (71): n=a or g
tgtactgtacctaacaactgtactagctagatgctggccggagttgttaattatacatagttgagtgatcnctagctccatatatactcctaatagctaga

SEQ ID NO: 1047 - DNA, 101 bp, rice(Oryza sativa)
  misc_feature (71): n=a or g
gattaattaatttgtacctgcatgtatatatagattaatagtatatatgtattgtcagatgaattcgttcnatcgatcgatctctgatcgctttcagggtg

SEQ ID NO: 1048 - DNA, 101 bp, rice(Oryza sativa)
  misc_feature (71): n=a or g
tatgaatacatatatacatggccatacgtattagtttatacgcacacgtacatgccgtcatgaaaatctcntcatgatcgaccagctagcctggcaattct

SEQ ID NO: 1049 - DNA, 101 bp, rice(Oryza sativa)
  misc_feature (71): n=a or g
aacaaatatctaccaaagctatacaactttctactcatagactttatgatgggataaaagctttatacctngaaatttcatggtggaataacaactttata

SEQ ID NO: 1050 - DNA, 101 bp, rice(Oryza sativa)
  misc_feature (71): n=a or t
cgttgtattgtctgttatcgaacatgatgtaggtagcttctctaactacatgttactactatgtaacttangtttgttgagaggttgtgaaatggtaaagc

SEQ ID NO: 1051 - DNA, 101 bp, rice(Oryza sativa)
  misc_feature (71): n=c or g
aatcccaacgaactaagctccattgacagcaaaagaggaattttgatgcttggggtgagaaatatgttcgnccaagctcaattagggcaagagccgatgcc

SEQ ID NO: 1052 - DNA, 101 bp, rice(Oryza sativa)
  misc_feature (71): n=t or c
cctacatacgtcggtggtcatctccagttaaacgaggtttggactggcttggttcattaaaccaagataantgatcttagatgtgcaattttaagtttacg

SEQ ID NO: 1053 - DNA, 101 bp, rice(Oryza sativa)
  misc_feature (71): n=t or g
tgggccactaggcctgttgagcgacacaatcttatgatttgggctcaaataggcaaaggctgtgtttatgnaggacatatccggtgaaaatgagctaagtg

SEQ ID NO: 1054 - DNA, 101 bp, rice(Oryza sativa)
  misc_feature (71): n=t or c
ggaagtaggactcacgtggacctcacacaatagcgacaactctttgtctctcttccctgttctccaggagnaccgagatccaatcctcatcgccgcaccgc

SEQ ID NO: 1055 - DNA, 101 bp, rice(Oryza sativa)
  misc_feature (71): n=a or g
ttgccacgaggataacactttggttggggttggagaagctagccggtgataatctagataagcttcttctntcttctagttcatttttagattttacaact

SEQ ID NO: 1056 - DNA, 101 bp, rice(Oryza sativa)
  misc_feature (71): n=a or g
gtttgattcatcattaaagttggggctacatatatctttgtcgatattattgtgtggcctcggtcttgatntgttgttcaccattacttgtgtactgcaac

SEQ ID NO: 1057 - DNA, 101 bp, rice(Oryza sativa)
  misc_feature (71): n=a or c
gagaagaaggaaaaagagaagaaaaactgtgaggcatgacggcttctgcttctctgctgcctatcatcatnagtgtttttttaattgccattatcaatatg

SEQ ID NO: 1058 - DNA, 101 bp, rice(Oryza sativa)
  misc_feature (71): n=a or g
aacttgaattactagtagcaccgtaaaatactacttcatccactctaaaatgtaaacatttttaatgtggncataggtattaaaaaatagatgtaaatgat

SEQ ID NO: 1059 - DNA, 101 bp, rice(Oryza sativa)
  misc_feature (71): n=t or g
cctccagccgtcggatcttgtgcagcagctccgccttcgatcctgcacgagtttcatgtcagtgaggacgnttttttttttttttctaatcaaactgtacc

SEQ ID NO: 1060 - DNA, 101 bp, rice(Oryza sativa)
  misc_feature (71): n=t or c
taggtttgaatcttgtgctaagattcgcagctgctttgcttaagcataagtagtttgcctttatctgcatngacatgctagataaatgagatcaattgtct

SEQ ID NO: 1061 - DNA, 101 bp, rice(Oryza sativa)
  misc_feature (71): n=a or c
aaaatttcggcacgtacactgtcccggtcgagattggcgcatgaatcctcgtgatgcaggtctccggtacncgactgcggtgcgcccgttcgcacaccatc

SEQ ID NO: 1062 - DNA, 101 bp, rice(Oryza sativa)
  misc_feature (71): n=a or g
ctatagagagaaggcaatgattagttagacttaaggtgtgatgttttcttctctttcctagaccttgtttngatccggaggactaataattagcccttcaa

SEQ ID NO: 1063 - DNA, 101 bp, rice(Oryza sativa)
  misc_feature (71): n=a or c
agctcgtgcaatcacaatcaccggcactggacatggaagaaagggaaaaaaaaacttgtgcttaaagcagnacgaaggaacacacggccgcggctaatgcg

SEQ ID NO: 1064 - DNA, 101 bp, rice(Oryza sativa)
  misc_feature (71): n=t or c
ttaactactgaccaagataatgtggaaaatatagttgtgagctactacctgagaaggagacctgatatgangaagcaaaatgtatttttgggtcaaaaata

SEQ ID NO: 1065 - DNA, 101 bp, rice(Oryza sativa)
  misc_feature (71): n=a or g
aggctgcacacggcacctaacacaggcaatcgatcgccctagctttgctatcctatactgcaagaactagnacgacacttgcaaagttgcttcttcctctt

SEQ ID NO: 1066 - DNA, 101 bp, rice(Oryza sativa)
  misc_feature (71): n=a or g
caaacacagtagctagcccgttcccctgcaaattaaagtgtttgtgtgcgtcgacgttcgtgcagtgcatncatgcagccatgcacaaacccatggtgaat

SEQ ID NO: 1067 - DNA, 101 bp, rice(Oryza sativa)
  misc_feature (71): n=a or g
atctcgcatctgtcttatcccagtaattcatattatgtgtgtgctttgaatgacagtttcagtgcaactanttgcactataaagtataaacaatatactct

SEQ ID NO: 1068 - DNA, 101 bp, rice(Oryza sativa)
  misc_feature (71): n=t or c
aaggaactattcaataaatatgccgcagtcagtctacactttcttcctagtaaaatttctagccatatgtntttgcctttgccatctttcttgtcctgttc

SEQ ID NO: 1069 - DNA, 101 bp, rice(Oryza sativa)
  misc_feature (71): n=a or g
tcattacatatgcaagtaagataaagatggaagtggtcagtaccacaagcatgactctacttacgcaatgncatgatcgcattgctcaacctacctggaaa

SEQ ID NO: 1070 - DNA, 101 bp, rice(Oryza sativa)
  misc_feature (71): n=t or g
gccgcaactttttcgccttatttcttccggccaatggagtagtactgtactactactattgtgcggcaggngaagcatccatatgctaatctgtacttcga

SEQ ID NO: 1071 - DNA, 101 bp, rice(Oryza sativa)
  misc_feature (71): n=a or g
ttttaccgggcttcatctccagaaaagatggagctctagctggaaccgtgcccaacagatcatacttaacngcatattccgtaaaattttttatataatat

SEQ ID NO: 1072 - DNA, 101 bp, rice(Oryza sativa)
  misc_feature (71): n=a or t
tgcagagttgtttgatggaaccttatggcacttcctggaaactagcgtatatcctatcaatgtatgttctngttttcatgtgtttgaattcaatatctatt

SEQ ID NO: 1073 - DNA, 101 bp, rice(Oryza sativa)
  misc_feature (71): n=a or c
taaccagctatacgtaattgcaaaaaggtgattgctcactgtttgggttggggccagctgtagcaaccatnaggtaagttagctataaacatattttaaag

SEQ ID NO: 1074 - DNA, 101 bp, rice(Oryza sativa)
  misc_feature (71): n=t or c
ccatcctgatcagattatttacaagaagacatttttgcagaacatagttggaacatgtgcattgtgtgtgngttttcatgaaaaagtacataaatcattgc

SEQ ID NO: 1075 - DNA, 101 bp, rice(Oryza sativa)
  misc_feature (71): n=t or c
gccttcaattgtggccataaccagacattacgtgggccaggaagcccttttgttcttttctctttcccggnccactaaaccaagcacagagccgccgccac

SEQ ID NO: 1076 - DNA, 101 bp, rice(Oryza sativa)
  misc_feature (71): n=a or g
cagagctgaagactgaagagcgcatctgatgtgcatgcaacaacgctggtcttttgggagctcagacttgnagggctcaccgtctccatcctcactcctcc

SEQ ID NO: 1077 - DNA, 101 bp, rice(Oryza sativa)
  misc_feature (71): n=a or g
attcgcgaactaaacaagatatttcctccatcctaaattaagttaatttaacgtgagatactaagatgtgntatattctaatactatgaatctggacaggt

SEQ ID NO: 1078 - DNA, 101 bp, rice(Oryza sativa)
  misc_feature (71): n=a or t
ctctatccttcttctcaccaacctccgcttcactagctccaccaatctaaaggaaagatccaatttttttnaaaaaaaataatacccatgctcacaactca

SEQ ID NO: 1079 - DNA, 101 bp, rice(Oryza sativa)
  misc_feature (71): n=t or c
tattttcttcccgcatgccaactataatagctgtactctgaaattgtcaacctcacttatgtaattacacnaaatgctatctatgataaggtgctgaagtg

SEQ ID NO: 1080 - DNA, 101 bp, rice(Oryza sativa)
  misc_feature (71): n=a or g
ctcgatgttgccacttcaggtaaaataacaagactatgagagcgtgtgacatatagaaattttacggtacnatatactaccaatatatactggcagtattt

SEQ ID NO: 1081 - DNA, 101 bp, rice(Oryza sativa)
  misc_feature (71): n=t or c
cggctgctgcagcctccctttcagccctctggtttttgttgagagctttgcttaagatgctgcaagttggnaaaacctatgataatattatcaataacttt

SEQ ID NO: 1082 - DNA, 101 bp, rice(Oryza sativa)
  misc_feature (71): n=t or g
cgacgcagaacttgccaaagcccagactgacaagctgagaatcctcgcattccttccattcctccggcagntgaagctccttccaaggtcctactagtagc

SEQ ID NO: 1083 - DNA, 101 bp, rice(Oryza sativa)
  misc_feature (71): n=t or c
gtcccaaaaaaagctaacctacgaaagaatgtgactcaacttagcacaacgaatttagataaaagagttanctagattcattgcactacgttgtatcacat

SEQ ID NO: 1084 - DNA, 101 bp, rice(Oryza sativa)
  misc_feature (71): n=a or g
atgcaagtgttcgtcatctcgttgcgtcctgaaggattacaccatctcaactccggacgagttgacggcgntggcaccgccgttggcagaagcttcctcgt

SEQ ID NO: 1085 - DNA, 101 bp, rice(Oryza sativa)
  misc_feature (71): n=a or g
gggggggggggggcattatttgcccaagtagtcgagtttgtgatttgatgtattatatcggaacagtttancctatttcagcatagtgctattttatatga

SEQ ID NO: 1086 - DNA, 101 bp, rice(Oryza sativa)
  misc_feature (71): n=t or c
ccaacaactaacccaaggcccagctgaggcccatgcgagcccaactatctcacgtttcttttgtaagtttntggaatatcaatttttttttactaaatttc

SEQ ID NO: 1087 - DNA, 101 bp, rice(Oryza sativa)
  misc_feature (71): n=a or g
aacgctgtgcgaacagtgtcggagtactgttcactcatacggtatcggtttactgttgattaccgtagcgntcgatcacatccggccgcatttaatctaac

SEQ ID NO: 1088 - DNA, 101 bp, rice(Oryza sativa)
  misc_feature (71): n=t or c
gatagcttcgcctgaactactacaatttctgtccattttccttactgccgttcgtagctgaaggttccggnctcacaggcagatatgttcatttttattcc

SEQ ID NO: 1089 - DNA, 101 bp, rice(Oryza sativa)
  misc_feature (71): n=a or g
taactaaataacctttgctatgccagattgccattagactcttactatcaccatactctgagaagtgagantcatgcacgctgcatccctcttcccctcgt

SEQ ID NO: 1090 - DNA, 101 bp, rice(Oryza sativa)
  misc_feature (71): n=a or g
gattcgtcgccggagagtccatcgacggcgccggaatttgccctccgcttattcccctttcccgatctganatcgatgagataggcttaacgggtcgcggg

SEQ ID NO: 1091 - DNA, 101 bp, rice(Oryza sativa)
  misc_feature (71): n=a or g
tatccacagccataggtattttggtcttaaaatcccccaaagtggcaaagtatcctaaaagtaacctattnagtggcattttatcctttacaatacatgta

SEQ ID NO: 1092 - DNA, 101 bp, rice(Oryza sativa)
  misc_feature (71): n=a or c
gacgaagttaattaattacgcacgcaatctcatcactgatcatccaatcgatattagagagttagctagcnctactggagaagtgatctttaccgggtcat

SEQ ID NO: 1093 - DNA, 101 bp, rice(Oryza sativa)
  misc_feature (71): n=t or c
aagcagtttagcacttgagctatgttggattcacttcctcgtcttcctgacatattccagtttttcctctnttctttcaagaatcggaattacttcagttg

SEQ ID NO: 1094 - DNA, 101 bp, rice(Oryza sativa)
  misc_feature (71): n=t or c
cctcgtctgctgctcgatctgccacgcagcatgtggcgatcgatcgatttatcgatcaaaagcctcgcccnctgcagcgtgcgaggaacacggatgtggct

SEQ ID NO: 1095 - DNA, 101 bp, rice(Oryza sativa)
  misc_feature (71): n=a or c
atggaagacgtacaagaatgggaaagactatgtctatatacggacaaacctttttcatacaaaaccccccnaaaaaaattatacgggatttgttgacttta

SEQ ID NO: 1096 - DNA, 101 bp, rice(Oryza sativa)
  misc_feature (71): n=t or g
cagtttaacgggcatggcaagtgactacgttctttgaccatacaagcttgatctaccacgcctgttgtggntgatataatagtattatcttgtcacgctag

SEQ ID NO: 1097 - DNA, 101 bp, rice(Oryza sativa)
  misc_feature (71): n=a or g
ttactgttcgtgttcatgacaatcaattaattcatgatgatagccaaagcaaaatacatgcttttctatgnaaaaaaaattcgcaagtgttgatttttttt

SEQ ID NO: 1098 - DNA, 101 bp, rice(Oryza sativa)
  misc_feature (71): n=t or c
ataatgtaattggctagagttgagcagctcatctattaatccattcatcttcagctctttacacatacctngagtttgctagagcaacctgtagaatcatg

SEQ ID NO: 1099 - DNA, 101 bp, rice(Oryza sativa)
  misc_feature (71): n=t or g
ggagacggatgggccggatggagaccggtcgatcgagacgtactcgactacttcgccgttcgcggcggtgntgctcgcacgcggcgacgccgcagacgcgc

SEQ ID NO: 1100 - DNA, 101 bp, rice(Oryza sativa)
  misc_feature (71): n=t or g
ggccaaacttcattgtctcgcaaaacatctcttctatgttatgttcagttctaagcaattctcttttgaangaaagttccaagttccaagtaggctcacta

SEQ ID NO: 1101 - DNA, 101 bp, rice(Oryza sativa)
  misc_feature (71): n=a or c
aggaaaatactgtttggtggtgatgtgcgtgtgcgcgtcaaccaaccatcgtatcgtcgtctatcgagatnttactgctacagcagagttgctagagatat

SEQ ID NO: 1102 - DNA, 101 bp, rice(Oryza sativa)
  misc_feature (71): n=a or g
atatagttgttttgagaccaaggtgtcgggcaaaatgatctggattgtggagtatccaaggccccattcantgagtttaagcggacagttattacttactt

SEQ ID NO: 1103 - DNA, 101 bp, rice(Oryza sativa)
  misc_feature (71): n=c or g
atagcatttgcgataggatgcaatgctgttttctccactgcagcggcgagacgaagaatctccgcctcctnatatgctaaagaagctatagaagtaactac

SEQ ID NO: 1104 - DNA, 101 bp, rice(Oryza sativa)
  misc_feature (71): n=a or g
gctactgaattttatagcaaatattaaatgtgagcctcattccaaatctataacttaagcccaattgaatngggaatggattctaataactcgagtggatg

SEQ ID NO: 1105 - DNA, 101 bp, rice(Oryza sativa)
  misc_feature (71): n=a or g
caggagagctctcactatcattccccatgaagttcccaccaaattttacaagttactacaaattctacggnaaagttcatcattatgtgaaaaaagggaat

SEQ ID NO: 1106 - DNA, 101 bp, rice(Oryza sativa)
  misc_feature (71): n=t or c
tgaaaacgcgcatgcaccgtatcggcggcgcatgcgcgcgcgcggctgtctaatatctctcgtacagtaanccgccgatcgatcgatcgagctagctagct

SEQ ID NO: 1107 - DNA, 101 bp, rice(Oryza sativa)
  misc_feature (71): n=a or c
ttcgacacgctctccacgtaccccacgaacgccatgttcggtatcagcggatgtatcgtccccctacacanacaaaaaaaaaacactcatccattagctaa

SEQ ID NO: 1108 - DNA, 101 bp, rice(Oryza sativa)
  misc_feature (71): n=a or g
ctccccttcgtgggcgcgctccattgctctctcccctcccacccaatcctattatgacattacgatgcctntccccattgccttcctcttcctcctccccc

SEQ ID NO: 1109 - DNA, 101 bp, rice(Oryza sativa)
  misc_feature (71): n=a or c
ttctcgcatcgtaagacaatttctctactcctagttattcatcctgcatatatggtatatctgaatgaccnaaaaaaaaagaacttgttcctgaaataatt

SEQ ID NO: 1110 - DNA, 101 bp, rice(Oryza sativa)
  misc_feature (71): n=t or g
aagtctagaagacgaagacacatgactatatcttatggttcttgttatgtattatgacatgatgaactagnactatatcttatggctcttttcaaacaaag

SEQ ID NO: 1111 - DNA, 101 bp, rice(Oryza sativa)
  misc_feature (71): n=a or c
ttgtcgatggctcaatcaacaacgaaatttcatagggtaccaacaggggaagcagcgcaagaacacaaatngggggaaacgaccccaggtgttcgtcaacc

SEQ ID NO: 1112 - DNA, 101 bp, rice(Oryza sativa)
  misc_feature (71): n=t or c
ccagttttgagcttatacggaggtggccgcccccaacaaattgggtgcttatatatgcgtgtgaatctctngaagatgtgagcaaaagtaggcacccatat

SEQ ID NO: 1113 - DNA, 101 bp, rice(Oryza sativa)
  misc_feature (71): n=a or g
agtgaaaatcaaaggatatatgttttgtttttttcttagaaaatcaaaggaagcgtacgtttagcagtttnaaaagcgcatcacgagcatcctaaatttct

SEQ ID NO: 1114 - DNA, 101 bp, rice(Oryza sativa)
  misc_feature (71): n=a or g
tgcattgcaccaagcttaaatagtcagctcaccaactctgcaccgccgagctcagtagcgagagcttgtancccatgtgggggcatcaggtggtgtggatg

SEQ ID NO: 1115 - DNA, 101 bp, rice(Oryza sativa)
  misc_feature (71): n=t or c
ccttagttcagtttgaagtgacattgctcgcagtattttactctaccagcagtgctcctgtaacagtgtcnagtgggttgagtttttggcttttaggactt

SEQ ID NO: 1116 - DNA, 101 bp, rice(Oryza sativa)
  misc_feature (71): n=c or g
tctcacccccaacccctattgatctcgcttctccccacctcaacgcctccccaatccctatcgcgccaatncccggcatgacagcccccagccaatgctgc

SEQ ID NO: 1117 - DNA, 101 bp, rice(Oryza sativa)
  misc_feature (71): n=t or c
tagtggttttcaataggtctagatgtcaatcttgtttaatttggttacaactgaattagtagcgccaccgngccgcaccatagctttggaagtagcacgac

SEQ ID NO: 1118 - DNA, 101 bp, rice(Oryza sativa)
  misc_feature (71): n=t or c
ccaaagaagttgcttccattgagtacctttctgaagtactccagatttcagtggaagtaaggaactgtttnacgacaattcaaccacggaaacgtagggcc

SEQ ID NO: 1119 - DNA, 101 bp, rice(Oryza sativa)
  misc_feature (71): n=t or c
tatttaaaaaataattacctggatatggtaatcagtttatcaccactgttgtgtttttatacaaacttctnttctcctctctctgctttttttttcggggg

SEQ ID NO: 1120 - DNA, 101 bp, rice(Oryza sativa)
  misc_feature (71): n=t or c
gcagaaatgagccgagtgccccagatcaagtaaaaagcggcccaaaattgtgagagccctcggcccaaaanctgccacgcctttgctttcctgtgatcccc

SEQ ID NO: 1121 - DNA, 101 bp, rice(Oryza sativa)
  misc_feature (71): n=c or g
aatatatctctccatatattactaggtatgtatgcagtattcttggttgctacaaatccaagtataggagntatacatatacctagtccataacactaaca

SEQ ID NO: 1122 - DNA, 101 bp, rice(Oryza sativa)
  misc_feature (71): n=a or g
ctcttatcaatttccacccagcgagaaggaattgtgtcttgtatgatttgaacaagatttttgagaaaacntttcaatgttttattctgttcaagaaaaat

SEQ ID NO: 1123 - DNA, 101 bp, rice(Oryza sativa)
  misc_feature (71): n=a or g
ctggctctaatgaagcaaccatggtagagagacattcaaaggctcgggaaaatttgggttcatggagatcngaatgtattagccaaaatattgatgatatt

SEQ ID NO: 1124 - DNA, 101 bp, rice(Oryza sativa)
  misc_feature (71): n=a or c
agactgactgacgattcggagccatacaggagtccgaatctggtaaaatcagagacaaacgtactttctcngtcaaaaaaaaaaaaaaagagaaggcaaac

SEQ ID NO: 1125 - DNA, 101 bp, rice(Oryza sativa)
  misc_feature (71): n=a or g
tccgaacgcggtgatggctcgatcgagtcgccacatgcagtggatacagtcatagcgtgtttggttacctncacatgggttggctcacaaggagcgcgagt

SEQ ID NO: 1126 - DNA, 101 bp, rice(Oryza sativa)
  misc_feature (71): n=a or c
tcaggtcaagggggcgacaaagagaggaggagacgcgaaacgaccttaacaatccagccgacacaccaggngcgcgcgttcttcatccactcctccaccat

SEQ ID NO: 1127 - DNA, 101 bp, rice(Oryza sativa)
  misc_feature (71): n=a or g
tgtcaaatagaagcacttagatacaatcaactttgccagaaatgctaccaaatcctagtgcaaactgcatnaatagctaaaacaataatagatataatctc

SEQ ID NO: 1128 - DNA, 101 bp, rice(Oryza sativa)
  misc_feature (71): n=t or c
cgaggcaggagcacgagaagcgggtggtgctcgagacgatcgtgagcctgctgccgagggagaggaacacnctgtcggtgagcttcctgtcgatgctgctc

SEQ ID NO: 1129 - DNA, 101 bp, rice(Oryza sativa)
  misc_feature (71): n=t or c
cgcttctgctatggaaaaggacaaaaaaaacagtagggagagataaaaataagacatgaagaaaatggccntgtgctgcttgtttgttggatggtttggaa

SEQ ID NO: 1130 - DNA, 101 bp, rice(Oryza sativa)
  misc_feature (71): n=a or g
gatgccacttcgaagagttttaaccatttttatgcccgaaatgcccttggctatggccgtggagagagagngagggagaggggagcgccgggggaggaccg

SEQ ID NO: 1131 - DNA, 101 bp, rice(Oryza sativa)
  misc_feature (71): n=t or c
aaattttaagaatttgtagttgtaaaattataaaaatgaattagggttttctaagttctccatattctcanttaggctgtgtttggaactccaagttccca

SEQ ID NO: 1132 - DNA, 101 bp, rice(Oryza sativa)
  misc_feature (71): n=a or c
gatgaaactgggccccacccacgatcctggcccacatcccagtgggtcgggtaagaaacggcccaggtgcngaaagtagcaccaccattttagccacctcg

SEQ ID NO: 1133 - DNA, 101 bp, rice(Oryza sativa)
  misc_feature (71): n=a or c
aagaaactctggagcagttaaaagatataaacccaatatgctaacttttgcacaaaaaaatccaatcaaangatggactattaattaactctttatataca

SEQ ID NO: 1134 - DNA, 101 bp, rice(Oryza sativa)
  misc_feature (71): n=a or g
agaagggcattcttgtagaactcagcaaattcttggcgagccttatggtactgagatgatatccagtagangctagcatgaactgtgggatcaacatcagt

SEQ ID NO: 1135 - DNA, 101 bp, rice(Oryza sativa)
  misc_feature (71): n=t or c
gtttggtattatcaaaattatcaaaagtttgatgttaccaaaatttgaaagggttaggccaagtttagttncaaatttttttcttcaaacttccaaacttt

SEQ ID NO: 1136 - DNA, 101 bp, rice(Oryza sativa)
  misc_feature (71): n=a or g
ttttcatggttctcactggtgctacaagaggtattgtagaactacaagaaagtagttctgtagcacacccnaattactagggatctgaagtgacaaatgca

SEQ ID NO: 1137 - DNA, 101 bp, rice(Oryza sativa)
  misc_feature (71): n=t or g
atccgcatcgatcttgggggcgtgacgtcgtacactgattgctgaagaaaccaagaacagaataaacgaangcctactaaacaaatgttctgttctgatgc

SEQ ID NO: 1138 - DNA, 101 bp, rice(Oryza sativa)
  misc_feature (71): n=t or c
caggtactcgacggctgcgtgcgttgcgtggctgggtcatcacggtcacgacctcacacgggcatcagacngatcggatgctagtaaatgcggacgaggcg

SEQ ID NO: 1139 - DNA, 101 bp, rice(Oryza sativa)
  misc_feature (71): n=a or g
cagtttttttttcgatccctgcatggtagaaatagaatcgcttacatggcttgggaagctgctcctgcagnttggggttgagcttccgctcccccgtaaca

SEQ ID NO: 1140 - DNA, 101 bp, rice(Oryza sativa)
  misc_feature (71): n=a or c
aagattagtaatgctagtaggcggatggatcccaaaggttatagacacagcattccagattaatctaaccnaatgacaatcaataaaaagatgttgtatcg

SEQ ID NO: 1141 - DNA, 101 bp, rice(Oryza sativa)
  misc_feature (71): n=t or c
aatcgtaccataattgttatgcacaattagctctaatgatctattttggacttgggtcaatggtcaatacngtatcatgtttgattgttaatcactatcct

SEQ ID NO: 1142 - DNA, 101 bp, rice(Oryza sativa)
  misc_feature (71): n=t or c
tcttgccggggcactgcttgttgtcaacgctagggttctccgtctctcgcccattcgaccagtacacgtantgcagcagcttcctcccctcctcgccgacg

SEQ ID NO: 1143 - DNA, 101 bp, rice(Oryza sativa)
  misc_feature (71): n=t or c
ttgtaaactaatgtatccaatttatttcatgaatatggcaaggcaacaggttacctagtactaacattganatctcaagtcactgttagtcatacaaacca

SEQ ID NO: 1144 - DNA, 101 bp, rice(Oryza sativa)
  misc_feature (71): n=t or c
cttagcattccttttccttatggtactttgaacacatatgcaggtggtgtttgaccatgatggtgagcttnttcaattggataattctcatattcactgag

SEQ ID NO: 1145 - DNA, 101 bp, rice(Oryza sativa)
  misc_feature (71): n=t or c
gcgagaaataaataaataaatacaacccaatgcagaccaaagtttagtatcctttctctcatagttttcanagctaccaacaaaaattagtctgaaagaag

SEQ ID NO: 1146 - DNA, 101 bp, rice(Oryza sativa)
  misc_feature (71): n=t or g
ccaccttcgctcgctcgctcgatcgaagcgggacatccatgatgcgtaaattggcaggtcggtgtgtgtgngggggctgtggaagcgagcaagctggaaca

SEQ ID NO: 1147 - DNA, 101 bp, rice(Oryza sativa)
  misc_feature (71): n=t or c
aatggcaagaaacagaaatggatcctaacatccatatggaagtacaatagccatcttgaccaagtccaagncctcacagaatcaagaatttttttagtaca

SEQ ID NO: 1148 - DNA, 101 bp, rice(Oryza sativa)
  misc_feature (71): n=a or g
gatgatggggaaaattataccacatgcactctgcagtgaaaactctggattagcaatagtatagaaacggnaaaaaaaagtctatttagggtttagcgttt

SEQ ID NO: 1149 - DNA, 101 bp, rice(Oryza sativa)
  misc_feature (71): n=a or c
gcctgcgcaagcatgcatgcttgcttggctgattgctgctagctgccgcatcatcctctctccctgatggnagcacgcagcaaaggtttcaaacgcgagcg

SEQ ID NO: 1150 - DNA, 101 bp, rice(Oryza sativa)
  misc_feature (71): n=t or c
tatatggcccatattgacatcaagttggccctcaaaaatctaaagcagagagctaaggcctaagaacatgnacaacgttctttattagtggactctcttta

SEQ ID NO: 1151 - DNA, 101 bp, rice(Oryza sativa)
  misc_feature (71): n=t or g
ttaatttttctgagtgtgtcggtgtgtacgttacaattgttgtaagcacggcctgatgttttgttcttgtnattcaacataaataaagatggttttcttct

SEQ ID NO: 1152 - DNA, 101 bp, rice(Oryza sativa)
  misc_feature (71): n=a or g
atttgtagccaattatagcacggactctaagacacaattaggggcggatccagaaacagaaaattaggggnggagggcctcaattacatggtttcttcaac

SEQ ID NO: 1153 - DNA, 101 bp, rice(Oryza sativa)
  misc_feature (71): n=t or c
gaaaaatcggttgcatacatatgttattttgtaattaagattcggattgtatctctgtttcgttagcacgnttttaaactattaaacggtatatttcatgc

SEQ ID NO: 1154 - DNA, 101 bp, rice(Oryza sativa)
  misc_feature (71): n=a or c
aatcgcggcaagtgaaatgctggtcggcgatgatgcgatcaccaagcgccttgaggctcttcaccgacagnggcttcagctcgtgaatctaaacaggtaac

SEQ ID NO: 1155 - DNA, 101 bp, rice(Oryza sativa)
  misc_feature (71): n=a or c
aactttcttgttagtgaatattgcagtcctaatccctcaacaatcacatcagcaaatcagccgtgagatgnagctcacgaacaagttgcattcttttttat

SEQ ID NO: 1156 - DNA, 101 bp, rice(Oryza sativa)
  misc_feature (71): n=a or t
tgttcctaaaatgctaagcttttagataaatgtggaaagttcacttatgcaaatatgaaagtttttttttnaaaaaaacaccactaatatattatcgactt

SEQ ID NO: 1157 - DNA, 101 bp, rice(Oryza sativa)
  misc_feature (71): n=t or c
tttatttttttgtgaatagaaatgtttttgctctattttgttttttcccaagacaaaaatacccctgatgnaggccccacctgtcatactcactcacctct

SEQ ID NO: 1158 - DNA, 101 bp, rice(Oryza sativa)
  misc_feature (71): n=a or g
gccgttccacaactccactctagactctgctcttagaattagatttcggaattatagtcctaccaaacagnccataataagttggtgtaagatactaaaag

SEQ ID NO: 1159 - DNA, 101 bp, rice(Oryza sativa)
  misc_feature (71): n=t or c
gaggcatttttatgatatactccctccatttcattttaagtagccataagtttccatattcaactttgatnatccatcttatttaaaaaatgctaaaattt

SEQ ID NO: 1160 - DNA, 101 bp, rice(Oryza sativa)
  misc_feature (71): n=t or g
tacaagctaccttgtgaaggttcacctaaacttaacctagtgtaagtagtctactattttcttcactgtcntctgtcatattgaatgcagttgtttcctaa

SEQ ID NO: 1161 - DNA, 101 bp, rice(Oryza sativa)
  misc_feature (71): n=a or g
acgagagcaaacaaatcttcccaaactcgatcactcgcttctctcacctgctcgagatatttgggcaggancggagaacgaggcaggacgtgtggggtagt

SEQ ID NO: 1162 - DNA, 101 bp, rice(Oryza sativa)
  misc_feature (71): n=a or c
tctgttcacagtgcaagcatcgagtcggacccacagtgcacgactttaccaaatcaatccccaaactcctncctcatcacgcactctccggctccttcctc

SEQ ID NO: 1163 - DNA, 101 bp, rice(Oryza sativa)
  misc_feature (71): n=a or g
aggcacctgttgtatgcaatgcaaatgggggcatgttttctgtgaactgtttttgcctgattgttataggngcctagtaactggtgtattagcggcccata

SEQ ID NO: 1164 - DNA, 101 bp, rice(Oryza sativa)
  misc_feature (71): n=t or g
gcgaagaggtggtgaaaccacggccatgtcttggagttcagcacagtgccacagtctgtctttggctgtgnttagttcagcgcaaagtttgaattttggtt

SEQ ID NO: 1165 - DNA, 101 bp, rice(Oryza sativa)
  misc_feature (71): n=a or g
tccttgatctggcagcgtctccatacgtacgagcagtgatttctcactactacagaaaatttttttgcagncggtcaaaaccaatcttaacgtgtggttag

SEQ ID NO: 1166 - DNA, 101 bp, rice(Oryza sativa)
  misc_feature (71): n=a or g
atgttcctcagtccaacagatgaacttggggagaaccaattatttcctggacagaaaacagtgcaggtccntattcgttattgttatgcagaattgcagac

SEQ ID NO: 1167 - DNA, 101 bp, rice(Oryza sativa)
  misc_feature (71): n=a or g
taatcaattcatcaatgccttatctaccaagtcatgcattttattatgaccttcggaatgatgataattcngtcggtcatgccgtcagggtatccacatat

SEQ ID NO: 1168 - DNA, 101 bp, rice(Oryza sativa)
  misc_feature (71): n=a or g
gcttaccacagtacatcttttaaattgctaactgtatgtttcgtgaaaaaacttcttatatgctccttccnttttatattatttgtcgttctagcaaatct

SEQ ID NO: 1169 - DNA, 101 bp, rice(Oryza sativa)
  misc_feature (71): n=a or c
aaataagtaaaagaattatgaaaggttatcgaatacattttttcaagatatccagagaacatcggacgatncatataaaagaagatttcaaataaaacagg

SEQ ID NO: 1170 - DNA, 101 bp, rice(Oryza sativa)
  misc_feature (71): n=t or c
ctgagcatgggccgctcagggtgactaggtgctactgagtttcttaggtgacacctaggctttgtggtcancttctttggaattccctttttgtatgaggt

SEQ ID NO: 1171 - DNA, 101 bp, rice(Oryza sativa)
  misc_feature (71): n=a or c
gtcatggagtggagactgcgaggtgcgaacagtgagacagggcaaacgtgagaacccgtgtgaaacagtgnagttctgtcggagaaacacggcctcccccg

SEQ ID NO: 1172 - DNA, 101 bp, rice(Oryza sativa)
  misc_feature (71): n=t or c
tgaaggtccacttaaatacttgtggatgtgttctgatggtcggtcgtctgcaaagattcattattgtagangaccaacttaaatagatagcctatcataaa

SEQ ID NO: 1173 - DNA, 101 bp, rice(Oryza sativa)
  misc_feature (71): n=t or g
cactccagatacagaaacatgtctcgtgctctgcctccgccaccgctttcctctgttcttcgtgtctctcnctggtcgtcttctcgtctcatctcatctgc

SEQ ID NO: 1174 - DNA, 101 bp, rice(Oryza sativa)
  misc_feature (71): n=t or c
cgcatcggatcgatcgatcattttttctaccaaacaaccgtcccaataacgtaaacgagtaacagcacagntctcaccaagccatagaaagggcaaagagt

SEQ ID NO: 1175 - DNA, 101 bp, rice(Oryza sativa)
  misc_feature (71): n=a or g
gacaaccttgtgatcatcgctcaggcagagcatctatccgaagaaaaacagagtcaatccaagatgagganctgtccaaaaaatgattagtattcttggca

SEQ ID NO: 1176 - DNA, 101 bp, rice(Oryza sativa)
  misc_feature (71): n=a or c
caccccgagtccccgacgaccggactgttccagctcaaactcactatagtagagagtactccctccgtccnaaaaaataataatctaggattagatgtcac

SEQ ID NO: 1177 - DNA, 101 bp, rice(Oryza sativa)
  misc_feature (71): n=a or g
caaatcccaatttcccggtggaataaacggagcacgacaggaacgaagagagacagaagaaaaaaaaagangggccccaccaaatttacccccactaccgc

SEQ ID NO: 1178 - DNA, 101 bp, rice(Oryza sativa)
  misc_feature (71): n=t or g
atactctgtagctgcaggggattatcatataatgttggtcactgctattgtttctctgctgtctttctttnttctgtaagggttttcatgctaaatgtata

SEQ ID NO: 1179 - DNA, 101 bp, rice(Oryza sativa)
  misc_feature (71): n=t or c
ctttggttttgtgccgggtttaaacctatctttatctaaagacgtctaaaatattcaaaatagtctctctnttttttttgaagtcattcaaaatagtcttt

SEQ ID NO: 1180 - DNA, 101 bp, rice(Oryza sativa)
  misc_feature (71): n=a or g
ctgcatattaaacaatcacacaaccaatacccaagaaatcactctttctatccttacccatgcaaaaatcngtagcggcgacatcaattgctagcttgatc

SEQ ID NO: 1181 - DNA, 101 bp, rice(Oryza sativa)
  misc_feature (71): n=t or c
atgatatgaaaacaatgctacccgacccagatgcttttaaaagaggatgcccaagttgacacaaatgatangcagattcaagatttgtagccatcaaaaat

SEQ ID NO: 1182 - DNA, 101 bp, rice(Oryza sativa)
  misc_feature (71): n=t or c
cctgacgagccgtataatcacttgtacgtgcacaacgaagacaaaccagaatctgtccaaaaatccgcagngaaatacggtgtttcaccctgccgtcctct

SEQ ID NO: 1183 - DNA, 101 bp, rice(Oryza sativa)
  misc_feature (71): n=a or g
aaatggtcggaaaatcattttatctggtgtagattgccgaccaaatcgattggttgatacatatggcagtnaaagagacacatcgtgtgttaataccagct

SEQ ID NO: 1184 - DNA, 101 bp, rice(Oryza sativa)
  misc_feature (71): n=t or c
agtatgaacaaattcacatcacagatttacatcacaaataaaaaattcacaggaaacaaattcacaaattngcatccgcgcagcccgccgccgcccggcgc

SEQ ID NO: 1185 - DNA, 101 bp, rice(Oryza sativa)
  misc_feature (71): n=a or g
atctgtccatcagtttaactcctataccatttcatctccagggaattggacggctttcactagttgcagcntctgctgcccagtctgctgccagtgttgtc

SEQ ID NO: 1186 - DNA, 101 bp, rice(Oryza sativa)
  misc_feature (71): n=a or g
tgacggactgacggtcagagggccgggagcgggtaggtcttgggccgtggactcgtgcgcagtcaattctntgttgttgttttttctttttcgggagaaaa

SEQ ID NO: 1187 - DNA, 101 bp, rice(Oryza sativa)
  misc_feature (71): n=a or g
taatatcttgtgcttggctgctactcctgccttgcccgttgctagttgctgcaagctaactatagtaactnctgctgctgctgctcgctactcctgcatgt

SEQ ID NO: 1188 - DNA, 101 bp, rice(Oryza sativa)
  misc_feature (71): n=a or c
ttcactccggtctaccctctccatcttaaaataactcaacctaatatatggtgagatccatcctagtgtanaatgaatctcaacaaaagcttattcggatt

SEQ ID NO: 1189 - DNA, 101 bp, rice(Oryza sativa)
  misc_feature (71): n=t or g
gacgtcgtgagtgggtgggcagttgataagtaaggtgcatgtggatgcatcagatcccattcttgtgccanggagagaataatggggagacgactctgcat

SEQ ID NO: 1190 - DNA, 101 bp, rice(Oryza sativa)
  misc_feature (71): n=a or g
tgatatgacacatggcatattgcctttaaaaaaaaaaaaaaactcgacctacaggggtaagacagcccccnggcattttacacagcggcgccgtggcccgt

SEQ ID NO: 1191 - DNA, 101 bp, rice(Oryza sativa)
  misc_feature (71): n=a or g
ccgccaaatacacaacctttgtttaaaatttggccggcccgttacaaactaccggatgccaatcttgtgcngtctgagcacccacggcctacctgcgccac

SEQ ID NO: 1192 - DNA, 101 bp, rice(Oryza sativa)
  misc_feature (71): n=a or c
cgattacgcatttgcaaaaatgccgctcaagattcgatccgtttttttgtcgattgctgcagaataaacantctctctctctctctctctctctctctctc

SEQ ID NO: 1193 - DNA, 101 bp, rice(Oryza sativa)
  misc_feature (71): n=a or c
gccccgcgcaaagcgtgcaagccagcatcacacaaacacaaatctgggaagccgtgtagcgcgcgtcatcncgtcgtcccgtcgtcctgctccgcgccgcg

SEQ ID NO: 1194 - DNA, 101 bp, rice(Oryza sativa)
  misc_feature (71): n=a or g
cataacttgatacttacttcagtgtcaaatccctgtcataagagtaataaagcccatgagtagtttctgcnattttcaggagagacatgaaatatgcctca

SEQ ID NO: 1195 - DNA, 101 bp, rice(Oryza sativa)
  misc_feature (71): n=a or c
gttcatgcattactcaagaatttgatggtgatttatctgtgggtgagggtaactatatactccctccgtcnaaaaaaacttaacttctagagtccaattta

SEQ ID NO: 1196 - DNA, 101 bp, rice(Oryza sativa)
  misc_feature (71): n=a or g
cgcgagataacagtttttgctagttattgccggcgtatatatccaacggatggacccaaaaatattggggnctaagatgcctagggaagaaggaattcatt

SEQ ID NO: 1197 - DNA, 101 bp, rice(Oryza sativa)
  misc_feature (71): n=t or g
attttagccatggacggagccggaggccgccgtttttagaagtggggcgtggcttcggggttcgagatggntcgggaacccggtacacgtgtcgcttgggc

SEQ ID NO: 1198 - DNA, 101 bp, rice(Oryza sativa)
  misc_feature (71): n=t or g
ctctagtctaaagtcttcaaacctactgggaaatgaagctcccacggcattttgagctggcgtggccatcncgaggtcgcgacgcgtggacgcgtgctgga

SEQ ID NO: 1199 - DNA, 101 bp, rice(Oryza sativa)
  misc_feature (71): n=a or g
atcggatctgatccttaactataaaacctggtataagccaacttcgaaaactaatgcaaatattctccccngacagtattgagccaagttttagcttacat

SEQ ID NO: 1200 - DNA, 101 bp, rice(Oryza sativa)
  misc_feature (71): n=a or g
actaggtccgagcctctgtttggcggcataagagagaaggagagatccagtggtcgtagaggcggtcgggntggtcgtgcacgagagggaatttccagcgc

SEQ ID NO: 1201 - DNA, 101 bp, rice(Oryza sativa)
  misc_feature (71): n=a or g
aatacatcagttgtcaaatctaattttatccgaatagggtcggtttgtactagtaataaaagctatgcaanttttactgcgcacattctaaaaatattaga

SEQ ID NO: 1202 - DNA, 101 bp, rice(Oryza sativa)
  misc_feature (71): n=a or g
taaatacagccaaacaccatggaggcaaaaacggcgagaggtggtggggatggcacgagatggcagcccgncggagacacggcaacgtgagatctggatgc

SEQ ID NO: 1203 - DNA, 101 bp, rice(Oryza sativa)
  misc_feature (71): n=a or c
tgtccgccacgtagggccggatcttggcgcggccctcgaagttgtaggtgagcaggatgccgttgcagtcnggcgtgggcgccggtgccgccgccgccgcc

SEQ ID NO: 1204 - DNA, 101 bp, rice(Oryza sativa)
  misc_feature (71): n=t or c
tgtcgagagtgatggaagggtgtgaccaatgaagcttctagatatggtgttttcattggcagcgacatganggtgagccatcatgcttctcgttggagttt

SEQ ID NO: 1205 - DNA, 101 bp, rice(Oryza sativa)
  misc_feature (71): n=t or g
ctatgttacattgagaaaaaagtatgccctcagctgaaaaatgatatacgaaagagaatgaaggtaatatnattatattaaatttgtgtacggcaagccta

SEQ ID NO: 1206 - DNA, 101 bp, rice(Oryza sativa)
  misc_feature (71): n=t or c
tcttctcccacaaagaccggttcctcccttgtggccgtgccgtttcgtccaaagggcccaccggctgacangaatttgggagaattgtaacgcaacgttct

SEQ ID NO: 1207 - DNA, 101 bp, rice(Oryza sativa)
  misc_feature (71): n=t or c
taaccatatcattgtttctctcttgccggtatatggttcgatctacatgaaatacatttatttccacaagngaatagcaactccgctggctttctattgtt

SEQ ID NO: 1208 - DNA, 101 bp, rice(Oryza sativa)
  misc_feature (71): n=a or g
atttataacggaaccgagccatgtaggatctcaccagatcatataaaaactgtactgctcaaacaaagagnaatagatactttgtggtaagtgcttaaatc

SEQ ID NO: 1209 - DNA, 101 bp, rice(Oryza sativa)
  misc_feature (71): n=a or g
gggttggcctgggcctgctgcaagtttgacctttatgagatcaagaaacagattcattgataacgaaagantccaaaatggtaaaatgaaatacaaccatg

SEQ ID NO: 1210 - DNA, 101 bp, rice(Oryza sativa)
  misc_feature (71): n=a or g
gaggttgctcatggcctcaaagaacaatttttctaagcttgtcctcaccaccaccaccaatggatgccccngccaccaagctccattgggtcactatttta

SEQ ID NO: 1211 - DNA, 101 bp, rice(Oryza sativa)
  misc_feature (71): n=a or c
aaaatttggcttggagagtcacttacccattctcttggagatgctcttataaaggagactagctagcttcnctcagttgagctgggtgcctgggtaaagct

SEQ ID NO: 1212 - DNA, 101 bp, rice(Oryza sativa)
  misc_feature (71): n=a or g
aagctggagatgtctatctggagttcgtgttaatagacaaatcatgcaattgcttccaaatataaaggtcnaacactagcctcgcttgattaatttatatg

SEQ ID NO: 1213 - DNA, 101 bp, rice(Oryza sativa)
  misc_feature (71): n=a or c
gcgaagaaaaagaaatgctactgcattttaaactttgcccaacagggagactcagaacaggcattgaaagnatgcaagactctggagggtattactgccgc

SEQ ID NO: 1214 - DNA, 101 bp, rice(Oryza sativa)
  misc_feature (71): n=t or c
tcacagcccaacttacagataaattacatctccgtccccacaatcactctctctctaaggaatgatcaggngaactaggttcgtcatcactactaatatca

SEQ ID NO: 1215 - DNA, 101 bp, rice(Oryza sativa)
  misc_feature (71): n=t or c
aagcgaaagggttatactttgccagtagaacaaagactatattgaatacaaggcgaaggcggcttaaagcngaacaaacaaaaagcttatatacaaaaact

SEQ ID NO: 1216 - DNA, 101 bp, rice(Oryza sativa)
  misc_feature (71): n=t or g
tgttcattcagaaaaagaatggtgtgactggttcaatgttttaccggcagaagccggcggcacgtccagantttgagcttttgggtgtgtgtagttcgcga

SEQ ID NO: 1217 - DNA, 101 bp, rice(Oryza sativa)
  misc_feature (71): n=t or c
gagctttgtagatttatacctgtcctaatcagagtatactgtatttataaaacaactgccttttttttttncataaaagttcagtaaaatgcgttctcttt

SEQ ID NO: 1218 - DNA, 101 bp, rice(Oryza sativa)
  misc_feature (71): n=a or g
agtgaatagaccctaaaatttatcatgagtaaatgaataaatctcaaacatctttatttttaatcttacantatgtaagtcatacagagtgagtctacctt

SEQ ID NO: 1219 - DNA, 101 bp, rice(Oryza sativa)
  misc_feature (71): n=a or g
tacttgctctgttccgtgcacgcgcgccccgcggtacaggtcggcacgggtgctatatatatgtacgttgnaccgtggcgccatgtaccggccgcgtacgt

SEQ ID NO: 1220 - DNA, 101 bp, rice(Oryza sativa)
  misc_feature (71): n=c or g
atttttgccggttcggtttgcgagggacggctcctccaaacatcgcttggttttgagaccaggaagaaacngaggagaggcctcggctaatcggcttatag

SEQ ID NO: 1221 - DNA, 101 bp, rice(Oryza sativa)
  misc_feature (71): n=t or c
agtagtatagctaaacttttaagaaatatatgtgggtattcacttgaatacctatgattaggatgtactcnctccgtcccataaaaaaccaatctagaact

SEQ ID NO: 1222 - DNA, 101 bp, rice(Oryza sativa)
  misc_feature (71): n=a or g
agccaagccaaccgggcatggttggcttggcaaagcgagatgttaaggcacatgttatccgtgtcgcttanttcaagcggcaaaagcgttaaagcgagatc

SEQ ID NO: 1223 - DNA, 101 bp, rice(Oryza sativa)
  misc_feature (71): n=t or g
gcaatactaggtatagagcatctctcaactatcaaaaccagtatgaatcgagtctcttagtcgtttttttnatggtttggctgacgtggaatcctaatcag

SEQ ID NO: 1224 - DNA, 101 bp, rice(Oryza sativa)
  misc_feature (71): n=a or g
cagtggtaaacagataaagaagagggccggcagcgctgtgtttagaggcagtggtagctaaagctaaaacntttaggtgctaattaactagtgccaacctg

SEQ ID NO: 1225 - DNA, 101 bp, rice(Oryza sativa)
  misc_feature (71): n=t or c
ttccattcccgagaatgtgtaccagctgcatgtgttcagttgatgctacccctactcgtcagtgtgttacnccattttctttttactaaaacttttattgg

SEQ ID NO: 1226 - DNA, 101 bp, rice(Oryza sativa)
  misc_feature (71): n=t or c
ttccaatcatgggccggctgccaccgtgagtccgtgtggcgtatttcccgcggaataagttcattctaggncccttacattatcatcgagtttaattaaac

SEQ ID NO: 1227 - DNA, 101 bp, rice(Oryza sativa)
  misc_feature (71): n=a or g
gcagtcatcactaataaggatttaaaacctcgtatgagccttcttctaatttagtaatggacatgtgagtnaaaaatcgaatgccgtaaattttacagact

SEQ ID NO: 1228 - DNA, 101 bp, rice(Oryza sativa)
  misc_feature (71): n=a or c
aggactaaggaatattttcctatagtacagtaaagttctttgccttgttcaaattcaggaactagggcctntttgaattggagaaaaaaatacagaagaag

SEQ ID NO: 1229 - DNA, 101 bp, rice(Oryza sativa)
  misc_feature (71): n=t or g
aaaagtcctttgtgtctatctcttttcttattcccgtacttttcatgtgcttattaaaatggctatttttngggggttttttcctaatccataggatttga

SEQ ID NO: 1230 - DNA, 101 bp, rice(Oryza sativa)
  misc_feature (71): n=t or c
gagtcttaaaaatctaactcccacaaatccacgaggaaagatagtattaattactaggttcataccagaanagcaatagtgttacataacatggggattat

SEQ ID NO: 1231 - DNA, 101 bp, rice(Oryza sativa)
  misc_feature (71): n=t or c
acattttgaatgcgtggcatgttctcctgctgagaatttggatggagcgcaagcgtgatgccacgtggctnagtgagaggcctgggattagacctgaaatc

SEQ ID NO: 1232 - DNA, 101 bp, rice(Oryza sativa)
  misc_feature (71): n=a or c
tcctaagtcaccagttgtagttcatgtctcaacatcatttgaagtgtagaacaatgatattttttgaatanttatcatacataaatattaatgttaaatat

SEQ ID NO: 1233 - DNA, 101 bp, rice(Oryza sativa)
  misc_feature (71): n=a or g
catttaaaaggggaattgcttttatggtccactctgcactgcatgtttaattcttcttttgctgccccttngacttggttttttttgtctccgtggcctgt

SEQ ID NO: 1234 - DNA, 101 bp, rice(Oryza sativa)
  misc_feature (71): n=a or c
cccgccgcctcccgattggaatcttgcggaggagacggagattcccaggaggaggaggcagcgagatctancgacctacggaagccggcgagatctagcgg

SEQ ID NO: 1235 - DNA, 101 bp, rice(Oryza sativa)
  misc_feature (71): n=t or c
gaagtggagtgcaaagattaaggtggtgtcagaggaaaagggtccacagatcttcaataaagggttctgantgattctacccctacttctcaccccatcac

SEQ ID NO: 1236 - DNA, 101 bp, rice(Oryza sativa)
  misc_feature (71): n=a or g
cccccctaacacacacacacacacaccaccgttggcgctgtttaggagaaaacacggcggcggcggaagcngtgcctctcccctccctctccagcctcctg

SEQ ID NO: 1237 - DNA, 101 bp, rice(Oryza sativa)
  misc_feature (71): n=a or t
tgatgtccgagcaagcatcaggttggtttgtttccttatcacacctcatctggtatcaaaagctttttttnaaaaaaagatctaatcaacaactctgcatt

SEQ ID NO: 1238 - DNA, 101 bp, rice(Oryza sativa)
  misc_feature (71): n=t or c
cttttttggactcactttaatcaatattgattcaacatccaacatttacacctatatatagtacttccaancaacattaacaagtatccataaacacagga

SEQ ID NO: 1239 - DNA, 101 bp, rice(Oryza sativa)
  misc_feature (71): n=a or g
ctttctaaatttcagggcagatcaggagatattacagatctcggaaggcggatcgttaattgtctgttacntagcctagtagtacgtacccaagttctgag

SEQ ID NO: 1240 - DNA, 101 bp, rice(Oryza sativa)
  misc_feature (71): n=a or c
taggtggtttgctaaaccttgcattcattggtgatgatctaaaattaaaagcactccctttcagtctgttnagaaagaaaaataagcacatgccttatagt

SEQ ID NO: 1241 - DNA, 101 bp, rice(Oryza sativa)
  misc_feature (71): n=c or g
tgtattctcttcgattttaagaattggggagtcaagctaaattctcgttgatccgagaaacggtggaatgnaatggattaattggagtgtatctaaaaatg

SEQ ID NO: 1242 - DNA, 101 bp, rice(Oryza sativa)
  misc_feature (71): n=t or c
gcgcacgtgcgacgcacgcatctccctgtacaaaaccctagccttccccatcctcgcctcctcctctctcnccccgcaccaccgcctcccctcctctcctc

SEQ ID NO: 1243 - DNA, 101 bp, rice(Oryza sativa)
  misc_feature (71): n=a or c
taatgagccaatctgattcatatccttaactattaaaacagtgccacatatcaggtcaaaactatcacgtnaacgtgacggcagcaaaaccattcttcaaa

SEQ ID NO: 1244 - DNA, 101 bp, rice(Oryza sativa)
  misc_feature (71): n=a or g
tgactcgtagagattttttccataattcggggcgtattccatacgacatttatgggaactatcagtatacncgaaggtataccttagtggtatatttcata

SEQ ID NO: 1245 - DNA, 101 bp, rice(Oryza sativa)
  misc_feature (71): n=a or g
actaatataaaccaatgtgaaaaaaaatatacagaagtttcataagccacaccaccttctcggcctcatcntcgccaccttcctcctccctctccctctca

SEQ ID NO: 1246 - DNA, 101 bp, rice(Oryza sativa)
  misc_feature (71): n=c or g
aaattaaaaaaagaaaaacgccagtccagtatattcaaaaaggagagtacaacaacaacgtactacctccnttacaaaatataagacattttggctttgcg

SEQ ID NO: 1247 - DNA, 101 bp, rice(Oryza sativa)
  misc_feature (71): n=c or g
gttagctacatatggattctatagatcgattattgcccttttcttgcgctgatgctggaaaattaagaganaaataattctactagctacgtacgtagaaa

SEQ ID NO: 1248 - DNA, 101 bp, rice(Oryza sativa)
  misc_feature (71): n=a or t
tcagactcggattggcttctccggaccagcctcgaatcggacaacctgtagctgaatcgatcgcctacatncgtataccagtactactatatattttggtt

SEQ ID NO: 1249 - DNA, 101 bp, rice(Oryza sativa)
  misc_feature (71): n=a or g
aaaagctcgaagctcgaacgagtcgagcccgagcctgactgaaagcttgacacttgatgaggctcggctcnagctcaactcgagtttgtaccgagctcgag

SEQ ID NO: 1250 - DNA, 101 bp, rice(Oryza sativa)
  misc_feature (71): n=t or g
ttactccagcctagttgcagttgcagttgcagttgcacttgcgccgttgcgttgcgcgctgggctggctgnctggatgcccccaataatgtcctgcacgtg

SEQ ID NO: 1251 - DNA, 101 bp, rice(Oryza sativa)
  misc_feature (71): n=a or c
ttatactatttgatgatatgcacgaaacgaggacacgttgctatcaaagtctatcccttcagtaagtaganaaccaccaatataatactatttgtatttct

SEQ ID NO: 1252 - DNA, 101 bp, rice(Oryza sativa)
  misc_feature (71): n=a or g
tggtttttttttaaatggagagggtatatattacgttgtgcctaatcgtcatggactgggccgagtaaganatcggtgatgacccccttgagcccggagcc

SEQ ID NO: 1253 - DNA, 101 bp, rice(Oryza sativa)
  misc_feature (71): n=a or c
tcttacagctagtaaaatggtagtagtttactgatacaaaaggtaagagaaacatatgatggaaatttctntagtctgcctattcatttcagtgtatcaaa

SEQ ID NO: 1254 - DNA, 101 bp, rice(Oryza sativa)
  misc_feature (71): n=a or g
cgccacgcgaatcttccaaaaacaaccaaaatccgcatccccgctcgccacatcaatcccaatcggtcccnagcgaagcaaacctctcccggcaccggcac

SEQ ID NO: 1255 - DNA, 101 bp, rice(Oryza sativa)
  misc_feature (71): n=a or c
aattggatgcaatctgcaaggagttagcctgagagcatacattgcaatctatggcgaatcgccgggtgagnatgattgcggtgttgcgttctctcgtcgtt

SEQ ID NO: 1256 - DNA, 101 bp, rice(Oryza sativa)
  misc_feature (71): n=t or c
ttgggctttttttttcttttgctcctcgtagtgatttagtacagttttacactaaggttccgtaggagttnggagtttggactgggatttttcaagtcatt

SEQ ID NO: 1257 - DNA, 101 bp, rice(Oryza sativa)
  misc_feature (71): n=t or g
atactagctaagctatgtttcctggatttgtccacatgtacgcttgaacacgtacagttaattgttgtgcnatccgtcgagaccagccaaagcaaggcctc

SEQ ID NO: 1258 - DNA, 101 bp, rice(Oryza sativa)
  misc_feature (71): n=a or c
ttttgcccgggtcgtctcttgtataattgatggtacattctctctttaccctctatatgccatctaggatnttatatgatatggcaatttgcaaagtgaca

SEQ ID NO: 1259 - DNA, 101 bp, rice(Oryza sativa)
  misc_feature (71): n=a or g
gacaaagctaactccagtcactctggacatcagaaaatcacacatataccaacactcccatctcaaacgtngaatataagggttggtttggtttgaggtct

SEQ ID NO: 1260 - DNA, 101 bp, rice(Oryza sativa)
  misc_feature (71): n=a or g
acgaaaatggtgctctaagctgatgcttgattcgtatgacgtatccaaagatatcattccacggtgcttcnactgtatcaacagttaatagctccgcgata

SEQ ID NO: 1261 - DNA, 101 bp, rice(Oryza sativa)
  misc_feature (71): n=t or c
agggtcaattgatcgatgaatagtactactatgcatgggccaattgaggaatcttcaaacattaattgccngtaggctggcaagcaagatctatgtacaca

SEQ ID NO: 1262 - DNA, 101 bp, rice(Oryza sativa)
  misc_feature (71): n=a or g
aacaaacatatccagattaatagctcgtatttagttttcttaagacagaaggagtacatcaaaataaaagnaaaaaaaagcaacacacatggtaagcaggg

SEQ ID NO: 1263 - DNA, 101 bp, rice(Oryza sativa)
  misc_feature (71): n=a or g
caacaccctacaacattggtttcgtaaagagcaacagacagcactcaatcatgacactccatctttccatncgaaatactgctataactagaatttcagat

SEQ ID NO: 1264 - DNA, 101 bp, rice(Oryza sativa)
  misc_feature (71): n=a or g
tcagacttcatctcagcttcatactctgttggtctttcttcatctcatggttgcacactagccacaaaacnatctggtactctcactcacttaacatgctt

SEQ ID NO: 1265 - DNA, 101 bp, rice(Oryza sativa)
  misc_feature (71): n=t or c
tgtttgtttcattgtagtttcccgtacgatgtcctaccattcaaggctttaagagttttaccgttcccccntttttttttttttgaagtggacgagtttta

SEQ ID NO: 1266 - DNA, 101 bp, rice(Oryza sativa)
  misc_feature (71): n=t or g
aacacgcttgacaccctagatcatcaaattaaattgcccttctaaacatggctgtccgcacgccttttttngcacgatatcgatttgatttgagggctgag

SEQ ID NO: 1267 - DNA, 101 bp, rice(Oryza sativa)
  misc_feature (71): n=a or g
aggtttccaaggtgggctcaaccatccatgagatatgttgtaacctttacaacgcaagtaccaatgcgacncattctctctaaaaagataatggctatcaa

SEQ ID NO: 1268 - DNA, 101 bp, rice(Oryza sativa)
  misc_feature (71): n=t or c
gtcatccatcaccttgtcgaccattgtggtgtgccaaaccgcggctgtcgtctgtttgtgattttgtagtntgcttgtactccctctggaagtgtttttgt

SEQ ID NO: 1269 - DNA, 101 bp, rice(Oryza sativa)
  misc_feature (71): n=t or g
gaaaataggccaagccttctaactcaactctattcattcagcccacgtgcaaacaagattttgataggaangagaaaacataggaataggaaaaacgcagg

SEQ ID NO: 1270 - DNA, 101 bp, rice(Oryza sativa)
  misc_feature (71): n=t or c
atcaccatcgtgcaccaccatgcacacatgtccttccatggacataaaccacgagcggtgcagtgtgggcnaccccatcgcgcctctatccatggacctcc

SEQ ID NO: 1271 - DNA, 101 bp, rice(Oryza sativa)
  misc_feature (71): n=a or c
catgaggtaccatatgtctgctaaaacataaaagggctagcgcagcaatgccatgctgcaattctagtacngtagtacctcaagctaaaaaatgggcaagt

SEQ ID NO: 1272 - DNA, 101 bp, rice(Oryza sativa)
  misc_feature (71): n=c or g
ttgcttttattttctctcttacgtttgcgcgaggaatcttgcaacatgtttaaataatgacaaatgttttnacagccaatagttacacatgttctttacct

SEQ ID NO: 1273 - DNA, 101 bp, rice(Oryza sativa)
  misc_feature (71): n=a or g
gacaactgttccagatgagaaacatagtattacggttatcttgcgtcgttagcatggatagtaaaaacaanaataaatcgttgatagctgccgtttcctct

SEQ ID NO: 1274 - DNA, 101 bp, rice(Oryza sativa)
  misc_feature (71): n=a or g
tcctcctctcctccaacctcctcactaatgatgacatctagcagagacgccaacaaaagtggagtttaacnaggcggtgacactctaggaccacgcgtcga

SEQ ID NO: 1275 - DNA, 101 bp, rice(Oryza sativa)
  misc_feature (71): n=t or c
gggcgggcagagctggggcttaagccccaacaagccccaaccatagatacgcccctgaggacatcaacacnatcgatacattcacgtctccacaagtacat

SEQ ID NO: 1276 - DNA, 101 bp, rice(Oryza sativa)
  misc_feature (71): n=a or g
atgaactttggttgtgtacatcctatatatgcagaggctggggatgcaatttggtgacaacgggatggccnatctcccgccaggtgaagataactattaat

SEQ ID NO: 1277 - DNA, 101 bp, rice(Oryza sativa)
  misc_feature (71): n=a or g
taacaaatgaaaagcagccttagtatcgtcctttatcctctgtgcttcatgacaaatgttttcattggatntcagctaattattagacacactgtgcatag

SEQ ID NO: 1278 - DNA, 101 bp, rice(Oryza sativa)
  misc_feature (71): n=t or c
tactcgcagccagcgaaaataggattatcgctggcagttattttcacatacggccagtaaagaggaacgcnagcgaaaataaattcgccgccatattaacc

SEQ ID NO: 1279 - DNA, 101 bp, rice(Oryza sativa)
  misc_feature (71): n=a or g
gttgttggaactcaagtcacgagtgagtgagccaggtatatccatctaatgttatctgtgtatctgccaanatccaaaatgctagcagtaattgtttcttg

SEQ ID NO: 1280 - DNA, 101 bp, rice(Oryza sativa)
  misc_feature (71): n=a or g
cctcctctccgcaaaagagcttctacgtagacatggcgatggtagagcaaccccgaaaaatgaatctagcntactatgccctcctcactgctacactggtg

SEQ ID NO: 1281 - DNA, 101 bp, rice(Oryza sativa)
  misc_feature (71): n=t or c
gtgggggcgaggtctgtagatggtggttggcctgatcgatctcctgatatttcttaggtatattgcttggnattatttgattccgtcgggctgttgccatg

SEQ ID NO: 1282 - DNA, 101 bp, rice(Oryza sativa)
  misc_feature (71): n=a or c
tacgatcttttttaacattttttttataaaacaatcaacaagattcctgcgcatatgtacgggctttgttnctagttaaaatgaaagaagaaaaaaaaaca

SEQ ID NO: 1283 - DNA, 101 bp, rice(Oryza sativa)
  misc_feature (71): n=t or g
tgcaaagtttgatttgatttatttactcatgtgcctgtctgttaatttgctctctattggcagtctttgtntcatctacctatttttttctaaattctttg

SEQ ID NO: 1284 - DNA, 101 bp, rice(Oryza sativa)
  misc_feature (71): n=a or g
ttgtcccttatcctttttcatgggctatccctttcatgcacatgcgatttaagatagctgatgaaacttantgccttataattttgtaatcaagaaagtaa

SEQ ID NO: 1285 - DNA, 101 bp, rice(Oryza sativa)
  misc_feature (71): n=t or c
agatgaagccccatcagtcctagcaggagcagacgatgtcggggtggggcgaggtcatgacaccggatgcngccctgacgaggcgcgggctgcggcgatgc

SEQ ID NO: 1286 - DNA, 101 bp, rice(Oryza sativa)
  misc_feature (71): n=t or c
aactaagaaatactagtattagtactagattgcacatcacaggtgctcaattttctctctcgtggattcangtgtttattatgcttcccagtagtagcctt

SEQ ID NO: 1287 - DNA, 101 bp, rice(Oryza sativa)
  misc_feature (71): n=a or g
aggagccatggcgcgaactccaagtagtcgtcgtcttcgtccccaagcgaagaaggcacctcctcctcctnctggtggtggtggtggtggtggtggtggtg

SEQ ID NO: 1288 - DNA, 101 bp, rice(Oryza sativa)
  misc_feature (71): n=t or c
aggcctgaaactttacgacacatggagtacgaagcgagggaacttataaaactatagttggtcaaatgggnggcacggcacggccgtgcctaggccgaggt

SEQ ID NO: 1289 - DNA, 101 bp, rice(Oryza sativa)
  misc_feature (71): n=t or c
tacatgtgaaaaagataagagatgagagagaagagaagtgtagatcagctgcagcacggactataaaacgntgtgtgtatgacatgtgagatcaattatta

SEQ ID NO: 1290 - DNA, 101 bp, rice(Oryza sativa)
  misc_feature (71): n=a or g
tctctgcgctacaatgtgatattggatttggtatacccaaggtcttcactgttccggcagctaactaattngaggcatcaaaatttcaaaccacatacatc

SEQ ID NO: 1291 - DNA, 101 bp, rice(Oryza sativa)
  misc_feature (71): n=a or g
gaagcaccgatgaacaggtgaatctggtggacgcacgagtgaaacaggattgaacagagaaagaaagaaanaaaaaaaaagaaagccatcaaagtgttcac

SEQ ID NO: 1292 - DNA, 101 bp, rice(Oryza sativa)
  misc_feature (71): n=t or c
gatagcacgcacaccttatcgatgtcggcgaaatcaccgaggcagatggcacagtcggtgttgaggacgcnggccttggtgccgtacacctccaccgaaat

SEQ ID NO: 1293 - DNA, 101 bp, rice(Oryza sativa)
  misc_feature (71): n=a or c
ccatcacaaacccaccatacatggtgcattgtcaaagtgccaatagctatgcacgatttgtgcttcgcccnaaaaaattcatcaacgtggaatgatgattc

SEQ ID NO: 1294 - DNA, 101 bp, rice(Oryza sativa)
  misc_feature (71): n=t or g
acacctatagaccaggagctgggttttacccattacggccatgtgtgccctcaaatgtttcttatttctanaataccgaccaaaaagcaatggaagattca

SEQ ID NO: 1295 - DNA, 101 bp, rice(Oryza sativa)
  misc_feature (71): n=a or g
ggtggccgggcttgctcgagacctgctgaaagtggaggagggggagatatggcctgaggcggcgggaatcnccggccggagaaggtagagatggagaagct

SEQ ID NO: 1296 - DNA, 101 bp, rice(Oryza sativa)
  misc_feature (71): n=a or g
atggattgttgttcatctgtgagatttgattttggcttggcttggagccggcttcctttttttttaatcgnggagagcacaaaggtgccggttctatgacc

SEQ ID NO: 1297 - DNA, 101 bp, rice(Oryza sativa)
  misc_feature (71): n=t or c
gcttgcatctctgtgcttcggcgcggtatgtacgtctcgagcgtggtggcggtgtacgactgttaacgacnaaatttggtaatatcagcatcggagatgag

SEQ ID NO: 1298 - DNA, 101 bp, rice(Oryza sativa)
  misc_feature (71): n=t or c
gatgcacctgagtccatgtgccacttgttggaaggcggtggagtcaacgttgccgtgtttaaggagctcgngagcgcctgtgggtcccactgggaggggcc

SEQ ID NO: 1299 - DNA, 101 bp, rice(Oryza sativa)
  misc_feature (71): n=t or c
attacttcaaagatttactgacaagtttgttgcaatgtctgaactggagtgatgttcctgtgtctttcctntgaagaatctggcttccatctttcttttcc

SEQ ID NO: 1300 - DNA, 101 bp, rice(Oryza sativa)
  misc_feature (71): n=a or g
attctctctctaaacaatcacaacccttcgcctttcaatttcccaaagtacattcacttctcatccaatcntaatccaaactgagctaagttaaaacttgc

SEQ ID NO: 1301 - DNA, 101 bp, rice(Oryza sativa)
  misc_feature (71): n=t or c
gttgggtttgtaatggctgataataatgagtgagctccctgcttgtagttgtatcatcctacccatctaanagactaattaattatacctctacgtgtttt

SEQ ID NO: 1302 - DNA, 101 bp, rice(Oryza sativa)
  misc_feature (71): n=a or t
gttgtcgctgattcactgtcaatagatcgaagtttgtaagatctaagaaagggtagtgcttgatgaagggnaaagagaatacagttttggtttaaataagt

SEQ ID NO: 1303 - DNA, 101 bp, rice(Oryza sativa)
  misc_feature (71): n=a or g
tgagtaagggcaaaaaggacaacttctcttgagttaacaccattaccaagtctttttatggaatagggtcngccttaatcttcaatttgaaaaacagggtc

SEQ ID NO: 1304 - DNA, 101 bp, rice(Oryza sativa)
  misc_feature (71): n=a or c
ttaattataagtaaatccctagttagcaatcatctgtgtagtcaatatcatgtggccttatgttttttttnacgagaaacagcaggagagactcctactgc

SEQ ID NO: 1305 - DNA, 101 bp, rice(Oryza sativa)
  misc_feature (71): n=t or c
agcgtctctcttttgctactaatacccaaaactatagggggaagaacactttcactatatgcacacagcanagaaccatctaattatataaaaaaaatgac

SEQ ID NO: 1306 - DNA, 101 bp, rice(Oryza sativa)
  misc_feature (71): n=t or g
atatgacttgctaagcatgataacaggtatctaatcagttagagctttattaatcaccaatgcagtgttgntaactggaaacaaatgtaacagaataatat

SEQ ID NO: 1307 - DNA, 101 bp, rice(Oryza sativa)
  misc_feature (71): n=t or c
attgtgataggagtttccctacgtctagatgtgtcccagattgtggatgtccttaggatcgtaacgaggancgagccgagccgagctgaaacggctcgata

SEQ ID NO: 1308 - DNA, 101 bp, rice(Oryza sativa)
  misc_feature (71): n=a or g
aaatgggttacaatggctggaaagtgcaccatgcacgcgagagtattgccgcaggggaataagttcaccanaagtccctcaacttaacaacgagatttttt

SEQ ID NO: 1309 - DNA, 101 bp, rice(Oryza sativa)
  misc_feature (71): n=t or c
tctttgaaatagttgagattgttatatagattacaagaatctatagactataattatagatagttgtagtnggaaaataaatcagaagtacaagctgcttc

SEQ ID NO: 1310 - DNA, 101 bp, rice(Oryza sativa)
  misc_feature (71): n=a or g
atttgagacactactctatgtagcaatttacatggtgcacttcattatttttgttttgactggtgaaaccnggcctcactaattgaaggaataacatatag

SEQ ID NO: 1311 - DNA, 101 bp, rice(Oryza sativa)
  misc_feature (71): n=t or g
aatcgacgactgtaaaaaaaataaaaagagtcatgtggaaaaaccgattggtatctgtcctcttttatccncctttttccttttttttctgcttttctttt

SEQ ID NO: 1312 - DNA, 101 bp, rice(Oryza sativa)
  misc_feature (71): n=t or c
cctttccaaactagcagttaaactggaaccatcatttatcacataattattattaatgaatggagtgggantaatattgaaaaacattgttaaacccgccc

SEQ ID NO: 1313 - DNA, 101 bp, rice(Oryza sativa)
  misc_feature (71): n=t or c
cagagctatccccgttcgacttgcattttgtagccgaatggacacctgtgttcgcttccgaacccgagccngtcgaacaaccctaggtgatgtgctctgac

SEQ ID NO: 1314 - DNA, 101 bp, rice(Oryza sativa)
  misc_feature (71): n=a or g
cttgatgagagaacctgatagtatagcaagtacctttgatttcgatcctctgtttcatagtaccaacaatntagccaacaaattattttttaaaatttttt

SEQ ID NO: 1315 - DNA, 101 bp, rice(Oryza sativa)
  misc_feature (71): n=t or c
ctgcacctaaactgacccagtaaatttcaggtgtttattagatgttcatccactaatcagaaagttctttngcacagtaactcagaagattcgtacgtgat

SEQ ID NO: 1316 - DNA, 101 bp, rice(Oryza sativa)
  misc_feature (71): n=a or c
tcaaaaaaaaatattattgtatgtattcacgtcacttttaacacatgcaatatatgtattatatcctaatnaaatgtttgttagtggctaaatgtatttat

SEQ ID NO: 1317 - DNA, 101 bp, rice(Oryza sativa)
  misc_feature (71): n=t or c
aggcgaacttgtcccattttcgtaggtggctatgtaaccatattttctggtggcgaggcacactcccatcngcttgggaagtgtcacgtcctgataaattc

SEQ ID NO: 1318 - DNA, 101 bp, rice(Oryza sativa)
  misc_feature (71): n=t or c
cgttatagtgattgtactagactcggtaagatttatcctcgggttggctgacaaaaactacttataaattncaaattttattaagagccactctattgtta

SEQ ID NO: 1319 - DNA, 101 bp, rice(Oryza sativa)
  misc_feature (71): n=t or g
tttgaaatttataagtagtttttgtcagccaacccgaggataaatcttaccgagtctagtacaatcactanaacgggatcgcttatctctaacgggctgaa

SEQ ID NO: 1320 - DNA, 101 bp, rice(Oryza sativa)
  misc_feature (71): n=a or g
agtcatttgtagagtctggatttggtttcttgggcaagagagtgatgtaagacttgttgagattctgaatngagatttcttggagaaaaaattgttcggcc

SEQ ID NO: 1321 - DNA, 101 bp, rice(Oryza sativa)
  misc_feature (71): n=t or c
aaaaaatctttagtactttgggacagagtctgtcagccaaaggagaaaggaggcttgggtataattgatcntcgtttgcaaaataatgctttgctcatgaa

SEQ ID NO: 1322 - DNA, 101 bp, rice(Oryza sativa)
  misc_feature (71): n=a or g
atcctttccacttgtcacaataaagtatctttccctgaacccttcgaacactagagttgaatcgaaacccnctccatctattcgactcggccttcatcgga

SEQ ID NO: 1323 - DNA, 101 bp, rice(Oryza sativa)
  misc_feature (71): n=t or c
caagtgggcgggcatcgcttcaatcctgacttcaccagggggtgtaccaattcgttacgcagcaagactgnagttcgacacaaccaacaacgcagcagaat

SEQ ID NO: 1324 - DNA, 101 bp, rice(Oryza sativa)
  misc_feature (71): n=a or c
tgtgtatggaatagtgaatttgttcttgttaccagcgtcgtgtaaacttaaaatgggagaggagttgccancatgtcataacgttttataaattgaaactg

SEQ ID NO: 1325 - DNA, 101 bp, rice(Oryza sativa)
  misc_feature (71): n=t or c
gaacttttttcagttaatgccgatattggcacattcatttaggtgtgtggataggcggagagcctacaggntcggattcttaatgaacacaagtgtgtaga

SEQ ID NO: 1326 - DNA, 101 bp, rice(Oryza sativa)
  misc_feature (71): n=a or g
agcctttcttgtattcacactcttcatccaatgtgctagaagttgaggtacagcttctgattctcggtgtnctttgtccattattcttagttggtgttagt

SEQ ID NO: 1327 - DNA, 101 bp, rice(Oryza sativa)
  misc_feature (71): n=t or c
atccttgtcttcttgccaggagggaagcagcagccgaagagtgggagctagcgattctaccagctcctcangccgagcctgtgccatccacatttcccgtt

SEQ ID NO: 1328 - DNA, 101 bp, rice(Oryza sativa)
  misc_feature (71): n=t or c
caggatgagcggcgtctcttttcccatatccatattcaacactacgaagtctaccgggataaagaaattcngtatcttgactggcacatcctccgctatcc

SEQ ID NO: 1329 - DNA, 101 bp, rice(Oryza sativa)
  misc_feature (71): n=a or g
tatcttttcctatttttattagtttgtatcatgccatgtttccatcatttcttcgataatgcttgtcgccngtcgatcggcacggagggagacggatcggg

SEQ ID NO: 1330 - DNA, 101 bp, rice(Oryza sativa)
  misc_feature (71): n=a or g
actcacaagagttcatccatagatcatccaactcacaaattgtccaaagaaggctcacaaataaacataanctattacaagaccacgaagggtccaaatga

SEQ ID NO: 1331 - DNA, 101 bp, rice(Oryza sativa)
  misc_feature (71): n=a or g
aattttgggagatcgagaatgattctaccgaatttgatagggaggatcgggtcccgcattgtacgaggacnggactacctttcggagattgaagacagcat

SEQ ID NO: 1332 - DNA, 101 bp, rice(Oryza sativa)
  misc_feature (71): n=a or c
tggtttttctcttccaacttcgaaattctttagggagattctggagttttatggaatcagcttgcatcatntgaaccccaattccatagttcatattgcca

SEQ ID NO: 1333 - DNA, 101 bp, rice(Oryza sativa)
  misc_feature (71): n=t or c
ccaagccgaatcacacgctggacgcgtacgacgtcatcgacgcaatcaaggagaagctggagcacaagtgncccgctaccgtctcctgcgccgacatcctc

SEQ ID NO: 1334 - DNA, 101 bp, rice(Oryza sativa)
  misc_feature (71): n=a or g
caaggtgtcagtggcactgttagatgagctagctattataatatcatctatatacaccaacataaacattntaacatctctcttgctataaaagaacaaag

SEQ ID NO: 1335 - DNA, 101 bp, rice(Oryza sativa)
  misc_feature (71): n=a or c
agggataattcatacttttcctatggtaaatggcaggataatttgtctttagtactccctgctatctcatnatataaagcatagttaaatttatcatggtc

SEQ ID NO: 1336 - DNA, 101 bp, rice(Oryza sativa)
  misc_feature (71): n=a or g
gagtctggaaaatgtgacggcttgacatagagataagtgcaagcagaagcgtggaggaagacatgacaagntggtgaagtggagcaatgatgtgactagca

SEQ ID NO: 1337 - DNA, 101 bp, rice(Oryza sativa)
  misc_feature (71): n=a or g
tttttttttacttagaaatgtgagcatttatgttgattctagcttttctataaccctaatgttttatatanctgtgtgatatgcatggcatttcaaataat

SEQ ID NO: 1338 - DNA, 101 bp, rice(Oryza sativa)
  misc_feature (71): n=a or g
atggcctgcacgaaaatgcgtattattgaggaagagaatggccctcatcttgccccagatgctggtacctnaccctggcggcgccggtggcctccgccacc

SEQ ID NO: 1339 - DNA, 101 bp, rice(Oryza sativa)
  misc_feature (71): n=c or g
ttcgacctcctcagtcctccctacccggcgaccagcctgtgcaagaggagaaaagtgagatagaaagtganagagagagagagagggaggaggaggaaggg

SEQ ID NO: 1340 - DNA, 101 bp, rice(Oryza sativa)
  misc_feature (71): n=a or g
aatgatgctaggaagttcagtccaaatcagaacattaattctccaccagcagcccaaccgagatctatggnggttaagagggcgaagaaagcaaagggagc

SEQ ID NO: 1341 - DNA, 101 bp, rice(Oryza sativa)
  misc_feature (71): n=t or c
acctcctatcataccgctccaaataccctgcaattggcgccatccatcaataacatgcaagaaactagtanatatatacactcatacactatacatgggtc

SEQ ID NO: 1342 - DNA, 101 bp, rice(Oryza sativa)
  misc_feature (71): n=a or g
aagtcaccgtttttatcccgagttttacaaattcactttgattttgataaagccagaaagagaagatcgantgtatcaataaccctcaaccaattttacaa

SEQ ID NO: 1343 - DNA, 101 bp, rice(Oryza sativa)
  misc_feature (71): n=a or t
agctggatagtaattgaggggtgcaccacttcactatgcacagggttcctcttacctttttggcgtggttnccgcacccccgcggtaaccgcgcagttacc

SEQ ID NO: 1344 - DNA, 101 bp, rice(Oryza sativa)
  misc_feature (71): n=t or c
aaaactctcgaaaaggagagaagatgttgtctattccacgccgcaagttgctcaaggttggaatcacgtangaaatataaacatgccaacaatcagtaaga

SEQ ID NO: 1345 - DNA, 101 bp, rice(Oryza sativa)
  misc_feature (71): n=a or g
aaaaaggtaaaaaggaggagttgcacctctctaatcctacaggctaaatcagtctgattccacgcgcgaanacttcgctcctcctcctccacgcgtgaaga

SEQ ID NO: 1346 - DNA, 101 bp, rice(Oryza sativa)
  misc_feature (71): n=t or c
ttccgagctaaaatggacagattcaaaaatccttaaattcaagaaaatttcttaagattttggggctgttnagattgatgccattatcaaccatacaattt

SEQ ID NO: 1347 - DNA, 101 bp, rice(Oryza sativa)
  misc_feature (71): n=a or c
atcccaatccaccaatcctgttattacattacaagcacgcttacacaaggtaatactgaatcaggacgaangaacatcagtacacaaaaaacatagcatta

SEQ ID NO: 1348 - DNA, 101 bp, rice(Oryza sativa)
  misc_feature (71): n=a or g
gcactttctatgatatgaagattaagtagcagtgttgaatgttgtttggcctaagtttgaagtctgaagcnaacattagctttccctgccatttgtaatcg

SEQ ID NO: 1349 - DNA, 101 bp, rice(Oryza sativa)
  misc_feature (71): n=t or c
cccttcggcctctggatcccccgaactgcttcaactagacagaagagaagatcatgtgagaagacgagagnggcagggacaaaccaccaactgcttcaaca

SEQ ID NO: 1350 - DNA, 101 bp, rice(Oryza sativa)
  misc_feature (71): n=a or c
tagaccacatatttgaaagtttctggatttccggtacctcaaatttttaaaaggtttggtgacttttctcntccatcgtacgataatctaatgattgtgat

SEQ ID NO: 1351 - DNA, 101 bp, rice(Oryza sativa)
  misc_feature (71): n=t or c
cagcttctttcaaacatagaaatttcaccgaacttgtacgtaactacattaatcgaaaagcccccacaatntctttacttcaaaatagtcaattttcgatc

SEQ ID NO: 1352 - DNA, 101 bp, rice(Oryza sativa)
  misc_feature (71): n=a or g
cggcgctagctgttgtccaaagacgaacacttgtcctaatggaaagtacgaaaacaatgaggtatgtatcnttttttttggaattcgtcttacagttaaaa

SEQ ID NO: 1353 - DNA, 101 bp, rice(Oryza sativa)
  misc_feature (71): n=t or c
cgcaagtccgaagaagattttcaccacaaggaagacgaaaggcatgtggtggcgttgaagaaggcgaatgncgaaaacaggtctctccgctctaacctaga

SEQ ID NO: 1354 - DNA, 101 bp, rice(Oryza sativa)
  misc_feature (71): n=a or g
cgagttctaaattaaaatcaaaatctctatagcttgtactcgtgtatggagcactaagcaatgtattactnctatctagaggtagagggtgcatgcctgct

SEQ ID NO: 1355 - DNA, 101 bp, rice(Oryza sativa)
  misc_feature (71): n=t or c
gattaagaataaaaaggtgattgagagtaaaataggaagaaatctaaatgggacgtgattaatactccatncgtgttattttaagcgcagccatgagtttc

SEQ ID NO: 1356 - DNA, 101 bp, rice(Oryza sativa)
  misc_feature (71): n=t or g
cacaccacctccaggtttgcgtatttgtttcaaagcccagaatatatgacagcttccctgtagccttgagngcaaacagccaaacatggctgtaatttgct

SEQ ID NO: 1357 - DNA, 101 bp, rice(Oryza sativa)
  misc_feature (71): n=a or g
ggacaagaagttgtctgtgttttcaggcaaatcacatttgctcgaaacctgtcaaaacagagtttgacacntatagaagggaaactattctaatcccttga

SEQ ID NO: 1358 - DNA, 101 bp, rice(Oryza sativa)
  misc_feature (71): n=t or c
taacgatttcgctttaaaggttaccacgaaaatttcatagagtatgttagttaatgaagaatttaagaaantaacttggaccatgatttattaagaaatat

SEQ ID NO: 1359 - DNA, 101 bp, rice(Oryza sativa)
  misc_feature (71): n=a or c
aggtgtagctcgtcgatcgtcaatcagctgatggacggtgacgcggcacgacacaaagaggcggacgagcnacttggcggccagagacgcggtgcgcacgt

SEQ ID NO: 1360 - DNA, 101 bp, rice(Oryza sativa)
  misc_feature (71): n=t or c
agtggattttaaatattctatttatgcagggatataaagtagtacaattatcttgctcaagatcgtattanttaaatatttttttattttctaataaataa

SEQ ID NO: 1361 - DNA, 101 bp, rice(Oryza sativa)
  misc_feature (71): n=a or g
gctatttgggcctttggaccggcaaatatttgggtggtccggggaccagcctttggatccaccaatgtgtnagaatagccaaattattgtggaactctaac

SEQ ID NO: 1362 - DNA, 101 bp, rice(Oryza sativa)
  misc_feature (71): n=t or c
gtctgaactgaaacaatttttgctctgtataattatttaccgttggcaaaaactagatgccagatgagatntattagtccaatatcaaatatgtacatagt

SEQ ID NO: 1363 - DNA, 101 bp, rice(Oryza sativa)
  misc_feature (71): n=a or g
tctcatgattgtaaatgttgagtcgcttgtagcggcttaagatatagtagagagtatatctagttttatcnagacaaacattgcgtaatgcctcggaccta

SEQ ID NO: 1364 - DNA, 101 bp, rice(Oryza sativa)
  misc_feature (71): n=t or c
ttgaaattccttaggagtgcctcaaatcataggagattttggagaattcttaacatgaggttctacccctngaaaaaaattcatttgtaatctatctctat

SEQ ID NO: 1365 - DNA, 101 bp, rice(Oryza sativa)
  misc_feature (71): n=a or g
ggcccaagcggctccatcaagagtggagaaagaagggatttggcattgttgctaccaccatcatcattgcncgttactagggtgcctcctcctttgctcgc

SEQ ID NO: 1366 - DNA, 101 bp, rice(Oryza sativa)
  misc_feature (71): n=a or g
taaatgctggcactaatccaaaaactctgcacctagatctccctcagtctcttcaatgtattctgttcagnttgcatatattggatcaagatcgacccaca

SEQ ID NO: 1367 - DNA, 101 bp, rice(Oryza sativa)
  misc_feature (71): n=t or c
gtgatatggctacgatatataagacacctgaattgagtttagagttttattattccggctctaatgttagncgagaacacaacatccatatgatcttattc

SEQ ID NO: 1368 - DNA, 101 bp, rice(Oryza sativa)
  misc_feature (71): n=a or g
acggccaggattttccattctcgattcaggagctttgtcactcgatgggtggattatcgggtgcttctatngtctatacaaaacaaagtcaacatggaagg

SEQ ID NO: 1369 - DNA, 101 bp, rice(Oryza sativa)
  misc_feature (71): n=t or c
tacctctgcatctagtacaatcatatgtataccatagaaatcatcagccattgtaggattaaccgcctcgnatagcctaatagcttctactttgattctcc

SEQ ID NO: 1370 - DNA, 101 bp, rice(Oryza sativa)
  misc_feature (71): n=a or g
ccaagcttaattaattatgccaaagaatcatcgcactataccattaccatcaatcatgcaagggagagagnagaggtggaatcgagcgcaacaatatagta

SEQ ID NO: 1371 - DNA, 101 bp, rice(Oryza sativa)
  misc_feature (71): n=t or c
acaaacagcaaagagtttctagtgcgattacgcacagcatggatcctgtttcaatccacttgagttgaaantcgtcacaaaagcttcgccccaaaggcacc

SEQ ID NO: 1372 - DNA, 101 bp, rice(Oryza sativa)
  misc_feature (71): n=a or g
agaaagcaattgttcaaggtaaagaaggaaatgaaagataccaataatcaggtctttcccattgggcttgntctctatgaacatccaagcaaaggacaagg

SEQ ID NO: 1373 - DNA, 101 bp, rice(Oryza sativa)
  misc_feature (71): n=t or c
aacaagccccgtccctatgagagagagctcgacatgaagaaaggaaggagctaaaggagggaaatggagtnctagctggcgaaagaggaaactggcaccca

SEQ ID NO: 1374 - DNA, 101 bp, rice(Oryza sativa)
  misc_feature (71): n=a or t
ttgaaatcctaatttcatccccggttggcaattagtagtgtatatattgtgtaattgttggaaaaaaaaantttaacaaccactcgaaccgcgggcaaaaa

SEQ ID NO: 1375 - DNA, 101 bp, rice(Oryza sativa)
  misc_feature (71): n=a or g
gctgtagctcagagcgttggaatcgcaagcagcaggttgtatcgctgtcgctacgcatggaattgggatcnacgtctcatcgtctttgtctctaaaatcgc

SEQ ID NO: 1376 - DNA, 101 bp, rice(Oryza sativa)
  misc_feature (71): n=t or c
tttaaaaatacataaggcttccgccttcactttcgtccgtcaccccttgcttccccctctctcccctcccnccttcctggtgccctgatcttcacacgctc

SEQ ID NO: 1377 - DNA, 101 bp, rice(Oryza sativa)
  misc_feature (71): n=t or c
ttagcaaaaatgtattgatttcactacagatctagtacaataacattgatggtcaaaggatcatcaggcancggttttaattatatttatggaagtcctga

SEQ ID NO: 1378 - DNA, 101 bp, rice(Oryza sativa)
  misc_feature (71): n=c or g
ccgccgccaccgccctcgggaaccagcacgtctgcactgccgtcaacacgtgcatccgtgtcgtccaccangccggcgccaagggcgagctcctgcagcga

SEQ ID NO: 1379 - DNA, 101 bp, rice(Oryza sativa)
  misc_feature (71): n=t or g
aggaaacatgaagctaaatccacaatgtgtcggcgtgactgcttggtacgtgttggatctggtgttgaggnagcagtcggcagaggccacttcgtcggtgc

SEQ ID NO: 1380 - DNA, 101 bp, rice(Oryza sativa)
  misc_feature (71): n=t or c
aatcacatgctaaggaaacaagggaaacaactgttcggaggagagcagtttggatccacaataagttttanagcatgaaggttaaggagtacaagggaaaa

SEQ ID NO: 1381 - DNA, 101 bp, rice(Oryza sativa)
  misc_feature (71): n=t or c
gtaaatcctgaagtgttttactgggattattactgtgggtgagttgccttttgccatggttatttgaaaanaaattagctgagatgaagaatttcatgggt

SEQ ID NO: 1382 - DNA, 101 bp, rice(Oryza sativa)
  misc_feature (71): n=a or c
attggctactaatgcaggcaaactcatacaagacatctctttgtgtatctatacctttttagttacctaanactcaatatgcaagcgtagcaattattaat

SEQ ID NO: 1383 - DNA, 101 bp, rice(Oryza sativa)
  misc_feature (71): n=t or c
tatgacacccacatcgatcgatcgatcgatccattgatgcgttcgaggaggaaccaatccgtgtgctctgnttttttttttggttgcagcggcgagcgtgc

SEQ ID NO: 1384 - DNA, 101 bp, rice(Oryza sativa)
  misc_feature (71): n=t or c
aaaggtttgcatataattgcattaagacgaaggaaaggtttacaaaagcaacaaacccgacctataggctnaccaaccggataaaatagagtgattttatg

SEQ ID NO: 1385 - DNA, 101 bp, rice(Oryza sativa)
  misc_feature (71): n=a or c
tcggctagatccgcagcacactactaaattaacccatgtagctagaattgtaaaatctaaacatatagccnccgcggttttagtatcgaaaagcaaaagat

SEQ ID NO: 1386 - DNA, 101 bp, rice(Oryza sativa)
  misc_feature (71): n=a or c
agtaattggcttcaaaagtgaagctatgatgcaattgtcccaaacaaaaaaacataagctagcgcgcgagnagatgggccaagtatccagctgggtcccgc

SEQ ID NO: 1387 - DNA, 101 bp, rice(Oryza sativa)
  misc_feature (71): n=t or c
caaatattagattgctccaattgtttagaaaccctcctactatttctttctagccaactaggagtgaaaantgatcggataatatccgatccgatccgatc

SEQ ID NO: 1388 - DNA, 101 bp, rice(Oryza sativa)
  misc_feature (71): n=t or c
tcaataatcaataattcatactttcataggggtgtctggtttactaccaaatttgtcaaactccgttagcntattattgtttgtttcgttgccacagttaa

SEQ ID NO: 1389 - DNA, 101 bp, rice(Oryza sativa)
  misc_feature (71): n=a or g
taattgatggcaataccttagacaagatgtgaatttttttaaaaaaagagtgtatgacgtgtgggcctctngattaaaataaaacgtactatggcctgatt

SEQ ID NO: 1390 - DNA, 101 bp, rice(Oryza sativa)
  misc_feature (71): n=t or c
aaaaaagagcagaactggagaaactgaagacaacttttgttcgacgcgcatcagaatttttgaggaactanttctctagcttggtggacttcatgataagt

SEQ ID NO: 1391 - DNA, 101 bp, rice(Oryza sativa)
  misc_feature (71): n=t or c
atcaaggtccagagctggtaattgatgctgcaaattttcatcggattaattaattatatgcaaagacacanatatatatatactatatagaaattagttat

SEQ ID NO: 1392 - DNA, 101 bp, rice(Oryza sativa)
  misc_feature (71): n=t or c
gtggcggcgaggccgctgcacgacgacgaggaggccggtcgtcaggcttctccttctacgttgctgatcgncgtcggccatgatcagcagcagcacggtgg

SEQ ID NO: 1393 - DNA, 101 bp, rice(Oryza sativa)
  misc_feature (71): n=t or c
acatgttttagctcatgaacttggcaagtagggccatgaaatacccttatttataaagtatgtagggatangggaaaatgagacaaaaacttgcgtttaca

SEQ ID NO: 1394 - DNA, 101 bp, rice(Oryza sativa)
  misc_feature (71): n=a or g
tgtgtttgcatcacctgctttcagccatgtgattctggatgtttgccttttcctggctttcatgacaacanccagccctaggatcctgagtttgaggtctc

SEQ ID NO: 1395 - DNA, 101 bp, rice(Oryza sativa)
  misc_feature (71): n=t or c
attaaaaatagtgaaagtaaaagaataggatccgacacgggtttttgagttgctacatgtgcatactcccnagctcagtaaggccattcacagtgcgtcac

SEQ ID NO: 1396 - DNA, 101 bp, rice(Oryza sativa)
  misc_feature (71): n=a or g
actttcactatttttaattagttctccctctatttttttatgtatatatgtcggggatgactcccggtcgngcgcccgatcgggaggggtaaaatcgggcg

SEQ ID NO: 1397 - DNA, 101 bp, rice(Oryza sativa)
  misc_feature (71): n=a or g
ccttagtttggaatgtactaagaagaaagggataagaaaaaaatgcgcagaaaaggggaaacaagagcatnagctcggatttttttttactgtttttttta

SEQ ID NO: 1398 - DNA, 101 bp, rice(Oryza sativa)
  misc_feature (71): n=a or c
gagagtcacttaaaatattccgttgcaacggtatcccgtggattagcagccctctaattcattaattctancgtgtatgtaaaatatgtacaatcaaataa

SEQ ID NO: 1399 - DNA, 101 bp, rice(Oryza sativa)
  misc_feature (71): n=a or t
ttaaaaccactacgtaggggaaatgtaatttttgaagccatcatcttaaaactactgtgaacatttttttntaaaaaaatatgccttaaaaatgataagcc

SEQ ID NO: 1400 - DNA, 101 bp, rice(Oryza sativa)
  misc_feature (71): n=a or c
gatcgtcgggcgccgccgcgcagtagacgccggtgtagttgcacacgaacggcccgcaccaatcctccgtnaggttcttggggtcctcggtgatggcgtgc

SEQ ID NO: 1401 - DNA, 101 bp, rice(Oryza sativa)
  misc_feature (71): n=a or c
aagataaggaaagagaatggtgatatctgtcaattatcatatggtcttataaacaactttgtatcctatcntatcttcctatatagttggtacccactaag

SEQ ID NO: 1402 - DNA, 101 bp, rice(Oryza sativa)
  misc_feature (71): n=t or c
cttgatcgggaagccgtacattttttttgtctcatagtggttagtaggtgtttactacctcctccttcgtncctaaatattgacaccattaacttttttaa

SEQ ID NO: 1403 - DNA, 101 bp, rice(Oryza sativa)
  misc_feature (71): n=t or g
gttgtgtttctttcttttggtccgagtgagaagattgttgacatcttctctgctcatcctaggaaccatgnaggtagtcacagagcttcttctggtgacac

SEQ ID NO: 1404 - DNA, 101 bp, rice(Oryza sativa)
  misc_feature (71): n=a or g
caaaaaaaaagcatgaaaaccgccagtaaatatgattttgtcggctaaccttataagatactccctccagnctaataatactcgtcgttttagacaatggt

SEQ ID NO: 1405 - DNA, 101 bp, rice(Oryza sativa)
  misc_feature (71): n=a or g
tttggatcggacttccaaccgatttatgttttagtcattaagcctacatctaatattctgtattaatatcngccgattggttcattggatatcaacttcat

SEQ ID NO: 1406 - DNA, 101 bp, rice(Oryza sativa)
  misc_feature (71): n=a or g
tgttttcggttgttagttcagtatgggcctaccttttagtttttttgaattaaattaaggctctctcttgnagagatgggttttttcactacctattttca

SEQ ID NO: 1407 - DNA, 101 bp, rice(Oryza sativa)
  misc_feature (71): n=a or g
cctagatagggtgtatctacggttgtgatacactgatatttcctccgttttttaataaatacatatagttnacttttaaacacatatttgacgattcgtat

SEQ ID NO: 1408 - DNA, 101 bp, rice(Oryza sativa)
  misc_feature (71): n=t or c
gctgcgacaaccaacccaagagatcgaccaggcaaggcaatatacaccgcacaccgcgcgtagtatcaacnatactgtgcagtgtgcctgtgcagctgtgc

SEQ ID NO: 1409 - DNA, 101 bp, rice(Oryza sativa)
  misc_feature (71): n=a or c
ggaacgatgacgtattattagtgtgaagctgatcaaaagctggaggcaaagtcgtagcacgtacgtacttntcagtcagcagatcggagcaaatcctgcca

SEQ ID NO: 1410 - DNA, 101 bp, rice(Oryza sativa)
  misc_feature (71): n=a or g
taaatttagttggcggcatctttcctggaagaacaccaagacaagactattttggtacaaccagcttgtgncggcacagtgccggtgatagtctttcatgt

SEQ ID NO: 1411 - DNA, 101 bp, rice(Oryza sativa)
  misc_feature (71): n=a or c
aaaatgaatatcaaaagaaccgatttcttccataaatagaaacaatacatttttaaatctacaatataatnttacagttacaatataaatagaagctgtta

SEQ ID NO: 1412 - DNA, 101 bp, rice(Oryza sativa)
  misc_feature (71): n=t or c
gtagtttgatgtactcaatgactatagatgaagaggaaatgtctggtgctctattttacagtgataatatntaaagttgtattagaataaatgtcgaatat

SEQ ID NO: 1413 - DNA, 101 bp, rice(Oryza sativa)
  misc_feature (71): n=a or g
cccgagcagaaacgatcggggagcagcggacagcggccgcttagcacgtactgatggtgcacccgaagccnaggcgggtggcgatgccgctgattgccgcg

SEQ ID NO: 1414 - DNA, 101 bp, rice(Oryza sativa)
  misc_feature (71): n=t or c
cgaaaaacattttcccaaaatcgccctcctagcaatggattgatccctcccatgccaccgattatgtcacncccgcagtcccgctcaagcctcaccatccc

SEQ ID NO: 1415 - DNA, 101 bp, rice(Oryza sativa)
  misc_feature (71): n=t or c
acctgtcaacaacaatgaagacaagtaccttgtgaggttaccaacaacttggctctcatccaaaagatttnagcggtcaagctgaaatcctagtagcatgg

SEQ ID NO: 1416 - DNA, 101 bp, rice(Oryza sativa)
  misc_feature (71): n=t or c
gctcgcggagtggcaggtcaaccctccctccggcttcaagcacaaggtcaccgacaatctccagaggtgancccccccctcccccgcgaccactccaaacc

SEQ ID NO: 1417 - DNA, 101 bp, rice(Oryza sativa)
  misc_feature (71): n=a or g
tatgatccactgtcaatcaaatcatctgcctgaacaaaatttggaacgggaaatgtggcacttacacttcnccatggcttgcggtaatgttttcagggttt

SEQ ID NO: 1418 - DNA, 101 bp, rice(Oryza sativa)
  misc_feature (71): n=a or g
ccacatgaaggcggcgaggcggagcaggagggcggcaacgcgtcatcaccatgtgaagagcaggaagaggntgacgacgacgacgaggaggaggaggcccc

SEQ ID NO: 1419 - DNA, 101 bp, rice(Oryza sativa)
  misc_feature (71): n=t or c
acggttaagcaagagagagatccgttggatacacgccagcatcagcatcagccagtgaggtgactcatcanctttttttttttttggagaacagattcatc

SEQ ID NO: 1420 - DNA, 101 bp, rice(Oryza sativa)
  misc_feature (71): n=a or g
tgctaaggttgcaaattgccaaattgggatctgcactctgcagtgcagaaaggtccaagaagggaggagcnacaggggttgggttgcccagggccccatgc

SEQ ID NO: 1421 - DNA, 101 bp, rice(Oryza sativa)
  misc_feature (71): n=a or c
tccagaagccaaagaatcaaagcaattggcaggtttaaggactcaagggggaaaggtaattacagtcaccnggtaaaagagtggtaagtatgatgcatgaa

SEQ ID NO: 1422 - DNA, 101 bp, rice(Oryza sativa)
  misc_feature (71): n=a or g
gctgaatcagatggcggaagaggcgaaacggagggccgagattgcaaggtaggacctaaatctgcagtagncacttgtataattcttttccatgatctgtc

SEQ ID NO: 1423 - DNA, 101 bp, rice(Oryza sativa)
  misc_feature (71): n=t or c
cacatatgtaccattctttagcataggtattatgccaccaaaacttaggttgtgttctttagcatgagttnccacacacgcttcctaaattactacacagt

SEQ ID NO: 1424 - DNA, 101 bp, rice(Oryza sativa)
  misc_feature (71): n=a or g
gtggttggctttgccggtactcagtaatttcccggactacggagtcatgatcagtgctcaaactcttcttntgcatctcgggcactttccggactgacctt

SEQ ID NO: 1425 - DNA, 101 bp, rice(Oryza sativa)
  misc_feature (71): n=t or c
agataaactttcgcggttcttggagcaagctagctcgctagctaagcacacttcttgtcagtctatctctntctctctctctctctctctctctctctctc

SEQ ID NO: 1426 - DNA, 101 bp, rice(Oryza sativa)
  misc_feature (71): n=a or g
cagtgtcacccagctgatatcgtaaatagtagtgctaatacaacaaatttgcaattatatggatccaatgnacccaaattttattatcttacctgcgaaca

SEQ ID NO: 1427 - DNA, 101 bp, rice(Oryza sativa)
  misc_feature (71): n=a or c
caagctatgaaaaaaattacatatttggtatcattagctggagttgtttgaatgcaaaattgacatagatntgttgcttgaggtttccaaacatttatcaa

SEQ ID NO: 1428 - DNA, 101 bp, rice(Oryza sativa)
  misc_feature (71): n=t or c
aaagaattccggtggaatacttcatggacgattctgcggacaccgcgttcatgtacggtgcgtattttatngctacccacattgacaagtactacaaccgc

SEQ ID NO: 1429 - DNA, 101 bp, rice(Oryza sativa)
  misc_feature (71): n=t or c
agcggcgaaccaagcccgtcctggaccgggtcatcgtctacctcaaagtcgtcatcctctaggtcaccctngataaaggggcctgatggagggtgcaaata

SEQ ID NO: 1430 - DNA, 101 bp, rice(Oryza sativa)
  misc_feature (71): n=t or g
gtgttttttttgctttgcgtttcttggctcggtggaggtctcatgatctaaggggaagatttggggttttngggaggagatttttggtggggttttggggg

SEQ ID NO: 1431 - DNA, 101 bp, rice(Oryza sativa)
  misc_feature (71): n=a or g
gccgtgttctgatcagccagagctttgcaagatgtcattcattttggttttacctcttgacgagatcgacngggagagcctgctcggtgaacttccagttc

SEQ ID NO: 1432 - DNA, 101 bp, rice(Oryza sativa)
  misc_feature (71): n=t or c
tgggaaattttcagatgggggaaactcttatcttgacaacgagatacttaatgacagaccatctcatcttnccccgtctactccctccagtcgttcccctc

SEQ ID NO: 1433 - DNA, 101 bp, rice(Oryza sativa)
  misc_feature (71): n=a or g
atatttgtgtcctttttacatggatgcaagtgaacaaatacattaccagtatagaaatctgcttaatagtnttaatttattttttatattatatgtactac

SEQ ID NO: 1434 - DNA, 101 bp, rice(Oryza sativa)
  misc_feature (71): n=a or c
tccaactgattcttccttcattcgagcttgatcttaaggaaattacacataccttttccaaggtaatgctnctcaaagtcataaggttataaaaaatgttt

SEQ ID NO: 1435 - DNA, 101 bp, rice(Oryza sativa)
  misc_feature (71): n=t or c
caaaggaaaaaaccaaaccaacctgtacggtacggctgcacctgatgagcgattgccgatgaggcgatgancccgaccggctgtctacccactgtcgcgcg

SEQ ID NO: 1436 - DNA, 101 bp, rice(Oryza sativa)
  misc_feature (71): n=a or g
gcgtcagtactgatttattggatgtatatttgctgttcactaccagtgcagtccattaattcaagctgctncttcattgacgtgatgacaatgtttttttt

SEQ ID NO: 1437 - DNA, 101 bp, rice(Oryza sativa)
  misc_feature (71): n=t or g
ctgcgcctgcgccgagccgagccgccgacgaaggagtgggagacaaaagtgaggcgacgaggacgaagggntccttcctctctctctctctctctctctcc

SEQ ID NO: 1438 - DNA, 101 bp, rice(Oryza sativa)
  misc_feature (71): n=a or g
gcaagcagacagactaacagttcaaaacaacatgaacagcagcgaaatgactagatctgcagttcaacggnggcatactgcatctaataggtaaaaaaacg

SEQ ID NO: 1439 - DNA, 101 bp, rice(Oryza sativa)
  misc_feature (71): n=a or g
acactttctcgttgatcagtaggcattgagaaccaatgagcccgcgagatttagaggcaagcgaacttacngccttgtgcttctcctcgccgcggccacca

SEQ ID NO: 1440 - DNA, 101 bp, rice(Oryza sativa)
  misc_feature (71): n=t or c
ttgctctaattgatattatcttgaccgagtaattgaaatttacattgtgaggtatatttcttagttagttnctatttagtatactggaatattattcacta

SEQ ID NO: 1441 - DNA, 101 bp, rice(Oryza sativa)
  misc_feature (71): n=a or g
cattagaactacccacgaacaagtccaacgcagaaagttacgttccaccggagaaaacaacctattaggcntgggcctccggaataacacaacggcgagct

SEQ ID NO: 1442 - DNA, 101 bp, rice(Oryza sativa)
  misc_feature (71): n=t or c
gacgacgacaatgtatcgtttcatcagaacaagaaaaaaaatgagtcggaatcggctcttctactccgttnccgtacaagtcagacttgattcgtcgtctc

SEQ ID NO: 1443 - DNA, 101 bp, rice(Oryza sativa)
  misc_feature (71): n=a or g
caggattacattaatgcaaatgttagctcaaactttttttgaagaaaaaaaatcatagacctcaactggcnttctttgtaggttctaatattttcacagtg

SEQ ID NO: 1444 - DNA, 101 bp, rice(Oryza sativa)
  misc_feature (71): n=t or c
ctcccgcggtttcccttcctccaagaaagaaaaaccgacgtcgtcgctcgctcgtccaagaaaaccacganctccttcctctttccaccatccacgatcca

SEQ ID NO: 1445 - DNA, 101 bp, rice(Oryza sativa)
  misc_feature (71): n=a or g
taccgaatattaagactttcacgcaccgcggatcctagcaatttcgcttggtcaaaacctcaatgtcattncaaaagaaacccaaataaacaatctagcaa

SEQ ID NO: 1446 - DNA, 101 bp, rice(Oryza sativa)
  misc_feature (71): n=a or g
tttgtctctctttgaagggagtgagtactactcagtgtcatcagtcaggccgcctatcgatcgacgacccngtccaaagttgcggactgtttccccgcgca

SEQ ID NO: 1447 - DNA, 101 bp, rice(Oryza sativa)
  misc_feature (71): n=a or g
cccttctaatccactacatagtaccctgtaaacgctcctagaccgtcatgtggtgctctaataagtcatanaaattacaagaaaaaagcaaaacattcgac

SEQ ID NO: 1448 - DNA, 101 bp, rice(Oryza sativa)
  misc_feature (71): n=a or g
aaggaatgcttagggcagttatagactcacagtacaagacaccactagtagtaccagtctcctcaaaattncttatacttgatttcattagtaggacaaaa

SEQ ID NO: 1449 - DNA, 101 bp, rice(Oryza sativa)
  misc_feature (71): n=t or c
cgacagcttctaaaatctttccattgctagtttaataacaaatagttcttcagccatgtacattttctttncagaaattgttttaagataaattacttaat

SEQ ID NO: 1450 - DNA, 101 bp, rice(Oryza sativa)
  misc_feature (71): n=a or g
aaagaacttagccagcgaaaaatgtcaattttagttcgacgaaagtacatatgccggtgacgaagtttttnaaggtcttcgagaactcatattaggaagta

SEQ ID NO: 1451 - DNA, 101 bp, rice(Oryza sativa)
  misc_feature (71): n=a or c
ttgacatttttcgctggctaagttctttagttgaggtttctcaattcacatctttcgttttcttcacacangtttccaaaatgctaaacaatacttttttt

SEQ ID NO: 1452 - DNA, 101 bp, rice(Oryza sativa)
  misc_feature (71): n=a or c
tccggcatacagccaagcagcacgcctgtggcagcagcggcggggttggacaatgggtcgataatggtcanagaaaacgggaaatgggatgagttggacag

SEQ ID NO: 1453 - DNA, 101 bp, rice(Oryza sativa)
  misc_feature (71): n=c or g
aagagcgagcgagcgagcggcgagccgacgctttaaggcgcggtattccacgtgacacagcataacgccancccactccactgccgcgtgggacccacgca

SEQ ID NO: 1454 - DNA, 101 bp, rice(Oryza sativa)
  misc_feature (71): n=t or c
tccacccgttcctgtcatcggcacgccgcatggtgggcttgtggtagaaccgcttccctatcaccgagccngtcatgaacgacatcaacatcgccaccgac

SEQ ID NO: 1455 - DNA, 101 bp, rice(Oryza sativa)
  misc_feature (71): n=t or c
tgattagtacagaggctaagtcgtaagcatgaaaaagttagtcagttgacaaacttggttgccaaaactantaacattctatactatggttttagttttaa

SEQ ID NO: 1456 - DNA, 101 bp, rice(Oryza sativa)
  misc_feature (71): n=a or g
aaaatcgcaaaaaaaaacccactactacagagaaggcattcggtgccggttcccaaaatcaaaaaaaaaanaaaaaaaaagagaaaactacacatcatatg

SEQ ID NO: 1457 - DNA, 101 bp, rice(Oryza sativa)
  misc_feature (71): n=t or c
attttttaacacctttaagatgttctgatactccctaaccctttctattctgttcttgaatgcactgaagntagattggaggctgtctcacgagaagccac

SEQ ID NO: 1458 - DNA, 101 bp, rice(Oryza sativa)
  misc_feature (71): n=a or g
gattagattgttacgtacagtagtagataggaaaccgtagtggcaacgggataactggataaggatgaagngttctaatcaacttcagaaatggaagatgg

SEQ ID NO: 1459 - DNA, 101 bp, rice(Oryza sativa)
  misc_feature (71): n=t or g
ggtttaccgtaaacaaattgatacagggaaaattcgtagtagtacttgttaacacatggcatcggaaagcngagacaagatccaagccaagcggtccgtgc

SEQ ID NO: 1460 - DNA, 101 bp, rice(Oryza sativa)
  misc_feature (71): n=a or c
aatggcataaccttaaaaagcctaaccgaaggagtaccactaggcggctgctgctgttgttgcagtaaacnaaaaaaaaaaaaaaatttgtttacaaaatg

SEQ ID NO: 1461 - DNA, 101 bp, rice(Oryza sativa)
  misc_feature (71): n=a or t
aatccctttctgcaccaatcactcacttgtcacttgtcactatactaaattgatacaccccctctcttttnaaagtataaatcaaaccccccaaatctgta

SEQ ID NO: 1462 - DNA, 101 bp, rice(Oryza sativa)
  misc_feature (71): n=a or g
gtgcggccccacatgacatctctcccccccctcaagatccagctcgtcctcgagctgaaaatccaggtacncggcacggaactcctccaagtcttcccatg

SEQ ID NO: 1463 - DNA, 101 bp, rice(Oryza sativa)
  misc_feature (71): n=a or g
ttggttattattactattaaactgttgccaagcatgaccagggacatgtttaaggaaacttttagtgattncagcttctttcagaatcaaaaactcctaaa

SEQ ID NO: 1464 - DNA, 101 bp, rice(Oryza sativa)
  misc_feature (71): n=a or g
gcagcactagtactcctacgtactagacccgttatcgctggcccattggtgagttgctaaatcacaagagngccttttcctcctttttttttttcagttgg

SEQ ID NO: 1465 - DNA, 101 bp, rice(Oryza sativa)
  misc_feature (71): n=a or g
ccttggtggatatctcatatctgtagattaaatctggagtaaattgcatcaacgatacacaacttagtggntgcagtctactagtgcataaatttgtaaaa

SEQ ID NO: 1466 - DNA, 101 bp, rice(Oryza sativa)
  misc_feature (71): n=a or c
tgtttacatagcattaaaatcaataacaaaatcagcaagattaacattgtcgtacggttttggtcttgtangcacgcaccaaataagttcatgcatcaaaa

SEQ ID NO: 1467 - DNA, 101 bp, rice(Oryza sativa)
  misc_feature (71): n=a or g
agcccttccattgttcttgaaatcacgctttaatgatttttaaccatagcaaatttagatggtcttgcagnttcagaactgaaatcaccactgtttcatgc

SEQ ID NO: 1468 - DNA, 101 bp, rice(Oryza sativa)
  misc_feature (71): n=a or g
tgacagcttagctaggattttagcgccaacgttgcaggcgctaagacgttatatatcagcgccaatctcantggcgctgagccgacggcttatttttgcaa

SEQ ID NO: 1469 - DNA, 101 bp, rice(Oryza sativa)
  misc_feature (71): n=a or g
caacgaaacgcttcgaatgggtgagctgcgtgtgctgcggccatgagatatctgtcgacatagatttctancactaaattagcagcgagcaccgaaggtgg

SEQ ID NO: 1470 - DNA, 101 bp, rice(Oryza sativa)
  misc_feature (71): n=t or c
ctcggtcgagtcaaacctagaaagaagtccaaaaagaaccggccgctccgcttcgcttccttccgcctccngcccggcgcccgccactcgatttcgaggag

SEQ ID NO: 1471 - DNA, 101 bp, rice(Oryza sativa)
  misc_feature (71): n=t or g
cagctcgctctgcctgctgcttttgcttgcgtttctctcgtgaaatctgctgtgaaaaatcctcctcgccncctccatccatcgtgcaaaacagccacgcg

SEQ ID NO: 1472 - DNA, 101 bp, rice(Oryza sativa)
  misc_feature (71): n=t or c
aatggaaaaacaagagtctcagggacccagaaaaaggattttttttgaccccggaggatttggagaaatgnacccaaccatgaagaatggatttttttttt

SEQ ID NO: 1473 - DNA, 101 bp, rice(Oryza sativa)
  misc_feature (71): n=t or c
caatatcttcaagcttcttcccattgaagatgtcaatggccacaaagtggcattttgcatgtccatgcttnccagtcttggaggtggagacctcaacaacc

SEQ ID NO: 1474 - DNA, 101 bp, rice(Oryza sativa)
  misc_feature (71): n=a or t
tcaatggcagcatgcaggaaaaatgcaaggaaaaaagtggcgatggtaccatggcagtatgcaggaaaaangcaaagctagaggcttagaaatccaagagg

SEQ ID NO: 1475 - DNA, 101 bp, rice(Oryza sativa)
  misc_feature (71): n=t or g
actctatataggataggtatagtaatacactctccacatcatatcgttaggcggttagggttgagagaggnacgatatcattcatttcgcaatattaatta

SEQ ID NO: 1476 - DNA, 101 bp, rice(Oryza sativa)
  misc_feature (71): n=a or c
tacctggtccgattaggtaggtcactgtcgcatcgtttaacgttgatgcactcagttataagttagagcgncactagcactagtggcaccgctctatccgt

SEQ ID NO: 1477 - DNA, 101 bp, rice(Oryza sativa)
  misc_feature (71): n=t or c
ccatcccgccgccgcgcgatccatcacccggaccagcttcacacccgcgtaaaataataaacaatcaaagncccacgttttcccactcgccccacgttgaa

SEQ ID NO: 1478 - DNA, 101 bp, rice(Oryza sativa)
  misc_feature (71): n=a or c
gcgtttgaaacaaattattcattggattattgtcgtggatagttactcgattgtaggattaaattaattanctagcatggtggcccgcacagattgcgtgg

SEQ ID NO: 1479 - DNA, 101 bp, rice(Oryza sativa)
  misc_feature (71): n=t or g
gaaaagtgacaagtcgtaatgtcgtctttgcttcgcgatatcttaacgtgggcacgttttagaacgaacangggtgaagcttcacctatactcactccttc

SEQ ID NO: 1480 - DNA, 101 bp, rice(Oryza sativa)
  misc_feature (71): n=a or g
agcctcaaattagcagccttaagaaataacagctgcaacaaccatacgagtccaaagaggaggtgaccaanaaaaaaaaaagactaactccaatcagccat

SEQ ID NO: 1481 - DNA, 101 bp, rice(Oryza sativa)
  misc_feature (71): n=a or g
ggaggaggggagacgacgagtgggggaagtggaaggaagaacaagaagaagggtggaggtggtttaatggngtggtagaataattaattggcggcagctgt

SEQ ID NO: 1482 - DNA, 101 bp, rice(Oryza sativa)
  misc_feature (71): n=t or g
atggacaggctcgtcgttgatcaccaccacggacttgtcgacttcgccggacgttcttgcatcgagcggcngcggagaagtcgccgccggtgaaaccatca

SEQ ID NO: 1483 - DNA, 101 bp, rice(Oryza sativa)
  misc_feature (71): n=t or c
tttcttatttttgtacgatttataaattggtggcttttaagcctccctatgggtgaagttctagctgcaanccacctaaaaagattactcaaagtttggct

SEQ ID NO: 1484 - DNA, 101 bp, rice(Oryza sativa)
  misc_feature (71): n=t or g
gaagattcaaataccataatagtatttaccctacttggcatcgcgaattaacgagggtttggtttgtctcntcggcggcacgtgttggtgggccatggatt

SEQ ID NO: 1485 - DNA, 101 bp, rice(Oryza sativa)
  misc_feature (71): n=t or c
catactatatcccagtgtttcctttgaaatcatgcaaacttgcgcgatcagtacaaagctatcacgtgcangggtttgcatgctttcgaaggaaactctag

SEQ ID NO: 1486 - DNA, 101 bp, rice(Oryza sativa)
  misc_feature (71): n=t or c
agcaccaggagagccacaacgacgagctatcctgtgcgcgtgtttgcatgtttcctcgtgagaccatgganacggagcctttctgatcccaacagtcttgt

SEQ ID NO: 1487 - DNA, 101 bp, rice(Oryza sativa)
  misc_feature (71): n=t or c
tattcaatatttggttttaatttggtgttataagagttgttacgtttctccgtaaaatcgatcaaatttanagaagtttaatttataataaaaaatcaaag

SEQ ID NO: 1488 - DNA, 101 bp, rice(Oryza sativa)
  misc_feature (71): n=a or g
aaagaggtcaatctagtcaagcaattccgacgaaacctcgaggacaagggagagcgaagactagagagcgngggtggcggcgggggcttgccttggcgacg

SEQ ID NO: 1489 - DNA, 101 bp, rice(Oryza sativa)
  misc_feature (71): n=a or g
cgtgtgtccccaaaaactttcgaggcgggatacctgcattttgctttgcatggattcaggccaaacaggtntcgattgctcatcgctgggggaaggatttc

SEQ ID NO: 1490 - DNA, 101 bp, rice(Oryza sativa)
  misc_feature (71): n=a or g
ttttttcatgttttttttagaaacatggaataaacacggacactcacaacgcgcgcacaatttcccctatncacgcacactctatctctaagaacacctat

SEQ ID NO: 1491 - DNA, 101 bp, rice(Oryza sativa)
  misc_feature (71): n=a or g
tggaatcttatgagacttatgtgttcttatcagggtttttgcgttatcgcgatacccggtgttatcaatgngcacctataacaaatttcttcaaaaattgt

SEQ ID NO: 1492 - DNA, 101 bp, rice(Oryza sativa)
  misc_feature (71): n=t or c
ggaatggttgcagaaatagagtggtgatccacttttaaaatatctgtgaatacatatgtggcttttggttntgtgttttctgcttttttttttggagtagc

SEQ ID NO: 1493 - DNA, 101 bp, rice(Oryza sativa)
  misc_feature (71): n=t or c
cccgttgcaacgcacagtcatttttctagtactcatatatatgtatgtaaaaattgcctgggtatgaaacnaattagaaggaggggcagctttatggtata

SEQ ID NO: 1494 - DNA, 101 bp, rice(Oryza sativa)
  misc_feature (71): n=a or c
tctaggcttcagcgagagctgcgagaccaagcagctaccagctacacatatcacactgcaggccagcaganactagatcgaaccgcgagtagtcggaaggg

SEQ ID NO: 1495 - DNA, 101 bp, rice(Oryza sativa)
  misc_feature (71): n=a or g
ggagtataaatttattttagaataaatttatctttgcatgtgcattgcgttgcagcgtgggcacgcggccngccggtgatgaggtgtcgctgcattacgct

SEQ ID NO: 1496 - DNA, 101 bp, rice(Oryza sativa)
  misc_feature (71): n=a or g
ggtgggggggtttgggatgggagaggagaggaaagcgagaggagagaaggggaaagcgagagaggcgatgngagaggtgggaataaagcggaggaggagga

SEQ ID NO: 1497 - DNA, 101 bp, rice(Oryza sativa)
  misc_feature (71): n=a or t
tgacaagggcaaatgggtcattttcacaagtttgccggacataatgcagccatcttcagttattttttttnaaaaaaaaactgcagaataacaccaaaaag

SEQ ID NO: 1498 - DNA, 101 bp, rice(Oryza sativa)
  misc_feature (71): n=t or c
ctataattttcatgatggagatggtaccattattttagagtaggaaagaaccaataaaatgatataaatantgaaaatagattaagaataatattctaaga

SEQ ID NO: 1499 - DNA, 101 bp, rice(Oryza sativa)
  misc_feature (71): n=t or c
tttcatgtgactgcatctttcgtagcagtaacctttttgttatctcatgccagtagccagtgtatatctanatgactaatgaaaatattgtaggtgtaatg

SEQ ID NO: 1500 - DNA, 101 bp, rice(Oryza sativa)
  misc_feature (71): n=t or c
tttgttatacggctaattgtctaaatgcaggagacatggctagcaaactatagagggtgtgttcggcagcnatttttcggctgcagttgcagctgtggcta

SEQ ID NO: 1501 - DNA, 101 bp, rice(Oryza sativa)
  misc_feature (71): n=a or g
acatgcactggtcaattcaatggagagcaagggaaatgttcgaacaaatgacaaacctcgagtctagaggncgcgggcttcggcggtggaggctgcggcga

SEQ ID NO: 1502 - DNA, 101 bp, rice(Oryza sativa)
  misc_feature (71): n=t or g
acttgacaggagcagcatgcaaagctcacaaacagctgtctactaaaaatagcatgcatatctagagggcncgccattgactaaatactctaaggcactgg

SEQ ID NO: 1503 - DNA, 101 bp, rice(Oryza sativa)
  misc_feature (71): n=t or c
actcctctctatctcataaaaatccaattctaagaataaatatgagcatatattgtgtccagattcatctngaagattggattctttttttgacagagaga

SEQ ID NO: 1504 - DNA, 101 bp, rice(Oryza sativa)
  misc_feature (71): n=a or c
tgattctcaaattcccttccttttgctcctaatgctctcaatagtttactgtggcaatgctccaagaaagnatgttgtcatgatgtaaagtacttcaaagt

SEQ ID NO: 1505 - DNA, 101 bp, rice(Oryza sativa)
  misc_feature (71): n=a or c
acaagcggcaaagaaaaaaaaaacacaccagcttggaaagttggtttggtaagcaggacaatgacaccccngtaaattacaaatggagagaaaaaaattac

SEQ ID NO: 1506 - DNA, 101 bp, rice(Oryza sativa)
  misc_feature (71): n=t or g
ctgccaattgcaatgcaaagcaagattgttcatatactggtaactggttgactcctttttgtttttgctgngtttctttgtgatatgaggagattgatgaa

SEQ ID NO: 1507 - DNA, 101 bp, rice(Oryza sativa)
  misc_feature (71): n=a or g
aaatgtaggagggaagagaatcggatcacgaccggattaccatgacgagcgacggcggtggcgctggttanctccggtttcgaaggctcgccggcggtgga

SEQ ID NO: 1508 - DNA, 101 bp, rice(Oryza sativa)
  misc_feature (71): n=t or c
tggcaatgcttctacagcttccttcttggcaggtggtgtaccagaacgattaagatcactttccgccaaangctgcaagaggatatctaatccaggaccaa

SEQ ID NO: 1509 - DNA, 101 bp, rice(Oryza sativa)
  misc_feature (71): n=t or c
ggaaatcagtgttgttgtcagctctaagattgaacattattgacctgtattttgccttgtgagccccagtngaacgtcccagcctctcaaataacgcagat

SEQ ID NO: 1510 - DNA, 101 bp, rice(Oryza sativa)
  misc_feature (71): n=t or c
agctgttgttgggatcaggtcctctctgttttcttcagaaatggcagagtacacgaagcagaggtcagtanttgtatggtacagaaagggaaggtgttttc

SEQ ID NO: 1511 - DNA, 101 bp, rice(Oryza sativa)
  misc_feature (71): n=t or c
tactttgcatagacgagtttttaacaggaatttagtaagatcagaaatgtatcgttggtttttgtctcttngaaagagtgttagaggatgtattcgtaagc

SEQ ID NO: 1512 - DNA, 101 bp, rice(Oryza sativa)
  misc_feature (71): n=a or g
tactctctctggatcgaaaaatataaacacttaaagtttttcgtctgaattgaacgagaagtgaagttgantgaggattttcaaatgtaaaatgcaatctc

SEQ ID NO: 1513 - DNA, 101 bp, rice(Oryza sativa)
  misc_feature (71): n=a or g
taataggaatagagacatacctgatttgagcaattccttctgcacaaagggtgccatgaagaaattaaacncctaatctgcagctctgaacagaaaagatc

SEQ ID NO: 1514 - DNA, 101 bp, rice(Oryza sativa)
  misc_feature (71): n=t or g
tcttggctgcaatggcgggccttgcctaacatggcgtctactgtagaacaggccagcctcgttgaaccggnacagccatggccggcccggccgacggagca

SEQ ID NO: 1515 - DNA, 101 bp, rice(Oryza sativa)
  misc_feature (71): n=a or c
gtggaaacaaaatcaacatgagttaaagggctcccctaggtacacagaaccagacagatgctatttactcnctccgcttcatattataagtcgctttgact

SEQ ID NO: 1516 - DNA, 101 bp, rice(Oryza sativa)
  misc_feature (71): n=a or g
aaagatattctggagcagcataaccatatgttcccatcaccctcgtggatacatggctcttctcaccaacnggaccatcctttgccaatccaaaatcagat

SEQ ID NO: 1517 - DNA, 101 bp, rice(Oryza sativa)
  misc_feature (71): n=a or g
ctagtactgctgttactcatcatcatcatcgctagtggtcactgctagtagtagttgtgctagtgcatgtntggttatggatactgcatcatgttggttgg

SEQ ID NO: 1518 - DNA, 101 bp, rice(Oryza sativa)
  misc_feature (71): n=a or g
cccccccccagcccccacgttgtctctgccgctgcttgttgacttgatccactcggctgagtcagcatgtnggcttacgtctcacccgttttgtgtttaga

SEQ ID NO: 1519 - DNA, 101 bp, rice(Oryza sativa)
  misc_feature (71): n=t or c
tttacagtatataattgttgataggtaaagcggcagtgagacctcttcatgtcataaatacacattagganatttttgcctttgcaaagaatatcccagca

SEQ ID NO: 1520 - DNA, 101 bp, rice(Oryza sativa)
  misc_feature (71): n=t or c
tttgcagcaacagttacaggagaaatctaacatcagggttctcccctgatgtattcccgttaaaaaacaanatgtggaaacaacgaaaagttcattgatca

SEQ ID NO: 1521 - DNA, 101 bp, rice(Oryza sativa)
  misc_feature (71): n=t or g
ttgaagttccggtcagttaattagccaaccggccgccggaatttcgactccttcccaatggctatttcctnaccaatcttttcatactctatttttttatt

SEQ ID NO: 1522 - DNA, 101 bp, rice(Oryza sativa)
  misc_feature (71): n=a or g
acccaacatggtgcgcatcgcgtcacggctgcgcgcatataggcacagtccactctccagtctccataganggaggcaaattactacattatggtgtttag

SEQ ID NO: 1523 - DNA, 101 bp, rice(Oryza sativa)
  misc_feature (71): n=a or g
gagtagtgccgcgtgtagttaacaagatagccacgttgtaggttatatcaatcttattgacacaactcgtnacaacactatggctacggcgttgtcatttg

SEQ ID NO: 1524 - DNA, 101 bp, rice(Oryza sativa)
  misc_feature (71): n=t or g
actgtttttttttactaatttttttgaggtaatttttttttactaattactactcccaccgttccatatcncaagttattttagttttagtcaaagtttaa

SEQ ID NO: 1525 - DNA, 101 bp, rice(Oryza sativa)
  misc_feature (71): n=t or g
atgcaattcacggtgttctttgtattttcagcatcgtttgccttgcccaaatcctgccgcagatgccaagnttcataacaacatagatcctgcaagtcttg

SEQ ID NO: 1526 - DNA, 101 bp, rice(Oryza sativa)
  misc_feature (71): n=a or c
tgccatgctaccatgttgtgctgaggattatctatgttctactgattcatcagcgtcaccaaagcaatgantaatatgatctatttagtgctgcaatttaa

SEQ ID NO: 1527 - DNA, 101 bp, rice(Oryza sativa)
  misc_feature (71): n=t or g
ccttagacacacttggtttgctactagttattcaatgatattttttgcccaacacttgggttgctaaaganctttttttttttctataagattttactctg

SEQ ID NO: 1528 - DNA, 101 bp, rice(Oryza sativa)
  misc_feature (71): n=a or g
gccttttgagtcgttcaattaattctgttcaatggaatgttgacttgttgaggcatgaattgagggaggcnttgactgttaaatattagggtatggggaca

SEQ ID NO: 1529 - DNA, 101 bp, rice(Oryza sativa)
  misc_feature (71): n=t or c
ccttagattaccctaattctagtgagacattgctatagtgcaaaaacttagcaaaacccatccaaaggccntagataatttctattccttttaggcaaaat

SEQ ID NO: 1530 - DNA, 101 bp, rice(Oryza sativa)
  misc_feature (71): n=t or c
gcccaacgccattagtacgccatatctggttcttccccatttaagtcttgattgattttcttgtgggtttncccttctcatcttagtacaagtgttatctc

SEQ ID NO: 1531 - DNA, 101 bp, rice(Oryza sativa)
  misc_feature (71): n=a or g
tcggcatggatgtaataaagctctttcctactcacaaccgtattgtgttccgttacaggatgggcaacaanctcaggatgatcctgaatgcaattgaggtc

SEQ ID NO: 1532 - DNA, 101 bp, rice(Oryza sativa)
  misc_feature (71): n=t or g
tgtcaataggcattctatttaactcctgaaaagattttaaccattgtacccttaagtctctggaagagaantcatatgattaaattgtttatattatgtta

SEQ ID NO: 1533 - DNA, 101 bp, rice(Oryza sativa)
  misc_feature (71): n=a or c
ctttttttgaccaccaccaccttaattattatttgcctccattcaccgcccctcgctaaaaatgaagcacngtaaaaacaagccagccagcacatatgcac

SEQ ID NO: 1534 - DNA, 101 bp, rice(Oryza sativa)
  misc_feature (71): n=t or c
ttagaatgggtcgaatgtgcgaatatgcctttcattaagaattaatggttctcctgtgctttgatatgctngcctagatttttgacatgcctaagctctaa

SEQ ID NO: 1535 - DNA, 101 bp, rice(Oryza sativa)
  misc_feature (71): n=a or c
tagcattaacacgtatcattgtcctattgtagctgcttttcaattgacgtcatagaatctatggcattagncacatctttagtgtgcccgctaatatgttt

SEQ ID NO: 1536 - DNA, 101 bp, rice(Oryza sativa)
  misc_feature (71): n=t or c
tatcagtcattgatcatctaagacacattagataacgacacagaaagacataatttttattaacgaagttnattcgaagcctacatctctagggatgggat

SEQ ID NO: 1537 - DNA, 101 bp, rice(Oryza sativa)
  misc_feature (71): n=t or c
ctctggaactagtagcggcgggtcggcgaggatgttggctgcagcggcacaacctcccatccacaagctanatgcatcggcagcgacggcattatccggca

SEQ ID NO: 1538 - DNA, 101 bp, rice(Oryza sativa)
  misc_feature (71): n=a or c
tgtgcttatatgttttatacatcaatgttttctttctcattcatcctgttcttgcacaagtgacgcatttnagctggattattgtatatcaattggattat

SEQ ID NO: 1539 - DNA, 101 bp, rice(Oryza sativa)
  misc_feature (71): n=a or t
ttattgtgtttttgacatttgatggacagagtctcctgcatcaagcattcagctgtcgctcgctagtaatncatgtaattcattttagtgaaggcgatgag

SEQ ID NO: 1540 - DNA, 101 bp, rice(Oryza sativa)
  misc_feature (71): n=t or c
agcaggggagagagtcaatcgagcggataacgaacagaacacacacccactgtgctcatggcttcctcttnctcctcccttggccttggcgccatcttcca

SEQ ID NO: 1541 - DNA, 101 bp, rice(Oryza sativa)
  misc_feature (71): n=t or c
gttgaaaccactgcaaaggtgatgtaaacaccgcacggcagattttagacagtgatatgtatgtaatacgntgtagcagtattcgaagataatatgtttag

SEQ ID NO: 1542 - DNA, 101 bp, rice(Oryza sativa)
  misc_feature (71): n=t or c
atgcaagcatcccactcccacacaacacagctggccaacaaagaaagtcgatttttatccctccatggaanatcccctcattttgtacatgacatttaaaa

SEQ ID NO: 1543 - DNA, 101 bp, rice(Oryza sativa)
  misc_feature (71): n=t or g
aatttcagatcaaatcgacattggttgcaagtgtacggcagctcagtcctttacctcggtaagcagaagcnaggcgccccctctagggtcgcggcggcggc

SEQ ID NO: 1544 - DNA, 101 bp, rice(Oryza sativa)
  misc_feature (71): n=t or c
gatcagattccttttggtttagactggtaatagtggggtagtataaaggaaagcagtccgtttgtctgttncatttggctcgccgtcccgctccctttcct

SEQ ID NO: 1545 - DNA, 101 bp, rice(Oryza sativa)
  misc_feature (71): n=t or g
gagggagccttttggccctttggccctggagggagcctccttctcattttgtgtacgctcgataatatttngggtgatacggccgcgccgatatgtttttg

SEQ ID NO: 1546 - DNA, 101 bp, rice(Oryza sativa)
  misc_feature (71): n=t or c
aatatatatgcatcagaattgtcgtcactacgggtgtgtcaacacattaaacaagattgctaagtgcaggnaaatcgttgatggatacaaacagcatggct

SEQ ID NO: 1547 - DNA, 101 bp, rice(Oryza sativa)
  misc_feature (71): n=a or g
cattattccttagcatcggcatgccgagtagggagtgtcacatgtctgtttcaagtagaaatatttaatcnagaattctttaagagaatttacctaagcac

SEQ ID NO: 1548 - DNA, 101 bp, rice(Oryza sativa)
  misc_feature (71): n=a or g
caaatcttgtcaacaatttctccacagaggttctcattcccttcgaatgccgttccgttcaacgtacaaanctgtgattcaaagggaatctcaccggagag

SEQ ID NO: 1549 - DNA, 101 bp, rice(Oryza sativa)
  misc_feature (71): n=a or c
aaacggtggtaattggcgtgcttaatttttaattttggtttcccgtacgtgtgagtgtgtgtacatgcacntgcgaatcgacgaggaagcagcagcagggg

SEQ ID NO: 1550 - DNA, 101 bp, rice(Oryza sativa)
  misc_feature (71): n=t or g
gtacatatatatatacttgttgttatacgctggttacttttatctttatacgctggttgctattatttttngactacacttgttttgattgctagattgta

SEQ ID NO: 1551 - DNA, 101 bp, rice(Oryza sativa)
  misc_feature (71): n=a or g
atcatcacctccagcactattatatatacccctggacgacacagccacagttcatctatcctaattaagcncaacaattcctctctagctaagccaattta

SEQ ID NO: 1552 - DNA, 101 bp, rice(Oryza sativa)
  misc_feature (71): n=a or g
tcttgaatttgacgatgtttgatcccaaatccatgattggagaaaataaggaaacccttcgcttaaaatcnactgaggactcacgttcctcgatgaagcta

SEQ ID NO: 1553 - DNA, 101 bp, rice(Oryza sativa)
  misc_feature (71): n=t or g
caccaaggcgggcgtgatccacagctggtttggctactccatccgggtcttgtctccggtcaccatctttncctccttcatcttgttcatcgtcagtggga

SEQ ID NO: 1554 - DNA, 101 bp, rice(Oryza sativa)
  misc_feature (71): n=a or t
tatgactgtgatgaggcaccactgctgattccagggtagcagggtgagtgttatgcttgtcacgatcgacngagttgggacacaatacaatgagccatgca

SEQ ID NO: 1555 - DNA, 101 bp, rice(Oryza sativa)
  misc_feature (71): n=a or g
acgacgtacgaagtcctctgtgacttcatatcccggcaacccttcttgttggaagttatccattttgtctntgaaactttggagagaagggacaaaggata

SEQ ID NO: 1556 - DNA, 101 bp, rice(Oryza sativa)
  misc_feature (71): n=a or g
tttttcgctgcaatttcttgttctcctcctcgagacgcctgttctctttcctctttgtgtctacctttaanttgagattttctttgtctctcttcaatctt

SEQ ID NO: 1557 - DNA, 101 bp, rice(Oryza sativa)
  misc_feature (71): n=t or c
acattccacttcggtgccagggttgacccggcaccctcatataacatataatcttacgtgattagctgcanaataaatcagctagctaaccgcccaatagt

SEQ ID NO: 1558 - DNA, 101 bp, rice(Oryza sativa)
  misc_feature (71): n=t or c
aagtaacctctgtaccaacggagttgcttacccggtagctccttgacatagctccggatgctgctgaagtngccgcgcttcagtgcaaaagtcctctcaca

SEQ ID NO: 1559 - DNA, 101 bp, rice(Oryza sativa)
  misc_feature (71): n=a or g
ttccaccactgacaagtgcgtgacaacagtgaccgagagtgatcatcgaccactcctccaagtctctacancatgtcatggtatttgagtggaccaagaca

SEQ ID NO: 1560 - DNA, 101 bp, rice(Oryza sativa)
  misc_feature (71): n=t or c
gcgactcgccgaaggcaatgtcacagccccaccagcgccagaggctttcgccgtcgccagttgcaatgccnggtccgaagcaacagcgttggccgaagtgc

SEQ ID NO: 1561 - DNA, 101 bp, rice(Oryza sativa)
  misc_feature (71): n=a or g
ccggcagctccaagatcgatgagtccccgagcttcttgaggacgttgtaagttttcgtcttgaggccattnaggatttccgtgttggcacgctccgcttga

SEQ ID NO: 1562 - DNA, 101 bp, rice(Oryza sativa)
  misc_feature (71): n=a or g
gcctcttcttgatttgtgagtagaccacgagctcggagttggcatctttgttggtgcagtcgaacatttgncgaacggtgagggcggcgcttccgccaagt

SEQ ID NO: 1563 - DNA, 101 bp, rice(Oryza sativa)
  misc_feature (71): n=t or c
agaaaatttcggactgctgtcattaacattaatttgccgaacaaaacgttcatggataatagtccgaggcnataaagaagtatgtccaaggccataataaa

SEQ ID NO: 1564 - DNA, 101 bp, rice(Oryza sativa)
  misc_feature (71): n=c or g
tacaaatttgtatcataaagtacagtttaagattggaaattgtacaaattcaagaaaagtaaaaatcgaancacagatgtcactagcatggaacacctcat

SEQ ID NO: 1565 - DNA, 101 bp, rice(Oryza sativa)
  misc_feature (71): n=t or g
tcagactgacattgtatggacggtcagaccgcccgaaggtcccgacagcccccaacggctagttttttttnaccgttggaccaagggctggtctgaccggg

SEQ ID NO: 1566 - DNA, 101 bp, rice(Oryza sativa)
  misc_feature (71): n=t or c
cacttctctcaattggactggaaatggagaaagctcttccttttaaaagagaggcccggcccatcgttgcntcaaaacggcagggctaaacaagcccaaca

SEQ ID NO: 1567 - DNA, 101 bp, rice(Oryza sativa)
  misc_feature (71): n=a or g
gcacttgctccatatgggagtggtattatcaaacatagccatggctaaagcttatattaatcttattattnttatacggtttagttaaagtgaaatttact

SEQ ID NO: 1568 - DNA, 101 bp, rice(Oryza sativa)
  misc_feature (71): n=a or g
tcctgaaagggctgctctactcgatgggcggtggagaggtgccgctgctcgacctggtagcttatggcggntatctatttgccgggctttcccttgctgtc

SEQ ID NO: 1569 - DNA, 101 bp, rice(Oryza sativa)
  misc_feature (71): n=t or c
tgccatatgtaggctcagataagtagatacagttgctcttgatcttggagacacttgcaccaccaaagccngaattgaaattcttggacatgaacattgcc

SEQ ID NO: 1570 - DNA, 101 bp, rice(Oryza sativa)
  misc_feature (71): n=a or g
agtagacatggcaataggggcccttcctatcccacgtataccggcaatagagctcctccctagcctgtagntggtcgcggtgatggtgtgctaaggacgat

SEQ ID NO: 1571 - DNA, 101 bp, rice(Oryza sativa)
  misc_feature (71): n=a or g
tataggcaaatgtccaagaacacatcccctcttagggcacgtccagtgcctgcgtcatatgccatgtcatntgcctcacacaaagcgcacaactaacgggt

SEQ ID NO: 1572 - DNA, 101 bp, rice(Oryza sativa)
  misc_feature (71): n=t or c
aggccccgcactgtcctagggccggccatgattctacatgtcttagcttagaagttatggttatgcagtgnagattttcgccaactacgaacggagattca

SEQ ID NO: 1573 - DNA, 101 bp, rice(Oryza sativa)
  misc_feature (71): n=a or c
ttaaaacttaattttgaagttgattttgttgttttagcgcagtttgtttttacatcatttgcttttgaatnactaagaacatatatataatacttgtactc

SEQ ID NO: 1574 - DNA, 101 bp, rice(Oryza sativa)
  misc_feature (71): n=t or c
tatcaacaaattttaagtgatggttgttcctacgaggacagttttgtttgtgttgttggttgtatagcgangcttctacaaggtttcgatgccgtgtttgt

SEQ ID NO: 1575 - DNA, 101 bp, rice(Oryza sativa)
  misc_feature (71): n=t or c
tgtttcgacgtggagacaagcatttttttttcgttcaattggacagcaatggcgattggcgacacaagganggtgaacgtatggatattaattattcacgt

SEQ ID NO: 1576 - DNA, 101 bp, rice(Oryza sativa)
  misc_feature (71): n=t or c
tgagaccacacagttcgaaacacactgtgaaactatgaacatcaccttgtcccttagactttacttattanactctcttctaagtttatggtgtattgttc

SEQ ID NO: 1577 - DNA, 101 bp, rice(Oryza sativa)
  misc_feature (71): n=a or g
tctattctgactcgcttattctatctagctgagccattcattcctttctataaaataaagataattaaggngacagaaaaaaaacaaataaagaaacaaac

SEQ ID NO: 1578 - DNA, 101 bp, rice(Oryza sativa)
  misc_feature (71): n=t or c
tcgaggagaattgtggatgatcgtcaaaccactgcaggcagacagttcaatatattcttagaaaagaacanaaattcacagcgaagaggaatgaaaatcct

SEQ ID NO: 1579 - DNA, 101 bp, rice(Oryza sativa)
  misc_feature (71): n=a or g
ctccgatgtagccgcaatggttcttgttggggtaactgccgaaggccatgcctctcaacctagcaatgacntcgtcctagcgccaggcgacgggcgaaccg

SEQ ID NO: 1580 - DNA, 101 bp, rice(Oryza sativa)
  misc_feature (71): n=t or c
tcccagtacactgactcaattcaacactgtatctgtatgcaatgaaacagaagcgcacttctgtatgaaanagaacccctcccctccgcacggaaaacgga

SEQ ID NO: 1581 - DNA, 101 bp, rice(Oryza sativa)
  misc_feature (71): n=c or g
cgaagctgacatgaggacgacgcattcctccgttatgccgccggcgacaatctagcacgaatggggcggcngccgccgccgccgggaggaggccgagggct

SEQ ID NO: 1582 - DNA, 101 bp, rice(Oryza sativa)
  misc_feature (71): n=t or c
ttttgtgtgacccagcaaagataatttctacagtagtgaaaattatattattttagtggtggcgctaatangcacgctgcgcacaaaatattagttcgagc

SEQ ID NO: 1583 - DNA, 101 bp, rice(Oryza sativa)
  misc_feature (71): n=t or c
acacctatttcttctgaacttgaatcaactgaaatacatgcatgccagatcggtttgggtagacatagggnagtccacctcacaatgaagctttgaagcac

SEQ ID NO: 1584 - DNA, 101 bp, rice(Oryza sativa)
  misc_feature (71): n=a or g
agtaagcaacaaaatctataaagacatgtgggatgaaaagcaatcttcgaaaagccactgccatccattcnagagaacatatcatgactacaataattgta

SEQ ID NO: 1585 - DNA, 101 bp, rice(Oryza sativa)
  misc_feature (71): n=a or t
tactatcccgtagccggggtgatagcagtgccctgccccggcactaaagatgatatctcatagcacactanaaaatatataccgagttggttaattacgtg

SEQ ID NO: 1586 - DNA, 101 bp, rice(Oryza sativa)
  misc_feature (71): n=a or g
acaaggaagccgctacgattctacgaagcttaatttggtggtctgagaaccagggagctcaagtcctgccnaagcttaaggtctatcagtaattataaata

SEQ ID NO: 1587 - DNA, 101 bp, rice(Oryza sativa)
  misc_feature (71): n=a or g
gaaatacatcaagacaacacgacgaaatactaatttggaagcacatatgaactaagctggtcgttttctgnacaatagatttaattaatttgtcataagag

SEQ ID NO: 1588 - DNA, 101 bp, rice(Oryza sativa)
  misc_feature (71): n=t or c
tatattattttatttgcatgcgaggatgatatggcatgcccaaattgtgttttttgggagggttaaatggntgcattgagctagatgatagtttaaggact

SEQ ID NO: 1589 - DNA, 101 bp, rice(Oryza sativa)
  misc_feature (71): n=a or c
ttgtcgtgcacttgcctttaaccttgacggtaactcgaggcaacactctccacaccagatctctacacacntgtggagtaaagctacaactaaacatctat

SEQ ID NO: 1590 - DNA, 101 bp, rice(Oryza sativa)
  misc_feature (71): n=a or g
ataagacgactcatttgtgataggtgttcaccatcagagataagattttattatcactgaccactcatctntgatgaggcctatacacgtcaatgaccctg

SEQ ID NO: 1591 - DNA, 101 bp, rice(Oryza sativa)
  misc_feature (71): n=a or t
ggacatatctctgtccagattcattgtaatagaatgtgtacggtgcaggccgtgcctagatattttttttnaaaaaagaactgtattgtgtgttgtgtaac

SEQ ID NO: 1592 - DNA, 101 bp, rice(Oryza sativa)
  misc_feature (71): n=t or c
cctagtttgaatgtcattttaccatcgagcttgtctgtacagaggcggtctgtgaactacaccctactggngtattgcacatatgatttaacttatggacc

SEQ ID NO: 1593 - DNA, 101 bp, rice(Oryza sativa)
  misc_feature (71): n=a or g
taatggtgtaatataatagtactactttgtaagaaaaattggaaatatagccaaaatgtagagtttagtcncatggaaggtaggatgtcaaaattaaataa

SEQ ID NO: 1594 - DNA, 101 bp, rice(Oryza sativa)
  misc_feature (71): n=a or g
tttggttgatgtagtgtctacgcggtacgttgatttggtatccatctaacgtgatatctacattgcatacntacacgatatgctcaatgggcgtggatgtg

SEQ ID NO: 1595 - DNA, 101 bp, rice(Oryza sativa)
  misc_feature (71): n=t or g
gcagcagtccatcatacatcgagtccaccatactcaaagccgctgaccatgggtcccacatatatttttcngttacaaaataattcaattcccgatattaa

SEQ ID NO: 1596 - DNA, 101 bp, rice(Oryza sativa)
  misc_feature (71): n=a or g
caccgactcgatcttggtgaggacagtataggcaatgtgaattgcgacatgattttcttttttcaatgacncacattattttttacggagtgtatcaaact

SEQ ID NO: 1597 - DNA, 101 bp, rice(Oryza sativa)
  misc_feature (71): n=t or c
tgagctcccaccgctatataaacgatcctcgtgatcccctcctccctttccctcttctgccgctcgttccngtctttctcgaagtggttgtagaggttcaa

SEQ ID NO: 1598 - DNA, 101 bp, rice(Oryza sativa)
  misc_feature (71): n=t or c
gacggtagggtttggactttggacccgtggaacgcacggtggccgatcagatgagagtttccggcttgctngggaactcgagggaaggggattgggagttt

SEQ ID NO: 1599 - DNA, 101 bp, rice(Oryza sativa)
  misc_feature (71): n=t or c
cacgtagacccacacatcattgacacatgatggtccacatgtcatgatatatgggttgcaaatagttgaangccaaatttaagagcggcaaatagttaaat

SEQ ID NO: 1600 - DNA, 101 bp, rice(Oryza sativa)
  misc_feature (71): n=t or c
atccacacattgaaacatacagaagctgtaaccaaacttttgtacctgccatatctcgtcctcagaatatngcccaattgggtcgatgttgcttcttatgg

SEQ ID NO: 1601 - DNA, 101 bp, rice(Oryza sativa)
  misc_feature (71): n=t or c
agactgatggttcttccttcaacgaattaggctgtgtttgctactatctccgtaccaaattagtagtcgcnttaacctttttcttttaatgtttgaccact

SEQ ID NO: 1602 - DNA, 101 bp, rice(Oryza sativa)
  misc_feature (71): n=a or g
tattcctcaaccgcaaaaaacggatatagcaactcccctaactatcaataccggttcattttgcctcctcnggtgctttggacagcggttttgttctacgt

SEQ ID NO: 1603 - DNA, 101 bp, rice(Oryza sativa)
  misc_feature (71): n=t or c
gatgagttacgactttaatttggagggcttatagactaacactaggcaagcatatacctaaaagctcaaanaaactcaattattaagggaacaaaactttg

SEQ ID NO: 1604 - DNA, 101 bp, rice(Oryza sativa)
  misc_feature (71): n=t or c
gtaacagaagaatttgtagctgccactgaaaaggttatttcttttcctgtttgaaaaatatgcacaaacgntcattatgctcatcactgcatacatgcaag

SEQ ID NO: 1605 - DNA, 101 bp, rice(Oryza sativa)
  misc_feature (71): n=t or c
gcagtggaggacaattgtgatcatctccaacattggtgttttcttgagcagaagattatcctgttccaatntattgtgataccatgaaaaacaaggggaaa

SEQ ID NO: 1606 - DNA, 101 bp, rice(Oryza sativa)
  misc_feature (71): n=t or c
ataaataatcacaggccattgattcgtttattcatgtgcttatacatatcgattattgccaaataaatgantatttgtgtgcaaatcttttatatacacgt

SEQ ID NO: 1607 - DNA, 101 bp, rice(Oryza sativa)
  misc_feature (71): n=a or c
cgcctccgtctctagcccattcctacaagtccaattaattgttcaaatgtgaacttttggataatgcaatnaaatcccggcatttgctcaaagagctacag

SEQ ID NO: 1608 - DNA, 101 bp, rice(Oryza sativa)
  misc_feature (71): n=a or g
aagctgtgtagataggtgggtgacagtttgagagagatgtattcatcgatactgtacagattttgcatacnaaattgttttaaaatatctatgtcttaaaa

SEQ ID NO: 1609 - DNA, 101 bp, rice(Oryza sativa)
  misc_feature (71): n=a or g
ttctgatgtcttatcctctctgacattgagcagtctcagtgcttttcttcgatatagatcattcctttatnacctggtggtcaccatccaaagaaaaaaaa

SEQ ID NO: 1610 - DNA, 101 bp, rice(Oryza sativa)
  misc_feature (71): n=t or c
cggtttaaactagtcggtgcatgcaactcaatatgttattagggccagagatcttgattttgaaacctgantgacgtgtaattaaataaataatttgcagc

SEQ ID NO: 1611 - DNA, 101 bp, rice(Oryza sativa)
  misc_feature (71): n=t or c
ctacaaagtaggttacttatgaaactgtaagttttaacagtaaagtacatggaaagtttgcagcagtgctnccttgtattccgatgacaatagttggcagc

SEQ ID NO: 1612 - DNA, 101 bp, rice(Oryza sativa)
  misc_feature (71): n=a or g
aggccgccaccttcgtgcgctcgctgccgttgaacgccaagcactgcaccacaatccttccacgcagctcnatggctcctcctcctccgtcgtcttccatg

SEQ ID NO: 1613 - DNA, 101 bp, rice(Oryza sativa)
  misc_feature (71): n=t or c
atttcaagcagtaacactccaaaactgtacacatcacatccggtcgagattttgtatcccattccatactntgtgaaagaaacagttaaattttaatgcaa

SEQ ID NO: 1614 - DNA, 101 bp, rice(Oryza sativa)
  misc_feature (71): n=t or g
aatgtgcgggaccattagcacatacaatcccgcattgtggacgaatcgtaccgcatcgttcccacggcttngccgtgcggcaccgtgtggtatcgcatcgc

SEQ ID NO: 1615 - DNA, 101 bp, rice(Oryza sativa)
  misc_feature (71): n=t or c
gggcatcttgagcatcggttccagagataacttttaaggatttggtcatgtcagcgacattttttatggcngatgtcaaccttgccttctgttcttcgaca

SEQ ID NO: 1616 - DNA, 101 bp, rice(Oryza sativa)
  misc_feature (71): n=t or c
gtttcccaggaattcaagaatctggtttgcatacgaaggacatggtatttttgaactgccagatgattttngatttgacaaagtcaattctgaaaaatacg

SEQ ID NO: 1617 - DNA, 101 bp, rice(Oryza sativa)
  misc_feature (71): n=a or g
tccggagtgcctgtcaatacattaaccaatataattaagtctgtgattgatggtacaatagctgaacaccngaccacagggccagtctttttgccaggggg

SEQ ID NO: 1618 - DNA, 101 bp, rice(Oryza sativa)
  misc_feature (71): n=t or c
gatagactgagacgcccatgccgtgaggaaggacaaatccgtccactcacgtaacacacacgtagggaatnatcctacaatcaaacagacacacatgagta

SEQ ID NO: 1619 - DNA, 101 bp, rice(Oryza sativa)
  misc_feature (71): n=a or g
gtagaagagtgccttgctgtggatagaacacgctgcccggcgacctgaaaagggcaaggacgagcgccacnatgaccttgctagctccgccgcccaccagt

SEQ ID NO: 1620 - DNA, 101 bp, rice(Oryza sativa)
  misc_feature (71): n=a or g
tataaaacattgtcaaacaatgcatcggatgaacgggggatccataaaatattaaagtctaatgagttttnaaatttagttcggcctctagagacaacact

SEQ ID NO: 1621 - DNA, 101 bp, rice(Oryza sativa)
  misc_feature (71): n=a or c
gggcgagagaacacttggttcggccaacccagctaggacatggttctggctgctgagttttgtgcgtgtcngtgggacaatgttcatcatgttgtccaccg

SEQ ID NO: 1622 - DNA, 101 bp, rice(Oryza sativa)
  misc_feature (71): n=c or g
ggaggaccaaagtaagactacgttcacatgctcgtacggcacctatgcataccgcagaatgactttcggantgtgcaacgctcttgcatctttctaaaggt

SEQ ID NO: 1623 - DNA, 101 bp, rice(Oryza sativa)
  misc_feature (71): n=a or g
tcgaacttcttgcacagtaagtttaccttcatatgagcttgattattttcccatttgcttttgggttcttntgttcgctgcacaaaatgttttgctaacca

SEQ ID NO: 1624 - DNA, 101 bp, rice(Oryza sativa)
  misc_feature (71): n=t or c
actgaggtgtgatctgatttgattaaaagactggggatgcacatgaatcggtagaaactggttatactgcncagttttgtataaaactggctaaaaacctg

SEQ ID NO: 1625 - DNA, 101 bp, rice(Oryza sativa)
  misc_feature (71): n=a or c
caacggtcaaaagtcatctgaataatttgtatccaacgtcccagattagcgcgcgtgcccacccctccctncgcatcctctcccgcactgcgcctcctccg

SEQ ID NO: 1626 - DNA, 101 bp, rice(Oryza sativa)
  misc_feature (71): n=a or c
taagcctcacatgtcagcaacaacttcccctcgctcacctcctctcttcaagtgcatggccggcgtcctcnccttcgaggagcacaaccgatgggggagga

SEQ ID NO: 1627 - DNA, 101 bp, rice(Oryza sativa)
  misc_feature (71): n=a or c
tggacgcgccgcgatggtgcaccagctgcgggtacaagtcaccgtacctgacgaggtagctcatctttatnacgttgatgcccagcacataatcagcctag

SEQ ID NO: 1628 - DNA, 101 bp, rice(Oryza sativa)
  misc_feature (71): n=a or g
gtgactcggctgacaaggaagttcagctagaaaagacagtgccataggagtactgcaacacacggttgctnccgtttccccaacggagtaggaaaccgtta

SEQ ID NO: 1629 - DNA, 101 bp, rice(Oryza sativa)
  misc_feature (71): n=t or c
tcagccgttaatcactgataatcaaccagtcatccagcagtcaattcctcttaatgcaccattggctcagncgacggcgccaatatcggctcctgcaactg

SEQ ID NO: 1630 - DNA, 101 bp, rice(Oryza sativa)
  misc_feature (71): n=t or c
ctactagtttacgatggttagtactttctttgtagggtttttgggtggttctcttttatcggttgcatagnggatatttcggatattcctcggatgtggat

SEQ ID NO: 1631 - DNA, 101 bp, rice(Oryza sativa)
  misc_feature (71): n=a or g
attccttcgaaatattctttccaataaaagaaatcatttttcattggtttctaaatacatttaaacttcanaaatccatatcttgcaaacagtaactccgt

SEQ ID NO: 1632 - DNA, 101 bp, rice(Oryza sativa)
  misc_feature (71): n=t or c
taatgttgcccttaattactagcatttgtagaatttgataactaggaattgttagattcttcaattttttntctctctattttgttttcttttcctttttt

SEQ ID NO: 1633 - DNA, 101 bp, rice(Oryza sativa)
  misc_feature (71): n=t or g
cggcggcgaccaggtgaatcgatccttgcggaggagctgtgtgagtggcgccgcaactgtgaagaagtccnggatgaatttgcggtagtaccctgccaggc

SEQ ID NO: 1634 - DNA, 101 bp, rice(Oryza sativa)
  misc_feature (71): n=t or c
tattttctttttgttggagttctagcctagctgccacctcaacatgccgccgtcgcccttgcactgtccanggctgccgtgtcacgcccagaaatttagcc

SEQ ID NO: 1635 - DNA, 101 bp, rice(Oryza sativa)
  misc_feature (71): n=t or c
agattgggccacaaggaaacaaacgatctacatgccaacatatatgcgtcatgctaaccgccccccccccncgggagagcagtcttagcgtcggctggcca

SEQ ID NO: 1636 - DNA, 101 bp, rice(Oryza sativa)
  misc_feature (71): n=a or g
atttattagcacgatgattgttctctttgagagtgtataatttggaaatttcaagtaaaaaacaacgtatnattgtgtggctcaaggtttaaaaaaacata

SEQ ID NO: 1637 - DNA, 101 bp, rice(Oryza sativa)
  misc_feature (71): n=t or c
ttcctcgtgatgtaaattggatttataaggattgcttgtttgctattttttcagttgatctttcctatgangacaattgcaataagaaaccgaggacggtt

SEQ ID NO: 1638 - DNA, 101 bp, rice(Oryza sativa)
  misc_feature (71): n=t or g
cacgttgctgcggtagttggagagcgcacagtttttttctttttactttaagtaaagtgcgcggttcatantttgggttgatcgtgtcaaaattgtaagtt

SEQ ID NO: 1639 - DNA, 101 bp, rice(Oryza sativa)
  misc_feature (71): n=t or c
ggaaccctctccggccacgacaaccatggcctggccgctgccatggagcccatgcagtgatgcttggtcancatgagctcgtacatgtgagagataaaagg

SEQ ID NO: 1640 - DNA, 101 bp, rice(Oryza sativa)
  misc_feature (71): n=t or c
tttaagcacattagccataagcaggaaattaatgagtgtgtccgcttattgtgagtgccgacgtttgtaangtgtttaaaaaacggtttggctatttatat

SEQ ID NO: 1641 - DNA, 101 bp, rice(Oryza sativa)
  misc_feature (71): n=t or c
tcttggggataacaggacgaggagacgccgtcttgtcagcaattcgagtcggctcaagtcactcaacagtnaacacattcgagcacaaattggacgaacac

SEQ ID NO: 1642 - DNA, 101 bp, rice(Oryza sativa)
  misc_feature (71): n=t or c
aaccagtcgattctactgatcagcacacaagcaaaccaaacacagagttatggaacatataaagaatgagngagtggaagctttatttcttctagatttga

SEQ ID NO: 1643 - DNA, 101 bp, rice(Oryza sativa)
  misc_feature (71): n=a or g
tcatgtgcacacggaagaaaaaaatctcctctaccacgaatcttaatgcacattcaacggctaaaaaactnaaagtttactctccttttcactatccacag

SEQ ID NO: 1644 - DNA, 101 bp, rice(Oryza sativa)
  misc_feature (71): n=t or g
cttttattttaaagctctaaaatttcataaattatagataatacatatagcttgcttgcataatgtttaanatataataattgttagtagacgataatgcg

SEQ ID NO: 1645 - DNA, 101 bp, rice(Oryza sativa)
  misc_feature (71): n=t or c
gttttctaaaatttactcaaaattggatgatgacagaaattggttacctatggtgacggtgactctacatngattcactataaatactatgtttgtcccaa

SEQ ID NO: 1646 - DNA, 101 bp, rice(Oryza sativa)
  misc_feature (71): n=a or g
atccaaaatgctccactcaacaaatcaacaaattatagatgaaaatcacaggaagaatcattctcacaacnagtgacgtcggagggcgctggcggacgtcg

SEQ ID NO: 1647 - DNA, 101 bp, rice(Oryza sativa)
  misc_feature (71): n=a or g
aacttataggactgcggttgaaaaaaaaccaggagaaaatggaggtgtggggaggccgtgtggaagtcggncgacttaccaaagcatgaggcaaaaacatc

SEQ ID NO: 1648 - DNA, 101 bp, rice(Oryza sativa)
  misc_feature (71): n=a or g
tggttggagatgaggaaaggatggactgcagcttcagatctggatgtggagcaaatccataggggctgcanctacagatcgacacatgaacattggagcaa

SEQ ID NO: 1649 - DNA, 101 bp, rice(Oryza sativa)
  misc_feature (71): n=a or g
taactatagcacatataaaacaatctaattgggcgttccaatcaagtctccacgttaataaaaaaattccncccattgatttcatagatcaccatcgatgg

SEQ ID NO: 1650 - DNA, 101 bp, rice(Oryza sativa)
  misc_feature (71): n=a or g
caccactccaccgctctcctcgccgagctcaggatgggtgccggtgaactcaagtgtggaggtcgatgggnactaaggagagaggggtcagagaagaagga

SEQ ID NO: 1651 - DNA, 101 bp, rice(Oryza sativa)
  misc_feature (71): n=t or c
aattggctgcaaaccgcatctgttgcctcctcctggcattgttttgtatagtgacagtgtgtgtgatcagnaagtagtatggttcgatgtgaaattaattt

SEQ ID NO: 1652 - DNA, 101 bp, rice(Oryza sativa)
  misc_feature (71): n=a or g
tgagagtctccatgaactatcagacgccggattcccaaagaaatcacaatccttagtcacgttgtgagacncagaaaaatgtatccaaaatacgtagctca

SEQ ID NO: 1653 - DNA, 101 bp, rice(Oryza sativa)
  misc_feature (71): n=t or c
tgcagatgataactactcgtaccgatgcggtacatatgtacatatagaactaatacttaacacaattatanccttctctatcccctagaaaattatctttt

SEQ ID NO: 1654 - DNA, 101 bp, rice(Oryza sativa)
  misc_feature (71): n=t or c
tgtttagtcataattatggactcaaacccagctaagtggagttatattatacactacttcaccaccacacntgatattttatgatctttagtcccggttgg

SEQ ID NO: 1655 - DNA, 101 bp, rice(Oryza sativa)
  misc_feature (71): n=a or g
ttgttagcaaggttattaatcgattttagaaggcagaactccatcaataagaaggataagtagaattatcnccaaactctctctctctctctctctctctc

SEQ ID NO: 1656 - DNA, 101 bp, rice(Oryza sativa)
  misc_feature (71): n=a or g
gtgtcggctatccagcattacttgtctagataattatccagtgtaataggacttagcaagtttagtaatcngctaggaaaccttgatgctccttttgtcat

SEQ ID NO: 1657 - DNA, 101 bp, rice(Oryza sativa)
  misc_feature (71): n=t or g
agtatcattcgattagacctggtataaaacttggtctgaaaaaggaaaaaatccgtgcaaaaaacgtgccnatatgtgcaaaattgcgtgcatagagaaaa

SEQ ID NO: 1658 - DNA, 101 bp, rice(Oryza sativa)
  misc_feature (71): n=a or g
ttttgcacatataggcacgttttttgcacggattttttcctttttcagaccaagttttataccaggtctantcgaatgatactgtcactgttctcttcttg

SEQ ID NO: 1659 - DNA, 101 bp, rice(Oryza sativa)
  misc_feature (71): n=a or g
tgtacgatttaatatcaaagaacacaatggtgtaattgggtcacagattgaatcattaatttaccattaanaatagtttaaagtttgagaaaggtttatat

SEQ ID NO: 1660 - DNA, 101 bp, rice(Oryza sativa)
  misc_feature (71): n=t or c
aggaatgtcatggttttttaaataaagaaactcctgaatgttatcctgtgaccattatgtttcaaattgtnaatttatattttgaagtagtgacggaaatt

SEQ ID NO: 1661 - DNA, 101 bp, rice(Oryza sativa)
  misc_feature (71): n=a or t
atttctcaaagtgcaacgacaaaaattgtagttccccgacttattagcgcgttggtgagacaactcacaanaaagggtgtcaactgatgcaggcaaaatct

SEQ ID NO: 1662 - DNA, 101 bp, rice(Oryza sativa)
  misc_feature (71): n=t or c
atgtcctccttgggggcgtcgcttcagagaagttcctatgaatcgacgactgttgatggtcttttgggttnaaaagctttcatatcttggggtttggcgag

SEQ ID NO: 1663 - DNA, 101 bp, rice(Oryza sativa)
  misc_feature (71): n=t or c
taagcagaatctaggtacctttcaaattcagctctcgaccaatctgacatgtgacatctaactccccatcnattttgaaacttgtttagtatttcgaatgt

SEQ ID NO: 1664 - DNA, 101 bp, rice(Oryza sativa)
  misc_feature (71): n=t or c
cctagaatcctagtattttaagatgggcttcttggacctgcaataggctatattttgagaggtaatatatnaccccgggacccagcgggtggaatgcctcg

SEQ ID NO: 1665 - DNA, 101 bp, rice(Oryza sativa)
  misc_feature (71): n=a or g
gagggggagccaactctgctcatggctcatgttatggggttgtctctcactggcgaggcgacatttggccnaacacctggcgtctacgaggtgcatatgac

SEQ ID NO: 1666 - DNA, 101 bp, rice(Oryza sativa)
  misc_feature (71): n=t or c
ccggccataaaacttataactagtgttttactacgtatttatttaccctgtgataaaatctgatttatccngaaacgtgatattcctaaaagttttatctt

SEQ ID NO: 1667 - DNA, 101 bp, rice(Oryza sativa)
  misc_feature (71): n=a or g
gtcgtcgcaaccggcaaagccgcccacagctacgaagagggaggaggggaatagagggaggcaccagagtnggggtggggatagcgccggagaggaggctg

SEQ ID NO: 1668 - DNA, 101 bp, rice(Oryza sativa)
  misc_feature (71): n=a or g
aaatcatttaaccataagcacttcctaccatgtctactgccttcgaaaattccagaaatttagtttcacanataagaatgggttaatataatttacaaatg

SEQ ID NO: 1669 - DNA, 101 bp, rice(Oryza sativa)
  misc_feature (71): n=a or c
acatttcagttcagatgagacaactcccctccccaacattaaaaaaaaagatttcttttttataccaaccntttgcccaacttgtcaaattgatgcattaa

SEQ ID NO: 1670 - DNA, 101 bp, rice(Oryza sativa)
  misc_feature (71): n=t or c
ctcgggccttttggccatctatagtttcaactccacaccacacacaaaaactcaagtggggtataaatctnggtcctctaacaccatcttcgactcagaac

SEQ ID NO: 1671 - DNA, 101 bp, rice(Oryza sativa)
  misc_feature (71): n=a or g
tcatagagggtatcctattccaacggtcgtcggaataccgttgtctagttttctcttataaatagcttatngtccgctattgtacctgtttgccactagca

SEQ ID NO: 1672 - DNA, 101 bp, rice(Oryza sativa)
  misc_feature (71): n=a or g
aatattgatatctctcagccagaggaagctgttcagctgatcaatttattacgagaaaaggctcagaacantcagttgattgatatgattgacaagcacag

SEQ ID NO: 1673 - DNA, 101 bp, rice(Oryza sativa)
  misc_feature (71): n=a or g
atgcaacagtaacaacacagacagagacacacacatgcacaaaggtagttctacacacacaacttggtaangtttccatagaaactgcaatcgaggagaaa

SEQ ID NO: 1674 - DNA, 101 bp, rice(Oryza sativa)
  misc_feature (71): n=t or c
tccctagggggtggccatatcccagtaccgcccaccatccaaacacctccaaaatttgggtggccataccntatcccagccaatccctccatccaaacaca

SEQ ID NO: 1675 - DNA, 101 bp, rice(Oryza sativa)
  misc_feature (71): n=t or c
gcggcgcgaacatgacgcggtggtcgacgagcgcacggaggaacgtgcggaggtcgaagcggtccatcacnaccaccgtgcccttgtgccggagcgtggcg

SEQ ID NO: 1676 - DNA, 101 bp, rice(Oryza sativa)
  misc_feature (71): n=t or c
ccagtgtaagattgcaggtagtaatcatctgagttcagcatctagaatctccacatatggcagctagtaanaatattaactacttcagtacagcaattagc

SEQ ID NO: 1677 - DNA, 101 bp, rice(Oryza sativa)
  misc_feature (71): n=a or c
gccgtgggcgtggcgccgccgtcgtccagaccacccctctaacccacaactctcgccatccaaccttatantacctgtcgctcaagggcatcaccgttggg

SEQ ID NO: 1678 - DNA, 101 bp, rice(Oryza sativa)
  misc_feature (71): n=t or g
cgaaataattaaggctacaatatccccatcactctgccaagcatgtcctggagacatagaccctatgaatnaactagtttacaacagtgaaattctgacat

SEQ ID NO: 1679 - DNA, 101 bp, rice(Oryza sativa)
  misc_feature (71): n=a or g
ggagaaatttatggaagcaaaagatccctcgaattgaaaaaggtaagcactcttgcttgtgtaaatccctncttcattccacttccaagagatatcatcag

SEQ ID NO: 1680 - DNA, 101 bp, rice(Oryza sativa)
  misc_feature (71): n=a or g
agggcagagattcgctgctcttgagcataaaggctaattagcaggcaagggtcaagttctccaacatctcnaggttgtagcacacaaactctgttctttcc

SEQ ID NO: 1681 - DNA, 101 bp, rice(Oryza sativa)
  misc_feature (71): n=a or c
gggacatcctgagccggcgacagtgatgtcctcacacgccgcattatattccacccttgggatattgtcgngcagccactcgtcccccctcgacaggacgc

SEQ ID NO: 1682 - DNA, 101 bp, rice(Oryza sativa)
  misc_feature (71): n=t or c
ccccgctcgtctataatccgttgcgatgcgcatttggaggtagaacagttgtatcagacccagagccctgntcttcctcctctctcccacttttgcaagcc

SEQ ID NO: 1683 - DNA, 101 bp, rice(Oryza sativa)
  misc_feature (71): n=a or c
acacactactctaacaaccattgtgcgggtaggtataatgtttctttctttttactagtcatgcgcattancatggagaaaagtgattgtatgacatacta

SEQ ID NO: 1684 - DNA, 101 bp, rice(Oryza sativa)
  misc_feature (71): n=t or c
gaaacataggacctgtttggtacaaatccagctctacctctcttagaactggagcctaaccaaacagtttnatctccacataaaataagagcggagttggg

SEQ ID NO: 1685 - DNA, 101 bp, rice(Oryza sativa)
  misc_feature (71): n=a or g
attactgtaggtaccccaaatgaaaaatcagggatttttttcactctggatgttgacactttatgatctgnaagtgacaattagtggaagaaacattttca

SEQ ID NO: 1686 - DNA, 101 bp, rice(Oryza sativa)
  misc_feature (71): n=a or g
ggggtggcacacaatcgtgatgtgattgttgatatatactacctgactacctccatccccttatgatgctngttattagttcgaaatcatgaaaaaaaaat

SEQ ID NO: 1687 - DNA, 101 bp, rice(Oryza sativa)
  misc_feature (71): n=t or g
aagtcgctaagtcgttcgttcgggaaagtcacgaagtcgctaagttcgttcgggaaagtcgctaagttatnaaactcgtgaaagtcgctaagtcgttaaac

SEQ ID NO: 1688 - DNA, 101 bp, rice(Oryza sativa)
  misc_feature (71): n=t or c
cacctcttggagtggccaacaacagagatggcactggtacataacttcttatatgtaacggcctttcctgngcctggggcttgcggaccgtcacaacatcg

SEQ ID NO: 1689 - DNA, 101 bp, rice(Oryza sativa)
  misc_feature (71): n=t or c
gaaagaagagagaaagtctcatatgcacatgcagggtaggaggcttcagctcaatttccaattttttcatntttgtcggatgactgatcacatgcaatttc

SEQ ID NO: 1690 - DNA, 101 bp, rice(Oryza sativa)
  misc_feature (71): n=t or c
tacgtttgctagtactttgattaacgtgatgacaccttttcgtcagttgaaacaagagatcgcatgtgtangatcagttgaaacgtagagaaccttgtttt

SEQ ID NO: 1691 - DNA, 101 bp, rice(Oryza sativa)
  misc_feature (71): n=a or g
tgtttttctacttcggagacagctctgctttactttgtttgatgttcacagcacaatattgcagtaataanctcttatagcttcgctgggaactataggta

SEQ ID NO: 1692 - DNA, 101 bp, rice(Oryza sativa)
  misc_feature (71): n=a or c
tactaggaaaaggattttcccagacggtgaaaaaggattttcgcgtgtggatgggcggccggcacgcaccnagaggtttgggaaagtcgtgatttttgcgt

SEQ ID NO: 1693 - DNA, 101 bp, rice(Oryza sativa)
  misc_feature (71): n=t or g
gtggccatttagtctttgaattgatggtgatcttaatactgcatgttatcctctctcattttttctttttngagtgcggttgtgtgttcggctgtgtgtat

SEQ ID NO: 1694 - DNA, 101 bp, rice(Oryza sativa)
  misc_feature (71): n=t or c
tttagcatatcattaattatttactagcaaatacaaaaaatcttataagggtccctaaatgtaggtattgntatcggtatggctgctggttttggaattct

SEQ ID NO: 1695 - DNA, 101 bp, rice(Oryza sativa)
  misc_feature (71): n=t or c
cttcctccttcgatccgcggtctagccagctggttgctgattcgctgcttgttcggattgattcgattcgncgtccatggatcgtcgtgacgattcttgct

SEQ ID NO: 1696 - DNA, 101 bp, rice(Oryza sativa)
  misc_feature (71): n=a or g
atgagatcccagtcacccaagaatacaataacacaatcacgaataaaacaaacatccacacaaatcatgancaaaatcaacgaggaagccgctgtcgccgc

SEQ ID NO: 1697 - DNA, 101 bp, rice(Oryza sativa)
  misc_feature (71): n=t or c
aaaagaaaacctcccgaaacgaaacgaagagaaatcggtattatgactgacagaataaagacccatccctncccactccccaccacggccgctctagggtt

SEQ ID NO: 1698 - DNA, 101 bp, rice(Oryza sativa)
  misc_feature (71): n=a or c
gccatggctcctcctcctgctggaggtgacagtgctgataccacctctggtcttgcggccatggacgaccnccaccgtgctcgatccctccgctagcaacg

SEQ ID NO: 1699 - DNA, 101 bp, rice(Oryza sativa)
  misc_feature (71): n=a or c
aagctacgagaggtgacaatactagcgagggttcacaatccgaacaaaaaccgaccgaacttctagataanacaaaccactcagtttcccgatcaaattca

SEQ ID NO: 1700 - DNA, 101 bp, rice(Oryza sativa)
  misc_feature (71): n=a or c
tctttaattattagtgatctttaacaagagtgagtgtcattgcagatatggtgctgccattattatcaatnatatggacatgactccacggctaatggtaa

SEQ ID NO: 1701 - DNA, 101 bp, rice(Oryza sativa)
  misc_feature (71): n=t or c
cctctatctccttcctctcttctcacttcttctccaatcacctatatatccaccccacgtagccgtaccangctcccttcctccatctacgtcttcagcct

SEQ ID NO: 1702 - DNA, 101 bp, rice(Oryza sativa)
  misc_feature (71): n=t or c
ggccgagtggatatcgtctgtggtggtgagatttgggtgtgcatgcatatgatggatggctctacatacanaggctcctcatgccaactctccattaggat

SEQ ID NO: 1703 - DNA, 101 bp, rice(Oryza sativa)
  misc_feature (71): n=t or c
tttttccctggaattttgttacgtaaatgtgtgcaatatgtttggtatgaagataagcggctgtttagttnccagacaaaaacttttcaccatgtcacatc

SEQ ID NO: 1704 - DNA, 101 bp, rice(Oryza sativa)
  misc_feature (71): n=a or g
accaaaagctcctcgtgggcgcatgtgattagggcatcgccatccccctaatgccagcactgtttgacaangattttgcaaagcaattgcttgcaacccat

SEQ ID NO: 1705 - DNA, 101 bp, rice(Oryza sativa)
  misc_feature (71): n=t or c
ctatgcaccatcctcaccatatggaagcatcaagtagggcttttgagtatatgtatatatgtgcctctctntctctctctctctctctccctgtgagagag

SEQ ID NO: 1706 - DNA, 101 bp, rice(Oryza sativa)
  misc_feature (71): n=a or g
caaaaaaaatagctctaaaaacgccgtctcaacattagtttttcttgtagcgaaaacatctcaatccacanttaactgttgagttcaagatttcgtctact

SEQ ID NO: 1707 - DNA, 101 bp, rice(Oryza sativa)
  misc_feature (71): n=a or g
tgatgaaacgacatgacgatatgtacgtcatccatatattgaatgactcgatgcattcaattttaaattgntgctattccctccatatcatattataagtc

SEQ ID NO: 1708 - DNA, 101 bp, rice(Oryza sativa)
  misc_feature (71): n=t or c
tctgttctgttttatatgtatggcataggctggttagttcaattataggatggagttaaacatacccgtgntaacgctatggtcatatttattcttagctt

SEQ ID NO: 1709 - DNA, 101 bp, rice(Oryza sativa)
  misc_feature (71): n=t or c
aacttcacttccaaccttagacaccactccctatgacgtcagaaccattaatttctacatagtggtagcantcttctgtcccaaaatagttatttctttgg

SEQ ID NO: 1710 - DNA, 101 bp, rice(Oryza sativa)
  misc_feature (71): n=t or g
tctcgcttttagcagcagcgagccagcgacttttggcctcaaacgcaggatttgttgccattttttttttnggggtcagaggagtcgagtcatggtgtgca

SEQ ID NO: 1711 - DNA, 101 bp, rice(Oryza sativa)
  misc_feature (71): n=a or g
aagcacgcccccaacgtctagaacatgttgcgaaggcacgacgctacgaggctctcctccgcgcgacgttngggggcccgcgcaggtcgtcgtcatcatca

SEQ ID NO: 1712 - DNA, 101 bp, rice(Oryza sativa)
  misc_feature (71): n=a or g
cagtgcaccatccctccctgatcaatctcgccagtttcttttttcgacgtgacaatcctgctgcctatatnctggtataatagtactagagtacttagctt

SEQ ID NO: 1713 - DNA, 101 bp, rice(Oryza sativa)
  misc_feature (71): n=t or c
atcgttctcgctatcaaattgggcctgatcggtaggttttgggccaacctgagctgaacgcagaggcgttnccgggcagtaacggctggcccacctgtcac

SEQ ID NO: 1714 - DNA, 101 bp, rice(Oryza sativa)
  misc_feature (71): n=a or g
tggaggcgaattgaagcgctgctagtaatcaagctcgataatcaggagcagcttttttgcacccggagagngctggatctggcgggcggcgtcgtcgtccg

SEQ ID NO: 1715 - DNA, 101 bp, rice(Oryza sativa)
  misc_feature (71): n=a or g
ttaaatatgcactgaactaatggaaaggcagtatcaatcataatttccattaaaaaataagcgatgtgaanaaatggaaaatggaacaaaaaataattccg

SEQ ID NO: 1716 - DNA, 101 bp, rice(Oryza sativa)
  misc_feature (71): n=a or c
ggcagtgcctgcacttttcagggcctaatgatctgtccccttaaaaaaaagggggaaagaaaggctgaggnaaattataaaccgacaataaaaatggccta

SEQ ID NO: 1717 - DNA, 101 bp, rice(Oryza sativa)
  misc_feature (71): n=t or c
gctaggtttcaccaatcatccgcggacggtttgaggaagcatcgatctccatcgaggactcgtgcggagcncgccgccgtcgagccgtccaggtgctcagt

SEQ ID NO: 1718 - DNA, 101 bp, rice(Oryza sativa)
  misc_feature (71): n=t or c
ggtccaatggaacactttatgtgatgaagttatgctgacataagcgtagtgccttaggtatcagatctaanactaaggatatctcagatacgatactcata

SEQ ID NO: 1719 - DNA, 101 bp, rice(Oryza sativa)
  misc_feature (71): n=t or g
tacggccagggaccattgggacttcgaagtacagagcttagctagaagacggtcgacctaataccctgctntgcttatatcagaaaaaatggaggcaagtg

SEQ ID NO: 1720 - DNA, 101 bp, rice(Oryza sativa)
  misc_feature (71): n=t or c
gacgacagcgggagacaccatgatcgatcgaccggattgttcttggataggcagctagctagctcgcgctngccccgatctcaacccaccgcacgcgtttt

SEQ ID NO: 1721 - DNA, 101 bp, rice(Oryza sativa)
  misc_feature (71): n=a or g
tcgatcttctttacgaacgcgtaaaaaaaacacacaccaatatgctatagaaaaaagttttagttacacancacaatcaaccagaacaacttatatcagag

SEQ ID NO: 1722 - DNA, 101 bp, rice(Oryza sativa)
  misc_feature (71): n=a or g
ttgatgatgagcaatgagcaatcacaaaggcaagaagccaagaattaatacctgctaacacttatcccttnttttgcctaagagtttaaattattatccct

SEQ ID NO: 1723 - DNA, 101 bp, rice(Oryza sativa)
  misc_feature (71): n=t or c
tggcatcgtctcttctacatcttcttctccttccacatcttgtagtcccaaacaattccgtcccactctanagctccgcgacacactgttgagacctgaag

SEQ ID NO: 1724 - DNA, 101 bp, rice(Oryza sativa)
  misc_feature (71): n=t or g
tttttctttctgagaggaacgattgtttgttgattgtagcagtaggttatcaattgggctgggtctttccntgcccgcccgaaaattcatgtgtagttgac

SEQ ID NO: 1725 - DNA, 101 bp, rice(Oryza sativa)
  misc_feature (71): n=t or c
cacgttttaaaatgtgttttgattatttaacattttggacattttcatttactcagatggccccacatgtnattctcacaagtatcaattaaaataattgg

SEQ ID NO: 1726 - DNA, 101 bp, rice(Oryza sativa)
  misc_feature (71): n=a or t
cggcgtgagctactgccacttcatggtaagaacagaaaaacgatcccagtaaacattgcattctttttttnaaaaaaaaaggatgggaaagtgttcaaatg

SEQ ID NO: 1727 - DNA, 101 bp, rice(Oryza sativa)
  misc_feature (71): n=t or c
ggcggcacggagagcggccagcacctgctcgagatcaacggctactccagcatcaaggacgccgtctccancggcaactgcgtccagtctcggcatttccg

SEQ ID NO: 1728 - DNA, 101 bp, rice(Oryza sativa)
  misc_feature (71): n=a or c
gagacagtgcagcagcagctactactactacagcagagtagtactagtggggggagaaattacagatatgncctccattagcttaccacggccgcggtgcg

SEQ ID NO: 1729 - DNA, 101 bp, rice(Oryza sativa)
  misc_feature (71): n=t or c
ctcgtggtaaaattaacctatctgcggggattcgagtatccaaaaaatcaacttagcatggacacatatantagtaaaaagatgtctatgctaaactcatc

SEQ ID NO: 1730 - DNA, 101 bp, rice(Oryza sativa)
  misc_feature (71): n=a or g
acaaccagcgggcatgacgagcacgccgcaaaagcaacgcggcggcgagaagcccaagaactgagaaagancggagtcctcggcgatctgatgcgttccca

SEQ ID NO: 1731 - DNA, 101 bp, rice(Oryza sativa)
  misc_feature (71): n=a or g
acaccatcctccgtcagataccaccaccaccaccacacctgagcaccagcagcggtataactagcgcaaanttgccgcacgcagggacgcagcctgcagtg

SEQ ID NO: 1732 - DNA, 101 bp, rice(Oryza sativa)
  misc_feature (71): n=a or c
gtggctgcactatattcgttttctttacttcatcgaatatgctttagttaacatcagcatatcctctttgntttgctatttttctttacattttgagaagg

SEQ ID NO: 1733 - DNA, 101 bp, rice(Oryza sativa)
  misc_feature (71): n=a or g
tgtgcccgtaagaaacaaggtagcttttctctcagtccgttgctgccgaatgcagctcaagtatcgttttnattcaatgcatatttctatgtttgtagacg

SEQ ID NO: 1734 - DNA, 101 bp, rice(Oryza sativa)
  misc_feature (71): n=a or t
gatgtgagctttcagttaaatcgtaacattggtgatttggtgccgatggcaattgaattttggctcaaganttctgttttgtgttgtgcttgtatttgttc

SEQ ID NO: 1735 - DNA, 101 bp, rice(Oryza sativa)
  misc_feature (71): n=t or c
acgtcagcgggttcgcatcattcacttcgcagccattcggtgcatgcacctactcaggccttgattaattngcgaaaagaaaatttttagatatcacgtta

SEQ ID NO: 1736 - DNA, 101 bp, rice(Oryza sativa)
  misc_feature (71): n=t or c
aagattctgggaggataaatggctaggtaatatagccttcaaagatagggaaattttgaaccatgccacanaaattttgcaaaatttgtgatatgccaccc

SEQ ID NO: 1737 - DNA, 101 bp, rice(Oryza sativa)
  misc_feature (71): n=a or g
ggcaataatcatatgaggagatcaatgtcgtgttggattttcctctttgtagtcttaccccccaacctatntaaggtgggcagggagcccttcaagctaag

SEQ ID NO: 1738 - DNA, 101 bp, rice(Oryza sativa)
  misc_feature (71): n=a or g
ttctccttcccacgcacgggcattttactagtatgttaatataagggctctaaaataaataatgaaaactncaagagaatcagcgtcgaatacaacaatca

SEQ ID NO: 1739 - DNA, 101 bp, rice(Oryza sativa)
  misc_feature (71): n=a or g
actactgtgcattgggctgcagtaaagagaattttgagatacctcaactcttcttgttagcggtttctctnatgcagattgggcatgctgtctagatgaca

SEQ ID NO: 1740 - DNA, 101 bp, rice(Oryza sativa)
  misc_feature (71): n=a or g
ttttaaagcaagttataaacaatctggtgcataatcagaatggattaattgatggtcgatcaatatactgnccaactcttcaattgattattgatcaatta

SEQ ID NO: 1741 - DNA, 101 bp, rice(Oryza sativa)
  misc_feature (71): n=a or t
agcagcaatataaatatgttgtgtatacccatagaaacatgctgggttatcaactcactagtttttttttnaaaaaaaggaaactcaattacattagacaa

SEQ ID NO: 1742 - DNA, 101 bp, rice(Oryza sativa)
  misc_feature (71): n=a or c
ccacaagaagtacaggcacatccaggtatatatctaaatcaaatgcttggcgccacagctttcgatgtacnccccccccccccccccccccccgagttgtt

SEQ ID NO: 1743 - DNA, 101 bp, rice(Oryza sativa)
  misc_feature (71): n=a or g
gccacagcatcagtgatttgttatatattctagcccttctgtcacactcgagagtgtctattacatgcatntgatgtaattaatcataaactctttttact

SEQ ID NO: 1744 - DNA, 101 bp, rice(Oryza sativa)
  misc_feature (71): n=a or g
cggtttagtaaattttgaggttaagattttcggtattgctgtttaggatacgattaaactcggcgtaaagntgagggatgcaaaataaacttattctttac

SEQ ID NO: 1745 - DNA, 101 bp, rice(Oryza sativa)
  misc_feature (71): n=a or c
tacttctgttgaatcactagtctgttctgtcaatcattgttttccccccttcacatttcagtgtttaagcntaccaacaaaaacccgtgaaccaccatctg

SEQ ID NO: 1746 - DNA, 101 bp, rice(Oryza sativa)
  misc_feature (71): n=t or g
gcctccaaaatccccaaaaaaaagaaagaaaagaagaaaactgctttgttagtgattgatcgatgaacatngatttgtttacgtcgggctgtgctcggtcg

SEQ ID NO: 1747 - DNA, 101 bp, rice(Oryza sativa)
  misc_feature (71): n=a or c
tcccaaaatcacgagtcatctccctgctcgattcccacgcatgctaaaaatttctcaataaattgtcctcnaaagcgatcgacaaagagactcttggtcag

SEQ ID NO: 1748 - DNA, 101 bp, rice(Oryza sativa)
  misc_feature (71): n=t or c
tttgaaaaggagcaattgcaaacaacatcacagccttgcaggctgagaacgttttacacctaagttgctancgcgacacgatcgtaaattcgcaacatgtg

SEQ ID NO: 1749 - DNA, 101 bp, rice(Oryza sativa)
  misc_feature (71): n=a or g
agagcttcgcggcggcggcgggggccatcgccgtgagatgggattttctgggggaagctttctgttccggngttcggcgaggcttttccgagacgtgacgg

SEQ ID NO: 1750 - DNA, 101 bp, rice(Oryza sativa)
  misc_feature (71): n=t or c
ccatgcagagcgagccttatggccatctatactccctagtccctactcccctcttcccaattttccatacntaatacgtagcgtttggttatagctttagc

SEQ ID NO: 1751 - DNA, 101 bp, rice(Oryza sativa)
  misc_feature (71): n=a or g
gtatatctcgtgataatcacacggtttttataataaccaggtaaccttttgggttttggggaaccctggcngtagtgcgtgtgcctcgcacgatggaaatg

SEQ ID NO: 1752 - DNA, 101 bp, rice(Oryza sativa)
  misc_feature (71): n=t or c
ccagtacacaggtaaacttacgtataataaaatatatctatacttgatccatatgaccatattaggtactncatccgtcccaaaataagtgtagttttgca

SEQ ID NO: 1753 - DNA, 101 bp, rice(Oryza sativa)
  misc_feature (71): n=a or g
ctgcaatcacaaaattgggttctacagttaggccttgagaacttctacagaaaaggaacaaacttgacacncgtggtatttcaaatacttagtaaaataac

SEQ ID NO: 1754 - DNA, 101 bp, rice(Oryza sativa)
  misc_feature (71): n=a or g
tatttgctctggttatttttcattgcagaggagcatacaaaaggaggaggctaagaagaaggaggtacatntagatgagaatgtccctgcaccatctcccc

SEQ ID NO: 1755 - DNA, 101 bp, rice(Oryza sativa)
  misc_feature (71): n=t or c
ctcaacgggccgtgacgaacgcgtgcaagcgggagtcggagtcggacgctggggttggatactactccctncattggaaaaagtacaccgaaggtccctca

SEQ ID NO: 1756 - DNA, 101 bp, rice(Oryza sativa)
  misc_feature (71): n=a or g
aataatcaacaataatgactcatattgtttcacatatcgttaaaaagctaaacaaacataagcactcttanccaactcatagtggaatggcatacacatat

SEQ ID NO: 1757 - DNA, 101 bp, rice(Oryza sativa)
  misc_feature (71): n=t or c
ctcttttctccgcaggtaggatgcagcttaagctactggtctcgaatacagatgcgatgacgatggcaacncccttgggagttgaaactttgcgggcattg

SEQ ID NO: 1758 - DNA, 101 bp, rice(Oryza sativa)
  misc_feature (71): n=a or g
tataagtagaggatcacatccaaatttccattccatcttccaagggaaaaaatacatcctatccagcggcngacccagaaaaattacagtgggtgtatcca

SEQ ID NO: 1759 - DNA, 101 bp, rice(Oryza sativa)
  misc_feature (71): n=a or c
ggttcgaagtagacgatgatactgttgtaagaaaaacacaacagcaacttattccacaatggaaaaaaaanccctctatatactactcccgcaaaaaaaaa

SEQ ID NO: 1760 - DNA, 101 bp, rice(Oryza sativa)
  misc_feature (71): n=a or c
tccttcggataccaggcgccggagtacgtgcacgcacgcacacacacaagcccagctgatctctgtctggncatggctgatcgatctcgtcatggctttct

SEQ ID NO: 1761 - DNA, 101 bp, rice(Oryza sativa)
  misc_feature (71): n=a or g
agacagcaggagatttcgaaattaaatctttagcccattcagaaaggatcttgttaacaggagaaatgaanataattcaattacgaacgatgataaagaaa

SEQ ID NO: 1762 - DNA, 101 bp, rice(Oryza sativa)
  misc_feature (71): n=a or g
gccccacgactaccattaatgctttcccttgtaaagtacaacgtgatcgagcatactctacacatcactantacgtgcacccactgttgaagctagctaat

SEQ ID NO: 1763 - DNA, 101 bp, rice(Oryza sativa)
  misc_feature (71): n=a or g
cctaaacccttcatcttaaaaaaaacatatgacatgataggacgttttctagtacatgcccagattcattntactaagaaacgtcacatcttgttttagga

SEQ ID NO: 1764 - DNA, 101 bp, rice(Oryza sativa)
  misc_feature (71): n=a or g
actgctttagtcgaattttcagaagaagaggaagcaaatgctgtattaaagaatactcttgtttttgcagnagcagatctggaaataaaaccaaagtaagc

SEQ ID NO: 1765 - DNA, 101 bp, rice(Oryza sativa)
  misc_feature (71): n=t or c
atgtgtgggtgaacgaataaaatagtataaaagttagtaggtggaagaataaattaggcatggtttagttnccaattttttcttcaaactttcaatttttc

SEQ ID NO: 1766 - DNA, 101 bp, rice(Oryza sativa)
  misc_feature (71): n=a or g
actcctccaactattaaaacaggtgcataataactcatagtgaagtattcctccaactatagtggatctcnattttatgcggaatcgtagtcaagtaaaaa

SEQ ID NO: 1767 - DNA, 101 bp, rice(Oryza sativa)
  misc_feature (71): n=a or c
attgtgtttgatctggaatcaaggatacagtaattatggaactaggagatataaagttccaaattatgctnttaacatgattttctgttcattttggatcg

SEQ ID NO: 1768 - DNA, 101 bp, rice(Oryza sativa)
  misc_feature (71): n=a or g
catcagtttgttcttttggtactgaaaatcagtcccagatggtgctgaacctgtggagttaaatgtttatnattttaaagggcctggtgtggctttatcaa

SEQ ID NO: 1769 - DNA, 101 bp, rice(Oryza sativa)
  misc_feature (71): n=t or c
ctcgcagagatgcacaaagacgctaaggaaagtaatggaattagagttcaagtgcagaagagaaagcccanagaaattcaagaccagtagaaggaattcag

SEQ ID NO: 1770 - DNA, 101 bp, rice(Oryza sativa)
  misc_feature (71): n=a or t
acgattagccatgcaaagatcttgcattattgaagcggagtgtgagttggctgctgtgggaagataaaaanctatgcatttctgtggtgttttgcctattt

SEQ ID NO: 1771 - DNA, 101 bp, rice(Oryza sativa)
  misc_feature (71): n=a or g
ctccgccacgtaaaacttggatcgatcaagcttctacctgggaccgcttttacaaaagagaagatagtacnggaaagtgttttaaacactcgggtggacgt

SEQ ID NO: 1772 - DNA, 101 bp, rice(Oryza sativa)
  misc_feature (71): n=a or g
agcgccttcaattgtcatgctgaaatgacattctcactcaattgaatgactgttactactctttccgtccnaaaaagacaaacactgggtttccgtgttca

SEQ ID NO: 1773 - DNA, 101 bp, rice(Oryza sativa)
  misc_feature (71): n=t or c
gagacagtgaagcatgcatgaagcaagaggattttgtaacaaacacattctggtttgcagataagaaatanacacggaaagtttcagcgtacataagttat

SEQ ID NO: 1774 - DNA, 101 bp, rice(Oryza sativa)
  misc_feature (71): n=t or c
ctagtatatattacacgatctctcaagaatactcgtagtggagtatactagagcgtgagcatgtgcaaagngaggggggcgatccaaggaagatactgtgt

SEQ ID NO: 1775 - DNA, 101 bp, rice(Oryza sativa)
  misc_feature (71): n=a or c
ggcgattagaatggcatgggtgcattcaactgtgggccattcggcgattaacttttatccaggcctctctntccttatatcgatgatctatgcataatttt

SEQ ID NO: 1776 - DNA, 101 bp, rice(Oryza sativa)
  misc_feature (71): n=a or g
aacctatatctcttggtttattgttgaagtaatggatgttcatttaggtctatctttaaagtactatcatnttaacaatcatattaattaggaccaaatgt

SEQ ID NO: 1777 - DNA, 101 bp, rice(Oryza sativa)
  misc_feature (71): n=t or c
catactcgattaattttatgggcttctgctggatgttcataaacgacatttacattacattttccaaggangtttgacatgcattttttgaatgtatatca

SEQ ID NO: 1778 - DNA, 101 bp, rice(Oryza sativa)
  misc_feature (71): n=t or c
tatatttatagttggcttataatctgctttatacccgctctaagttctctccttggtatgcccacaagttncggcttatagtctgctattgtatctgctct

SEQ ID NO: 1779 - DNA, 101 bp, rice(Oryza sativa)
  misc_feature (71): n=t or c
tgttgcccgggattattttcacccactcgaagactgtctttaccgagtcgtaccaacacttagcatgttantgccttgctgcatgcatcaatttccttcgc

SEQ ID NO: 1780 - DNA, 101 bp, rice(Oryza sativa)
  misc_feature (71): n=a or c
gtcacggtactgttaacctctgactttaacacctaaagtcaggatctcaatccgtacgaattacctctctnaattaaaaaaacaaacatattttttcaccc

SEQ ID NO: 1781 - DNA, 101 bp, rice(Oryza sativa)
  misc_feature (71): n=t or g
attaatcacggctacagctacagctgcacagtgcacagcggaggggaagagttgtgttaattatgtgggcnctagctagcctcctagccttgactagctga

SEQ ID NO: 1782 - DNA, 101 bp, rice(Oryza sativa)
  misc_feature (71): n=t or g
tgctcggcctcgactccaagctcgagaagagcctcctgatcccgttccgcgagatcaaggtgagacggggntttttttttttttgattcctgtttccagct

SEQ ID NO: 1783 - DNA, 101 bp, rice(Oryza sativa)
  misc_feature (71): n=a or g
tgagacgcggttgatgggattttgggggcttatttcggacgggtcgccgtgcgatcgtcggtgttttgcgntttttccccctgtgcaggaaaaacgccgcg

SEQ ID NO: 1784 - DNA, 101 bp, rice(Oryza sativa)
  misc_feature (71): n=t or g
gcattaagcacacgtcgcatcaaaatgcattgtgtgctacgtaccatgcgagcacgagacgcgcgaccgcncgtacgaccgtacacactacgtaccacaca

SEQ ID NO: 1785 - DNA, 101 bp, rice(Oryza sativa)
  misc_feature (71): n=t or c
ccactaactacaccttaccgtctccgatctttgtatgtcatgaccaatctcccggccgggatggtacaacntagtagtataaggctattcccaacctaata

SEQ ID NO: 1786 - DNA, 101 bp, rice(Oryza sativa)
  misc_feature (71): n=a or c
cgtggtccaccacccggctagcgagccaaggatggtcgcgcgcggattcgtggtgcacctacgaaatccancgcagccgacaagacctccccgcggtgtat

SEQ ID NO: 1787 - DNA, 101 bp, rice(Oryza sativa)
  misc_feature (71): n=t or c
gtgatctgacagagttacacagaagcatgtcaatgtcgtcgccatttatcgccactgatcagagaggcttnaatttatcgctgacacggatgtggctaaaa

SEQ ID NO: 1788 - DNA, 101 bp, rice(Oryza sativa)
  misc_feature (71): n=a or g
gtattcgtgtgtagtagtatatccaccaggactccaaatgaacgttattttcaaggaaaaagtacaccgantatccctctaacttgtcatccagttacaaa

SEQ ID NO: 1789 - DNA, 101 bp, rice(Oryza sativa)
  misc_feature (71): n=t or c
aacgttcatttggagtcctggtggatatactactacacacgaatacacgattagcacatgcgcaagaccangactcaactagtttattcttccaatcttta

SEQ ID NO: 1790 - DNA, 101 bp, rice(Oryza sativa)
  misc_feature (71): n=t or g
attctatagtggaatttatagtcaagaagaattatatggatgtgagaattaagaacctaacaagctcaacntgtagttagtcaaaataagaagcaacgcgt

SEQ ID NO: 1791 - DNA, 101 bp, rice(Oryza sativa)
  misc_feature (71): n=t or c
cctactccaggcgacgcctcctcattctcctctcctctaccgccgtcgcgaggggtgccaagcaccgtctngcgctcatcattgtgaagctgctcgtgtcc

SEQ ID NO: 1792 - DNA, 101 bp, rice(Oryza sativa)
  misc_feature (71): n=a or g
agttagaagttagaagaaaaaaggttaaatctaaacaaggccaaatattggtggtaaaaaacgaacacttnagtttggtgaaatggacaaaaataataata

SEQ ID NO: 1793 - DNA, 101 bp, rice(Oryza sativa)
  misc_feature (71): n=t or g
atacacaacgttgagtgcatgcaacagagttgttgtgtcatatatccgctcttaaaatggtgtcgtcaccnagaaaacggacgatatgccactctctaggt

SEQ ID NO: 1794 - DNA, 101 bp, rice(Oryza sativa)
  misc_feature (71): n=t or c
agtgataaatcaaaatccagtgcaaaataggcaccattgagctatgcatattagaacggccaaccaaaagngtctcgcttaaatgaagaatgaataaggtt

SEQ ID NO: 1795 - DNA, 101 bp, rice(Oryza sativa)
  misc_feature (71): n=a or c
ggtcagaaatgaatagccgatataataatggataccatcttgccttagacggaaatccaatcagaacctcncatgtcacaagcgtatcatcaagcaactag

SEQ ID NO: 1796 - DNA, 101 bp, rice(Oryza sativa)
  misc_feature (71): n=a or g
attaatccaatagtgaagaatgcggtttcttgtcatacggagcatgacttgcatggaaataggaagaaccnagcacttattggctttaattttgagtcagt

SEQ ID NO: 1797 - DNA, 101 bp, rice(Oryza sativa)
  misc_feature (71): n=a or g
aatggtatgtttagaaaggacaacatcatatacacatgaatatatgtaatctcagctactgtacaggtggntactgccagtatcaaagaatataaatatac

SEQ ID NO: 1798 - DNA, 101 bp, rice(Oryza sativa)
  misc_feature (71): n=t or c
actagttgtcccctaggatatgtttaccatacatggcaagtctaaacttggactggggtgtcatctaggtncttgaagttgtaaaatgcgtatttgggtcc

SEQ ID NO: 1799 - DNA, 101 bp, rice(Oryza sativa)
  misc_feature (71): n=t or g
agtctactaggaaactacttcaaatataatatgcagtactccttttttttaatagatgacttttaaatacntgtttgaccattcgtcttattaaaaaaagc

SEQ ID NO: 1800 - DNA, 101 bp, rice(Oryza sativa)
  misc_feature (71): n=a or g
aaaaattataagagaattacaaaataaattattgtgtttaatgcgtgcgaggagcttgctcagcacatganaggggggggggatgcatttgcatgtgagac

SEQ ID NO: 1801 - DNA, 101 bp, rice(Oryza sativa)
  misc_feature (71): n=a or c
gttctgatctgaattaatgtagttcacttcatatagatttcattggcgtgcatctgaatgcaatcgcaagnctgaaagtccgttgtttctggcttcagaac

SEQ ID NO: 1802 - DNA, 101 bp, rice(Oryza sativa)
  misc_feature (71): n=t or g
ctccctccgttccacgtaataagacacgatcaaacatgacaccatcatcaaaattaatctgactttaaatntatcatatactatagtgtttgtacctacaa

SEQ ID NO: 1803 - DNA, 101 bp, rice(Oryza sativa)
  misc_feature (71): n=t or c
tgcaaccactattgcatcaacctatgttattctcctcttatcttccttttatgttgattctgtttatatgngcaagtaaattagacatgcttgtttctatg

SEQ ID NO: 1804 - DNA, 101 bp, rice(Oryza sativa)
  misc_feature (71): n=t or c
ctgaacattttccgcataatgcaatcacgatcttgtgctatagttcttttatgagaaaatccatgaaatgncattgacaaacatcctaattccagaaatgc

SEQ ID NO: 1805 - DNA, 101 bp, rice(Oryza sativa)
  misc_feature (71): n=a or g
gttttagaattgtgattattgttgagaatataggctttgttcatatatgaaaaataacaaagctaaacttnttaccataacaaaagtaaaaagttatctcc

SEQ ID NO: 1806 - DNA, 101 bp, rice(Oryza sativa)
  misc_feature (71): n=t or c
agaacgcacggcccatcaacccaactttcatggcgccatggccgctcgctgctgcagcagcgcccatccantcgtttcatcgacgaccgtatcccgccgac

SEQ ID NO: 1807 - DNA, 101 bp, rice(Oryza sativa)
  misc_feature (71): n=a or g
cttcaaccccatcttaacaaaaccattcgagtcaagtgccatgacagtatagatgggtggttttactaacntagtaacgtggcatcctagttgaaaaaata

SEQ ID NO: 1808 - DNA, 101 bp, rice(Oryza sativa)
  misc_feature (71): n=t or c
gttagtacttaattagtgaactgttaatgagttatatcgttttgcatgcctagcataaaaggtttagggcnctttaaatcacaggaatgaaaaaacggagg

SEQ ID NO: 1809 - DNA, 101 bp, rice(Oryza sativa)
  misc_feature (71): n=a or c
agacttatatgtagtccagtcaacaaaatcattttttttagaaactagtactaagacctacccctccggtncataaaaaactcaatcctaccaacgaacct

SEQ ID NO: 1810 - DNA, 101 bp, rice(Oryza sativa)
  misc_feature (71): n=a or c
tttaggttgcatacacgtaagtgctgccaattaaagcaaggtgttctagccctatcaacgttctagccctntgttttctgtacttgctagttgaaactagg

SEQ ID NO: 1811 - DNA, 101 bp, rice(Oryza sativa)
  misc_feature (71): n=t or c
ttatcgtcactgacccccgccagatctataacgagatacccctcccttctgctaccacccatcctctgtgncgctgagccccgccgctgctccccttcacc

SEQ ID NO: 1812 - DNA, 101 bp, rice(Oryza sativa)
  misc_feature (71): n=a or c
atgcccatccagtaccgccggtacgttcgattcttggctgcatcctttgattgctgctatctttagtctantttgcactggattctagactagatctgagg

SEQ ID NO: 1813 - DNA, 101 bp, rice(Oryza sativa)
  misc_feature (71): n=a or t
gatatgttacatccagcgtacctttcactagatttcaccatgtgttctatgcatatacatatgaaccatgnttacatggttttttctattgaaatgaatcc

SEQ ID NO: 1814 - DNA, 101 bp, rice(Oryza sativa)
  misc_feature (71): n=a or g
ggcccacatgtcatggagcacgaaaccggggcttggaaaggacacgggacttttaaacgcgcagcggagcngtagcaagacgaaagcgacggtggagacgc

SEQ ID NO: 1815 - DNA, 101 bp, rice(Oryza sativa)
  misc_feature (71): n=a or g
ctaagttatcaccaaatcttgacagctttaggagactcaattcccaattctcttaacaaggtttgtacccncattaactcagctgtagtattcgccacagc

SEQ ID NO: 1816 - DNA, 101 bp, rice(Oryza sativa)
  misc_feature (71): n=t or c
actccaaattttgacatcgacacaattcccagttgaatttgttgcatttttattttctgagtaatgctganatgtgggccaccaatcatcctaaaaaaaga

SEQ ID NO: 1817 - DNA, 101 bp, rice(Oryza sativa)
  misc_feature (71): n=a or c
tcagcagtatgaaaatcttctttctgcttggctacttcatcctccaaagacctgaccttatcctgaagtgnttcgatttcagattctttttcttggagcag

SEQ ID NO: 1818 - DNA, 101 bp, rice(Oryza sativa)
  misc_feature (71): n=t or g
gtacaccacacactgcagttgaatcctatatcttgtagccagaagaactttcagagagaatggatgtattntatgcactaaaacaatgaaaactttagagt

SEQ ID NO: 1819 - DNA, 101 bp, rice(Oryza sativa)
  misc_feature (71): n=t or c
ctcgatctctcccgacgtacgtgcgtgggtataggggtacagcacctgtcgttagctagaatcagatcccnggctggaaaatggaaacacccgctcgtttc

SEQ ID NO: 1820 - DNA, 101 bp, rice(Oryza sativa)
  misc_feature (71): n=t or c
ttgagttgccctagcgtggggaaaatctgcagaatgacacgctaatcttctgcccccaccgctcacacgantacatggacaaccgccacgtacgataatta

SEQ ID NO: 1821 - DNA, 101 bp, rice(Oryza sativa)
  misc_feature (71): n=t or g
ccccgtacgtccgacgacctaacaactggtccacgactcgtcacgagcgcgcgcgacgctaaacttgcttngcccgcgcggcgcgatcccggccggacggc

SEQ ID NO: 1822 - DNA, 101 bp, rice(Oryza sativa)
  misc_feature (71): n=a or g
taaattggttgactgcaatgtaaaaatgttagttcaaggatggacatcaaactgtcaaagatagaggggtntagatcgattgcatgatttagttagatgcc

SEQ ID NO: 1823 - DNA, 101 bp, rice(Oryza sativa)
  misc_feature (71): n=t or g
cgattgattgttggtggttgattcttttgtcggttggtaagaggtctattcatggcaatgggacttcgatncggtgccgttgttctctcgccgattccgat

SEQ ID NO: 1824 - DNA, 101 bp, rice(Oryza sativa)
  misc_feature (71): n=t or c
gtgcccagataaggatgaaggccgcgctgcattgaatggggaaatagaccggtcgaaacgacgtacgtaanggtgactactccctccgttccaaaaaaaaa

SEQ ID NO: 1825 - DNA, 101 bp, rice(Oryza sativa)
  misc_feature (71): n=t or c
ttaatccacgctggaagcttcacccgaatacggcatgtggaaagggatatggttaggtgtgttaagttcangtcaaaattgaaagtttggttaaaattaga

SEQ ID NO: 1826 - DNA, 101 bp, rice(Oryza sativa)
  misc_feature (71): n=a or t
gccataatgcaaagcataaaaagagatacatgatgtactaagaatgaaaataaagatctgtaatttttttnaaaaaaaatccaaaccaaagaagcccctta

SEQ ID NO: 1827 - DNA, 101 bp, rice(Oryza sativa)
  misc_feature (71): n=t or c
gatcaacagacggacagtttacagcatttcactatgttccaccgctcagtgcaaaatggtggctttgtgtnagtcctgaaagcgaaaagtatgttataaaa

SEQ ID NO: 1828 - DNA, 101 bp, rice(Oryza sativa)
  misc_feature (71): n=a or g
atttcattttgcaaattaaacttgcaccgccgtatttttttagttttgagccattgatgatggttgatagnctaattaattactggcatgtactaatgttc

SEQ ID NO: 1829 - DNA, 101 bp, rice(Oryza sativa)
  misc_feature (71): n=a or c
acgcgcgtcagcgcaccagctgcagcgacttccaacgacccaaccctagcgcctacctgacctccaccacncctccccaccctcccaacgcttgagcagta

SEQ ID NO: 1830 - DNA, 101 bp, rice(Oryza sativa)
  misc_feature (71): n=t or c
aatctgtagaaagtgagcatcacgagcattgtgctttttctccacatcaaagcatgtctgaccctccaganattgacagaatcattgctggtctttgccct

SEQ ID NO: 1831 - DNA, 101 bp, rice(Oryza sativa)
  misc_feature (71): n=a or g
cagcaagtgtccgctaatccttctagtaggtgccatgaatcttgtgatggtttctcaaatcaacggttacnctagtgctagtagttatactctctcggccc

SEQ ID NO: 1832 - DNA, 101 bp, rice(Oryza sativa)
  misc_feature (71): n=t or g
tacttagtaaattatgttaatcgtctattgttttcatacttccatacacctattggtactgccggtgaggnaaaaaaaatgtttcttgcaactacttcctc

SEQ ID NO: 1833 - DNA, 101 bp, rice(Oryza sativa)
  misc_feature (71): n=a or g
ccaatccctccgattcaagaaccgatggcgcgagcgagagcgcgagcaatttcccgccaaatcgaatcgcnggagccgcaagggctgggaagcaaatcggg

SEQ ID NO: 1834 - DNA, 101 bp, rice(Oryza sativa)
  misc_feature (71): n=a or g
cgcaagagcagatggcagcaatggaagaaacagcaaacacgtgtaacacatcagccaaccgacaaataaanggagcttcagcaaatttttgcaatggcgga

SEQ ID NO: 1835 - DNA, 101 bp, rice(Oryza sativa)
  misc_feature (71): n=a or g
tcttggaccaacaaacatactaacacttgacaaaagcatgtcctccacatgccattgtcatgatctctttngtattcaaatctaaccctatcaatctgacc

SEQ ID NO: 1836 - DNA, 101 bp, rice(Oryza sativa)
  misc_feature (71): n=t or g
ccacggtatctggccccatcacgcacgtctttctcggtccttctcaaatcgtttttgcatgcgtagctagntgtcgccaatctacgagcacgaggctagca

SEQ ID NO: 1837 - DNA, 101 bp, rice(Oryza sativa)
  misc_feature (71): n=t or c
tcgaggtagtaatgtataaggtcgttatgaaatttacatcgagtacaagcagtaatatacgagttgttttncctttatattagctactccctctgtgtcag

SEQ ID NO: 1838 - DNA, 101 bp, rice(Oryza sativa)
  misc_feature (71): n=t or g
ttcttccttcttttctacctcttctttttcttgcctttctgcttgaatgtatttttgttatatcttttttnaccaccattaatacaatggttataaggtag

SEQ ID NO: 1839 - DNA, 101 bp, rice(Oryza sativa)
  misc_feature (71): n=t or g
aggttcagagggctagcgagagctagagatcacacggcaagagatcaaggtgagatcttctcgatcaggancaggaggaggagaggaagaagaagaggaga

SEQ ID NO: 1840 - DNA, 101 bp, rice(Oryza sativa)
  misc_feature (71): n=t or c
ataagtcattgttgtgtgttacggtatggtaatctctttatgatacggaccctttcactaccacagaacangtgaaaaacctcttaaggtatcggttttct

SEQ ID NO: 1841 - DNA, 101 bp, rice(Oryza sativa)
  misc_feature (71): n=t or c
gaaattatgtttggccgtagaatattatgaagtcttagccttgtatattcataatctgaacaatggcatgnatcatacaaattattcctctaaatcataca

SEQ ID NO: 1842 - DNA, 101 bp, rice(Oryza sativa)
  misc_feature (71): n=t or g
cttacggcaacaacggagatggaattcggatcagcagcaagcacatcaaaactcaaaatgcacaggccaanatgcaagaaacctcaagacaagatccctcg

SEQ ID NO: 1843 - DNA, 101 bp, rice(Oryza sativa)
  misc_feature (71): n=t or g
tgtagattggccacttccagttcgaatcgaaaaggtatttcgcgaatcatcataatccaaagttctggggntttttttttcctctttactagaacttgtcc

SEQ ID NO: 1844 - DNA, 101 bp, rice(Oryza sativa)
  misc_feature (71): n=a or g
agtaggcgagactggcgagtacaccagcacctccgaagtctcagtctccatttaatcctgggaagcatgcnaaggcactagtagtaaatgtacgcatttgc

SEQ ID NO: 1845 - DNA, 101 bp, rice(Oryza sativa)
  misc_feature (71): n=a or g
tcgatcactccaaatttttttcccattccattgcatagcacaaagtggcgctaagattgaactataatacngtactatacacaacttctcccaccccgcta

SEQ ID NO: 1846 - DNA, 101 bp, rice(Oryza sativa)
  misc_feature (71): n=t or g
cgaaaggtatcctcaaacgcttgcatgaccatctcgaacgccgccacctcgatctgaaattaagagacatncaaagatcgatatgaaactaatgggggtgg

SEQ ID NO: 1847 - DNA, 101 bp, rice(Oryza sativa)
  misc_feature (71): n=t or c
tgcaagacggagctccctgacggcttcaaatgtgtctgattagatctgcattttagagtaattctacggtntttgagaaggtatcatgagatacaaaaaat

SEQ ID NO: 1848 - DNA, 101 bp, rice(Oryza sativa)
  misc_feature (71): n=t or g
ctggcacaaggaggggatcagcttaatcgttggcgacgagctgcacaatatctagaagccggaataaagtntaagaaacgggaatatgataaattaaaacc

SEQ ID NO: 1849 - DNA, 101 bp, rice(Oryza sativa)
  misc_feature (71): n=t or c
caggatgattttatgaatagactaagtattcgaggaaagaaattcaaaattagcatgcctcgtacctgtanagttcccttataacttataagaaagtagtg

SEQ ID NO: 1850 - DNA, 101 bp, rice(Oryza sativa)
  misc_feature (71): n=t or c
ggagcatgtaaggatcataatttctcgtgtagagcaaaaggacgttcggattgttgtgatccaagccagantattaagcaaatcggtaaccagaaacaaat

SEQ ID NO: 1851 - DNA, 101 bp, rice(Oryza sativa)
  misc_feature (71): n=t or c
gggaaaaactcaatgcagatttaccagcaagaacaagagctggatgctattcttttgctctaccttttttnttctctctttcttcttctctgtttcttgat

SEQ ID NO: 1852 - DNA, 101 bp, rice(Oryza sativa)
  misc_feature (71): n=a or g
agcaagcagaaggggaacaccaacttgctgaaaaggattctggcaggaaggagaaaggaagccatgaccangccaaatgtcgttgcgactgcttagcctcc

SEQ ID NO: 1853 - DNA, 101 bp, rice(Oryza sativa)
  misc_feature (71): n=t or g
agctagagagatcgaggacggggactggcagagcaacgagcacagctagcggaggttgagttatggctggnctggacgagcgggccatcgagtcgcaaaag

SEQ ID NO: 1854 - DNA, 101 bp, rice(Oryza sativa)
  misc_feature (71): n=t or c
ttccaagttcctacgagcagttgtgcttcctagttgcatttatttttaccttgaaacattgttagtactcncttcatcccacccactaagacactaagggt

SEQ ID NO: 1855 - DNA, 101 bp, rice(Oryza sativa)
  misc_feature (71): n=a or c
tactcttaccttaaataaagctataaatgtgtagcctactgtttatctctatctttttttcatcttctctntatatatatttatagctggtttaaagtatg

SEQ ID NO: 1856 - DNA, 101 bp, rice(Oryza sativa)
  misc_feature (71): n=a or g
cgatcaaatcggctaaaccgaaaggtttaaccctgcctgcggcgcacctacatgctacaggtgcaacacancgatttcgtactctctccgtttcacaatgt

SEQ ID NO: 1857 - DNA, 101 bp, rice(Oryza sativa)
  misc_feature (71): n=t or c
tcagggtgcaattgataatgcttatgttagctgtgaacactttttttttaacgcaaactggtctcaaagcnatttttagataatggaataaatatcccggc

SEQ ID NO: 1858 - DNA, 101 bp, rice(Oryza sativa)
  misc_feature (71): n=t or c
tttaatcaacagttacaaacgactgcaatacacatgaacatactctttttgaatgatctatgatcgtatgnctctagttgtacatgagttgtacaactgag

SEQ ID NO: 1859 - DNA, 101 bp, rice(Oryza sativa)
  misc_feature (71): n=t or c
aacaaaaataaggtctctcttcatcatccgtgccggccagggacgtcacgcatcgaggtagccacgtcgtngcgcatcgaggccgccgccgccgccgcgca

SEQ ID NO: 1860 - DNA, 101 bp, rice(Oryza sativa)
  misc_feature (71): n=a or g
taagttggatttgctaagttatttgcccaagtataaatcctacctgacatttgtaactccctaagacacantccctcaataatagcattaaaaagaaaggg

SEQ ID NO: 1861 - DNA, 101 bp, rice(Oryza sativa)
  misc_feature (71): n=t or g
tttccggaacagtacactgtacagttcccttcctcaacggcggagcaggattatgcatgataggagagggnggccagtcaagaaacaataaaaacaaaaca

SEQ ID NO: 1862 - DNA, 101 bp, rice(Oryza sativa)
  misc_feature (71): n=t or g
gtgcgtgcgtgtgcgtgcgtttgctgccttgttgcctcctaccgcgacccgccaccaacgggccatgggtntgtttagttgggaaaaagaaaatttttgga

SEQ ID NO: 1863 - DNA, 101 bp, rice(Oryza sativa)
  misc_feature (71): n=t or g
cacacattttatatagatgttgatatagttttatcataaatttactacaagttagcgaaatatggaaaaanagtatgtatctatactatctataaaattat

SEQ ID NO: 1864 - DNA, 101 bp, rice(Oryza sativa)
  misc_feature (71): n=a or t
cgcggtccagattagcttgaggcgagatggggctcggcgtgtcaaacagaaacggcccaagaaggcccaantttaggatctctcccatcgatctgatccgc

SEQ ID NO: 1865 - DNA, 101 bp, rice(Oryza sativa)
  misc_feature (71): n=t or c
atctcttacaaatgctgctactaatggaggattaacttctctatttcaggattcagcttagaccccccccntcccaaccaaaaaaaaaaaaaacagtaacg

SEQ ID NO: 1866 - DNA, 101 bp, rice(Oryza sativa)
  misc_feature (71): n=a or c
tttctgctcaaggctcttggcatgccatttcaacctcaacgcttgcccgaacagatctaggtccatcaccncgaggccgcctttctcaatgggcatacaga

SEQ ID NO: 1867 - DNA, 101 bp, rice(Oryza sativa)
  misc_feature (71): n=a or g
aggcaggcatgcatgcttagctttgcgaaaaagttgaaaggctgacacttaaccaccaccaccacctgcanctaatagctagtacgccaaatgcagaggcc

SEQ ID NO: 1868 - DNA, 101 bp, rice(Oryza sativa)
  misc_feature (71): n=a or g
tacagattacgggtcacaactactctcttatggtatacagaactgatcaaaacatattcttgatgttgacnataaaaatgaatataaaacaacccaagaag

SEQ ID NO: 1869 - DNA, 101 bp, rice(Oryza sativa)
  misc_feature (71): n=a or g
gactcggagttaagcacatcaaagtcagacaagataccaacgaaaaagcatccacaaaactaaagcattcnacaaactgaaataatgcaatcctatctcca

SEQ ID NO: 1870 - DNA, 101 bp, rice(Oryza sativa)
  misc_feature (71): n=t or c
aatattgcgctgtcaccgtcgccccccgccttgcattgcttctcctactctcgaatcgaatcgaatgcgtngctcgctcgctcgcttctctgcagtgcagt

SEQ ID NO: 1871 - DNA, 101 bp, rice(Oryza sativa)
  misc_feature (71): n=t or c
ctattcctacctcctactaagtaattgctactcccactgaagtccctttgataaaaaaaattaaaaaaatnactacttactccgttataaaatataataat

SEQ ID NO: 1872 - DNA, 101 bp, rice(Oryza sativa)
  misc_feature (71): n=a or c
aatgtcattttctgtttgagagccttatctcaaagcgttatattttgatttcactagtcgaatcattcacnccttttaaatgtattttgtggtaaatcatg

SEQ ID NO: 1873 - DNA, 101 bp, rice(Oryza sativa)
  misc_feature (71): n=t or c
aggctcatcctgccagcgtactggtctgatcgcacggccataagcaaatttcaagttccagccccaattangtaagcaaatttgaagcgaacaatattcag

SEQ ID NO: 1874 - DNA, 101 bp, rice(Oryza sativa)
  misc_feature (71): n=t or c
gagaagacgggtcgttgtccgagggtaggtggggaaattgatttccttcggtccccttcgctgccatccancaagtcacgagcgttgtgggccggtttcct

SEQ ID NO: 1875 - DNA, 101 bp, rice(Oryza sativa)
  misc_feature (71): n=a or c
ctgaaatactgttaagaacttaagatggtttatattgctagaatgctgctgctacatggtacatcttggangtgtgtttaagtcatgctctttttagttta

SEQ ID NO: 1876 - DNA, 101 bp, rice(Oryza sativa)
  misc_feature (71): n=a or g
gcgttaccgtgaggccacggcgcttcaatcaaactgtatcaaattaaccaccggatgtgatagaggctgtntttagattggcctaaagtttaaaatttagt

SEQ ID NO: 1877 - DNA, 101 bp, rice(Oryza sativa)
  misc_feature (71): n=t or g
agacttgagttcagaggtaatgacggatgaatagagtcgtctgaaacctatgtcttctcatgaagtttaangaacagaaatggcagtacataaaggcaaag

SEQ ID NO: 1878 - DNA, 101 bp, rice(Oryza sativa)
  misc_feature (71): n=a or g
ttagtactagtatccatgattaagcattgaagatacccaaataatccatcttcagggtgtaaatacaagtngtacaatactctacttttgtgttcagttca

SEQ ID NO: 1879 - DNA, 101 bp, rice(Oryza sativa)
  misc_feature (71): n=t or g
ggttttttttgtgtgtgtgtttgggatgaggtgggaggtagtgtgtgggtgtgggggatagaacgtttatntatgtgggtaaaagtgtatcgtacaattct

SEQ ID NO: 1880 - DNA, 101 bp, rice(Oryza sativa)
  misc_feature (71): n=t or c
catgttttatgatataagttgtagaaaaccacaagtattctgacttggcgccatcccccatgtattatggntctaaagtttcacaaaacctcaccctttgc

SEQ ID NO: 1881 - DNA, 101 bp, rice(Oryza sativa)
  misc_feature (71): n=a or g
attggtcaaagtcgtccacgtttgcacaccatcactagtgtacaccaacgatgatcatgtgaatgttttgngacaaaggaatccaataactcagcaaataa

SEQ ID NO: 1882 - DNA, 101 bp, rice(Oryza sativa)
  misc_feature (71): n=t or c
acgggggagactaaattctcggagaaggaaggtgtccataattaagcgatcgattcgagtccccttccctncctccctaaaccctaaccaaacccccacca

SEQ ID NO: 1883 - DNA, 101 bp, rice(Oryza sativa)
  misc_feature (71): n=a or c
agttacaaactggagtagccatcaaagtcaatgaaagcctaagctccaaaggttaaaacaaatactgaatntccatgttgatcaagttaggaaattgaccg

SEQ ID NO: 1884 - DNA, 101 bp, rice(Oryza sativa)
  misc_feature (71): n=a or g
cgccttgtttataatatgatattttggaatttttggccaaaatttggaatttccgtcccaggtgtatttcngtcattaggacaaaattatatagtactaat

SEQ ID NO: 1885 - DNA, 101 bp, rice(Oryza sativa)
  misc_feature (71): n=t or c
cacctgtcaaggactcatatccttctaactttaagtcagaggagctcctttcgtggtggacgaatgaactngtcggcgtgtgagaacagagaactgacact

SEQ ID NO: 1886 - DNA, 101 bp, rice(Oryza sativa)
  misc_feature (71): n=a or c
ctttaaattgatggcctaaattaaatcatgcagctgcctggtttcatgaattatgaatttttgacctagcntacatcaaatcattcagctttcaacttctg

SEQ ID NO: 1887 - DNA, 101 bp, rice(Oryza sativa)
  misc_feature (71): n=a or g
ggagccaattctaaaccatgttcttaggatcaaaaccaagtgtcatcagttcagtatagaggcggacatgnagccaattctaaaccctgttcttaggatcc

SEQ ID NO: 1888 - DNA, 101 bp, rice(Oryza sativa)
  misc_feature (71): n=a or g
atataaaaaaattttagttagatatgatgcatattagttgcgaatctgaaaaataaagagtatgtaataantagtggtgtgtatcaggtggtgtttgggaa

SEQ ID NO: 1889 - DNA, 101 bp, rice(Oryza sativa)
  misc_feature (71): n=a or c
agatctagccacacaaaaagttgtagacatcgtgtccgtagctagtatagttcacaatacgaaatgacagntaaatttaagtgatttagatcttactagta

SEQ ID NO: 1890 - DNA, 101 bp, rice(Oryza sativa)
  misc_feature (71): n=a or g
gctgcttttgtagtaattgttttcaaaaatatttttctcactaaagattgaggttggtgtagtaattgtgnaacaaatgactttgtttcactaaaatccaa

SEQ ID NO: 1891 - DNA, 101 bp, rice(Oryza sativa)
  misc_feature (71): n=t or c
gtttcaagaaatattttggggaaaaaaaatccttgcacgagaacgagtttcaggaatagtttgattttgantggtttgcattttaccaggaccttatgcaa

SEQ ID NO: 1892 - DNA, 101 bp, rice(Oryza sativa)
  misc_feature (71): n=c or g
gtggtccaccacgcatagtaaaattgtatgtatagtacatagtaagctacaaaaacttggtgtagagtaantgcttttttcccttcactagacggcatttg

SEQ ID NO: 1893 - DNA, 101 bp, rice(Oryza sativa)
  misc_feature (71): n=a or g
cgaagcgatgcgagggatgatttccagtcggccacaagatcgatcaaaacctgtgatgactgacgagacanaaatgaaagaaacacagccaattcatcatc

SEQ ID NO: 1894 - DNA, 101 bp, rice(Oryza sativa)
  misc_feature (71): n=a or t
aaatctcatcgtttcttctttctttgtaggagtagctacctcctctcctttgatctttctttggttacatntacaggccgtgttcagttgtttggtcaaaa

SEQ ID NO: 1895 - DNA, 101 bp, rice(Oryza sativa)
  misc_feature (71): n=t or g
gcccacatgctgactcagcttaggtatcaagggggtggttgggcccacttgccattgaccgttcgccgccnaggcgggaacgaaaccaccgggtgcttttc

SEQ ID NO: 1896 - DNA, 101 bp, rice(Oryza sativa)
  misc_feature (71): n=a or g
caaaattctgaatctcactcactcagtctgctgctgaccttgttcatgcatgcgtgcagttcatctcatcngtgtctgtactttgtagattctgggtcaac

SEQ ID NO: 1897 - DNA, 101 bp, rice(Oryza sativa)
  misc_feature (71): n=a or g
tgtccctaatcaacatatatacatggatgcatgcatgcataaatgtactaattactacactagctaccatncatgatccctagagcattttttactgacta

SEQ ID NO: 1898 - DNA, 101 bp, rice(Oryza sativa)
  misc_feature (71): n=a or t
tgtagtgctaaacctgacgtttctcatcatggaaatgagagagggctttggcctatctttgattttttttnaaaaaaagaaaatataagaaatgcttttga

SEQ ID NO: 1899 - DNA, 101 bp, rice(Oryza sativa)
  misc_feature (71): n=t or c
aaaacacattctactaatcatgtttgtttatttccaattacgctgcattacacatgatggttgatgaaganaataagattctgagtagtacacaataacac

SEQ ID NO: 1900 - DNA, 101 bp, rice(Oryza sativa)
  misc_feature (71): n=a or t
ccatatcattacggcaaataaatcctccattaatagatatatatgccctgcattaatcctccatttttttnaaaaaaataatcctccattaatatggtgca

SEQ ID NO: 1901 - DNA, 101 bp, rice(Oryza sativa)
  misc_feature (71): n=a or c
gcttgtgactcatgactgagttgtcgatggcgccaagcacattcatcctcatcattctcgctaatcaaacngatgagtgtgatcaacatttgcatcgaatg

SEQ ID NO: 1902 - DNA, 101 bp, rice(Oryza sativa)
  misc_feature (71): n=t or c
aatagatatgtgtgacccacatgtcatccacacacaaaatatacaatggacccactgactgtggggcccanatggtcatcctctctctccaacccttcttc

SEQ ID NO: 1903 - DNA, 101 bp, rice(Oryza sativa)
  misc_feature (71): n=t or c
tataacttgcttataactcactgttgtttttctctaattaaatgagagatgaatgggggtgagagaatagntagaggtaagattgaaagaaatttaaatga

SEQ ID NO: 1904 - DNA, 101 bp, rice(Oryza sativa)
  misc_feature (71): n=a or g
tgagcacattgcgctccatgataaacgttgctggaatcagcagaacgacggccaccggagccatgtaaccnagaagctccatgggattgagcttctccctg

SEQ ID NO: 1905 - DNA, 101 bp, rice(Oryza sativa)
  misc_feature (71): n=t or c
cgtcatctgtccacgatatttttctggtgttaaaagagttagtacatttttctgtaaaagttggtaaaacntacaaaaatttgacataaaaaagaatcaaa

SEQ ID NO: 1906 - DNA, 101 bp, rice(Oryza sativa)
  misc_feature (71): n=t or c
gccccaacgtggtctcctaccttgtgccgcccaacgacgacgatcaccgtatgctcatggtgcgctattanggcgacctcacccacctcacagatcacgag

SEQ ID NO: 1907 - DNA, 101 bp, rice(Oryza sativa)
  misc_feature (71): n=t or g
gtaactcggatgtaagtggaatggaatgtactaatatgtaatttgtctaattatttagaaacttgcgacanatcaagtggctagcatgcacggcttgtggg

SEQ ID NO: 1908 - DNA, 101 bp, rice(Oryza sativa)
  misc_feature (71): n=t or g
tatcgaaatgggaaaaaggactagagactggttcattttattgctattttaaaccctactaaattttaacnttacttagttttagtcttgatagggtaaca

SEQ ID NO: 1909 - DNA, 101 bp, rice(Oryza sativa)
  misc_feature (71): n=a or c
tacttgcaactggacactagtaatccttggaccatatctcaattcccaggtgcatatactccctccgtccnaaaaaaaaaaagacaaaccctggtttccgt

SEQ ID NO: 1910 - DNA, 101 bp, rice(Oryza sativa)
  misc_feature (71): n=t or c
tgactggagtagctagtgaagtggggaggtggaggtcacgtacccttggttttggataacgagtcgtgtcnccgtcgagctcgacggcgacgggggagatg

SEQ ID NO: 1911 - DNA, 101 bp, rice(Oryza sativa)
  misc_feature (71): n=t or c
tcttgtgtacttgctcttacctgctgtctcttcttgtttcctacccacttcttctaggctgtatttagttnctttcaaagttgtaagtttggttaaaattg

SEQ ID NO: 1912 - DNA, 101 bp, rice(Oryza sativa)
  misc_feature (71): n=t or g
tgtgctgaggtcaattcacatctttaccaggtaatgtgcagtgcatccctgtattaacttcttgctttatntgattttcacttatgatttgcgcattgcca

SEQ ID NO: 1913 - DNA, 101 bp, rice(Oryza sativa)
  misc_feature (71): n=a or c
acaagtaagcattgtgatgttctcgtagcttgcgaaccggtgctaccccgactgagcttttcttcttctanaaacttctccaaccaccatacatcttttct

SEQ ID NO: 1914 - DNA, 101 bp, rice(Oryza sativa)
  misc_feature (71): n=t or c
cacttcagtacttcctactgctgtcaacaacctctctatctacctatatagcttgtcatctcctcattcancagtacaattaattttgtcattacactagg

SEQ ID NO: 1915 - DNA, 101 bp, rice(Oryza sativa)
  misc_feature (71): n=a or c
tcgggtttgcagaaatgtatcttatgtgaccaacacgagaaaacaattgaccacattctaatccggtgtcnaaagacgctccagctatggtggatgatggt

SEQ ID NO: 1916 - DNA, 101 bp, rice(Oryza sativa)
  misc_feature (71): n=a or g
gcgaaggctgacgatagaccatgataaagaaactaaaatttggctacagttgtaagccaacaagcacacantgagacctgaaatttaagttgcagcactct

SEQ ID NO: 1917 - DNA, 101 bp, rice(Oryza sativa)
  misc_feature (71): n=t or g
tataggagttccagcaaacattaatgtttaaggtacgtaaaattctattgccttcactcccaatgatacanataattgcagtaaatcttgagaggtgatca

SEQ ID NO: 1918 - DNA, 101 bp, rice(Oryza sativa)
  misc_feature (71): n=a or c
cttatccatattcataggatatagagcatttagtaccgatgctagattcatcctttttggcctatcactantattgaatttgcacataatagccatacaac

SEQ ID NO: 1919 - DNA, 101 bp, rice(Oryza sativa)
  misc_feature (71): n=a or g
ttccccggagcttgtgactactttgatctaacttgctacaatatttataattctagatcaatatgaggagnattgggtacttctctcttggttgatatgga

SEQ ID NO: 1920 - DNA, 101 bp, rice(Oryza sativa)
  misc_feature (71): n=t or g
ctggatcaatactcccaacagaattctaaagactgctgcatcacttcacgcacaagacgctttccctgtanaaatacagaagaaagatgttaaaattattt

SEQ ID NO: 1921 - DNA, 101 bp, rice(Oryza sativa)
  misc_feature (71): n=a or g
tgcaaataagacatggtgttactgtacaatgaccgtcacgttattgcatcattcctacgggacgagagctnagactgagaggaggtgggttgtggggaaag

SEQ ID NO: 1922 - DNA, 101 bp, rice(Oryza sativa)
  misc_feature (71): n=a or c
gctgcagtcaactcttcttttcgtgaaatacaactaatgtgctcttcagtttttcactggctgcttactanctccatcccaaaataagtacaaccatagat

SEQ ID NO: 1923 - DNA, 101 bp, rice(Oryza sativa)
  misc_feature (71): n=a or c
aaacagaggcagtgcgaggtacaagcacaaagtagaacaactgtttgctgagccgcacacttgtttggacnctaccactttcatgcaaaattcatgcatat

SEQ ID NO: 1924 - DNA, 101 bp, rice(Oryza sativa)
  misc_feature (71): n=t or c
ttgctctctgatgctatttagtcatgtccctcctcagggccaaacattgccactttgttctgccccccccnctctctctctctctctctctctctctctct

SEQ ID NO: 1925 - DNA, 101 bp, rice(Oryza sativa)
  misc_feature (71): n=t or c
atgtcatggcccccaacactgactgacctttccttgggaggaggattcggctgcccttaggagtatttatntatctatatgtattgatcgatcactatgta

SEQ ID NO: 1926 - DNA, 101 bp, rice(Oryza sativa)
  misc_feature (71): n=a or g
ctatattacatcctgcagctgtataaaaggactatgagccaagagatatgcaaatagaaagaaagagatcnagagagatgtcatatactccctccgtttca

SEQ ID NO: 1927 - DNA, 101 bp, rice(Oryza sativa)
  misc_feature (71): n=a or g
ttcacttgagcaggttacaaaacacaagcgaaaatttatctaccgtaccttagacaataaggaaaaaaaangggtacccattaaagcctaacaacaacaac

SEQ ID NO: 1928 - DNA, 101 bp, rice(Oryza sativa)
  misc_feature (71): n=a or c
tcttgaaaaggatattgagctggctagctgtgtagcttagcaatatgatggcttggctaggttgttttgcnttagcgtttggtgtcattagtggtttggtg

SEQ ID NO: 1929 - DNA, 101 bp, rice(Oryza sativa)
  misc_feature (71): n=t or g
agtttcctgaaaatataacagaatctatctttcaacgagctatgcatagttttttctgttttatggactancaaaaatgcttgtacgttgcaacatatgaa

SEQ ID NO: 1930 - DNA, 101 bp, rice(Oryza sativa)
  misc_feature (71): n=t or g
tctgctggaaaccaatggacaatggtgcaagaagcagcagcttcatcttaaagtgatctcaaatcagcaangggcaattcacagtggacagatatttgcca

SEQ ID NO: 1931 - DNA, 101 bp, rice(Oryza sativa)
  misc_feature (71): n=a or g
atatgtaatgctgtttttttttgctctagtcatttactgtgactacctggaggacatcaccaacattgacnaaaatggccgatgggtccgatggcacctga

SEQ ID NO: 1932 - DNA, 101 bp, rice(Oryza sativa)
  misc_feature (71): n=t or g
ttgaaacccaagcataaagtgctagtgacacatgtgcctgcatcctgtgtttatatataaaacacacggtnccacacgcatcatcgccattccattttctc

SEQ ID NO: 1933 - DNA, 101 bp, rice(Oryza sativa)
  misc_feature (71): n=a or g
aataggaaagctaaggccaatactgcttctttactgaaacaaatctacagcaagcaatgaaagagagaggnagagtgtttattttttttaccacttcatta

SEQ ID NO: 1934 - DNA, 101 bp, rice(Oryza sativa)
  misc_feature (71): n=a or g
atgacaatttatttaattattgaaagatatcttgatggttttctgcagctcaggaccacgcattatgcacncatgcattcgatttacttgcatatacatcc

SEQ ID NO: 1935 - DNA, 101 bp, rice(Oryza sativa)
  misc_feature (71): n=a or g
tggtcttgcaatgcaacatgcgtggcgcccgcgcattcaactcaaaatcagatgacttctaaccacgtatnattataaacacatcgtttcatatgccatat

SEQ ID NO: 1936 - DNA, 101 bp, rice(Oryza sativa)
  misc_feature (71): n=a or g
tccaaaaaatagatcaatgtaacttttaagcaatttaaatttaaattcatcgttaaattgtttggaaagcntgtacggaaaacgattgactattcctctaa

SEQ ID NO: 1937 - DNA, 101 bp, rice(Oryza sativa)
  misc_feature (71): n=t or g
tcgccgttggcaccttctccccaccacccactgctgaggaaggagaggaacaaagaaagagaggagatatnagactgatgagtgggcccgtgggcaaaatt

SEQ ID NO: 1938 - DNA, 101 bp, rice(Oryza sativa)
  misc_feature (71): n=a or g
cgaaaagagacgtcattcaattaagcccacaattgcaagctgggtagaatagaatgatggaccacaagggnaaataagtccactttgactcccttactgac

SEQ ID NO: 1939 - DNA, 101 bp, rice(Oryza sativa)
  misc_feature (71): n=t or c
cccgtttgtagtcggtgcttgttttcaatgagaaatctattgttccagtggtgatttacttcctccgtctnaaaatatagcaagttttagttggatgtgac

SEQ ID NO: 1940 - DNA, 101 bp, rice(Oryza sativa)
  misc_feature (71): n=a or g
caaacaatatgtgcgggttggaatacttgtacataagtagtagtattaaaaacttgcaacacgcggaaggncaagggcctttagcctagtggttacaagcc

SEQ ID NO: 1941 - DNA, 101 bp, rice(Oryza sativa)
  misc_feature (71): n=t or c
caacctcgtataggatctgatgcatcccagtattacaaatctgaacatgcgtatgtccacatttatagtantaggatgtatcatatttcatacgaagttgg

SEQ ID NO: 1942 - DNA, 101 bp, rice(Oryza sativa)
  misc_feature (71): n=t or c
catgatccttgtgacatggcttaaggagagagacatactatatttgtctttcctctctccgtgtgtggcanatccgctactttaggatgaccggatggggc

SEQ ID NO: 1943 - DNA, 101 bp, rice(Oryza sativa)
  misc_feature (71): n=t or c
tagaacctctcccagggggtcccttttatactgtcgatcatcctgatccccaaggaaggtttgaggatatnggacctagtacggtataacataaactctat

SEQ ID NO: 1944 - DNA, 101 bp, rice(Oryza sativa)
  misc_feature (71): n=t or c
ccaaaaaaaaacataggaggttcacttaggtcccttaatttgccacaaagtatgaaattcgtccataaacnggtatgtctctcaacttttgaaatcggtac

SEQ ID NO: 1945 - DNA, 101 bp, rice(Oryza sativa)
  misc_feature (71): n=t or c
aagataattataatactctatcaaattatgtatggttggtagttgggtaaaatggagaaaattttaagggntcattcggaatggaggaaatgtgaaggaaa

SEQ ID NO: 1946 - DNA, 101 bp, rice(Oryza sativa)
  misc_feature (71): n=a or g
actctgcgagaaaatttggtgaaatctggctaaccaaacatggttagcgtggtagtcttttcctccctctngttcatgatcgatgagccgagcgtgacgag

SEQ ID NO: 1947 - DNA, 101 bp, rice(Oryza sativa)
  misc_feature (71): n=t or c
ttacatacttgtgctgaaacatttcgccaccggttatgatttcacagcatgccctaacaaactaggtcttncgtattataatatagtaacctaaaatcggt

SEQ ID NO: 1948 - DNA, 101 bp, rice(Oryza sativa)
  misc_feature (71): n=a or g
tggagtcagcttccagtcacacttgttagcaatgtggttgacaatgtgagagttgcacgtcaaggtaaacncatgaagaggaacgagtggggcctgtgatt

SEQ ID NO: 1949 - DNA, 101 bp, rice(Oryza sativa)
  misc_feature (71): n=t or c
tgattcacgtgatcctacttctagattttggttttgtgaagctaaattattagaacttttgattttggttntgtgaagctaaattattagaacttttgata

SEQ ID NO: 1950 - DNA, 101 bp, rice(Oryza sativa)
  misc_feature (71): n=a or g
aggatggtgagggaggagggagagggggtgcgacagatccaagtaccccaacgattatttcttgcagcacncaatctggagcaccaatggtggcaaaggct

SEQ ID NO: 1951 - DNA, 101 bp, rice(Oryza sativa)
  misc_feature (71): n=t or c
gaaccgtcatctataatatattataagtaccggttaattaaaaattgacacttgtaatatagtatagatgncgatttttttaaagaaccagcacccataca

SEQ ID NO: 1952 - DNA, 101 bp, rice(Oryza sativa)
  misc_feature (71): n=t or c
taggaacttagatttagaaagcccgggagaggaagatatacaacttatttgataagaatgtttttttatgnattacatttgttagaaacatcattatatta

SEQ ID NO: 1953 - DNA, 101 bp, rice(Oryza sativa)
  misc_feature (71): n=a or c
cgcaagcaggcagaagaacacgacttagtaggaataaggataagaaaatagagagaaaagagagaggatangaaaagaaaggaggaggacaaggaaagagt

SEQ ID NO: 1954 - DNA, 101 bp, rice(Oryza sativa)
  misc_feature (71): n=a or g
ccaacaacctcgatctagacagcttgaaatcgatcaagatggattttgaagattaaactggctagcggagncgatttagatatcaaaactagccatgaggc

SEQ ID NO: 1955 - DNA, 101 bp, rice(Oryza sativa)
  misc_feature (71): n=t or c
cgagtccaacagaatcgctagcgattcttcgttcttcactaacgcggagaaaaaggtgatttctagtttgnagggggctcattttttacttttttaatttc

SEQ ID NO: 1956 - DNA, 101 bp, rice(Oryza sativa)
  misc_feature (71): n=a or g
ccgtccttcgcttgatgacgtcgcctattgcagccaccggtctaaccaatgtagagacgccagtcttatcnggcagtagccgccggtctaaaccgtcgtac

SEQ ID NO: 1957 - DNA, 101 bp, rice(Oryza sativa)
  misc_feature (71): n=c or g
aaaaaaaagcaatttgttgcaaaggcccacccacccaaacccctctgtacacgtgaatagaagagctagcncattttcacctaagtgtaacctcagaaagc

SEQ ID NO: 1958 - DNA, 101 bp, rice(Oryza sativa)
  misc_feature (71): n=a or g
ataggtcgtctccagggattgcgttttcggttcaaaatttcggaccccctagcaagtgattatctcggctnaaaattttggtttttctcaatcttttacaa

SEQ ID NO: 1959 - DNA, 101 bp, rice(Oryza sativa)
  misc_feature (71): n=t or g
tttccccaaaacattaaaaaataaaagcaaatccagaaaccctagccaccttccttgtgaagccaccgtcnttgttgccgtggcattccattgctatcggg

SEQ ID NO: 1960 - DNA, 101 bp, rice(Oryza sativa)
  misc_feature (71): n=a or c
gcgaggtcgacggcgatcgatggattggtcgttaaataggcaaaaatgtggacatcttcaccaatagtganaaccggcaaatgtcacacctatggctaagg

SEQ ID NO: 1961 - DNA, 101 bp, rice(Oryza sativa)
  misc_feature (71): n=t or c
ttttcttatgcggtcctcttaaggggccatatgaaaaatagaatttcatatgctagcctattaagtagtcngcatgcgaaattaccctcatctactccatc

SEQ ID NO: 1962 - DNA, 101 bp, rice(Oryza sativa)
  misc_feature (71): n=a or g
ggaccaaagttgacatggtattgtaagtcaggtacctggtagcttggtttcaggaatgaatttcagacttngtgacaaattgagggttctaaagtaaactt

SEQ ID NO: 1963 - DNA, 101 bp, rice(Oryza sativa)
  misc_feature (71): n=t or g
atttgtgaagattccttgtggtatatgatgggagattgtgtgcgtatggaaaacggagtcaaattggaganactccaaatttgggaagattggagtttgaa

SEQ ID NO: 1964 - DNA, 101 bp, rice(Oryza sativa)
  misc_feature (71): n=a or g
cacaggtaggtgggttcttcaaaatccaaagctactcggtgaggatactccagttcacaatgggtatcccngtctcaagtagtcccaggtgacaaattccc

SEQ ID NO: 1965 - DNA, 101 bp, rice(Oryza sativa)
  misc_feature (71): n=a or g
agctctcaacgctggcggctcgcacctcacctcttcacacattagcttttcccaaatccaagctgttctangctagctagctctggctacttcttctcttc

SEQ ID NO: 1966 - DNA, 101 bp, rice(Oryza sativa)
  misc_feature (71): n=t or c
gtaatttgcttttcttgacgagtacatgttcatttgaacaacgattgatcaaaccattatttaaaaaaacnaaaaacaaatcatgaataaaacttttatat

SEQ ID NO: 1967 - DNA, 101 bp, rice(Oryza sativa)
  misc_feature (71): n=t or c
gggtgtgcgccgcccatgaatacacctcgtgatatacatgcctacacgttttcactctcctttgtctgganttgtgtgatgattataatgaatataagtca

SEQ ID NO: 1968 - DNA, 101 bp, rice(Oryza sativa)
  misc_feature (71): n=a or g
ttttgagtatttgcaaatttattttctgtagaaaagacaagtagtcaaagtttaaaaacgaatagtgttgncagttatttaagaaaatggagggagtatat

SEQ ID NO: 1969 - DNA, 101 bp, rice(Oryza sativa)
  misc_feature (71): n=t or c
tgagttggagggaaaagtcactagcctttcgactagcatggaaaatacacataatacatgtaagatacaancacggttcaaccgtcgggtcaacggttgga

SEQ ID NO: 1970 - DNA, 101 bp, rice(Oryza sativa)
  misc_feature (71): n=a or c
cacgtatcagcgactcctaccgtagcatcagtaatgaagaggcaaggggttagagtacatcagtattgacngtatatgagtgcctccttggttttatgaaa

SEQ ID NO: 1971 - DNA, 101 bp, rice(Oryza sativa)
  misc_feature (71): n=a or g
ccatggggtgtggcggctggttgtgccgcttggacatggacgacatggcgagcgtcttcctgaaggaggcncggcgctcgagtcgtttgatggtgaagcgg

SEQ ID NO: 1972 - DNA, 101 bp, rice(Oryza sativa)
  misc_feature (71): n=a or g
cattaatggctggctccgtgggtagctgagctctttgctggccgagctgagctagcctacctagctggggngagagagagagagagagagagagagcataa

SEQ ID NO: 1973 - DNA, 101 bp, rice(Oryza sativa)
  misc_feature (71): n=a or g
atccagagatggcgaccaatgtaagatgtgtagtactagtactactcgcacaaacgcgtttgacagaccanatattattatcataaattaattatctactc

SEQ ID NO: 1974 - DNA, 101 bp, rice(Oryza sativa)
  misc_feature (71): n=a or g
acattctatttttccgttaaaatttaaaaagttgtagaacttataaaatgtattagaaaaccacagcctanaaagcccaggccagcttcttcatagggtgt

SEQ ID NO: 1975 - DNA, 101 bp, rice(Oryza sativa)
  misc_feature (71): n=t or c
cgggcagttggactcttgtagccaccagccaaaccaaccaacatcgccaccaaagcaagcgttgattccgnccttggtctctcgaccatcggctacagcgg

SEQ ID NO: 1976 - DNA, 101 bp, rice(Oryza sativa)
  misc_feature (71): n=t or c
atccattttgcagccactacgtacgtacctccatgcatgtcacttccgctcgctgtactgtatatattcantgtcaggggttcgatgccggccgccgccac

SEQ ID NO: 1977 - DNA, 101 bp, rice(Oryza sativa)
  misc_feature (71): n=a or g
aaaaatcatgggacatattagtgagtattcggtaaaaagttaagttaaaagaaaaatgcagtgggaccatntcgtcgcccctctctctttcccctcttctt

SEQ ID NO: 1978 - DNA, 101 bp, rice(Oryza sativa)
  misc_feature (71): n=a or c
tctatctactttctaattaaatgcttttgaagtaaattcactagcattgtccgtttgaatggaatgcacangtgttaacaaccgaatttggtaatatcagc

SEQ ID NO: 1979 - DNA, 101 bp, rice(Oryza sativa)
  misc_feature (71): n=t or g
attattgaagtcaatttgtgaaatcctttccttttttcctctctctttctactccagtttcgttttcttgntgttttggaagttttcttggcagcttggta

SEQ ID NO: 1980 - DNA, 101 bp, rice(Oryza sativa)
  misc_feature (71): n=a or c
atataaaaattgcgattttcgcgtgcgggtgcgtcacccgaaaaaaaaaatcggattttcacagacacttngttcaagacgggtggaagatccatatgcga

SEQ ID NO: 1981 - DNA, 101 bp, rice(Oryza sativa)
  misc_feature (71): n=a or g
atccagcggtccacgggcactctattccaccgacctacaacatacctccaacacaacgacaaaatatgcanatggcaagaaacatcttgatctatctctat

SEQ ID NO: 1982 - DNA, 101 bp, rice(Oryza sativa)
  misc_feature (71): n=t or c
cattagaggggtcaaaaggattacaacgttgccaaccttgttatacactatcctctaccagtctactgtanacaaaaaatataaaaaagaatcactaggtt

SEQ ID NO: 1983 - DNA, 101 bp, rice(Oryza sativa)
  misc_feature (71): n=t or c
tggtgacccaagtatggtaatcgatgagctggtaacccactttaagagcttcttggaaaagcagaaatttnataggattttcaaatgaaactatttggttt

SEQ ID NO: 1984 - DNA, 101 bp, rice(Oryza sativa)
  misc_feature (71): n=a or g
ccaccttagtgaaaattttgaagctagcatatagccgagagatatcatatagccgaagaaaaccaagaacnaagaacacatcaaaactgaagacaaatcaa

SEQ ID NO: 1985 - DNA, 101 bp, rice(Oryza sativa)
  misc_feature (71): n=t or c
tcgccggcaacccatcgatcttcgtgatacactcaatcaacgccatgcagaaagaggccaccaaccacacngttcaccaaatcgacatcacgacgacgaag

SEQ ID NO: 1986 - DNA, 101 bp, rice(Oryza sativa)
  misc_feature (71): n=t or c
atttagctgtagcccatctttggttaacttctactcgtggatgtagctcgtgttgaatgtagtatacacanattatgcgtcattgcaccctgaactcccaa

SEQ ID NO: 1987 - DNA, 101 bp, rice(Oryza sativa)
  misc_feature (71): n=a or g
ctggggaaggcgagaacggcaatatcaatggaggcaacaactccaacaatgcctcaactagttctgaaccnttctctgggtacgttgctaaagtcatcgtc

SEQ ID NO: 1988 - DNA, 101 bp, rice(Oryza sativa)
  misc_feature (71): n=a or t
tcttcgagaactatgatgaccgccatgaccttgccgatgccgacccaagaaaaaccaccgcatcttcgagngatgagagagagaaggaagggaaagaagat

SEQ ID NO: 1989 - DNA, 101 bp, rice(Oryza sativa)
  misc_feature (71): n=a or g
gggagttctagaagagggatatctacttattagcgaggatgctatcctagtcacttgaggcatataaggtngagagaataaggggaacacatgcgcgctcg

SEQ ID NO: 1990 - DNA, 101 bp, rice(Oryza sativa)
  misc_feature (71): n=a or t
tgtcatatgcaatattaattggttatgttaattgttcgaatgaatggtaatggtactatgatttttttttnaaaaaaaactaacttgtggatacatggtca

SEQ ID NO: 1991 - DNA, 101 bp, rice(Oryza sativa)
  misc_feature (71): n=t or c
ttaattcatgcgtgcctctttggttattgaccttggtccttggatcaatgcccatggcattacactttagntatttattactttgtcagaaagtttaatag

SEQ ID NO: 1992 - DNA, 101 bp, rice(Oryza sativa)
  misc_feature (71): n=t or c
tctcaccagaatctttttaaatgaaatgaagatcatcctcttctagaatagacttaggagactcatgaagnagaaccgccattacttcctctatcggcgta

SEQ ID NO: 1993 - DNA, 101 bp, rice(Oryza sativa)
  misc_feature (71): n=a or c
tgacggttggagggcactttggacatttcctattcgctaaccgtcattaactgtcctatttaaggacctcnctcacttcacacacacttccaagcttgagc

SEQ ID NO: 1994 - DNA, 101 bp, rice(Oryza sativa)
  misc_feature (71): n=a or c
ccatttatttaagtattttttcagcgaactttactttgtgtaatgtttacatttctaacaaacctgattcnctcaagttatgtttggttttgtattgatga

SEQ ID NO: 1995 - DNA, 101 bp, rice(Oryza sativa)
  misc_feature (71): n=a or g
gatggcaattaaattaaccatgttttcatctaagggagttgtatagcctaattggcagccaaaatgggttnttgaaaatcaaggagtctataggcgtattt

SEQ ID NO: 1996 - DNA, 101 bp, rice(Oryza sativa)
  misc_feature (71): n=a or t
tcactgcaagaccattcacctccatgcacatgatgcactctctaaaaaagttacattctaccagttcattntctcatttgtcatgtgcagaaaattgtttg

SEQ ID NO: 1997 - DNA, 101 bp, rice(Oryza sativa)
  misc_feature (71): n=a or g
aaccaactacaaatcgaacggctgatttaacaccaaagtcgggcaccgggagccacaggcgtggagggacntgcattaaatatcttgctaaacttaaatca

SEQ ID NO: 1998 - DNA, 101 bp, rice(Oryza sativa)
  misc_feature (71): n=a or g
atgcatcaacctagatcaccatcgtgtagttgcctcgagcccctccacgttgatccatcagtcgggacccntcactgaatcagcccctccgcctcgatcca

SEQ ID NO: 1999 - DNA, 101 bp, rice(Oryza sativa)
  misc_feature (71): n=a or g
catacggttggttttaaataaactggcacatgtgagacggtacctagctattagggattctatagtagtgnaaatcattttgaaatacttttaaaaaagaa

SEQ ID NO: 2000 - DNA, 101 bp, rice(Oryza sativa)
  misc_feature (71): n=a or c
cagtgggtatacccttcacactaaaacatcaacaagcccatgtagaataagtctctttgagcttctggttncttccactcacattaattcccaatgcatct

SEQ ID NO: 2001 - DNA, 101 bp, rice(Oryza sativa)
  misc_feature (71): n=t or c
tgggcgatatctttaggagtctggttgtttggccacctggatttccattcttttcttgtttttaccattgnccaaagaaataagtctggaggcactaaaaa

SEQ ID NO: 2002 - DNA, 101 bp, rice(Oryza sativa)
  misc_feature (71): n=a or g
ctgcaggtacagtaagactgagctataagtttattcacaacaatacaatctcacgtggaagggagaagaantgaagagagagcatagatctggcaactaat

SEQ ID NO: 2003 - DNA, 101 bp, rice(Oryza sativa)
  misc_feature (71): n=a or g
tataaaaaaagttacgggagacttacattctccggtatatcttacattagtcaatcgtattatttacggtntcggcactataggtgccggagtaggtaaag

SEQ ID NO: 2004 - DNA, 101 bp, rice(Oryza sativa)
  misc_feature (71): n=a or c
ctcttttaaaactgtacatgtataggttttgttcgaagaaataaaaagagttcaacgtatacagttgagcngtgcagttgtacattgaatatatagaaaac

SEQ ID NO: 2005 - DNA, 101 bp, rice(Oryza sativa)
  misc_feature (71): n=a or g
ttggatatgcttatcccgtctctgacatttcacctctcgctagagacactacgagcattcatgaaaaaacnacgatcaaactcggaatatttttctccctt

SEQ ID NO: 2006 - DNA, 101 bp, rice(Oryza sativa)
  misc_feature (71): n=t or c
gctccatgaagtttcagtctgcaggagaactcggaaagcacgaaaagtttttccatgaagacgaagaaggnaaaagtaatccaatatattgataggaaatg

SEQ ID NO: 2007 - DNA, 101 bp, rice(Oryza sativa)
  misc_feature (71): n=a or g
tcgcgctgagaaggaggaggaggaggaaagcaaagcagggtcgtcggtgatataggcggcgacgggggcgnggacggggggcgcggccgtgcggggcggcg

SEQ ID NO: 2008 - DNA, 101 bp, rice(Oryza sativa)
  misc_feature (71): n=t or c
tgtcgcttaatccgaaattcgtccccgaaccacaatatatatgatgtgtcctcaagtcccaaagctagtgnaaatatgatctcaagacagtttagatgtcg

SEQ ID NO: 2009 - DNA, 101 bp, rice(Oryza sativa)
  misc_feature (71): n=a or g
gggcacgccgcgccgtcatccttcgcggacaagcccagcagtggctacctacatgtttttatgtttttttnataatggaatgaaacatcccggcctttact

SEQ ID NO: 2010 - DNA, 101 bp, rice(Oryza sativa)
  misc_feature (71): n=a or g
tatgacagtaattgaatcagaattatgagattatatatatggtggcattattggttgagggaaagggatgncaggtgggtctaaagagttctttttaattt

SEQ ID NO: 2011 - DNA, 101 bp, rice(Oryza sativa)
  misc_feature (71): n=a or g
atcccctaactcccaaaaccattgcaaattgactacccggacaattttagaggcggtttcgtttgacgtgncagttgactcactgagttattaagtgagac

SEQ ID NO: 2012 - DNA, 101 bp, rice(Oryza sativa)
  misc_feature (71): n=a or t
tgtttagcaatagcaaaggttgaaattcgaagcacaaataagttgggtgtgcacgatgttgtaagttgttnaacagccagaggtaactattccttctatag

SEQ ID NO: 2013 - DNA, 101 bp, rice(Oryza sativa)
  misc_feature (71): n=a or g
aagacgaaaaagatggatgttggcatcttcattgagctattcaagaaatgggaagaagaaaacctagtacnagatactcgatttacaacatgataaatcta

SEQ ID NO: 2014 - DNA, 101 bp, rice(Oryza sativa)
  misc_feature (71): n=a or g
aattaattaaccaaaaagcaaagaattaaacctggacagcatggcatccatatggatgaactgataactcnacaacacagccatacatgtcctctagaaag

SEQ ID NO: 2015 - DNA, 101 bp, rice(Oryza sativa)
  misc_feature (71): n=t or c
tgatttgtaaaacttcttgaatggtgcacatttaatgaaggtcaatgatttgtcacactacttcaagaatngacgacaggctccagatagagcaatttcag

SEQ ID NO: 2016 - DNA, 101 bp, rice(Oryza sativa)
  misc_feature (71): n=a or c
ttttcatttttaatggaatatctcttcaagagtatatagatttgatgttcagagtgtgttcatttagtttnaaaaatatgtccagatgttatatttgagaa

SEQ ID NO: 2017 - DNA, 101 bp, rice(Oryza sativa)
  misc_feature (71): n=t or g
ggggccaaggtgaggaaagcaagctgcacaaaggattaaagttcttgtaaacttgaaactcaatttgagtntttatcctagctaatatgatcccttcatcc

SEQ ID NO: 2018 - DNA, 101 bp, rice(Oryza sativa)
  misc_feature (71): n=a or g
caagaaattctttagttgagctcttgctcactttgaatcatagaagtataactcagacataacttattcantatagaagcaaaaaatgcagcagcaacaat

SEQ ID NO: 2019 - DNA, 101 bp, rice(Oryza sativa)
  misc_feature (71): n=a or g
gcttttctttacctactggcttggctactggttcctccaacaaaaagggagaataaaaagaaaaggactcntagcatagcactatagcagtgctccctcat

SEQ ID NO: 2020 - DNA, 101 bp, rice(Oryza sativa)
  misc_feature (71): n=a or c
gatcacttggaacacgtgtaatgaggtggctcgatcgatctcatggttaggccatcccaaacccaacaaancctccatatcatatagtgtccatagcattt

SEQ ID NO: 2021 - DNA, 101 bp, rice(Oryza sativa)
  misc_feature (71): n=t or c
actaaactactgaaaccatcaaataagttagaaatcataggcaagaactggtatgtcaggaagtgcagacntttgcatgcaattttttttctaaacaaata

SEQ ID NO: 2022 - DNA, 101 bp, rice(Oryza sativa)
  misc_feature (71): n=a or c
ataaaaggaggtccaggcctacttagggagggggagagaagaaaactcggcgagagagaagaaaactcaangagagaggaggaaactccagagaaaactca

SEQ ID NO: 2023 - DNA, 101 bp, rice(Oryza sativa)
  misc_feature (71): n=a or c
agcaactatggtttgctacccatccaacttttttcatgtagataagtgatgtaacctgccattgttagtanaaaacaagaaacaacaaaagagtattatcc

SEQ ID NO: 2024 - DNA, 101 bp, rice(Oryza sativa)
  misc_feature (71): n=t or c
agtaaccggttgagcatatgaaccggaattgatgatatactcatttggctttactttctatgcactaacangagatcggtcatctcaatcgggcggcaagc

SEQ ID NO: 2025 - DNA, 101 bp, rice(Oryza sativa)
  misc_feature (71): n=t or c
ccactatatttttggacatacctagggagcaaaatcccctatacttctgaacaataggagtataagctcanataagttgatatgatttatgataatttaaa

SEQ ID NO: 2026 - DNA, 101 bp, rice(Oryza sativa)
  misc_feature (71): n=t or c
tgtgcataaggaagattgatgcaacaccaccttgtaaagatggtaatagaacttggagttgtagctattgnagatgcttcaattgaaggaaagtaaatgct

SEQ ID NO: 2027 - DNA, 101 bp, rice(Oryza sativa)
  misc_feature (71): n=a or c
caagatttctaagtgaccattacattacaaaattgccccctctttctaatatgtcaatgtgccaagtcagnattgcataccaaaaaaatcaaaataaattt

SEQ ID NO: 2028 - DNA, 101 bp, rice(Oryza sativa)
  misc_feature (71): n=t or c
tatttaaagtactatagataataattgctactgggtaataatgtgacacatttacatatatattgagattnagaagttagtggacatcaactttatactaa

SEQ ID NO: 2029 - DNA, 101 bp, rice(Oryza sativa)
  misc_feature (71): n=t or g
aacggtggtgatattctgggtgacacgtacgccagtcctacgtagcagcagccaaagagcaagtttaatantatagcccattcctagctctaattcatcta

SEQ ID NO: 2030 - DNA, 101 bp, rice(Oryza sativa)
  misc_feature (71): n=t or c
cggggagaagggcaccactactgcgagcttgacatgtgggcgccttgtaggtgacgaagtgtgcctctacngactactgggcctcctctgtcgctgttgtt

SEQ ID NO: 2031 - DNA, 101 bp, rice(Oryza sativa)
  misc_feature (71): n=t or c
tagcggtatcatataatcccccttaacccacccacccactcccaaaaaaatggtagtgcataagtatatgngcaaagtagctttattgtgctcatgtttac

SEQ ID NO: 2032 - DNA, 101 bp, rice(Oryza sativa)
  misc_feature (71): n=a or c
attagcccctcctttccatcattccagatgtgctgcaaacggcttttaaaggtttatgcccgtcgatgtcnatctatacacaacaacatatcgatcgttat

SEQ ID NO: 2033 - DNA, 101 bp, rice(Oryza sativa)
  misc_feature (71): n=a or g
ctcattgtcggtctgtatacgtgctggtgggtgattgcatgcatgcagcaattaacacctccgttctaaantaagtgcaaccgtggatatccatgtccaac

SEQ ID NO: 2034 - DNA, 101 bp, rice(Oryza sativa)
  misc_feature (71): n=t or c
acgagcataagccagaagacagtaaaagagtacagttgagtcacatagtaattggaataaaatcgaaatcnattccaacttgaggaacgatcaaagcttgt

SEQ ID NO: 2035 - DNA, 101 bp, rice(Oryza sativa)
  misc_feature (71): n=t or c
catacatatatattttttcggaaaacgctagcgatcgggcgcccgatcattagcacaaaaatcaggccccngccgcctccgctgtctcccccacgcgcccc

SEQ ID NO: 2036 - DNA, 101 bp, rice(Oryza sativa)
  misc_feature (71): n=a or g
ttctggtgggtggggggagggcgaaataactgaaatttcataattctgttccggaattgcaatccctgatntgacgtggtgggggatgacatgctggcggt

SEQ ID NO: 2037 - DNA, 101 bp, rice(Oryza sativa)
  misc_feature (71): n=t or c
ttagtgtagtatgctgtaaaaaaacactataagaagtatttcacttttcatatgtgtcaacggggataccngtagaccagataaatagggtattggggtac

SEQ ID NO: 2038 - DNA, 101 bp, rice(Oryza sativa)
  misc_feature (71): n=t or c
gggattttagccatttcctcggctcatcccattgctcaaatttagctatcaatgttttgagaataatctanattgaataagctggattattataataagtt

SEQ ID NO: 2039 - DNA, 101 bp, rice(Oryza sativa)
  misc_feature (71): n=a or g
gcctccgcctcctcctgcggggagtggttgttcccgaaaccgtcagtacatggagagagaacagcgaggancagcgcagagcgcgcggcgtggtgcttgct

SEQ ID NO: 2040 - DNA, 101 bp, rice(Oryza sativa)
  misc_feature (71): n=a or g
ggggtgactcaaaactttctattcgctcaaactcgaggtctttttttaattttttggacgaatgcactcgngttctaaacaagccgaattgagctgtctat

SEQ ID NO: 2041 - DNA, 101 bp, rice(Oryza sativa)
  misc_feature (71): n=t or c
gtggtattgacgtggcacatgcgtagggcccacgtgttagttacactagaaaataataaaaagaaaaccangtcaatgccacataggacaaaaacgtagtc

SEQ ID NO: 2042 - DNA, 101 bp, rice(Oryza sativa)
  misc_feature (71): n=c or g
taccccaagaggaaacggcctcagcaggcatcgtctttgcttgcccatggttgtttaaggagacgactccnggtcgggcatccgatcgggagggggccgac

SEQ ID NO: 2043 - DNA, 101 bp, rice(Oryza sativa)
  misc_feature (71): n=t or g
accagacgacgtaaagagctgcagctcccgtgctagaaccttgtgtggtcaaaagttaaatactccctacntactcgtaaagtcgtttcggatagacacac

SEQ ID NO: 2044 - DNA, 101 bp, rice(Oryza sativa)
  misc_feature (71): n=t or g
agatgttgatgtgagtcctgctttctttgcgagccatgcagcagtatatgattcccctgaccaggaataanttcctcctagattacaaaggaaagatgctg

SEQ ID NO: 2045 - DNA, 101 bp, rice(Oryza sativa)
  misc_feature (71): n=a or g
atgaagtacttttctagtgaccaatttagcagtgttgctttcacatatcaacctttggttatatttacagnaaaaaaaaaggtttcatgaagtatttttag

SEQ ID NO: 2046 - DNA, 101 bp, rice(Oryza sativa)
  misc_feature (71): n=a or g
gtactttgtagcatggtataagattagtttatgagatagtgtatggctgttgattctcctgccttttcggnactgattcactgccggctacttgcctgcct

SEQ ID NO: 2047 - DNA, 101 bp, rice(Oryza sativa)
  misc_feature (71): n=t or c
ttttaaacgacatactcagaatgaggggatgttcacttgtgaggtacaggcaaaatccactccagtacatntagctaattcatagttagtgtcatcaaaga

SEQ ID NO: 2048 - DNA, 101 bp, rice(Oryza sativa)
  misc_feature (71): n=a or g
ataccaacttcaatattatcctaggagtcattttgtaatggtgttaacagttggagaagttattataaccngttttgtgtttaagggatacaaatcagatc

SEQ ID NO: 2049 - DNA, 101 bp, rice(Oryza sativa)
  misc_feature (71): n=t or g
agtgacgaggacgaggggttacggtcactcatttcttaacttagggcatatttttcatataagcatatttntctcggaaataataaccgaaaactgaataa

SEQ ID NO: 2050 - DNA, 101 bp, rice(Oryza sativa)
  misc_feature (71): n=a or c
ttctcggaaagttttgaccggcgctcgtgacgagcgattgggcgaaacgcgctcgcggagaacagaacagnccccccccccccccacccggatgctcgggc

SEQ ID NO: 2051 - DNA, 101 bp, rice(Oryza sativa)
  misc_feature (71): n=a or g
tccaaatttcttgtatgctcatccaaccagtcattgccatttacgtactaagcaacaggcaaaaaaaaaanaaaagaaaaaagaaggcataagaatgctgg

SEQ ID NO: 2052 - DNA, 101 bp, rice(Oryza sativa)
  misc_feature (71): n=a or g
ctcttaagaaattgacatacaaaggggttggcgctaaagtggatacgtctgttcctgtctctgagccatcngccattcaacttgaaggagctgaattatgg

SEQ ID NO: 2053 - DNA, 101 bp, rice(Oryza sativa)
  misc_feature (71): n=t or c
cttcgaggttcgtgccattcgtcccacatctcaaaggtattccattgtattttgctactccactcattttntaccacccgtatatggaacaaaatgtcatt

SEQ ID NO: 2054 - DNA, 101 bp, rice(Oryza sativa)
  misc_feature (71): n=t or c
acataccacagggcggttgatgtcttcaaccatcccaacctacaccgccgccgccagtgcctccctccacngccgccatatatatcctcaaattgtttgta

SEQ ID NO: 2055 - DNA, 101 bp, rice(Oryza sativa)
  misc_feature (71): n=a or g
tggctcggaggcggcgtcgatggctgattggttgtaggtcgcgtgggccgatttttctgcaacatgggcgnagtctaatcgctatgctcgctcgactccgt

SEQ ID NO: 2056 - DNA, 101 bp, rice(Oryza sativa)
  misc_feature (71): n=t or c
ctctagcctcactaaatttctattgaacttttttcttgcgtggtagtcttataaggtacttcctccgtttnacaatgtaagtcattctagcattacccata

SEQ ID NO: 2057 - DNA, 101 bp, rice(Oryza sativa)
  misc_feature (71): n=t or c
caagggcgatgaactactaaactgtgtggtcaacgacttaagtcttccctacttaatactccctccgtttnaaaatatttgacaccgttgattttttagta

SEQ ID NO: 2058 - DNA, 101 bp, rice(Oryza sativa)
  misc_feature (71): n=a or c
gggtgccaaatagactaaagaacttcaaaagccactacaaaatgcaatgtggcctaaaaccgagtcatttntgtttgaagacacacatgtggcatggccta

SEQ ID NO: 2059 - DNA, 101 bp, rice(Oryza sativa)
  misc_feature (71): n=c or g
gctaaactctagaagcttccgctcttcacatttcgtttctccctcaggccggagaaaaacagaggctgggntagattcatagaattagcactgatttcatt

SEQ ID NO: 2060 - DNA, 101 bp, rice(Oryza sativa)
  misc_feature (71): n=a or g
ttatattatagtagaatggtgtgatgattcattagctttgtctttttttgtcagttttgttactctgaaanttggtgctgattgccaacctgacaggataa

SEQ ID NO: 2061 - DNA, 101 bp, rice(Oryza sativa)
  misc_feature (71): n=a or g
agtgggtgtctcggcccaaatagccgccaacgacctcgaggatttgggggacgggcgcaagagagaggggnaaaggggtggaagaggaaatcctcgctagg

SEQ ID NO: 2062 - DNA, 101 bp, rice(Oryza sativa)
  misc_feature (71): n=t or c
gttatacttcatttatccttaagaagatactaagcgcattataatcataagatactcctgcactgccaggnagccacaaactgcctctttgcctcatcaaa

SEQ ID NO: 2063 - DNA, 101 bp, rice(Oryza sativa)
  misc_feature (71): n=t or c
acttaaattaatcgtgtgttaatggctcatctcgttatgtatcttctcagtatttttcttttgggtcaacngtacatttgacctattttaaagttgcggta

SEQ ID NO: 2064 - DNA, 101 bp, rice(Oryza sativa)
  misc_feature (71): n=t or c
tcactaattgctaaaggatacctttacgaggggttctcactactagaaaaatcaagtttcatagtgttacncttttatttttattgataggtttgataaaa

SEQ ID NO: 2065 - DNA, 101 bp, rice(Oryza sativa)
  misc_feature (71): n=a or g
tggttagggaggagatataaagctacattattctctgctatccaaagcagagatggttgtgacaaaccatntggtgttgtagtttttaattggataactct

SEQ ID NO: 2066 - DNA, 101 bp, rice(Oryza sativa)
  misc_feature (71): n=t or c
ggagagcaagaggagataaggtggagagagaagatgatgtcctaaactgcttagttgatggaagcattcgncggcgcgaatggccgacgcgaacagtcatg

SEQ ID NO: 2067 - DNA, 101 bp, rice(Oryza sativa)
  misc_feature (71): n=a or g
accggcaagggtgtttgcattgtatacggtctgttggtcatatgataaaaaagaaattactccaaatgagnagcacacatttgagctggactatttgttat

SEQ ID NO: 2068 - DNA, 101 bp, rice(Oryza sativa)
  misc_feature (71): n=t or c
gagcatctccaccccatgcgtttgccactaaccgactctacagttttgagggccctaggcgaatttgactntataggtcctaagtatctttttactggtaa

SEQ ID NO: 2069 - DNA, 101 bp, rice(Oryza sativa)
  misc_feature (71): n=t or g
gaaaaggctccacggccaacccgtgaatcttagcctaggttacatttgggccacacagaatcccagacccntagattaggaataagttcactttaggttct

SEQ ID NO: 2070 - DNA, 101 bp, rice(Oryza sativa)
  misc_feature (71): n=t or c
cattgctacagtaatggatctatagtgtgcagaagtaaaccgaagtactctggctatactacggcggtatntgaatatcttaaagatttcaagtagaatga

SEQ ID NO: 2071 - DNA, 101 bp, rice(Oryza sativa)
  misc_feature (71): n=a or g
cttgctcctatgaggcagagaccacctcttggaagaattggcaatcacattccacctaaggctcctcttanactgaggctcagtaaagcacccacaattca

SEQ ID NO: 2072 - DNA, 101 bp, rice(Oryza sativa)
  misc_feature (71): n=t or c
cataaatagaactgacctaggccagattttttctaagtccttaatctccctcacctctcctctcccgtgtncctccccttccccctcccctcatctctcct

SEQ ID NO: 2073 - DNA, 101 bp, rice(Oryza sativa)
  misc_feature (71): n=a or g
actatacgacccccccctactactgagtaatctaagagggattacataattctagtaaaagtgaatacatnagatatgtggagggggaattaaatttgaaa

SEQ ID NO: 2074 - DNA, 101 bp, rice(Oryza sativa)
  misc_feature (71): n=a or g
gggcggttgcactccctactgtgctactgtgctggtgcgtagtgtagatcaacctgcagatgccggtgccngcctcgcgcgatctcgatcgagtgcatgtc

SEQ ID NO: 2075 - DNA, 101 bp, rice(Oryza sativa)
  misc_feature (71): n=t or c
cggactccgagcccgccgccacttctgccggcgtcctttgccgtggtcagagaggatatcatcttccgccnagactcctaggcctccgccgcccctagggc

SEQ ID NO: 2076 - DNA, 101 bp, rice(Oryza sativa)
  misc_feature (71): n=t or c
tgcaattctaatggatatttagacttaagagtagggttgcagccctagcagtcttctcccatctctacccntggttatacagattcttgttaatcataaat

SEQ ID NO: 2077 - DNA, 101 bp, rice(Oryza sativa)
  misc_feature (71): n=t or c
acttagagtgttaatcttaacgagccaaaacgctagctcggctcgactgactatctagcttgttaatgagntctatctcatttacatcaacctttataatt

SEQ ID NO: 2078 - DNA, 101 bp, rice(Oryza sativa)
  misc_feature (71): n=a or c
ctttttttcctctcttcttttcacatcgtcatgtttcatgttagtgatgctttctttaccttgccaccccnacacgcatgtaacgaatgactactcggccg

SEQ ID NO: 2079 - DNA, 101 bp, rice(Oryza sativa)
  misc_feature (71): n=t or c
attgaccttcattaacagctttctcccagagaattcaactggatggtgaattgggcccgaacaattagtgnctattcactttgatgctaaaaaaaacctta

SEQ ID NO: 2080 - DNA, 101 bp, rice(Oryza sativa)
  misc_feature (71): n=a or g
ttccttctccagcttgagcgagtttcaacaagttagtgttgggggttgagataggggtggaaggagggagngatggtggttccctagccctaggtagatgg

SEQ ID NO: 2081 - DNA, 101 bp, rice(Oryza sativa)
  misc_feature (71): n=t or g
cctcgtcgtggtggggcccgccggcttggctccagcttggcttggctcggctctatttggctcgatttttngggtgtcagtttttaattaaccgacaccta

SEQ ID NO: 2082 - DNA, 101 bp, rice(Oryza sativa)
  misc_feature (71): n=t or c
ccatcatacctcagtatcagcagcagtacttgtgaagttgtgattcgtcacggtatgcacactcgacgtangtaccgagagtacgagacacggcaggcagg

SEQ ID NO: 2083 - DNA, 101 bp, rice(Oryza sativa)
  misc_feature (71): n=a or g
tttaaaaaatatctaggcccacatgtcacctcttttctcaagcaaggcgtccctaatccccattccccctncttcctgctctctctctttcatgatgtcat

SEQ ID NO: 2084 - DNA, 101 bp, rice(Oryza sativa)
  misc_feature (71): n=t or g
ggatgaaacagctcagactaaattgtcttctttttttcctacagaagctgtttcttcagaactgcagaatntaacaaatttcaccctttgttttgataatt

SEQ ID NO: 2085 - DNA, 101 bp, rice(Oryza sativa)
  misc_feature (71): n=a or g
gacaagtgagtcccgctcacacaaatgcatcactgtgatattccggaggcggctacgtgtgcaaatcgtcngacggtgttgcaccatattgttgagggatg

SEQ ID NO: 2086 - DNA, 101 bp, rice(Oryza sativa)
  misc_feature (71): n=t or c
gtcttcattattggatggcgcgcgggttataattgagggaagaatgaaggggattctggtttcggtggttngaggaacgtgcactactgaaaaaccgatct

SEQ ID NO: 2087 - DNA, 101 bp, rice(Oryza sativa)
  misc_feature (71): n=t or c
gattaatatctttgattttcggtgtatgacgctattaactttaggcatacatttaacatatttaaattttnttatatagatatccaaaataagtcatgttt

SEQ ID NO: 2088 - DNA, 101 bp, rice(Oryza sativa)
  misc_feature (71): n=a or g
tttgatttggattcataggggtgtccctaatgttaatattaatacactttccaagacagttggagaatggngatcaaccatggactgaagtttaatttcag

SEQ ID NO: 2089 - DNA, 101 bp, rice(Oryza sativa)
  misc_feature (71): n=t or g
gtgtagtgttcccgctacacgatagtgttgtgccgctaaaataacgaaggaaacattgtgggcgctatgtncgaaataatggccctatttggtaatgtact

SEQ ID NO: 2090 - DNA, 101 bp, rice(Oryza sativa)
  misc_feature (71): n=a or c
tttgttttgttatagaagaaacgtctttttgcgtttgttatttggtcgtgggtgtatatatatttgtagtncttttatgttttcgctactccctccatact

SEQ ID NO: 2091 - DNA, 101 bp, rice(Oryza sativa)
  misc_feature (71): n=t or c
cgggataaataatttatacgttgcgcggagcttttcgtctcgctccggggaggatgacaggtggggcccanctcgccggggaggcttgacggcgacgtagg

SEQ ID NO: 2092 - DNA, 101 bp, rice(Oryza sativa)
  misc_feature (71): n=a or g
aaagggacatgagcaagattcagccagaaaagtgaccggaggaagaaggggatcatgatggaagagagagngggggggggaaatagaggagagggtggcac

SEQ ID NO: 2093 - DNA, 101 bp, rice(Oryza sativa)
  misc_feature (71): n=t or c
tggccacacggtcttgaccaccatgaacacctccacaaaaagacggcctaggtgcaagacgttgtctcacngatcggcgccccgtctccacctggattgat

SEQ ID NO: 2094 - DNA, 101 bp, rice(Oryza sativa)
  misc_feature (71): n=a or g
tgggctttttttggttaattggattcacgccatttgcaaatttacctattcaaaaaaggcattacaattcntatattcgtagctgtgttattgtcatcacg

SEQ ID NO: 2095 - DNA, 101 bp, rice(Oryza sativa)
  misc_feature (71): n=a or g
tggaggtgaaggctggtgcatgtggtctacaggttcggaaggagaggtacggcctggtggtggcggtgacnagctcggggcatcgcgagtagatctggcat

SEQ ID NO: 2096 - DNA, 101 bp, rice(Oryza sativa)
  misc_feature (71): n=t or c
ccgtttgccatatgtgtttctactcatatgtgcacggatatcccttttcccaacccttcttccttgttttncacgcacacgcttttcaaactgataaacga

SEQ ID NO: 2097 - DNA, 101 bp, rice(Oryza sativa)
  misc_feature (71): n=a or g
tgagaatataagcaaaacgggtgtgcttgagagaatgaaaaatgaagattaaaaagttacgcaaaacgagntaaaccgttagcatataattagtgaaaaaa

SEQ ID NO: 2098 - DNA, 101 bp, rice(Oryza sativa)
  misc_feature (71): n=t or g
tagccatggcctctcaccttcaccttaatggtgactcttgtgagaaattactactgctagacggcttttangacggacagattagctttcagattaggcac

SEQ ID NO: 2099 - DNA, 101 bp, rice(Oryza sativa)
  misc_feature (71): n=a or c
aataaaggggttgcaaaccggaactaaagtcccacttctccagtagtgtgcccgagctagctaaaaagctntgtatataaacgcaccaagacgagggagga

SEQ ID NO: 2100 - DNA, 101 bp, rice(Oryza sativa)
  misc_feature (71): n=t or c
caaagaaaagcgaagggacaaagaacgaaattgttccacctgaattatagggaagtaatgctctttactangctcgcatctacaagccactctccagtctc

SEQ ID NO: 2101 - DNA, 101 bp, rice(Oryza sativa)
  misc_feature (71): n=a or g
ggtaataatcataccagttgttcgaccgctagcatacaaggatagaacagcctggattgcgacatacattnctgggcaattgaaggtctcaaacatgatct

SEQ ID NO: 2102 - DNA, 101 bp, rice(Oryza sativa)
  misc_feature (71): n=t or g
caagttgagggaccttcggtgtactttttccgaggaccagctgcaccatgttgtatttttgtagttactanaacccgtacgttgcaatggctaaaatcatt

SEQ ID NO: 2103 - DNA, 101 bp, rice(Oryza sativa)
  misc_feature (71): n=t or c
actccatctcaaaatataagtattctagctataaatctagatagtagattcattgttaaaagttattactntcttcgtttcaggttataagacgttttgac

SEQ ID NO: 2104 - DNA, 101 bp, rice(Oryza sativa)
  misc_feature (71): n=c or g
acggcaatcacttaatccatcgatttcatctatgttgccacagtatcattcgatgcttcgatcgatcactntgtgtgtgtgtgtgtgtgtgtgggtgtgtg

SEQ ID NO: 2105 - DNA, 101 bp, rice(Oryza sativa)
  misc_feature (71): n=a or g
attaactaaacaaacaaaggttagttgagctcgagagcatcatgtgcatttctctctcatctatgcacacncagagagagaaagagagagtctctctcgct

SEQ ID NO: 2106 - DNA, 101 bp, rice(Oryza sativa)
  misc_feature (71): n=a or g
tataaatattaaaaaagtatgttaaaatgataggagaaaagttcttattggttcataagagaaaaaatagntaaaaaaattaaatgaacaatggttgtgat

SEQ ID NO: 2107 - DNA, 101 bp, rice(Oryza sativa)
  misc_feature (71): n=a or c
tcggctccgccgcctcctgtgacgacctcctgtcgcgattcatgggctccatcaacgacgacaagtacctncgcgacatcgtcgtgagcttcatgctcgcc

SEQ ID NO: 2108 - DNA, 101 bp, rice(Oryza sativa)
  misc_feature (71): n=a or g
ttccctagcgtcctccgggatccaccatgactcggaatgtgtgccttgcattatctcttcgggtgtgtttngaaaatgggttaggagaggtgggattggga

SEQ ID NO: 2109 - DNA, 101 bp, rice(Oryza sativa)
  misc_feature (71): n=t or c
caaatgcaaagaaaaacaggacacctctggctgaacctactataatttcttcgaacaaaggaagaaatcgnctccaagccgctgctgaaagaacagaagaa

SEQ ID NO: 2110 - DNA, 101 bp, rice(Oryza sativa)
  misc_feature (71): n=t or c
acttattacaccatttacccagtgacaaaatccccattggtcattttagcactcatagtacttggacacangctgggctatggtacaacgcgcccatatgc

SEQ ID NO: 2111 - DNA, 101 bp, rice(Oryza sativa)
  misc_feature (71): n=a or g
tccaatatagccaaggcctgtatctgaaagtccccctggtctcaagtatagagcaaacctccgaagtttcntgcagcccctcagcagtgcacggacaccat

SEQ ID NO: 2112 - DNA, 101 bp, rice(Oryza sativa)
  misc_feature (71): n=a or g
tggaccaatatattctctacacattatgtaacaatccatgcacgtgttgtagggttgtcaaaaaagctcgnggctcgcgagctgctcgagttcgactcgtc

SEQ ID NO: 2113 - DNA, 101 bp, rice(Oryza sativa)
  misc_feature (71): n=a or g
ctttcacgatatcatgcgaaggtattcgtttggtcggttggaaatcctttgggacgtaaaccaaactaaantttagaaaggtatatcatgttgtcaagtaa

SEQ ID NO: 2114 - DNA, 101 bp, rice(Oryza sativa)
  misc_feature (71): n=t or c
gtgtttttgactgtggtcaatatgccatgtcaaccaatattattctcaatattgtcgtaggagtaattttntactggttttaatagttgaaatagctgtta

SEQ ID NO: 2115 - DNA, 101 bp, rice(Oryza sativa)
  misc_feature (71): n=a or g
gactatatggttccacgcgcagtagttcagaatgaattttggagggttttgtcctcctttcttctgttttnggtgtgtttagttcctgaaaaaagatagaa

SEQ ID NO: 2116 - DNA, 101 bp, rice(Oryza sativa)
  misc_feature (71): n=a or c
atatatccttgcatctgtggccatgtgtatcctactccctgaatcctcttctgtaaattccaaaccatctngcgtgctcgcctgcctttctctgaatgatt

SEQ ID NO: 2117 - DNA, 101 bp, rice(Oryza sativa)
  misc_feature (71): n=a or c
aaaaaaaatttgcagggataatgtacacgatcatgcggcagataaggaattacggaagcacactacggccntgtttagatcctccaaaatagcaaaagttt

SEQ ID NO: 2118 - DNA, 101 bp, rice(Oryza sativa)
  misc_feature (71): n=a or g
tcagactctacctttatacatgcccttatagcatttcacagaaagccagatcatttttcgttggctggccnggttacgatcacacgaccactccgcagaat

SEQ ID NO: 2119 - DNA, 101 bp, rice(Oryza sativa)
  misc_feature (71): n=t or c
ggtatcaaattttacactataaaatatgttacctccaaataactcttaaggatataaaattatcctattgntatataaaaatgctgaaaatggtcagctca

SEQ ID NO: 2120 - DNA, 101 bp, rice(Oryza sativa)
  misc_feature (71): n=a or g
tgtaacactatactcacacctccgcgaatatgccttgtaacacatatttaagagacggaaccaatggcacnttcctgatctcattaaaattatattgaatg

SEQ ID NO: 2121 - DNA, 101 bp, rice(Oryza sativa)
  misc_feature (71): n=a or g
ttttttagacggagggagtatgtgttatgctaaagatgagagtgttggtcttctgtgtttattaggccatntttctttcagcttgggattattataatcca

SEQ ID NO: 2122 - DNA, 101 bp, rice(Oryza sativa)
  misc_feature (71): n=a or g
cattagaaatactactgagtatatcctttaaagaaaaagactgagtatactactctaacaagaaaaaattncgattttgctataaatctgttgacaaattc

SEQ ID NO: 2123 - DNA, 101 bp, rice(Oryza sativa)
  misc_feature (71): n=a or c
ccaaccggcccggcctctcggtccatttgctctcgtctgcctctccgaccacgaccagagctcgcctcgcnctcgccgattaccagttcaccacgcccgcg

SEQ ID NO: 2124 - DNA, 101 bp, rice(Oryza sativa)
  misc_feature (71): n=a or g
gggtgaaagagagaaacaaactttccctttttctgaggatagagaaacgaattctgtggaactatttttcnccactttaaccagaatttttttataacttt

SEQ ID NO: 2125 - DNA, 101 bp, rice(Oryza sativa)
  misc_feature (71): n=a or c
atcaacagtggaaactgcttgctcctactgtcgtgcagcaggatgcggacgtcgaaacccagatctcttcnaaaaaaaaaaaaaagcaaacatcacggagc

SEQ ID NO: 2126 - DNA, 101 bp, rice(Oryza sativa)
  misc_feature (71): n=a or g
aagtgcataatatctaaagtgaattggattcaacaggatgtgcaaagcacgcatgatgctgagttaggctncacctttaagagcaatgggccaggaagagc

SEQ ID NO: 2127 - DNA, 101 bp, rice(Oryza sativa)
  misc_feature (71): n=t or c
tggatacttttgtagccaaggttgaaacaggaagcatttaggagtagatgtaaagccaaaggatgctgatntctctctctctctctctctctctctctctc

SEQ ID NO: 2128 - DNA, 101 bp, rice(Oryza sativa)
  misc_feature (71): n=t or c
ctgcctctcttcctagtttccagagccacacctcgacaagcttctctacctctgtctctacctcaatctcnagcaccgcatgtcgagatgaggtcacctga

SEQ ID NO: 2129 - DNA, 101 bp, rice(Oryza sativa)
  misc_feature (71): n=t or g
gggttgaggggggtggagggatttgtggatctgcgggtaggttggggtgggggcatgttgttggaggtttnggggggtgtagatctaggtaaagttacagc

SEQ ID NO: 2130 - DNA, 101 bp, rice(Oryza sativa)
  misc_feature (71): n=t or c
tcaaacatcaacaagcaaaagttgcattgtaataacatatattatgaacgactttattaataaggtgctangatgggtagtatccatcctaaaatataata

SEQ ID NO: 2131 - DNA, 101 bp, rice(Oryza sativa)
  misc_feature (71): n=a or g
tatggttcgagtatttctttaataaaaaacaaatagtacaaatgcaaatgcaaaagctcaccttataaacncacacacgtcctatttccatgagtacctgc

SEQ ID NO: 2132 - DNA, 101 bp, rice(Oryza sativa)
  misc_feature (71): n=t or c
cctccccggccgccaaaccgccgagaatccctcgaaaatccacgcagaattatcgttgacgcgcacgccancgtacgcccgcaccgcccccgcccacccat

SEQ ID NO: 2133 - DNA, 101 bp, rice(Oryza sativa)
  misc_feature (71): n=a or g
tggttatcgatgcctcgcataaataatcacaatacacgtcatcacttacgtttcacgcacgaccaacttgnctgtagcaagctactccttgctaggacaag

SEQ ID NO: 2134 - DNA, 101 bp, rice(Oryza sativa)
  misc_feature (71): n=t or c
agggcaccttgacttaagctgaactgtattaaaaattagagaacgttgaaaaggatcataccatatagggnctggtatagggtcttgtttagttcctaaat

SEQ ID NO: 2135 - DNA, 101 bp, rice(Oryza sativa)
  misc_feature (71): n=a or c
ttgtttttttcttggaatttctataatttgttagagcgccacgtgatggtatgggagtgtttctaggagcnatgtagcggtttaggagcgtttgtagaaag

SEQ ID NO: 2136 - DNA, 101 bp, rice(Oryza sativa)
  misc_feature (71): n=a or c
aaccaaagttcacatcgtctccacctactgaaggggtacacctcagccagctagctgcgctgcccaatctntcgatccccaatggcgaggcgcctgccaaa

SEQ ID NO: 2137 - DNA, 101 bp, rice(Oryza sativa)
  misc_feature (71): n=t or c
agaatcgacaataatttatgggcaacacttttaatgggtcgtcatcctgaatatccaccaaaccttgatantaagggcatgtacatagataattaatagga

SEQ ID NO: 2138 - DNA, 101 bp, rice(Oryza sativa)
  misc_feature (71): n=t or g
tttttctattactttattaatataatagatagattaattttacatggtacattaaagtatgttctcccaanattatcataaaaattcatattacttgtgta

SEQ ID NO: 2139 - DNA, 101 bp, rice(Oryza sativa)
  misc_feature (71): n=t or c
tggtgtatgacatcctccagaagtcgcccagcaatggtgttagtacaggtcgtcgccactgcaatctgctnccccatgcgccagaatgcatgaacgcgtgg

SEQ ID NO: 2140 - DNA, 101 bp, rice(Oryza sativa)
  misc_feature (71): n=a or c
tcttagttaggaggcttcttgggaggatatgcttgtgctcgtttgttttcctcttgttttggggaccaatntcgaaatagcgcttctttgtgcgtctagct

SEQ ID NO: 2141 - DNA, 101 bp, rice(Oryza sativa)
  misc_feature (71): n=t or c
ccgattgagtcgtccgcgtacaacaccctctcttcgtttttttttctccttccttcaaaaaatcttctcgngtcagccgccgtcgcgccggaccgatcgac

SEQ ID NO: 2142 - DNA, 101 bp, rice(Oryza sativa)
  misc_feature (71): n=t or c
cctccaaggtatatatataaatctctctagggttcttccaaatcccctcaaccaaattacccacaaccgcngctgccgcggacagtgtctccatgctcaac

SEQ ID NO: 2143 - DNA, 101 bp, rice(Oryza sativa)
  misc_feature (71): n=a or c
tataaataatctgaagctacacgactggcgtttgttatattaagagcaacaatgcaaagatatgtagggcnaccgatccacagtatcttcgcatcaggata

SEQ ID NO: 2144 - DNA, 101 bp, rice(Oryza sativa)
  misc_feature (71): n=t or c
ctggtgcgggcgtcgctgagctcgctcttgccggacaggttatcagccaccgctgacctcttgagctccgntctcgcctaaaaaaaaacataaatcctcta

SEQ ID NO: 2145 - DNA, 101 bp, rice(Oryza sativa)
  misc_feature (71): n=a or g
ttagtttttgcagaggaaaatctggggttcagttgaaccctaatgcccccaggttaggtcagcctcgctgngtatcgcggctgctgaggttacttggagag

SEQ ID NO: 2146 - DNA, 101 bp, rice(Oryza sativa)
  misc_feature (71): n=t or c
catcttcaactccctcctcctacgcttccttcgttcacttctggttgattttgccttgccatctgcatccncctgttcattcggcagctccttctctggtt

SEQ ID NO: 2147 - DNA, 101 bp, rice(Oryza sativa)
  misc_feature (71): n=a or g
agcagatattgccagttgaccacccttgtaggatcaaagaataaaaagtatatcactcagataaaaaaacntgaatattaagaaatgatctaatatcaaat

SEQ ID NO: 2148 - DNA, 101 bp, rice(Oryza sativa)
  misc_feature (71): n=a or g
cagagagggaaacgggaggaagaacgaatcgggaaaggttggctatgatgatgtcatctactatatgattntgtgcgtgagatcgttgtcttctactccgg

SEQ ID NO: 2149 - DNA, 101 bp, rice(Oryza sativa)
  misc_feature (71): n=a or g
cttaactcttagtggcagaaaggagtgcagtttgtagcgaaaataattatgagcctctaaaccgaatactnataagttactgagagttaaatagctatata

SEQ ID NO: 2150 - DNA, 101 bp, rice(Oryza sativa)
  misc_feature (71): n=t or g
catcatatcccgtcttagcagctaaaacctgggaggaaaatccacatgagggacataattaaaaagtgatnagcaatgctccggtgctttctacttggagt

SEQ ID NO: 2151 - DNA, 101 bp, rice(Oryza sativa)
  misc_feature (71): n=t or c
attttgcatggtacgacgctgtgatgaatccgagcaaacaccaagatggtttaaccttcttgcgtaaaatnaatgtgtgaagtatgaatagacccttttat

SEQ ID NO: 2152 - DNA, 101 bp, rice(Oryza sativa)
  misc_feature (71): n=a or c
tattataatcatgtgatgccgaaagaaaaatggaaagtgaggcagatggaaccccatgtttcttgtggccnaaacctcttactttgcgctgtactacccta

SEQ ID NO: 2153 - DNA, 101 bp, rice(Oryza sativa)
  misc_feature (71): n=a or g
catcaccatggtatggggagttgatttcccctgcttagcgcgggcgaaggtggcctggcatcggcggtccnaggtcgacacggcggtggggcctaatcaac

SEQ ID NO: 2154 - DNA, 101 bp, rice(Oryza sativa)
  misc_feature (71): n=a or c
ccatgaattaattgcaattatttgaagacagaataatcttcaaatcttcagactaatttagagagtggganagacaaatgaatccctgcaaagataactcc

SEQ ID NO: 2155 - DNA, 101 bp, rice(Oryza sativa)
  misc_feature (71): n=t or c
cttaccaagtgattgagtcagtgatgaacaaacagcttagcttgtaggtggctaggtgcacccggggggcnccacagtgtggcttagtcgagagcccgaga

SEQ ID NO: 2156 - DNA, 101 bp, rice(Oryza sativa)
  misc_feature (71): n=t or c
ttagttcaaactgtaattttttatagctcaattgtaggtagagacgttagtggtggtgttcaccactgttnagttgagttgttgccgtatcttttttcttt

SEQ ID NO: 2157 - DNA, 101 bp, rice(Oryza sativa)
  misc_feature (71): n=a or g
cctcgatttctccctctcgggcgtggagtccttgcaagatttcagatttgggaggaatgattgcgaggagnaggaggagggatttgggggaagattttatc

SEQ ID NO: 2158 - DNA, 101 bp, rice(Oryza sativa)
  misc_feature (71): n=t or c
ccctgtccccaccttctccatcacgacaacctccactccgcttcttccccgtcactggatcccaccccttnccccctcccccgactatccgatgcgctgcc

SEQ ID NO: 2159 - DNA, 101 bp, rice(Oryza sativa)
  misc_feature (71): n=t or c
cctaaccaagacagcgttgtgttttcctttcgtttttcttttccacctttcaagacagcgttgctaatacnctcctcatcctccatgacagcaggtacaac

SEQ ID NO: 2160 - DNA, 101 bp, rice(Oryza sativa)
  misc_feature (71): n=a or c
acgagccaaactaattggtagttgtttaacgaagaaactagttttacgtaattggcaatacgagatgcagncaatgcagtggtaagaggtgtgtggtttca

SEQ ID NO: 2161 - DNA, 101 bp, rice(Oryza sativa)
  misc_feature (71): n=a or c
tgagtttaccatgaccgtaattaatttatatggacaactatatcaaaggtaaaattagggtcctaatttgnatgttgtcccggggcaccaaaattgtgtag

SEQ ID NO: 2162 - DNA, 101 bp, rice(Oryza sativa)
  misc_feature (71): n=a or g
gctgagttgaatgctgcaagcttgcaacacaacatgtaaaacttggaagtggatttttatccctcgagagnacatcacatatgttttgtgcatgtcgttca

SEQ ID NO: 2163 - DNA, 101 bp, rice(Oryza sativa)
  misc_feature (71): n=a or g
ccgttgacttcactcgtcaaggtggcttcaaccgctgtcgattccttccacagctttcatacacacacacncactctatctctctctctctcctcttccca

SEQ ID NO: 2164 - DNA, 101 bp, rice(Oryza sativa)
  misc_feature (71): n=a or c
ggcgaacaagtaagacgtgatcattaccgtgcagcaaacgcatgcgcttttcccttttttttttcatggcncagtttttttttcctgctaagtgtgtatac

SEQ ID NO: 2165 - DNA, 101 bp, rice(Oryza sativa)
  misc_feature (71): n=t or g
ggagcatcaccgcagcagcagcttgcgaatcgaagcaacgggaagggagtgtcgggagggggccactcacnggggcatcggggaggtggtcgacgaggtgc

SEQ ID NO: 2166 - DNA, 101 bp, rice(Oryza sativa)
  misc_feature (71): n=t or c
cctcactacaccacatatgttcatgtcaatagtaaataatttatagagatatatgaactagaaaggtggcncgcgcctatgtgcgagcatttatattgttg

SEQ ID NO: 2167 - DNA, 101 bp, rice(Oryza sativa)
  misc_feature (71): n=t or c
aaactataaaacaagtataaaactaacaggcatagaggaaaaatcacatactgcatctcttactacaatangagggtaaccattgtggttgcacaggtcta

SEQ ID NO: 2168 - DNA, 101 bp, rice(Oryza sativa)
  misc_feature (71): n=c or g
atcgggattctccgcatcatcctccgccatcgccacgacaacggcatcaccgctgtgcggaaacaggctcnccagcttctccgccaaggtcgcaagctcaa

SEQ ID NO: 2169 - DNA, 101 bp, rice(Oryza sativa)
  misc_feature (71): n=a or c
gtttaatgtttgtgataagctgttttaggacaatcgtgtctagttctatgttgaaggggatttttgttccntatcgaaatacaggattaatctgggaattg

SEQ ID NO: 2170 - DNA, 101 bp, rice(Oryza sativa)
  misc_feature (71): n=t or g
taccatggctgaggatttgctgtgtacacagcgcaagaggcggcttctacggtcttggatttgccgcggtngccgattccgccgccagcgctgatactgac

SEQ ID NO: 2171 - DNA, 101 bp, rice(Oryza sativa)
  misc_feature (71): n=t or g
gctatatgtcaggacaatgtacacaatacagtgcaacgaagagggccatggaagcacggagcaaagaagcngcttaccacgggcttggacctgccgccgag

SEQ ID NO: 2172 - DNA, 101 bp, rice(Oryza sativa)
  misc_feature (71): n=t or c
gaaaaggaagagagaaacgactgctagacgcaactccaattagcaggagggggcaaggccacactaccctnctaaaaaaaccccaaaaaaaagtgacacca

SEQ ID NO: 2173 - DNA, 101 bp, rice(Oryza sativa)
  misc_feature (71): n=a or g
atgagtagttggtaaataaaaaaaatactatacctggtggggtgtggggtggaaacggtccggattggtancaatatattcggaaacgacgctcgattaac

SEQ ID NO: 2174 - DNA, 101 bp, rice(Oryza sativa)
  misc_feature (71): n=a or g
atactgcgagcaccatatatgtgctcctaatatatggagcataacaattcttctcttggcttgctacccanaacagactttggacggcggacagactgggg

SEQ ID NO: 2175 - DNA, 101 bp, rice(Oryza sativa)
  misc_feature (71): n=t or c
gcgtactacaggagggaaagccgtcgtagtggacgcacagttcgtccactctccaggatccagatcgtgcngacgcacagttcgtcgtagtggacactgga

SEQ ID NO: 2176 - DNA, 101 bp, rice(Oryza sativa)
  misc_feature (71): n=t or c
tccaatactagattgatttttttttgggacgaagggagtaagttattatgcggattatatattctctctcngtcctataatataagagattttgagtggat

SEQ ID NO: 2177 - DNA, 101 bp, rice(Oryza sativa)
  misc_feature (71): n=a or g
gctacggcgagagctccagcaacagcagcaactggacctgcgccgaggtgagcaatgtgctcgacagcgangtgctcaactgggccgcctcggccggcgcc

SEQ ID NO: 2178 - DNA, 101 bp, rice(Oryza sativa)
  misc_feature (71): n=a or g
ttcataaaaggaggattggttctcggaagatcatcacaataaagcaatgtgatggcttagtcaatctcaanatatataccggttcaatctattggaggtac

SEQ ID NO: 2179 - DNA, 101 bp, rice(Oryza sativa)
  misc_feature (71): n=a or c
gcagccaaaagttaggcctaccaatcgaacatccgagttcataatatatgataatgagtacagacaaacgnatcttagataagctgagagcgcccattaac

SEQ ID NO: 2180 - DNA, 101 bp, rice(Oryza sativa)
  misc_feature (71): n=a or g
atatgaaatttagagcaaaataaaaattatatatcacaggtcaggcagtccaggccattttatattgaacngaatgaaccaattaagaattccttataata

SEQ ID NO: 2181 - DNA, 101 bp, rice(Oryza sativa)
  misc_feature (71): n=a or g
tgcaggacgccggcggcgccgccatgaccaagagcaagagagccatggacgccatggctgagtcacaagcncacgtggtttttaagaagcaatgcatagag

SEQ ID NO: 2182 - DNA, 101 bp, rice(Oryza sativa)
  misc_feature (71): n=t or c
gctgtgaattacacttgattaaaagcaagaaaaaacatataagcctaaagacaaagataacacctaccgcntaacttctttttgtgtaatgctaggtaatt

SEQ ID NO: 2183 - DNA, 101 bp, rice(Oryza sativa)
  misc_feature (71): n=a or g
accatttgactgttcaaacagtactccagattcatgctgagacttcagaggaaacatttacccaatcaggnaaaaaaacgctgaggtttcagaatgtgtaa

SEQ ID NO: 2184 - DNA, 101 bp, rice(Oryza sativa)
  misc_feature (71): n=a or c
ctatccaaaccagcaaatcacattgcaaaagtgatgtcaaaattcagaaagaaaggcaaccgaaagatgtntcagaatcaacgagttttttttattctttt

SEQ ID NO: 2185 - DNA, 101 bp, rice(Oryza sativa)
  misc_feature (71): n=a or g
tgctgtgatctctttatacctagtggtgtgccgcaatctgtgaatggggaggagacggaggggattgggangagacgcggtggcagcaacgatgggaggag

SEQ ID NO: 2186 - DNA, 101 bp, rice(Oryza sativa)
  misc_feature (71): n=t or g
tccataaacaatcatatgcttctcttcttatcatggggagaatcctattctaaaccaacatggcacttttntgcatcaaacattaacaaagcaaaggaagg

SEQ ID NO: 2187 - DNA, 101 bp, rice(Oryza sativa)
  misc_feature (71): n=a or c
agcagggagccaactcttctagcttaaggtattgtacaactctatattgtactcccgatattgaacagtgnaaaatgttgagctcagtgaatacccaattt

SEQ ID NO: 2188 - DNA, 101 bp, rice(Oryza sativa)
  misc_feature (71): n=t or c
actttatgcctgaaacttaatcgctacatgtcatcaccaaattaattaaaaacggtgacttctgaacaatnatctatgtttcaagcaaagcaggtgataat

SEQ ID NO: 2189 - DNA, 101 bp, rice(Oryza sativa)
  misc_feature (71): n=t or g
ctcaagggaaggaaaataacgccacaatggtgcagcatctttagttccattaacttgaccactaattcacngtcttaaattactgctgcagttaggcacac

SEQ ID NO: 2190 - DNA, 101 bp, rice(Oryza sativa)
  misc_feature (71): n=a or g
ttttggtagccttgtagtactttataagatctccaatctaccgcagaatgttctacttttgtgtgcactanaggtgtcttcaaaagttgtatcttttgttt

SEQ ID NO: 2191 - DNA, 101 bp, rice(Oryza sativa)
  misc_feature (71): n=a or g
ctcttatatcaaatgttatgttgctagttctatttctgccaagtttctatgctttgtttgcagtgcatttntgatatttataattcaatacgacatcatgt

SEQ ID NO: 2192 - DNA, 101 bp, rice(Oryza sativa)
  misc_feature (71): n=t or c
atggaaatcaggaaagaatatccaaaattatccaatatatgtctgcttatccagcttgtgcacatgatgtngtattgaattataaatatcacaaatgcact

SEQ ID NO: 2193 - DNA, 101 bp, rice(Oryza sativa)
  misc_feature (71): n=a or g
ctcagtacattttacccttaacttggtaggagaatttaatttttggacaagttatgcctttaatttccttntgagttcattctttgtgaatagggtaattt

SEQ ID NO: 2194 - DNA, 101 bp, rice(Oryza sativa)
  misc_feature (71): n=t or c
tagaaagctcgtgttttcggagccattcatgtaatccttcagaagctgaggatgatactctaatatctcanggaatataagttccttgatatcatctttgg

SEQ ID NO: 2195 - DNA, 101 bp, rice(Oryza sativa)
  misc_feature (71): n=t or g
cgaattttatggaaaccgaactaaaatttaatcacgcagaaggcgtagtctgctggaaatagatggcgtgncgtggtagctggctacttgcttgctcaaag

SEQ ID NO: 2196 - DNA, 101 bp, rice(Oryza sativa)
  misc_feature (71): n=a or g
cttgtcatgtggggaattccgttccagaggtgaaggtgcagggctgcggcaaatgatggcgctggcgctgncgcgatacaggatgggagcggagtcaggtc

SEQ ID NO: 2197 - DNA, 101 bp, rice(Oryza sativa)
  misc_feature (71): n=a or g
aaaacatttatcaacaaacacacggtaagtaacattctgcattctgccactgcgttaattcatcttgggtnaacatcatatttacccaacccacccgggtt

SEQ ID NO: 2198 - DNA, 101 bp, rice(Oryza sativa)
  misc_feature (71): n=a or c
ttttgggctgcgaattacttgcagcatttgacaaatacgcccaagattgcattatttgtaacaccggcccnccaaagcctcgtcgcgctccacacatgtca

SEQ ID NO: 2199 - DNA, 101 bp, rice(Oryza sativa)
  misc_feature (71): n=a or g
gtgtattattaatttttagattagattttgtagacaatccaggccttgcttgaggaagtttcgaatcttcngttctcacaaagattatgagaatcatctct

SEQ ID NO: 2200 - DNA, 101 bp, rice(Oryza sativa)
  misc_feature (71): n=a or c
gatcgagctactaatcgtaaacagtacgaaaagtatatatatggagattctttcacacgctctggccagtntaggcttcaatctccagctacaaattaata

SEQ ID NO: 2201 - DNA, 101 bp, rice(Oryza sativa)
  misc_feature (71): n=t or c
catcagtcgatcgtgccaaaaccctttttgttcatacaaattactagtagatctttcggtgtttccaggangataatctttggcaacattaagtttaacta

SEQ ID NO: 2202 - DNA, 101 bp, rice(Oryza sativa)
  misc_feature (71): n=a or c
gatatcgactttgacacttgagtgcaaggaatttggtggtggaaaccggaaatgactagtatttgatatantggccataagttagtttgtcagttaaagca

SEQ ID NO: 2203 - DNA, 101 bp, rice(Oryza sativa)
  misc_feature (71): n=c or g
ctataaatggccccacgcttcagcgtctcgtgcagaaagtccattactctcctccccgcatcagaacacanagagagagagagagagagagagagagagag

SEQ ID NO: 2204 - DNA, 101 bp, rice(Oryza sativa)
  misc_feature (71): n=a or t
ctccgcgacgacaacctcgacacctactggcagtcagtaaaacccgctccaaatctccatttgtttttccntcttctttttccgagggaggagattgttaa

SEQ ID NO: 2205 - DNA, 101 bp, rice(Oryza sativa)
  misc_feature (71): n=t or c
gtatcactaactaaacggccgtagcgattggctcgtgtcgccacaatattgctcttcttctctctctcttntttctttcttgttgctgttgctgttgttgt

SEQ ID NO: 2206 - DNA, 101 bp, rice(Oryza sativa)
  misc_feature (71): n=t or c
ttgtaaacgtcagtcgaagtgtcatataagaatggaagtagaaatggcaaccacggcgacttacagatcantcatacagacacaagaattctattcccctt

SEQ ID NO: 2207 - DNA, 101 bp, rice(Oryza sativa)
  misc_feature (71): n=t or c
tggcataattccaggtttattccgtacttcatgtagctgcgccaggtgtgccagatggtttctctgttccncaccacagctcggttttgcacatccggttt

SEQ ID NO: 2208 - DNA, 101 bp, rice(Oryza sativa)
  misc_feature (71): n=a or g
aaaaatgcaaatactcccttctcagtatcatcattgcaagctagtttgaggagattaggccctgattgaanttactaacatgtctatcactctttcaagca

SEQ ID NO: 2209 - DNA, 101 bp, rice(Oryza sativa)
  misc_feature (71): n=a or c
gagggaaacctcttaatttttttgtcatatatttacaaagaaagttaaaactttatctaatttgttcagtnctatttttcttttcgtccgtccccgatacc

SEQ ID NO: 2210 - DNA, 101 bp, rice(Oryza sativa)
  misc_feature (71): n=t or c
gctatatctaccagaaacgtctctccatacatactctaaaaacaagctaaatgactatctctatacaattnatctgatattatccctatcctaaattaaca

SEQ ID NO: 2211 - DNA, 101 bp, rice(Oryza sativa)
  misc_feature (71): n=a or g
atcaacatacttcctttgtcatttaaaaaaacctaggtgagaatatgagaatatgactccatataaaacancccgattatttttttatggaggaaatatat

SEQ ID NO: 2212 - DNA, 101 bp, rice(Oryza sativa)
  misc_feature (71): n=t or c
gtactgtaaaaaccaacagtatcccacagtccctgccggattatcgctgtggccaccactgcttcagtttngcatcggccgacgtgacgtgatggctcgtt

SEQ ID NO: 2213 - DNA, 101 bp, rice(Oryza sativa)
  misc_feature (71): n=a or c
catgcatgaatgctactagctagcttcgttccctcccgatctaattctcatgcattttactagctactccntccgtttcacaatgtaaatcattttagcat

SEQ ID NO: 2214 - DNA, 101 bp, rice(Oryza sativa)
  misc_feature (71): n=a or g
taggatgtttgtagacatcatagactaggcttcccgtgaggaagtaaattgttgtgttgcgaggcaaacgngactcttcactcttggagtccaaggaaatg

SEQ ID NO: 2215 - DNA, 101 bp, rice(Oryza sativa)
  misc_feature (71): n=t or c
caagaaaggatgaaatgcatctaagcttgctgttatggggaaaaaagcatataaactttgaagccagctancctaagagaaaaattaatgcgagttctcat

SEQ ID NO: 2216 - DNA, 101 bp, rice(Oryza sativa)
  misc_feature (71): n=a or c
acaggctgtcaggtataaatctattctttagtggattgtaattgtactgcagctcctaagttattttcacntagataaacagcaggtgtttttcagtttct

SEQ ID NO: 2217 - DNA, 101 bp, rice(Oryza sativa)
  misc_feature (71): n=t or c
cttaacttcgataatataccatcgttgtctaattagttttggttagtacttataattttgtcctaatgtcngaaatagctttgggatgaaaatttcgaaat

SEQ ID NO: 2218 - DNA, 101 bp, rice(Oryza sativa)
  misc_feature (71): n=a or g
tggcagtggctggttgacaagatgtgagcagctctcggacgaccggtttgacaagtacaagactatgttcngtgatggtgtaggggtagcgacatgggctg

SEQ ID NO: 2219 - DNA, 101 bp, rice(Oryza sativa)
  misc_feature (71): n=a or t
cgatgatcttgactgaagagcatcggacaaagaggggatgaggaggtataagttactctatagcttttatntttttttttgtaagatgattacgctaatgt

SEQ ID NO: 2220 - DNA, 101 bp, rice(Oryza sativa)
  misc_feature (71): n=t or c
attaagatatttatattatttatagctgtagatatcatttagatccatcacagtaataatataaggacttnaagttagtttttcttgccaaactaaaggat

SEQ ID NO: 2221 - DNA, 101 bp, rice(Oryza sativa)
  misc_feature (71): n=a or g
gcagaacatgtagggctggtgtctctctctataaaaattcttagggctgtagctggggtagaatgcagttntttgcttgagccctcctgttcatattttat

SEQ ID NO: 2222 - DNA, 101 bp, rice(Oryza sativa)
  misc_feature (71): n=a or g
cctcttcaaatgacattggttcaggttagtctcaaccctaacctccaaacctagtgctatgattgggcttntgagtatttgtaccccaaacctgaccaagc

SEQ ID NO: 2223 - DNA, 101 bp, rice(Oryza sativa)
  misc_feature (71): n=t or c
gaacccagaggtgtttgatttagaggtgagcgtaatgagttggttcctgatagaaacaacgtcagcttgtncgcgctcgtccacgccctccgtcacctccg

SEQ ID NO: 2224 - DNA, 101 bp, rice(Oryza sativa)
  misc_feature (71): n=a or g
gatcgatcgattcgatctcgaattcgtcgtctactagagactagacttgaatgaatgcgatgcggagaagngaagagaagagcggaggaggaggaagacga

SEQ ID NO: 2225 - DNA, 101 bp, rice(Oryza sativa)
  misc_feature (71): n=a or g
acacttacacaatatataaaccccttatgttggaccatttagaattctgtgtagaaactctggaggggaantgcatgcagtgaaacaggcagcttaccacg

SEQ ID NO: 2226 - DNA, 101 bp, rice(Oryza sativa)
  misc_feature (71): n=a or g
tgccaaccatttatgttatgtggttcagtggctaatcgatcggctgcgtgcgttacatttatatccatgcnaacatgtatcttgatatgatccatatatat

SEQ ID NO: 2227 - DNA, 101 bp, rice(Oryza sativa)
  misc_feature (71): n=t or g
atggcatggaggctggcccgagtgacggcgtgtgaggccgacgtagtaatgacagggaagccaacacagtngacgtagttatttcttgttgattgtaggat

SEQ ID NO: 2228 - DNA, 101 bp, rice(Oryza sativa)
  misc_feature (71): n=a or g
tttagggtctaaattcttgtaatgcatggtaacagtaggtgcaaacatgccactttatctggcacccctgnaaccatcactcgccgccaagacaagaggga

SEQ ID NO: 2229 - DNA, 101 bp, rice(Oryza sativa)
  misc_feature (71): n=a or c
tagaggagaacaccagttagttggatctgtaccacggcgagttggaagcggatggtggtggataaaaggcncgcagtcgagcccgtcctcgcacgccgccc

SEQ ID NO: 2230 - DNA, 101 bp, rice(Oryza sativa)
  misc_feature (71): n=t or c
aacaagtgaatgcccacctttttggatgctctatggatatttaagatctcatgaatctgctaagatgaccnataataagaaagaagcaatgtgaaggaaga

SEQ ID NO: 2231 - DNA, 101 bp, rice(Oryza sativa)
  misc_feature (71): n=t or c
tatgcgctttacaatacaaaggggtgttgtgtagtatgaaagatgactatattgtattataatttgatganatctttaatgcaataggtttatatttaatc

SEQ ID NO: 2232 - DNA, 101 bp, rice(Oryza sativa)
  misc_feature (71): n=a or c
tttaattcaaatttaaattatggttaacacgctaaaaagaaaatgatgaacttgtattgtgtatcactttntttgtttcaaattatgaggtgtttgttcaa

SEQ ID NO: 2233 - DNA, 101 bp, rice(Oryza sativa)
  misc_feature (71): n=a or g
accccagccttcgcctactccggtcctattcttgcaggagagatagagagagaggggatagggagagagcnccgcagcgtgggcctgggcactggaggtgc

SEQ ID NO: 2234 - DNA, 101 bp, rice(Oryza sativa)
  misc_feature (71): n=t or c
attgcatatccttcattttgtcaaagttgtgccagtccatctcttcattgtcatttcatcatgactagctncacagagttggccttcatcatatcaccagc

SEQ ID NO: 2235 - DNA, 101 bp, rice(Oryza sativa)
  misc_feature (71): n=t or c
agtggacctcggagccttcaaaaactgttcttcagttctcagtaccttaaagcctttacaaaccgttcttnggctcttcattgattcagagacgtggatga

SEQ ID NO: 2236 - DNA, 101 bp, rice(Oryza sativa)
  misc_feature (71): n=t or c
tgtagccatcaatctccaacaacatcaaaaagtttagagcagaacatccctcttcctctagctagctggtngagcaagaataaaaggcaccagtttgttct

SEQ ID NO: 2237 - DNA, 101 bp, rice(Oryza sativa)
  misc_feature (71): n=a or g
ccaaaaacaaacaaaaaaaaaacgatcgagtggcacaaccttaccttaatcttcgcaatgcacatttgtcnaccaacactggcaagcagcccacacggcgc

SEQ ID NO: 2238 - DNA, 101 bp, rice(Oryza sativa)
  misc_feature (71): n=a or c
tcaacaaggaaacagccaaaaatgcatattcatctgattcttacctacactgatgagagaggtttattttntcttctttcttttcttgagcaggagtgtgt

SEQ ID NO: 2239 - DNA, 101 bp, rice(Oryza sativa)
  misc_feature (71): n=t or c
gaggaatagagaaaacataggattttgacaaaaatacaagtgtgcagggacctgcgtagtaccctaaggtnctgagttcaaatctcctatggagcgaattt

SEQ ID NO: 2240 - DNA, 101 bp, rice(Oryza sativa)
  misc_feature (71): n=t or g
aagctaattgccatcaatggcttgagcaggagatgaaagccaacgtgacggcaaactgcgtccaccctggnatcgtcaggacccggctcatccgagaacgc

SEQ ID NO: 2241 - DNA, 101 bp, rice(Oryza sativa)
  misc_feature (71): n=t or c
atactactcgtattttacaagtctgcatacgtaaatgcatactttcatttcatcttatataacgactttangataatactacctccgtcccacaaaggtgg

SEQ ID NO: 2242 - DNA, 101 bp, rice(Oryza sativa)
  misc_feature (71): n=t or c
ggcgggtcttccggtcgacaggaaaatcccactgatcgcgttcatcggcaggctggaggaacagaagggcnctgacgtcatggccgccgccatcccggagc

SEQ ID NO: 2243 - DNA, 101 bp, rice(Oryza sativa)
  misc_feature (71): n=t or c
cctagataaactataaaacagaactgattcaaacccaactcctaccatcatctggttcttgaacatacggntcacgatttgcttggcgttgcctccctgag

SEQ ID NO: 2244 - DNA, 101 bp, rice(Oryza sativa)
  misc_feature (71): n=t or c
gtgccttttaacacaaacatgtatgctgcttcatattgcagaaacccattgctacgaacagttagaaacgntggatgtcatcaatgactggactactcaca

SEQ ID NO: 2245 - DNA, 101 bp, rice(Oryza sativa)
  misc_feature (71): n=t or c
ttaaatgtaaactgcaagccaagcaaaggttaattcctagtccaagcctacttatctttcttgctctaaanttcccccccaccttaacaacctaatttggt

SEQ ID NO: 2246 - DNA, 101 bp, rice(Oryza sativa)
  misc_feature (71): n=a or g
attggatccttcccaaacctcttctcagtcgatctcagcaaaaactcactatcaggtcatgtacataccantatcagtcagctcacagagttaattgaact

SEQ ID NO: 2247 - DNA, 101 bp, rice(Oryza sativa)
  misc_feature (71): n=t or c
accaggctaggccaatcttagcttatatggtgtgatgatgttgtcattgctccggtgcgctctttgtgtgngatctctttggtcgccggcggtccagaaaa

SEQ ID NO: 2248 - DNA, 101 bp, rice(Oryza sativa)
  misc_feature (71): n=c or g
tatttttatttttttgctaagttcaaaaattttacaaattcggtcggaagaacctcctacttggagccacnggtaaacacgaaattttggagatccagaac

SEQ ID NO: 2249 - DNA, 101 bp, rice(Oryza sativa)
  misc_feature (71): n=t or c
cttgattcccaaaccaaacactaccttaagacggcaacttgtttggctgtcagtcgagtcttcttttcttngttgtggggccggtatccaactatccaata

SEQ ID NO: 2250 - DNA, 101 bp, rice(Oryza sativa)
  misc_feature (71): n=a or g
gtcagcgacctgttgcatccaggcataataacaacagaatcaccgatcattttctttgtccctttgcatancacaacacattgattggaaatttggaataa

SEQ ID NO: 2251 - DNA, 101 bp, rice(Oryza sativa)
  misc_feature (71): n=t or c
gtgacttgtatatgcagttatctggtaactcgattctaagtccatttggaacgcagggtagaaaaacacanaggaataggaaaaacgtaggaatcgaattg

SEQ ID NO: 2252 - DNA, 101 bp, rice(Oryza sativa)
  misc_feature (71): n=a or g
gtattcttccacaattcacatcatactaccatggatgtgaacgttgtggtattgccgacggtggtcagccntagttgccgcctgaccgtcgtggtcgagcc

SEQ ID NO: 2253 - DNA, 101 bp, rice(Oryza sativa)
  misc_feature (71): n=a or g
tttatggggatgtttctttcacttggtttcacaataatacgagatgagagggttttatcaaaccgtttagngatgagttaccacgtgaggtatattatggt

SEQ ID NO: 2254 - DNA, 101 bp, rice(Oryza sativa)
  misc_feature (71): n=a or t
ggtggtgggggtgggccccacccggtgggggcagggttcacaatcttgatatcggatcaaaatctgtcctnactaccgtcctcactctatcccataaaaaa

SEQ ID NO: 2255 - DNA, 101 bp, rice(Oryza sativa)
  misc_feature (71): n=a or g
gactggacctatggagaagcagtgctaaagaagaggttaggtgacaattttttcatctatggtaggtatgncatatagggatcacctgcccattcctattg

SEQ ID NO: 2256 - DNA, 101 bp, rice(Oryza sativa)
  misc_feature (71): n=a or c
cgaagctggctcaatgaagctcctgacgatcgcctcccacatcttttctatgcctcaatatctcaacaccnaaataatcgacgattccacgtacagcaaca

SEQ ID NO: 2257 - DNA, 101 bp, rice(Oryza sativa)
  misc_feature (71): n=t or c
aataagcagatctcactaaagcaaatacaaccttatagtgatgagtgatctctatctcatgtttatttganaacgaaccgtaaaattacatctaagatcat

SEQ ID NO: 2258 - DNA, 101 bp, rice(Oryza sativa)
  misc_feature (71): n=a or t
ccgttggatgcggcgagagatctgggcctctgggccgtcggatctgagagaagtattgtgcgcgtctctgngcgacggcggctttggtctggaaggggaga

SEQ ID NO: 2259 - DNA, 101 bp, rice(Oryza sativa)
  misc_feature (71): n=t or c
ggcagcacatgaaacagtgggggccagatagaagtagttgcaatatggagctacgtaccatcgggctctanatccctactccaactcatctacttttactg

SEQ ID NO: 2260 - DNA, 101 bp, rice(Oryza sativa)
  misc_feature (71): n=a or c
aaggaaggagcaagttaattacctgcggctcattgacgcttctgtttttcgctgctccacctctagtgctnctgaatgtatgtcgcagtcgtgagtgaggg

SEQ ID NO: 2261 - DNA, 101 bp, rice(Oryza sativa)
  misc_feature (71): n=t or g
tgtcgatatccttcagcggcaaaaaccgtaaactttggatgtcttatagcagattttaccaataactaagncagtttcactacaaatcctaacaaaatttg

SEQ ID NO: 2262 - DNA, 101 bp, rice(Oryza sativa)
  misc_feature (71): n=a or t
acattgatatgggtgcaaaaaagctttacaaattgatacaagtaacatgtacaaaactttcaaaaaaaaantaacttgagattacaccctggctataaatg

SEQ ID NO: 2263 - DNA, 101 bp, rice(Oryza sativa)
  misc_feature (71): n=a or g
tgtggaaactcggtcaagttatgaaaccacagaataccaccctgtataattgtcaaaaaaaatgaaaacanaaggttaaacctgaagaaggtcaaaataaa

SEQ ID NO: 2264 - DNA, 101 bp, rice(Oryza sativa)
  misc_feature (71): n=t or c
tgtcgccaacccctatatatatcgggtgtttttctttccttggacgatataagtgtcgttgatgctggganattggatctcggtatctagtgctgagaaaa

SEQ ID NO: 2265 - DNA, 101 bp, rice(Oryza sativa)
  misc_feature (71): n=t or c
cctgagctgaagtagccagggctaaacatgccaaggttgttgttgccggtgcctatgcaaccaatgcaatngactttggggactagcaaaagacaatttat

SEQ ID NO: 2266 - DNA, 101 bp, rice(Oryza sativa)
  misc_feature (71): n=t or g
ggtagctaagcttgcccatctcaagatgaagtaaagctgcaaggctgaaaagtttgtgatttttttttttnggggttgttcaattgtgtaagattgggaaa

SEQ ID NO: 2267 - DNA, 101 bp, rice(Oryza sativa)
  misc_feature (71): n=t or g
gatagatgtcagatatgtgtgaccagttctactgagagtactgacatgaagaagtcatcaactggtaagtnaccacaaattgactccgttctttggacaaa

SEQ ID NO: 2268 - DNA, 101 bp, rice(Oryza sativa)
  misc_feature (71): n=a or c
ccaacacacccactaaaaacacacgtacacaaaaaaaaacacacccacaaatgcccccctctcagggtttnttgggcaacggctcttggagcttagaagct

SEQ ID NO: 2269 - DNA, 101 bp, rice(Oryza sativa)
  misc_feature (71): n=a or g
gtgaggccaccttgttgatgcacctcaccagcaaatgcaaccacttcttgaagcaatttgctcagttttcnccattgccaacaccttgcacgttgagggca

SEQ ID NO: 2270 - DNA, 101 bp, rice(Oryza sativa)
  misc_feature (71): n=a or c
cacacatgcatgttgtgccacgtgtacagtcatgacgtgtgaaacggtccctaacacttgaggaaatctanctattgcacgtacggatcgtaattccacga

SEQ ID NO: 2271 - DNA, 101 bp, rice(Oryza sativa)
  misc_feature (71): n=a or g
ctcttcttttgtcttagataatgttggattgaacaattgtttgttgcctgtatattttgtacatatacttnctcttcttacttgctgatgcagaggacagt

SEQ ID NO: 2272 - DNA, 101 bp, rice(Oryza sativa)
  misc_feature (71): n=a or c
ccagttgttaaaaagcgtctcccaaagaaaattagacaagttcctgaatgctattttctgcctcggcgatntttgccttctgcattggcaatctatggcgc

SEQ ID NO: 2273 - DNA, 101 bp, rice(Oryza sativa)
  misc_feature (71): n=a or c
aggtacgagaaaactactgacagaaacaagcactgccccattttattttattattattgagaggaccaagngtcaacttagtttgacgtgatgccacaata

SEQ ID NO: 2274 - DNA, 101 bp, rice(Oryza sativa)
  misc_feature (71): n=t or c
acgaacatgaattatctgggttttcaggttctctgtcaccctgtgctggttcatccatgtctgctaagatngaagtcaatgattccattgcaacgcaagca

SEQ ID NO: 2275 - DNA, 101 bp, rice(Oryza sativa)
  misc_feature (71): n=t or g
gggtccaattgttcatcttccaaaagatatcgactcgaaggatgccgctgcaacaaaatgtaaatgcagtntcgcaccaggactgtaacatatgtatgatt

SEQ ID NO: 2276 - DNA, 101 bp, rice(Oryza sativa)
  misc_feature (71): n=t or g
gcgtgaattccaaacgagagattaatatcccacgggaattcacaagcgaaaaagagataatttgtcaatgntttaacagatatcatcaatccatcatacat

SEQ ID NO: 2277 - DNA, 101 bp, rice(Oryza sativa)
  misc_feature (71): n=t or c
acccagctctataactctagtttatttggtgagaaagctccactcagcttcacttccaattttgatggagntgaaactgtttgactgagttggagctgtac

SEQ ID NO: 2278 - DNA, 101 bp, rice(Oryza sativa)
  misc_feature (71): n=t or c
agtgtatattctaatactacgaatctgaatatgatatttagggatggagagagtacccgtaaaatgtactncatccgtcctaaaatatatgatgtcgttaa

SEQ ID NO: 2279 - DNA, 101 bp, rice(Oryza sativa)
  misc_feature (71): n=t or c
ggtttcactgatgtgacgtatatatggttgtgtttagctgatttttgtcctacgtgatgttgacgtgatanttacatgatactccctccatccttaaatag

SEQ ID NO: 2280 - DNA, 101 bp, rice(Oryza sativa)
  misc_feature (71): n=a or g
aggaaagaggcagatgtttacaaagagagaggaaagaggcgtgtggcagtgagaataaaaaggaaaaaggnagagagagagggtgtgaaaaatttaaagtg

SEQ ID NO: 2281 - DNA, 101 bp, rice(Oryza sativa)
  misc_feature (71): n=t or c
tattccctcttgcttcacctccctgtgacatgtatccacgacgtttgtttcaggtagaaacggtcacaacngccattggatgtcgataactacccgcctgt

SEQ ID NO: 2282 - DNA, 101 bp, rice(Oryza sativa)
  misc_feature (71): n=t or c
tcaagtatgtatggaattaatatagtgatcaaagggtatacaaaggacataatttaacaagttcttggacntaaatatgtattttaagagttttaagacct

SEQ ID NO: 2283 - DNA, 101 bp, rice(Oryza sativa)
  misc_feature (71): n=a or g
gttgggatgatcttaagctatattcggcagcatttgttcccaattcctctcactcgtgttccgtgcacacntttttcaaacaactaaacgatgtgtttttt

SEQ ID NO: 2284 - DNA, 101 bp, rice(Oryza sativa)
  misc_feature (71): n=t or c
aatatgtcaacccttcattacttgtaagtgcacgttttattttattcccatagcatattctgatttgttgngacctgatttatgtcattgttgactaattt

SEQ ID NO: 2285 - DNA, 101 bp, rice(Oryza sativa)
  misc_feature (71): n=c or g
tgtgaccccctaattacagataattaataaacctttaaaagccaggtctccaatgaccaagctggggttgntgataagcccctacctgaggggctggtgta

SEQ ID NO: 2286 - DNA, 101 bp, rice(Oryza sativa)
  misc_feature (71): n=t or c
tttgagtaagagttatctacgtctcatttcattgttattatggttaccgtggtaaaccgtataaaatccangtaaactttaaattcaattacctaaaatgg

SEQ ID NO: 2287 - DNA, 101 bp, rice(Oryza sativa)
  misc_feature (71): n=t or c
ttagattaacttattattattaacgcaaaaaaaaacttgttttttttacttagtgtgggtatgtggttggnagcaaggcaacgacgaactatttaccggtt

SEQ ID NO: 2288 - DNA, 101 bp, rice(Oryza sativa)
  misc_feature (71): n=t or c
aacacacacttgtcgatgtcatttaacggattatctcaaaaaatagaactagtacaagatatgacatatantaatactataatatgttatatcctaaatta

SEQ ID NO: 2289 - DNA, 101 bp, rice(Oryza sativa)
  misc_feature (71): n=a or g
attcattttttttttctgcaccgggccaccaaaaagtcagggctgaccctgtttatatttttttaaggttntttaattagctaatacttaattaatcatac

SEQ ID NO: 2290 - DNA, 101 bp, rice(Oryza sativa)
  misc_feature (71): n=t or c
gcccggcgcgccggcggtgtggatcaagtcgaccgttgccagcctagccgcacgagggggtaagtgactgnagtttcgtgcttacttgttacaaaggaacc

SEQ ID NO: 2291 - DNA, 101 bp, rice(Oryza sativa)
  misc_feature (71): n=a or t
cgccaacaaaaaggggaaaagtagagggggtgggcatcatcatgacacactacgtaacaagttcatttttnaaaaaaaggtactctattaatcaactatca

SEQ ID NO: 2292 - DNA, 101 bp, rice(Oryza sativa)
  misc_feature (71): n=a or g
tggggactaatattgcctcacattttttactaaggtagcgtagctaagcttagtcttttcatacttttgtngaaaacaaaatgacaaactaagcttagaca

SEQ ID NO: 2293 - DNA, 101 bp, rice(Oryza sativa)
  misc_feature (71): n=t or c
tactcaggatgcttgatgtttcataatattaaggcagccgtagctgataaatgcttgttcaaagcagcaantttgatactacccatccttctatttggacc

SEQ ID NO: 2294 - DNA, 101 bp, rice(Oryza sativa)
  misc_feature (71): n=c or g
tttcaaattcttggtccaaatacctgctttgaggtgattttggttaatttcgcaacccaccttgaaaacancttcaattttggttgaattctatggcatgt

SEQ ID NO: 2295 - DNA, 101 bp, rice(Oryza sativa)
  misc_feature (71): n=a or g
caggctcagtctgaacaggggacttgataatataccctgcatttcttatcaccaataatttgataataacnacgagttattccttggcttattttgttgaa

SEQ ID NO: 2296 - DNA, 101 bp, rice(Oryza sativa)
  misc_feature (71): n=a or g
gccttgtaaaccccgtagaccaaacttcagttatatttggcaaggccaatggacctagtataatataggcnggtacctacaaggtctgattgttcgccttt

SEQ ID NO: 2297 - DNA, 101 bp, rice(Oryza sativa)
  misc_feature (71): n=a or c
taattattatagtgccctacaagaattgatctacttccgcatccttaaaaatcctaatcctatagaaaacncatctaaattcgtaggactatgatatacac

SEQ ID NO: 2298 - DNA, 101 bp, rice(Oryza sativa)
  misc_feature (71): n=t or c
gattcggcgtcgcaaaaaatcacacgtatgcacgcacaaagacacaaatggccggtttacatgaatgtgangagctcaaaagcaaagcttgtgaaaaagag

SEQ ID NO: 2299 - DNA, 101 bp, rice(Oryza sativa)
  misc_feature (71): n=a or g
attccaactgttttggggtttggcttaatcagtagaattatttgggaacagtcggtgtactcgctcgcagntgtgtacatgtatactacaccaattaacac

SEQ ID NO: 2300 - DNA, 101 bp, rice(Oryza sativa)
  misc_feature (71): n=t or g
agcaatggagtggctgatggcacgtgtaatggagtgtgtgagtaactcttcagggttcttgccgaagcccnttatataacgttagggcttccggcggcatg

SEQ ID NO: 2301 - DNA, 101 bp, rice(Oryza sativa)
  misc_feature (71): n=a or c
cgtgctgaatacctgccactccctctcaatcccgaccagatctggtggccagcctatagatccggcgagcnaccaaccgatccagcagctgcgatagcagg

SEQ ID NO: 2302 - DNA, 101 bp, rice(Oryza sativa)
  misc_feature (71): n=a or c
cgcggtcggccggactgtgttgttgttggttattttagtcggtcggcgagatcgtgctgggtatcttgcancaccttcttgccgagagaccagctgctata

SEQ ID NO: 2303 - DNA, 101 bp, rice(Oryza sativa)
  misc_feature (71): n=t or g
cctgagcaaagcacagaacgcactgaatgactcatcgactactggagtgagcaaacaaataagttcacttncggtctctcatctttaacgtcgagtttaag

SEQ ID NO: 2304 - DNA, 101 bp, rice(Oryza sativa)
  misc_feature (71): n=t or c
gttcataacagttaatatcaatctgaaaatgactctgtacaccacacttgcaattgctacatagagttgtngttggttgtactattccatcatcaattctc

SEQ ID NO: 2305 - DNA, 101 bp, rice(Oryza sativa)
  misc_feature (71): n=t or c
cgcctatttgttagactgtcatgcacaagcagacatgtcgcaaatgtggagcaatagaacgacatgctatntgcagccacgtagctcgagaattcagcata

SEQ ID NO: 2306 - DNA, 101 bp, rice(Oryza sativa)
  misc_feature (71): n=a or g
ttttttttcttgtgagaataacagtatgtttaaaccgatagaacacttcccaaaatatgctactcccttcntttcataatgtaagactttctagcattatt

SEQ ID NO: 2307 - DNA, 101 bp, rice(Oryza sativa)
  misc_feature (71): n=t or c
aggacggaagtagctagtaataatcaagtacgccagctgcatcagcccagtaagcatcaccaaagagtatnctaatattttattctcaaaactatattttt

SEQ ID NO: 2308 - DNA, 101 bp, rice(Oryza sativa)
  misc_feature (71): n=t or g
taatgaaacaatcgacatcattcaatctgcaaattaatgtcatagtaggagctatatattgcaatggtgcntgtatattaatatgagatttactctggtcc

SEQ ID NO: 2309 - DNA, 101 bp, rice(Oryza sativa)
  misc_feature (71): n=t or c
cgccatcagtccagtaaccctttggctagctttcttgttttaagaggattgggaaccttcccccttggtanatataacggagcggttgattattacatcgt

SEQ ID NO: 2310 - DNA, 101 bp, rice(Oryza sativa)
  misc_feature (71): n=t or c
ctaagatttatatatgtatagacggtacaacaaataacatgcatggataacgtgagcccgtaattactgantagatcgacgagcgcaagagattaggggta

SEQ ID NO: 2311 - DNA, 101 bp, rice(Oryza sativa)
  misc_feature (71): n=t or c
gctgcttcatgggctccgccttcggcgcggggcccatgtctcagccctcagatacccaccacaacgtcgcnggagtcgggaacgcggcggcgagctcgtcg

SEQ ID NO: 2312 - DNA, 101 bp, rice(Oryza sativa)
  misc_feature (71): n=a or c
gttcctcatattatgttttcactatataatttaataaagtaaagtacgtctgggtgaacatctttttcctnccggtttttatttttcacatatatttcatc

SEQ ID NO: 2313 - DNA, 101 bp, rice(Oryza sativa)
  misc_feature (71): n=t or c
gtgcatgtggttagcagcagatgaagcacgtgcagaaatactctacttctatctattagttcattgttatngccattactaattgatgaaatgccatatgc

SEQ ID NO: 2314 - DNA, 101 bp, rice(Oryza sativa)
  misc_feature (71): n=a or g
tcaatcattactatcttactaaattttagcagttatgtggtatacgttttcttttatttttcctgattatnacattccagagttataatcttgtaattttt

SEQ ID NO: 2315 - DNA, 101 bp, rice(Oryza sativa)
  misc_feature (71): n=a or g
gggcagaattgtcctcatttaagtcttctgaaggagaacatcctactaaattcttatcatgggaatcatcntttgtacaactgtgggttggattgtcacct

SEQ ID NO: 2316 - DNA, 101 bp, rice(Oryza sativa)
  misc_feature (71): n=t or c
gtcacctgtgccgaagcagatcaagaagcttaccaaatgtagagacagatcccaggcaaaaatcttggcgnaaatccgacaatgtgaaatctataagattt

SEQ ID NO: 2317 - DNA, 101 bp, rice(Oryza sativa)
  misc_feature (71): n=a or g
ctggtatgtatatgtggcactgaacagtgcagaaagtggcaaaaaattacaaaacctcctctctccagtgncaaattcttaagtgcaaatctaagaagggt

SEQ ID NO: 2318 - DNA, 101 bp, rice(Oryza sativa)
  misc_feature (71): n=t or c
tttgtaaccacaaaaaaaataaaacacaataataatcctgaaattaggtaatggagtactccctctgtttngaaatgtttgacaccgttgactttttagca

SEQ ID NO: 2319 - DNA, 101 bp, rice(Oryza sativa)
  misc_feature (71): n=a or g
ggaaggagagaaatagcctattttttaatggaattcagcctggggttcttacctggaaaaggaacttcaancttgatttgagtctacatttatctaggctc

SEQ ID NO: 2320 - DNA, 101 bp, rice(Oryza sativa)
  misc_feature (71): n=a or g
ggtgtggatttgcatggcaaggtgcagaactgcagggcggagttgttgcattgatgggcagggtcccatcngccatcacacttgggcaatgacctcgccgg

SEQ ID NO: 2321 - DNA, 101 bp, rice(Oryza sativa)
  misc_feature (71): n=a or c
tctccagctctcgcaaaagacaataaaatgcaccatccatttgaaatgactagttcgggttctatctttcnttttcttttttacttattgtttaggacacc

SEQ ID NO: 2322 - DNA, 101 bp, rice(Oryza sativa)
  misc_feature (71): n=t or c
gtacatcagtcctagaatcacgcgtctgttgcgagccatgccctcccgcgagcaatcggaacggtttggcncgacgccggagtcgctgccgtctccatcgc

SEQ ID NO: 2323 - DNA, 101 bp, rice(Oryza sativa)
  misc_feature (71): n=t or c
aaagcaggtggggaagtaggagtggcgaccaagacagtagtggagctcggtggagaaggcgtgatgatganggcggaaggagttgggagcgccgaagctgt

SEQ ID NO: 2324 - DNA, 101 bp, rice(Oryza sativa)
  misc_feature (71): n=t or c
tgaaatgtgatcagaaaaacttagtcctattgcatcgagtaaatgataacagaacagaccgaggagtcaanagtgagttgggaatggtctggactgattta

SEQ ID NO: 2325 - DNA, 101 bp, rice(Oryza sativa)
  misc_feature (71): n=a or g
aggctcggaaaaaaaggcgccaagcatcgcatcgcatcacatcgagccaattcacagggcgtcgcaaaccngagattcctaatcttaaacatctccagttt

SEQ ID NO: 2326 - DNA, 101 bp, rice(Oryza sativa)
  misc_feature (71): n=a or c
ctctccaacaccgaattccacccgcagtggctgaaaaaccctttgatagacttatggcttagaaccccganttgatcgatgaaaccttggtataccttccc

SEQ ID NO: 2327 - DNA, 101 bp, rice(Oryza sativa)
  misc_feature (71): n=t or c
tggaacgacatgctctcacacatgttgctcacatcgcaaagctagttagttaggttattgatcaaacgaangtagcagccgaaaaaaacagagaaaaatac

SEQ ID NO: 2328 - DNA, 101 bp, rice(Oryza sativa)
  misc_feature (71): n=a or g
taattacttttggccaaattaacgagaaatgatatggtccgccaacttttcatctcggtcgtgactaaagntaccactatatggtagatcagtttgatctt

SEQ ID NO: 2329 - DNA, 101 bp, rice(Oryza sativa)
  misc_feature (71): n=t or c
tacaaatctcttaatgaaaacctacaattaaaacagagttaagtgagtcggtcgtcgttcgaaccaccacnacaaacactttgtctcttgggatctaatca

SEQ ID NO: 2330 - DNA, 101 bp, rice(Oryza sativa)
  misc_feature (71): n=t or c
ttttgtttgttagttggtaaccccaacatttgtgtgagtgtcgggtagattgtaatggacaactgttatgntttgttagtaaagttagacggaagcctttc

SEQ ID NO: 2331 - DNA, 101 bp, rice(Oryza sativa)
  misc_feature (71): n=a or g
tagcacatcggggattcagacatcctatgaaagaaacttatccagcaaaaataaaaaataaaatcatggtnccagcgaaaaatcatatttttaagtagcgc

SEQ ID NO: 2332 - DNA, 101 bp, rice(Oryza sativa)
  misc_feature (71): n=a or c
ggcagggcagtgaccgcctcctctcttccttgcataaccacaacaattccctgaggttgccctgaagtagncgccgtcacctgaccaccgcccccgccatc

SEQ ID NO: 2333 - DNA, 101 bp, rice(Oryza sativa)
  misc_feature (71): n=a or c
gataggtcggtggacgagctcaacgaatcagagcaatctggaaggaggcgagtaggaatgagatcggcggnaacacaaatggcaagctccatagcagcgct

SEQ ID NO: 2334 - DNA, 101 bp, rice(Oryza sativa)
  misc_feature (71): n=a or g
cacaatgattgcttgtttgctattttttcagttgatctctcctatacgacaattgcaataagaaatcgagnacggttttcaaacgaggaggggtggatgat

SEQ ID NO: 2335 - DNA, 101 bp, rice(Oryza sativa)
  misc_feature (71): n=a or g
gtggaggccgcgtcaagcggtcaacgggtgtagcaggcaaatggagcaggggagagcggagccagccagcncggcggcgatggccggagtaggccggcgaa

SEQ ID NO: 2336 - DNA, 101 bp, rice(Oryza sativa)
  misc_feature (71): n=t or c
atgcatatgagtagcatcgagcgagagattactcagtatccacatcaattattgggtgcattatcaattantgggtggatatatgagtcttgtttgtgttt

SEQ ID NO: 2337 - DNA, 101 bp, rice(Oryza sativa)
  misc_feature (71): n=a or g
agcgggtggactgcagagaagtatagtggcgaagccactaacgattatggagacttatagaaatttaaaangaacacaaacaataattatgttcgattatt

SEQ ID NO: 2338 - DNA, 101 bp, rice(Oryza sativa)
  misc_feature (71): n=t or c
gatgccaccatacctacaacaggcccaccattcgaccgtccaacaccatgtctaaacaactaaacatccangggctctcggacatcgccatccaagggtgt

SEQ ID NO: 2339 - DNA, 101 bp, rice(Oryza sativa)
  misc_feature (71): n=a or g
ggcaattgtatatgttaattaggacattttcagtttccttagggatatgtttggtaagagtccaccaaagnacttatttgtattttaagttgtgttagaga

SEQ ID NO: 2340 - DNA, 101 bp, rice(Oryza sativa)
  misc_feature (71): n=a or c
cccatggcaatttggcatggcaattagctgcacagcccaaggtattgacggacctgagctgtgacggaccnccaccacggcccctgttagcttgaggccag

SEQ ID NO: 2341 - DNA, 101 bp, rice(Oryza sativa)
  misc_feature (71): n=a or g
aattatgaatagatttaaaacaacatttataaataacaggtgctaccaaccattcatcgacacatgatctntctgcacaagaccatatagctatattcatt

SEQ ID NO: 2342 - DNA, 101 bp, rice(Oryza sativa)
  misc_feature (71): n=a or g
ttgctacccgtaagatcaatggactcattttgatgctgagttgatttctgctccttttgcaccacttcggnattcggtttgcttgattcagctgaccttcc

SEQ ID NO: 2343 - DNA, 101 bp, rice(Oryza sativa)
  misc_feature (71): n=a or g
taactcaaacagtttcagttcagttccgctcaaaacgggagtggagaaggctgaagttctttcacaaaatnaacttgagagttggagttgggtttaggctg

SEQ ID NO: 2344 - DNA, 101 bp, rice(Oryza sativa)
  misc_feature (71): n=t or c
tttggtattgtgccggcaagcagaaagtcttgttagtacacttgcagttctagtagaacatgggcatgagngctaggctgctagctagattcatatataaa

SEQ ID NO: 2345 - DNA, 101 bp, rice(Oryza sativa)
  misc_feature (71): n=t or c
ggtgtaaaaaaaaccctagcaagaaaattggagcacattgtcaccgcatcaccatcgccaaaacctcaaantgacaatatagcaatcactgacagttcatc

SEQ ID NO: 2346 - DNA, 101 bp, rice(Oryza sativa)
  misc_feature (71): n=a or g
agcacaacacgataagtattttcccaattagaaatagatagaataccagccagttttgcaccattgtgccncgcggccggccacaacccgcacgaaactgc

SEQ ID NO: 2347 - DNA, 101 bp, rice(Oryza sativa)
  misc_feature (71): n=t or g
tattcaattaaaacttatttggtgttacacatgttgttaaattcttttatacacttgataaaaaaagattnactactagaaaaaactacttataatatgaa

SEQ ID NO: 2348 - DNA, 101 bp, rice(Oryza sativa)
  misc_feature (71): n=t or g
cggttttttgtggtgttctttagcaaatttacgttcttgcgatgtccacaggctaattatacatttttttngatgtcctgtagtaaattttgcctaaatat

SEQ ID NO: 2349 - DNA, 101 bp, rice(Oryza sativa)
  misc_feature (71): n=a or c
cgagtagggtaatggagtaattatgctgagtaaaaagaagtgaatgcctctaatgctctgcttggaacaanaagatttgtgtgagtttctaagaaacattt

SEQ ID NO: 2350 - DNA, 101 bp, rice(Oryza sativa)
  misc_feature (71): n=a or g
aaatttccaaagccatgcataatgtgggtaaaaactcaattaatgaaattaatgaatagttatgggagagngtataaatgtcctatttaacaccgttaact

SEQ ID NO: 2351 - DNA, 101 bp, rice(Oryza sativa)
  misc_feature (71): n=a or g
cttcccccttttttcgctgctactcacctggccttgccttgtctaatttaacacattttgacatgaatccnacgtgcgtgcagatcttgaaaggaaattgc

SEQ ID NO: 2352 - DNA, 101 bp, rice(Oryza sativa)
  misc_feature (71): n=a or g
catttgtaggaagctcaaattttcttcagttttcagcaatttttatttcacgtactgttctggtccctccnctttgctagtagtaactctcactctcagca

SEQ ID NO: 2353 - DNA, 101 bp, rice(Oryza sativa)
  misc_feature (71): n=a or c
ttattactactgtgattgatctataatcactagctagctagctgatcgatcgatgcatccatgcagatgtngctgcagcaaagacgagccacttaagctgc

SEQ ID NO: 2354 - DNA, 101 bp, rice(Oryza sativa)
  misc_feature (71): n=c or g
cataggctggttctctagtgaggccatggaggagagttgatgtccgatgacagggggagataattcctccntttggaatcaagcctgcagcatattcgata

SEQ ID NO: 2355 - DNA, 101 bp, rice(Oryza sativa)
  misc_feature (71): n=a or g
tggccgatattgttatatcgccctttgttgatttataatgtaatcggctgacagttgccgatttacaatgnccgatattgctatatcgcccttagttgttt

SEQ ID NO: 2356 - DNA, 101 bp, rice(Oryza sativa)
  misc_feature (71): n=t or g
tagtttgtacaaatatatttataaacaagttcttgctatatatatatagccatacatcaattgacaccctnaaagtaaaattgttttctttctagtctcaa

SEQ ID NO: 2357 - DNA, 101 bp, rice(Oryza sativa)
  misc_feature (71): n=a or g
tttgttttcccatatgttttcccagtgttcccatacattgcatgagtcatgcatatgaaggtcaaggttgntccatggttacattgctgcaaactgtttgg

SEQ ID NO: 2358 - DNA, 101 bp, rice(Oryza sativa)
  misc_feature (71): n=a or c
attgtggcacaagtttgtagtttgttcatggtttcaatgatgtaccggtacttttacaaaatttactcatnataattgcatgaaaatactagttgtagtta

SEQ ID NO: 2359 - DNA, 101 bp, rice(Oryza sativa)
  misc_feature (71): n=a or g
tagatatatatatgtgggacgttttacagagtcccctaccgctgtgacctgtgagtggtagtgtagtaagnttatgtgttagcgttgattttcatgggcac

SEQ ID NO: 2360 - DNA, 101 bp, rice(Oryza sativa)
  misc_feature (71): n=t or c
tgcccctgcacagccacctaaatgtccctgacccttaagtcgtagcagacctgggtcattcctagaggggncattagagcaggtacaataaggtgacatca

SEQ ID NO: 2361 - DNA, 101 bp, rice(Oryza sativa)
  misc_feature (71): n=a or g
gtgtctgatgtgtttcttcatatgattttgtgtatgccgagtttggtcaatgttatagttgtgcttgcctnttatatctcttgtattacaacaatctaata

SEQ ID NO: 2362 - DNA, 101 bp, rice(Oryza sativa)
  misc_feature (71): n=t or c
ttaatagtttatggctcgttcgatttgcgggatttttaacacgtatgaataaggaaaagcatagggatagnatgagaatacttgggcaaacctaaggattg

SEQ ID NO: 2363 - DNA, 101 bp, rice(Oryza sativa)
  misc_feature (71): n=a or g
tggcaacaaagtgcagttgagagacctgcaaatgatgctgtatgccctggaggagacactggacaagatcncgatccctccccgcgggccggggaggcttc

SEQ ID NO: 2364 - DNA, 101 bp, rice(Oryza sativa)
  misc_feature (71): n=t or c
aattataatattcaacgtaacaagtagcaatctaaaggacatcatcttggggaggtacttaattggtactncctccattccaaaatgtttgacgccgttga

SEQ ID NO: 2365 - DNA, 101 bp, rice(Oryza sativa)
  misc_feature (71): n=a or g
acaacagtgatggaagtgacggcggagggggagatgcagtgggagtgacaacggaaggcataggcggaggnggagattaggcgggagcgatggtggaaagt

SEQ ID NO: 2366 - DNA, 101 bp, rice(Oryza sativa)
  misc_feature (71): n=a or c
aaaatctgttctgatttaccttctcagcagaaagagcatcagtgcagacattgcttatgagctgcgaattnacctatagaaaagaaaaaagttcaagtaac

SEQ ID NO: 2367 - DNA, 101 bp, rice(Oryza sativa)
  misc_feature (71): n=a or c
aaagataacctttgagggcccaagtcatagcccatcctacttcacgtgagaatctgacacgaggcccgtanagcccagtggatcatcctgtgagtaattga

SEQ ID NO: 2368 - DNA, 101 bp, rice(Oryza sativa)
  misc_feature (71): n=a or g
cgacacagatccacccagctgctgccgcctcctcgtcgctagatggggatgacaagctcgatggcgactcntagggatggggaggaggtggacagcagtga

SEQ ID NO: 2369 - DNA, 101 bp, rice(Oryza sativa)
  misc_feature (71): n=a or g
ggatttcaaaggggcttattaaaagatttggaagagaatcacaaaaggcatatgaatcgtattaaccatcncacctcttgtcccaattgatttggcgattt

SEQ ID NO: 2370 - DNA, 101 bp, rice(Oryza sativa)
  misc_feature (71): n=a or g
ctcatatggtgggctgctgtggagctaacggtcggcgcgtttcgctttgtagccgttgcgtacggtggtcngtgcgcgtctgctttccagcttcctctcct

SEQ ID NO: 2371 - DNA, 101 bp, rice(Oryza sativa)
  misc_feature (71): n=a or g
attatttctgtttggcaatacataatggatcggtgacaagggatctctttgctgtatgcctagctattccntgattgaaaactgatatctcgcaatgagcc

SEQ ID NO: 2372 - DNA, 101 bp, rice(Oryza sativa)
  misc_feature (71): n=t or c
aggccttgttcggttgcttgggaaataatcccaaggagaacctatcaggggaggaattaggtgaatccctnccatattaaccaatctgtggggtttgaatc

SEQ ID NO: 2373 - DNA, 101 bp, rice(Oryza sativa)
  misc_feature (71): n=a or c
acaagttagttacgtgtgagttactacttccttctcaaaatacaataatttctactatttaaagtttgttnaaaaatacatcaatttctctaaataaattt

SEQ ID NO: 2374 - DNA, 101 bp, rice(Oryza sativa)
  misc_feature (71): n=a or g
ggtcttgcagtcgtttctactgtagtttgttgtgggaaataatggaatggtagtgggtggctgactggctncgatgtactggttttcgctgccggggaatt

SEQ ID NO: 2375 - DNA, 101 bp, rice(Oryza sativa)
  misc_feature (71): n=a or c
acagaaccgattaatgtcaaacgcatcaacatttacgtcgagcagcaaaatgttgaccaagtgaccgtacnttcactgtatgtccatacaagatgcaaatg

SEQ ID NO: 2376 - DNA, 101 bp, rice(Oryza sativa)
  misc_feature (71): n=t or c
tcgatgaatggagaaaaaccgaatcacatctgctgagggaccctgaattacgattaagtggtgcagactgnagtttattcatctcattaccaggaaagctg

SEQ ID NO: 2377 - DNA, 101 bp, rice(Oryza sativa)
  misc_feature (71): n=t or c
cagcaccagagaccttgctaggaggtggtggggatgatgggggaaggaggagaaaacactcttggctcttnttcttcctccctcaaatgccaaaagagtcc

SEQ ID NO: 2378 - DNA, 101 bp, rice(Oryza sativa)
  misc_feature (71): n=t or c
ttataaataggatcaatatgctcaaggaggggagcgtagtgtcttgccttgctttaggttcttgtatcttngagaaatccacgtccgttgattggccggaa

SEQ ID NO: 2379 - DNA, 101 bp, rice(Oryza sativa)
  misc_feature (71): n=t or c
ttgagaagtggtccccacagaatcttccatttgactctccccttgtccaaatggattttccctttcaaganacctagtcggatgcctcatgtgctctttgg

SEQ ID NO: 2380 - DNA, 101 bp, rice(Oryza sativa)
  misc_feature (71): n=a or c
tccacatatattctgtcacttgcatacgctttgtcaatcaaatgtcaatgccttcaattattgctgctgcnaaggttactgttccaccatcatagatcatg

SEQ ID NO: 2381 - DNA, 101 bp, rice(Oryza sativa)
  misc_feature (71): n=a or g
tggagcatcgcatcagagaacctatagctgagagtggtggcaaggggcagagtagtcggtgctagctgcgngcggccgcctcctgggtgagcgtcgcaaca

SEQ ID NO: 2382 - DNA, 101 bp, rice(Oryza sativa)
  misc_feature (71): n=a or g
cactagtccatttaattgaaccaagtgattttgcgcttgctggtttgatacgttgctagcaccgagatctnatctttgcttttcctttttttttttttgga

SEQ ID NO: 2383 - DNA, 101 bp, rice(Oryza sativa)
  misc_feature (71): n=a or g
tctaacacgcccattccccctccttgtggttgtgaatgaatacaagcatgcaagcacaagtggcagtggcngttcctagcatgtgcacgggtggttgttgt

SEQ ID NO: 2384 - DNA, 101 bp, rice(Oryza sativa)
  misc_feature (71): n=t or c
cggatagcccgtaaacgaattccggcccaatacaaatctgattacgctcctagacgggcggaatgtgatancgatatggagaggagagcgtgacctagcac

SEQ ID NO: 2385 - DNA, 101 bp, rice(Oryza sativa)
  misc_feature (71): n=t or c
caggaaaatctattatgtagtagtgagatcattcgtcgaattattatcgcagattatccacttgattacanggttaaattaatgttttgataaataaacat

SEQ ID NO: 2386 - DNA, 101 bp, rice(Oryza sativa)
  misc_feature (71): n=a or g
agagaaagagagggcctgaatgtatgcaacatagtctgtcaaatctgtatcaccaatggtgtgtggagatntactatatatctgaagcaaaagtgatcgag

SEQ ID NO: 2387 - DNA, 101 bp, rice(Oryza sativa)
  misc_feature (71): n=t or c
ttaaatccgattttcgtaggcagctgggtggcctgcacgcacccagttgtttgtgaaatcgctctttttgnatgtgggtggcgcacccacacacgaaaatt

SEQ ID NO: 2388 - DNA, 101 bp, rice(Oryza sativa)
  misc_feature (71): n=t or c
tagaaaaatgtgtttttaagtagtgatggctcagttcgcactacagtttgagaacaaattgatcagtcatnatgaagctctgcaaaacagccatttagaca

SEQ ID NO: 2389 - DNA, 101 bp, rice(Oryza sativa)
  misc_feature (71): n=a or c
ctggtatatctgtggccgaatcaatctagtattcggctaggttcaggaggagtacaggcacggcacaacancagaagcagcagcacacggcaacaggaaaa

SEQ ID NO: 2390 - DNA, 101 bp, rice(Oryza sativa)
  misc_feature (71): n=t or g
cttctgctgctattcttttgtgttgtatgacaggtttatgaacccgattatgttggtggtggcggcagtgnccaagggaggcaactggtgggctccccaga

SEQ ID NO: 2391 - DNA, 101 bp, rice(Oryza sativa)
  misc_feature (71): n=t or c
acggtatccatttcgacgtgactctagaacaactattatacacccccttcctagcccaacgcctccctctncctctccctctcctagtgcacccaacccag

SEQ ID NO: 2392 - DNA, 101 bp, rice(Oryza sativa)
  misc_feature (71): n=a or t
tgcccagaaaataaggacattgcagtcttgcggattcattcaagaaaaaagctgaagagcgttgtaaatcngaaaggctaaaagatgggatttatctttta

SEQ ID NO: 2393 - DNA, 101 bp, rice(Oryza sativa)
  misc_feature (71): n=t or c
tccgcattgctcacgcttgggctagggggggaggggttgttagagtacatagataatatcgtattatatcngatttgatatggtaggataggattagtttc

SEQ ID NO: 2394 - DNA, 101 bp, rice(Oryza sativa)
  misc_feature (71): n=t or c
taagaagtttgtttagtgtctcatcaggactagtttctgcccatgggtcccctcttccattttgctcactngccgcccacgtctaaactaccagatactac

SEQ ID NO: 2395 - DNA, 101 bp, rice(Oryza sativa)
  misc_feature (71): n=a or g
ttcacaggcttttcagccaagaacaggtgacaaagtttggccactcggtcctcacttggctgtacatgtgnaaaacgtggcaccgaaaatggcattgcttc

SEQ ID NO: 2396 - DNA, 101 bp, rice(Oryza sativa)
  misc_feature (71): n=t or c
gtagtgggctatactattaaacttgctcttataccacgctgatggactatctatgcaacaagttaaaatanattccaagacctcttttcaaaaaaaatgca

SEQ ID NO: 2397 - DNA, 101 bp, rice(Oryza sativa)
  misc_feature (71): n=t or c
caagcgcagccaggagtgatcaaacaagagtaatactccactgttcttactatgctcccaaattaagcgtnccagcagctgggctgcacctgcgtgccctg

SEQ ID NO: 2398 - DNA, 101 bp, rice(Oryza sativa)
  misc_feature (71): n=t or c
agcccccgattagagaccagccggatactgaacaaaatgaagacatcccagagaccaagggacaagcgagnagccctcccttaaatgataccaatactggt

SEQ ID NO: 2399 - DNA, 101 bp, rice(Oryza sativa)
  misc_feature (71): n=a or g
aatcaaatctcagtttccagtttccacaacatcagaagagcaagaactgagggtagtgcggggagaaagangggtcatcgaccggccgggaacgggtggtt

SEQ ID NO: 2400 - DNA, 101 bp, rice(Oryza sativa)
  misc_feature (71): n=a or g
ctgaagttttagagaaaaaacagaggaacaaagcaagaaatttgtgcagtgcaaccttcttctgcttttcngtttttctctatttattctcttccatccaa

SEQ ID NO: 2401 - DNA, 101 bp, rice(Oryza sativa)
  misc_feature (71): n=a or g
tcacagagtagaaccatatctaaagacattggttagtggagctgactttgtcatgcacattggccagcacncttgctccatcccatacccaaaccctaacc

SEQ ID NO: 2402 - DNA, 101 bp, rice(Oryza sativa)
  misc_feature (71): n=t or g
acatggttgcgaaagttatgcagtgggaaagaaaaactggaaacgcagacaaccttgcatggagatgtcgntctcaatgccatgttcaacatccgcatctg

SEQ ID NO: 2403 - DNA, 101 bp, rice(Oryza sativa)
  misc_feature (71): n=a or g
atagattagatcatagagtaaattgcacccatggtacaccaacttagcgggtggatgcgatataatataanaatttgagaattgaacattcgagtgcaaca

SEQ ID NO: 2404 - DNA, 101 bp, rice(Oryza sativa)
  misc_feature (71): n=a or g
ggtcggcaaagaacacccggacatcgagggaggcaaaatccctgagtccgtggtgaggtcggtgtagaacncctgggcagcaagggaggcgaagcccccga

SEQ ID NO: 2405 - DNA, 101 bp, rice(Oryza sativa)
  misc_feature (71): n=t or g
aacaacaccactttgctccaaatatagacgaatcatctaactcttgttgaccttcttggtcccccacttcnattgtattatgtactatattatttggatgg

SEQ ID NO: 2406 - DNA, 101 bp, rice(Oryza sativa)
  misc_feature (71): n=t or c
gtcgcttgccccgtcccattctctcgcttgcagcaactcggccctcaactgcgctctatcgctgcaccacngccgctgccatcaggagcaggtgtccgaca

SEQ ID NO: 2407 - DNA, 101 bp, rice(Oryza sativa)
  misc_feature (71): n=t or c
gtacatcttctcacaagaagacttttgtgaaaatctatcgaatttgaagtagaatattttgtactacctcngttccaaattagtggtcactacatacaatg

SEQ ID NO: 2408 - DNA, 101 bp, rice(Oryza sativa)
  misc_feature (71): n=t or g
ctcaggcatggtggagtgtcaaagcatccggccgacttgttccacgcttcaattccatccatccccacganctgtctacattccgatccccatcccgggtc

SEQ ID NO: 2409 - DNA, 101 bp, rice(Oryza sativa)
  misc_feature (71): n=a or c
aaagttcagtagcttcaactccaaatgaaggctcgatctcaaagttggtgtgatcccccttcacccagacngaatggttgattgacagtacgacattcaac

SEQ ID NO: 2410 - DNA, 101 bp, rice(Oryza sativa)
  misc_feature (71): n=a or g
ccatgttattgtacttaaacgtctcattctcaagttcgtgtactacatcgtacccacctatcaacttgttntactgtgggtataatttacacttcttaaaa

SEQ ID NO: 2411 - DNA, 101 bp, rice(Oryza sativa)
  misc_feature (71): n=t or c
actgtagtacatgcaggcccggcccaaactctatccgaggactacattttgggcttagctcgtctacaacnacaaccgaaactcctattgggcgattgatc

SEQ ID NO: 2412 - DNA, 101 bp, rice(Oryza sativa)
  misc_feature (71): n=a or g
tgtaagacatccagcgtcagaaccttgataccgtgggaagctggagtggttgcaacgctgcaatgcgtatnggccatcgtagaatttcacctcgtcggtta

SEQ ID NO: 2413 - DNA, 101 bp, rice(Oryza sativa)
  misc_feature (71): n=t or c
atagagatataatcatattaatactcgtttcttacatactggaataactcagcaaagcattgctattaccncgtaatcagcgcataaagttttgataattt

SEQ ID NO: 2414 - DNA, 101 bp, rice(Oryza sativa)
  misc_feature (71): n=t or c
gtgagcttcttcatgttcggtcggtagaaaaaggcttaagagctaaatagagaaagtaagtttgattctcnggagcccggatttccccaatgtatgcattt

SEQ ID NO: 2415 - DNA, 101 bp, rice(Oryza sativa)
  misc_feature (71): n=t or c
tctctgccccacggaggaaattaatctcgtcgctgagcgcaggttgcaggtgatgcagctgagcgcctccnccgctttcctctcatctcccggtgccgccg

SEQ ID NO: 2416 - DNA, 101 bp, rice(Oryza sativa)
  misc_feature (71): n=t or c
ccaaattgcccctgggggtcgttttgtgccaaatgaagcagcaagcggtgtcctagtccggcgctctctcnagcgccgccacgctgccgctctacttcgtc

SEQ ID NO: 2417 - DNA, 101 bp, rice(Oryza sativa)
  misc_feature (71): n=a or g
cctcttcctctcctctctctctctcaccgaagcttgaaatccttatcctctccctttcctctttctcaccngaccctaagaggaacttcctcccgccaccc

SEQ ID NO: 2418 - DNA, 101 bp, rice(Oryza sativa)
  misc_feature (71): n=a or g
caacttgtatcggagaatatttagcacgacaaaaagctgctgtgcctggcattttgacgtacactgattcnctgtatgttggagacacaaggcacaatatc

SEQ ID NO: 2419 - DNA, 101 bp, rice(Oryza sativa)
  misc_feature (71): n=t or c
aatcagtgtacgtcaaaatgccaggcacagcagctttttgtcgtgctaaatattctccgatacaagttggnacattacttacgaatgacgtatctaacagt

SEQ ID NO: 2420 - DNA, 101 bp, rice(Oryza sativa)
  misc_feature (71): n=t or c
ttcaaagcaataatgtcaatctgttcagaaatcacatatggctgtgcaaccttttgccaaacaccataatntttagctataatgtaagattgcatcttatc

SEQ ID NO: 2421 - DNA, 101 bp, rice(Oryza sativa)
  misc_feature (71): n=t or c
actccatctctatcggagcaaagctcggaacagctagatgaagccagctctcatccgatctctaccattgngactcctctccctgtactgccgctagcacc

SEQ ID NO: 2422 - DNA, 101 bp, rice(Oryza sativa)
  misc_feature (71): n=t or c
caattggcatgcgagttgattacactagtttagatacgatggtggtttattggacagagtggtttttgctntgggtgtgatcgatcagacaggccaggcaa

SEQ ID NO: 2423 - DNA, 101 bp, rice(Oryza sativa)
  misc_feature (71): n=a or g
ttcataatgatcgatggttaagatgatactatctatgcagagtctgatgatacaactgaaccttagtagtnttttcttagcattcagttcttttttaacct

SEQ ID NO: 2424 - DNA, 101 bp, rice(Oryza sativa)
  misc_feature (71): n=t or c
acgcttgctagcaaagcttgctttgtttttgatagttgcggcatgtcatgtcctgtcgtgattttttttanagggagtaactatatttacggcgtcatatt

SEQ ID NO: 2425 - DNA, 101 bp, rice(Oryza sativa)
  misc_feature (71): n=a or c
gaggataaggaaaacaacttaaagaacttaaagaccagctggttcggctcggcttcatccctaaatgtacnaattttttatttaaaaaacagcacttttat

SEQ ID NO: 2426 - DNA, 101 bp, rice(Oryza sativa)
  misc_feature (71): n=a or g
aagcataaggccgcctaattttcgtacagaaagctccatatatctaccctgcagctgcattttggataaanccagctacctagtgttgccaactaggaaaa

SEQ ID NO: 2427 - DNA, 101 bp, rice(Oryza sativa)
  misc_feature (71): n=a or g
aatgttggattagaggcttgtggacttggatatgttggattcccctttcaaaattcccaaacttgttttcnataggctaggctcgaggtgcttggttgagc

SEQ ID NO: 2428 - DNA, 101 bp, rice(Oryza sativa)
  misc_feature (71): n=t or g
cacgtcacccccaatgagctctttcgtgatactggaccgatgtattttcggattgacgaaatcaccacaancatctattgtgaatagttatatttcctact

SEQ ID NO: 2429 - DNA, 101 bp, rice(Oryza sativa)
  misc_feature (71): n=t or c
aatgtttagcaatttgaaaagtgtgttcacataaattagacatttggagtttgtgtcacgtaatacgaagnaaaccattaacacatgattaattgagtatt

SEQ ID NO: 2430 - DNA, 101 bp, rice(Oryza sativa)
  misc_feature (71): n=t or c
actatgtaggaagataggattagtgtctctggttccgccgctattcaataggattagtgtctctggtttcngccgctatttaacaatggttcatgtttttt

SEQ ID NO: 2431 - DNA, 101 bp, rice(Oryza sativa)
  misc_feature (71): n=t or c
ccaaaaatcaatgggagactgggtaacatacatttttttatgatccaattgcaagaggtagctacgttttngttgaataagagaaagcataattatggggg

SEQ ID NO: 2432 - DNA, 101 bp, rice(Oryza sativa)
  misc_feature (71): n=a or g
ctatgcctaagaccggaattgttagtaatcctcttcctattgctcctattgattctgacaagaagaaaatnttgatttgacctagtcaagccgaatccaca

SEQ ID NO: 2433 - DNA, 101 bp, rice(Oryza sativa)
  misc_feature (71): n=t or c
cttccaaatatgctgtcatctgtttctgctagtgtattctctctgggtttaactcccccatctgttaatcngccagtctctacaattgaatcgactatgtc

SEQ ID NO: 2434 - DNA, 101 bp, rice(Oryza sativa)
  misc_feature (71): n=t or c
ccagaataccagataaaacgaggaatgacacactcaaagagaagatctatggtccacacggacacggtttnactcactccacgcatcttacacttttcaga

SEQ ID NO: 2435 - DNA, 101 bp, rice(Oryza sativa)
  misc_feature (71): n=t or c
ccagtgaaagatatgcatagtgcaagcttacttttggacaaactatcatcagtgtcgggttttcttgaacnggcactgatgatgggggcactgatgtgctg

SEQ ID NO: 2436 - DNA, 101 bp, rice(Oryza sativa)
  misc_feature (71): n=a or t
caacccaaccgggtccccgtattgggtagccactccatccgatcagcacgaaaaaaaaaactttccatgancgcaaatactttcacacatacatatttcca

SEQ ID NO: 2437 - DNA, 101 bp, rice(Oryza sativa)
  misc_feature (71): n=a or g
atactcaagtgaatcctattctcactgttcatgctaaaagtgatcggatagaagagttcgtctagggttcnttttctgctattgtaaaccgaatccgtata

SEQ ID NO: 2438 - DNA, 101 bp, rice(Oryza sativa)
  misc_feature (71): n=a or g
tgcagttgtgcatgctgggagccgctgctgcctactgtgttgtggcctgcaagctgcaggctgcggtggtntcgaggctgtcgccatccgctgcctacgcc

SEQ ID NO: 2439 - DNA, 101 bp, rice(Oryza sativa)
  misc_feature (71): n=t or c
tcggtgcaacttgttgctgcagtagctgcaactacatcaacagtatcagtgtgtagaaataatattgtcgntgtttcagctgcagctgcgcagctgtgaaa

SEQ ID NO: 2440 - DNA, 101 bp, rice(Oryza sativa)
  misc_feature (71): n=t or g
caataatgttttgatcacaagaaattattaatgcatttgtgcgtctacttgttacataaaaatctacttgntacgtaaaaactagatgataccttgcacgt

SEQ ID NO: 2441 - DNA, 101 bp, rice(Oryza sativa)
  misc_feature (71): n=a or c
tgggccattctggtcttggccactggccagtgctaaattacattgatcccacatcacatttggagctttgnaagaaaaaagaatatcagtttcgtttgggt

SEQ ID NO: 2442 - DNA, 101 bp, rice(Oryza sativa)
  misc_feature (71): n=a or g
gccgccctccttggctgttttgaggatgggtagaggtccccacttgacttttggggaaaatgtcaaagggntgagagagaatgtgatgctagagagagaga

SEQ ID NO: 2443 - DNA, 101 bp, rice(Oryza sativa)
  misc_feature (71): n=t or c
acttttaggacatatcaatttcaagatgggaaatataatacaatgggtggatcatgaaattatattctaancttatgtttagacttcttggctagttatta

SEQ ID NO: 2444 - DNA, 101 bp, rice(Oryza sativa)
  misc_feature (71): n=a or g
ctctggggctgtccacgtcggatagctacagtgctagggctgtgtatttttcgaaaaagccctctggtttntacataattcgatatatgcccctaatgaac

SEQ ID NO: 2445 - DNA, 101 bp, rice(Oryza sativa)
  misc_feature (71): n=a or g
cctgaagtcgttaggattaaacttaagctttccctaaacattgttctcaccagtaaatcctttttatcccngcctatcatttgcttggtgttcttggatca

SEQ ID NO: 2446 - DNA, 101 bp, rice(Oryza sativa)
  misc_feature (71): n=t or c
tgatctgtactctgtattgtttgtttagagaccaagccacttacactagtacataatagacttttccgtgnggtcaaaatacattttttccgtgcagagga

SEQ ID NO: 2447 - DNA, 101 bp, rice(Oryza sativa)
  misc_feature (71): n=a or g
aggtcttataatttgggacagagggagtatactagtagatgtaaactgcttcctccgtttcgaaatgtcanactttctagcattgcccacattcatataga

SEQ ID NO: 2448 - DNA, 101 bp, rice(Oryza sativa)
  misc_feature (71): n=a or t
tgcgctaagaaaagagcgacgactagcagttagggtgcgtttgagccgtgtggctttatttgttttttttnaaaaaaaaaaaaaactgagctgcgttacta

SEQ ID NO: 2449 - DNA, 101 bp, rice(Oryza sativa)
  misc_feature (71): n=t or c
ttttttttcaatgatgccgtcacttagctttttgtcaaagatatcaatagggtatgtttggttgctatccngagaaacctgctggagtattttccatgcct

SEQ ID NO: 2450 - DNA, 101 bp, rice(Oryza sativa)
  misc_feature (71): n=a or c
ataaaatttcgggatttggagcagagaaagatcatgtgagcatccttcccttctcatatgtcatcatggcngaaatcgtttgtgctgctctgattaatgtt

SEQ ID NO: 2451 - DNA, 101 bp, rice(Oryza sativa)
  misc_feature (71): n=t or c
acagtttctttgaatgatagcaactaatcacttaatcagcctaatattcattcgttcccacggaataatantacaaattctctgagagattttagggcttg

SEQ ID NO: 2452 - DNA, 101 bp, rice(Oryza sativa)
  misc_feature (71): n=a or g
tggtggggttggtgggaacagggtgtcggtggcgtgggagcaggcactgtatgtggcacgcgagggcatanggagtgggcagcggcatggaggatgaagtc

SEQ ID NO: 2453 - DNA, 101 bp, rice(Oryza sativa)
  misc_feature (71): n=t or c
tgtgtcgagcggtgactgaggaggagatgggggtgggagatgtggtgactgaggaggagatagggttatcnagtgaatttcttttaaatttttttacccga

SEQ ID NO: 2454 - DNA, 101 bp, rice(Oryza sativa)
  misc_feature (71): n=a or g
ctttagtaatcagtgttgatcaaagagctgcattgtttctcggagttttaacaagttctaccaatttgatntctcgattaatccaacaatcaccaaagaag

SEQ ID NO: 2455 - DNA, 101 bp, rice(Oryza sativa)
  misc_feature (71): n=a or t
gaacaaaactaaggtttagtgttagagcgttagaaaaaaaaattggctctagcatatatgatgaaaaactnactcaaaaatagtttttttattttaacgga

SEQ ID NO: 2456 - DNA, 101 bp, rice(Oryza sativa)
  misc_feature (71): n=a or g
tgaatttgaaatactcaaagcgatattttttgtgaaattttaaacacgttgattacatgtattccaaaacntcacttatttgtctttatatacaattcgaa

SEQ ID NO: 2457 - DNA, 101 bp, rice(Oryza sativa)
  misc_feature (71): n=t or c
ccacacatgattattttcatattaaatatatatgtgtttgatgtttcatgtgtgagaaacatgtgtttcanggagaattcgacattgttgcatattttata

SEQ ID NO: 2458 - DNA, 101 bp, rice(Oryza sativa)
  misc_feature (71): n=t or c
gcttgcaaatgtaaagaagattcatccatcacattcatgcttatgcctgcctgcatcagcagcatgtttgntgtttaattaaattaattaattaatgtatc

SEQ ID NO: 2459 - DNA, 101 bp, rice(Oryza sativa)
  misc_feature (71): n=c or g
cagaatgcaaacagagatcatgatggaaaacactacattataaacgttcattcatcattaggcagtcatanatgcacaaatttgatctctttattaccata

SEQ ID NO: 2460 - DNA, 101 bp, rice(Oryza sativa)
  misc_feature (71): n=t or c
actagattgctggaggaagggatgtgaaacttgcaaaagtagaatgagtattctggaacatattagaacanattggattagattgaaacctaaattttagg

SEQ ID NO: 2461 - DNA, 101 bp, rice(Oryza sativa)
  misc_feature (71): n=a or c
aagctaggataaatttatgatcatattatatatgaacaaatatatgttcacaaaataattcgccatgtttncagtggtttctatacaaatttaatttgttg

SEQ ID NO: 2462 - DNA, 101 bp, rice(Oryza sativa)
  misc_feature (71): n=t or g
ccattcagagattaattataagaaaaacacaaaatcccacttcataagaagatatgcatgaggatgtttantatttgtcggtgatatggacccgggatacc

SEQ ID NO: 2463 - DNA, 101 bp, rice(Oryza sativa)
  misc_feature (71): n=t or c
gctccattttttgagccgtgaatagccacaaccaaatactgagccgaactgagtctaaactatttcgtcangcgtagaaatgatcattataaacaaacaca

SEQ ID NO: 2464 - DNA, 101 bp, rice(Oryza sativa)
  misc_feature (71): n=t or c
ctcaacaatgtgtttgttttggcactacattaatcagtacattgagatatacgtatataaaacttgaacgntctaaagcctaaaaaaagtattactaataa

SEQ ID NO: 2465 - DNA, 101 bp, rice(Oryza sativa)
  misc_feature (71): n=t or c
atggctaggctaatctctgatgtcgatatacggcagcgtattggcttgtagctttgtggcttctctcctcntgggggcttgtatctatacccatagatgct

SEQ ID NO: 2466 - DNA, 101 bp, rice(Oryza sativa)
  misc_feature (71): n=a or c
tcattttggcactgcaagttatccatacaacaaaaggaggtcaaggtttccacaacaatcttgctcttctnaatgatattccatcttcaactcatcctcat

SEQ ID NO: 2467 - DNA, 101 bp, rice(Oryza sativa)
  misc_feature (71): n=t or c
tggggcgacagatgaggccgcttctgccatgccgttgcggcgccaagggcaatccgtgaatcacgcagtgncacgtggtaggtctctccgacggagaacgc

SEQ ID NO: 2468 - DNA, 101 bp, rice(Oryza sativa)
  misc_feature (71): n=a or c
cgtggcgcggcggagggagggaggagttgggagttggtttggttgatagatcagtcatcactcatcagtgngtgtggtaggtggtgggggccacccgtctc

SEQ ID NO: 2469 - DNA, 101 bp, rice(Oryza sativa)
  misc_feature (71): n=a or g
gatgaaagaaatcgttagaattgcttgctgacatattggtaaagttaaaaaatatggaaaaggaaatttgncttgcctaaaattctgttttattgttaagt

SEQ ID NO: 2470 - DNA, 101 bp, rice(Oryza sativa)
  misc_feature (71): n=t or g
ctaacgagcaagaagtccagttcaagctagctcgttaagttcgcaaaccacatcgtggcacaattctcagnggaggggacgagctcgagttcgtcagcaac

SEQ ID NO: 2471 - DNA, 101 bp, rice(Oryza sativa)
  misc_feature (71): n=t or g
caatccaagatggaatctcagcccatcatatcccataccaaccaaaacgatccaaaccaaaagttagattnggtacttggaagcatttgtatactagacat

SEQ ID NO: 2472 - DNA, 101 bp, rice(Oryza sativa)
  misc_feature (71): n=t or c
tgtaaagtttgtagaattgtagctgcaccttgcataagtatatgaaatatgcttaggtcccctttgtttcngcttaggtttttaagctgacttttcatttt

SEQ ID NO: 2473 - DNA, 101 bp, rice(Oryza sativa)
  misc_feature (71): n=a or g
aagaattagttgttgaattcccacaaaaatattgcaaaaatcctctacccaaaagaagctcttaatatctntactggtgctaagaactgctgggaaagaga

SEQ ID NO: 2474 - DNA, 101 bp, rice(Oryza sativa)
  misc_feature (71): n=a or g
ggctagaccactttatcatgctcagaagacatcaccacccgctgaactttagaaagcaattctgcaagctnagctcttttctcttcattgaggtgtctcct

SEQ ID NO: 2475 - DNA, 101 bp, rice(Oryza sativa)
  misc_feature (71): n=t or c
tctcacaacgaaaaacccggcaggggcattttttttccgctgtctgaaaaacctaagctagctagcttggngctaattaacgagctcgatctgatctagag

SEQ ID NO: 2476 - DNA, 101 bp, rice(Oryza sativa)
  misc_feature (71): n=t or g
cgtaggattttttttgatgttggtagatcttttgctcgatccccgaaatggaaagggtttgactcgtttcngttgtggtaaatggtttttcagtgtttttt

SEQ ID NO: 2477 - DNA, 101 bp, rice(Oryza sativa)
  misc_feature (71): n=t or g
gcctgttcggctggcaggtacagcagctacctgcagccagctgcggtcagccgctgctttttttttttttngcttgcttcactgttcctataggctgcagc

SEQ ID NO: 2478 - DNA, 101 bp, rice(Oryza sativa)
  misc_feature (71): n=a or c
caatgccgctgatgaatcctccaaagatgtccccaatggccaccgcaactgtatgccggtcacccctttcnccttccacctcttgccgccgccaccaccac

SEQ ID NO: 2479 - DNA, 101 bp, rice(Oryza sativa)
  misc_feature (71): n=a or g
catgttgctacaaaatgacatcctatcctatctatggccagcacgaaacttttcacttcccccaccatccnaaccaaaccaactccactcgaatgaatcac

SEQ ID NO: 2480 - DNA, 101 bp, rice(Oryza sativa)
  misc_feature (71): n=a or c
aatagagtcgctatgtgacgagcggtttgatggtaggggctataagcagcgaagtatctgaaggctcgacntaagtccactagggaagaaacgaataccgg

SEQ ID NO: 2481 - DNA, 101 bp, rice(Oryza sativa)
  misc_feature (71): n=a or g
gaatgttgtactgtaataagtgtggtcctttaggaagttacattagtgggtaaaaaaggccatataattcncactatttcaggatatgccactcaatttga

SEQ ID NO: 2482 - DNA, 101 bp, rice(Oryza sativa)
  misc_feature (71): n=a or g
tgcgaatccactattgcattctgcctgacagtgtttagcttggagatgatgatttacctgtgatctgtttngtccttgagcactactaggtgatgtgctcc

SEQ ID NO: 2483 - DNA, 101 bp, rice(Oryza sativa)
  misc_feature (71): n=a or g
ctaaactaaccttgttttcctcgttctgaatctacgtgcgaactttggccaaaaaacaacaaaaacaaaancaaaacggaacaggtgaccctggaaagacg

SEQ ID NO: 2484 - DNA, 101 bp, rice(Oryza sativa)
  misc_feature (71): n=t or g
cttagcagatgattttcaacttacaacaatataccgtagaaaaaaaaatggcggagctacattatgagggngtggtgcccaggaacccggttaaagttcgt

SEQ ID NO: 2485 - DNA, 101 bp, rice(Oryza sativa)
  misc_feature (71): n=a or t
ctttgtagttttaatatagtcacatgcttataacaaatgtttttctaacctcctaaatggtgtattttttnaaaaaaaattatatttctttatcgatactt

SEQ ID NO: 2486 - DNA, 101 bp, rice(Oryza sativa)
  misc_feature (71): n=t or c
aaaaataaatctacctgctccatatttgaatgcattgttaaagtcaaaaaggaaaggattactgagaaganaaacaaaagagatagggcgcgggaagggtg

SEQ ID NO: 2487 - DNA, 101 bp, rice(Oryza sativa)
  misc_feature (71): n=t or g
aaaagaatccatccgctctaccttcagttgtctcccaggctacacctccaacaaaaattttcctgcagagncacacagatcaaacaaaaccaacaaaattc

SEQ ID NO: 2488 - DNA, 101 bp, rice(Oryza sativa)
  misc_feature (71): n=c or g
tcaactgtgttcggtagtaggcgtcgggaacatatagggccctaccggccgtacgcgtggcacgtactgtntacgtagcgtttagagcaggtacaataagc

SEQ ID NO: 2489 - DNA, 101 bp, rice(Oryza sativa)
  misc_feature (71): n=a or g
attgaaaaacaatcgacaaatttagggaatgtcatttcagttatgtttgcaaagtaataacgcgagttatntgaatttattggctgttaatggaaaacaga

SEQ ID NO: 2490 - DNA, 101 bp, rice(Oryza sativa)
  misc_feature (71): n=a or g
gcttatattaataccattatcacattagtgtaagcctcttatagacaggatatatacatccagtagatctncgatctgtcgattcaggctaagcactcgtt

SEQ ID NO: 2491 - DNA, 101 bp, rice(Oryza sativa)
  misc_feature (71): n=a or c
aagctgcaggaggcggtggcggcggcatgggtcttgctccagctgagcccgatgctgtcgacgagagtacnacccctcgtcgtcggcgccgggggcggggc

SEQ ID NO: 2492 - DNA, 101 bp, rice(Oryza sativa)
  misc_feature (71): n=a or g
accacaaaataagatatatatatatcgttctcaacttataaaaccaggttcttagatggttttaattatgnttttatccgatgtggctgctaaatcaacgt

SEQ ID NO: 2493 - DNA, 101 bp, rice(Oryza sativa)
  misc_feature (71): n=t or c
tgtcaagaaccccatttgtggtgctgttgaatggacttcttagctttgcccaaatagtcatactagggttnggccagtagataaaagatatgttcttctca

SEQ ID NO: 2494 - DNA, 101 bp, rice(Oryza sativa)
  misc_feature (71): n=a or g
atcgatacaaaattttcagttgatgttattagcatatccctggaggcaataaaaaaatccacatattttgnaaactctctattaagtgaatttagtttatt

SEQ ID NO: 2495 - DNA, 101 bp, rice(Oryza sativa)
  misc_feature (71): n=a or c
tatctcaagatcacatcttgagcctcatgtccatcgtctcaatctatgaatttaaatcaagatatattacntaggcaatttacttaatcatctgaaatcga

SEQ ID NO: 2496 - DNA, 101 bp, rice(Oryza sativa)
  misc_feature (71): n=a or g
ttccaatttcaatgtactatgcatcactgctaatcgacttgaaccctgtgggaaacaagacaaactctacngtatgtgtgctgccacttgctgttttaact

SEQ ID NO: 2497 - DNA, 101 bp, rice(Oryza sativa)
  misc_feature (71): n=t or g
taatattccgagcacaaaatggagccttgatcctctgggaaacagctacgttagtgattggcttcttgttngctgccattaatccaacttgcagtggctga

SEQ ID NO: 2498 - DNA, 101 bp, rice(Oryza sativa)
  misc_feature (71): n=a or t
agctgacatttacaattcatacaaattgtgaaatattattatttacagcaactactagaaagacgccttanactcctttatccttgaagctgaggaattct

SEQ ID NO: 2499 - DNA, 101 bp, rice(Oryza sativa)
  misc_feature (71): n=t or c
actccgaaccattgaggtctttgctaattatctagagggagagatacccagtgagcttggttcactccaangtcttgagctcctcaatctttacaataata

SEQ ID NO: 2500 - DNA, 101 bp, rice(Oryza sativa)
  misc_feature (71): n=t or c
taccagtgaaaagattgtaatccataaacaatatactgagactctttagattacctatttctggcggtatnggtccatagattttgttatttcttagccat

SEQ ID NO: 2501 - DNA, 101 bp, rice(Oryza sativa)
  misc_feature (71): n=a or g
tataagcaactgatcagttatctcgcgtgtgctccagtacagactacagtacagccaaccaaaagaaaatncagagtaagatggcacccgtcgtcatcagc

SEQ ID NO: 2502 - DNA, 101 bp, rice(Oryza sativa)
  misc_feature (71): n=a or g
agaatagagtcaaagcaacacatatactgaagcaacaataaataaggttcctagtcaaaccatgatgtgtntactgctgtccggcggtatggtcaaactca

SEQ ID NO: 2503 - DNA, 101 bp, rice(Oryza sativa)
  misc_feature (71): n=a or g
tcaagtcctcggagcgctagcaggtgttctggctagaaatccagccgacgttcctcctctggctagacctngaggtatagccggtcgcaccagttgaggat

SEQ ID NO: 2504 - DNA, 101 bp, rice(Oryza sativa)
  misc_feature (71): n=a or c
taaactactacctccctattcactccacaaatacatacatgttgtaatggtcttcaaaataatttttctcntgaactacttatccaatctacgatatgatc

SEQ ID NO: 2505 - DNA, 101 bp, rice(Oryza sativa)
  misc_feature (71): n=a or t
ttttctacggtggccagcgctgccgtcaatgatcaataaccaatgaaaatgcaccattttcactagcaggnaaccttgcctagccgccagcggaaatggtt

SEQ ID NO: 2506 - DNA, 101 bp, rice(Oryza sativa)
  misc_feature (71): n=t or c
tctagaggtcaaagacaatgctcggggcactgaagatgtacaaaaaagcatgtgagtcttttttatattancacttatcgatgttgagtatatcagcttaa

SEQ ID NO: 2507 - DNA, 101 bp, rice(Oryza sativa)
  misc_feature (71): n=a or g
gcccacacacaccgcctcagcccgatccatccaccgatccacgtacggctccaccacacacagtggctggnttcgtttctcctgcgcatagaaaacgaaaa

SEQ ID NO: 2508 - DNA, 101 bp, rice(Oryza sativa)
  misc_feature (71): n=t or c
atcatacacatacgactctaccaaatctgcgcatacgctcagttatatgagctcatatgaatcaatttacnatagatgttgaccaaactgggacaatgttt

SEQ ID NO: 2509 - DNA, 101 bp, rice(Oryza sativa)
  misc_feature (71): n=t or c
gctgtgctgcctgcatttgcagcaagtcacattccattgcagaggatgcttttgcatgggctttgtcagangatcaagaagaggttttcaaggctgcaatg

SEQ ID NO: 2510 - DNA, 101 bp, rice(Oryza sativa)
  misc_feature (71): n=t or g
cttcttccagttctgctattaatctagtacttagccaaaaccaaaccgttagacctatatccaacatttgntacctcgagatatcacatattgcaacgcac

SEQ ID NO: 2511 - DNA, 101 bp, rice(Oryza sativa)
  misc_feature (71): n=t or c
tggtggttgccaaggactgtcaggacctgtcgtccagtaaaaaccgttgacaggtgagcactataaacgcnagtacaccacactgatcatatatacattgt

SEQ ID NO: 2512 - DNA, 101 bp, rice(Oryza sativa)
  misc_feature (71): n=a or g
gttagtgcaattccatgcaacatttaaagtgtgatgcaatatccactggatatatggagcaccttgattgntgataattaatttaaaaacatgaaaatttt

SEQ ID NO: 2513 - DNA, 101 bp, rice(Oryza sativa)
  misc_feature (71): n=a or c
tttgtgcaagtttggaaaaaaatcataacgcgcacacaagtgatgagattcggtctcgcgacctccatttnacgaaaatagcgtgttattgtgattttttt

SEQ ID NO: 2514 - DNA, 101 bp, rice(Oryza sativa)
  misc_feature (71): n=t or g
taccagtggtttgcttactccaactgtaatgatgtccatgtgccgtttttttgttaatagaatttaagagnagttttcactttggaggatatgatagtatt

SEQ ID NO: 2515 - DNA, 101 bp, rice(Oryza sativa)
  misc_feature (71): n=a or g
gttgactggaacttacaggcttgttaactggaactaacaaggctattcgaaaggaatgccagaaagcatgncatgtaacactaaaagagaggcagaatgtt

SEQ ID NO: 2516 - DNA, 101 bp, rice(Oryza sativa)
  misc_feature (71): n=t or g
tcgtgtttttttttggcttcttacacgtgccgctgaattgtgtatttgtttggggttatttgtaggtctgnttttttacattttatcatgttaattttggc

SEQ ID NO: 2517 - DNA, 101 bp, rice(Oryza sativa)
  misc_feature (71): n=t or c
gtttaacatcacatagcactagatcaactgatagattgcccttttcgtagctgactgaaccaactaaatcnatggttgattagtggttctcatccagttga

SEQ ID NO: 2518 - DNA, 101 bp, rice(Oryza sativa)
  misc_feature (71): n=t or c
tggcccaatttgtacctttttttttttgaaaaagagtactcgatcgagtagtttactctctctgccctganaaaaaaaactaacatagtaccgaatatata

SEQ ID NO: 2519 - DNA, 101 bp, rice(Oryza sativa)
  misc_feature (71): n=t or c
cattatcaatgatgccttaattgtaaaagtaactagttctaggcattctaaggtaaccattgttcaagtgntagccatctagatactacttattgtactaa

SEQ ID NO: 2520 - DNA, 101 bp, rice(Oryza sativa)
  misc_feature (71): n=a or g
ctagtaaaaataaacatgactatatcacagtaaccttcttggatataatggactaaataggtctattacanatcgatgaaatctcagagagcttgttgtaa

SEQ ID NO: 2521 - DNA, 101 bp, rice(Oryza sativa)
  misc_feature (71): n=a or g
aagaaaaaaaagcaacaaatataatccattttctcagacttggagattgtggcactctatgcaaattgccngctgccgatgatggagcacaccatggagga

SEQ ID NO: 2522 - DNA, 101 bp, rice(Oryza sativa)
  misc_feature (71): n=t or c
gccaccaaggttagatcattcatgctgcgagagaaaacacacatttttcactactgcatcaacatgattgngtgtacgtacagaatcggatcgaggtgtta

SEQ ID NO: 2523 - DNA, 101 bp, rice(Oryza sativa)
  misc_feature (71): n=a or c
cttcctcctgtcttttctctctcctaaagatgtcgcatcgaggactctcgccagtgatggacggactagcnggcggagggagccaacgagcgttcgtgcat

SEQ ID NO: 2524 - DNA, 101 bp, rice(Oryza sativa)
  misc_feature (71): n=a or g
cctgattttgtcacttcgagtttggctgaccgactgaccagcaacgaaacgaagtttaaaattacgagtanaaatatgttccacggcagcgggcccgtcga

SEQ ID NO: 2525 - DNA, 101 bp, rice(Oryza sativa)
  misc_feature (71): n=a or g
tcttccaggacgacgacgatgacgacggcgacttggagtagagggcagtggccatggtggtagtggtagtngtaggaggggggggggcgtgtagaggagga

SEQ ID NO: 2526 - DNA, 101 bp, rice(Oryza sativa)
  misc_feature (71): n=a or g
tgttcgggtgggcagccgggctggtcagccatggtagggtggaggtcctcctgcgcagcgacgatgatgcngcggaggatctggagagagtggagcggttc

SEQ ID NO: 2527 - DNA, 101 bp, rice(Oryza sativa)
  misc_feature (71): n=t or c
gctatttacccaaaaaaaagccaacctgtagaaaatgtgacccctgctcagggtttacgattccgacaggnccttccgtttcgggcaccggcggaattcgg

SEQ ID NO: 2528 - DNA, 101 bp, rice(Oryza sativa)
  misc_feature (71): n=a or g
aactctctagtctttacctgttccactgtgaaacgagagaggcttaaagagagacgcagctttagagcagntataatagcaggctataaactagctataaa

SEQ ID NO: 2529 - DNA, 101 bp, rice(Oryza sativa)
  misc_feature (71): n=t or c
ctatttcctaacttaaacagattctttccctatacttgtagatataccgtatccgtatatctcataactcnaaggatagagggtatgtcttatccgtaatc

SEQ ID NO: 2530 - DNA, 101 bp, rice(Oryza sativa)
  misc_feature (71): n=t or c
atgggagaagcaaatatgttcctttcgataagatgagaagcgaaagagctaccggtgagaggggcaccaangcaggaaccggaggtggaggaggtctgcaa

SEQ ID NO: 2531 - DNA, 101 bp, rice(Oryza sativa)
  misc_feature (71): n=t or c
gactggcacctatggccggttctgaaccagtaccggtaagggattgtgtactagtaattatttcgtgcttnaggaaacaatggttctaaaatgatacagac

SEQ ID NO: 2532 - DNA, 101 bp, rice(Oryza sativa)
  misc_feature (71): n=t or g
ggtgttggatccgcccatgtactagctagtttactccttactagcagttgctaagctagtcttggccatgnaaatatgtgcaattcatgttgcatttgcat

SEQ ID NO: 2533 - DNA, 101 bp, rice(Oryza sativa)
  misc_feature (71): n=t or c
caacaagacatcgcagccatggcgtaccaatcgttcggcgcggtggacttggcggcgagcttcttcttctnctcctcctcctcctcgccgcagcctggatt

SEQ ID NO: 2534 - DNA, 101 bp, rice(Oryza sativa)
  misc_feature (71): n=t or g
agtcattcttcatccaaaacatcataatcagaatatcaaaatagaaacagccatcaggcaacaattacaantgtgacaatggatgaaagattataactgat

SEQ ID NO: 2535 - DNA, 101 bp, rice(Oryza sativa)
  misc_feature (71): n=a or g
tccactatatcggtcactccctggtgagctcatatgtgccacttgaaaatgtcaattactagacacttctnccttttcagtgatgctgtaaaaaaaattgc

SEQ ID NO: 2536 - DNA, 101 bp, rice(Oryza sativa)
  misc_feature (71): n=a or g
accattttcattttcgttttatcagttaccgtttcattggttagtagaaattgaaattgagtgtcggttgnaaatttatgtaaccgtttttaccccctgac

SEQ ID NO: 2537 - DNA, 101 bp, rice(Oryza sativa)
  misc_feature (71): n=a or c
cacaaatttcttagggaaccgtttaattctcacacgaccagagaaacaaaaaagacgtcttatcttccccnaaaaaaaaaaaccagcacgtcttatcttcg

SEQ ID NO: 2538 - DNA, 101 bp, rice(Oryza sativa)
  misc_feature (71): n=a or c
agattttcttgtttctggagcacagcactccaccaaatgaaactcaacccaattttctgtggctgaaactngtagcatcagaaatccaaaacttttttagt

SEQ ID NO: 2539 - DNA, 101 bp, rice(Oryza sativa)
  misc_feature (71): n=t or c
tacttatgtctgtgtgatatcatcacttaaaatgttccttgggaccaacggtataccgatctagtatttantatccgtttgttaatccttagtcatttttt

SEQ ID NO: 2540 - DNA, 101 bp, rice(Oryza sativa)
  misc_feature (71): n=a or g
catggcggcggcggcgtcgtctgttctggcctacctgctcgtcgttgctctccttgccatcgtgcctctcntctacttcggctgggtggcgcgccggcgcg

SEQ ID NO: 2541 - DNA, 101 bp, rice(Oryza sativa)
  misc_feature (71): n=a or g
aacattttaacaatacaatagcctttttatgattggcatagtagtaagtaaagtttgcatgctaagacttntgatttctctgtgctattagtaaacagctt

SEQ ID NO: 2542 - DNA, 101 bp, rice(Oryza sativa)
  misc_feature (71): n=t or c
tttatgtcctatcacaattcacaacactacatacctcccaagtaatcagccaacagaagagatgatttgcngcatgtatgatgctatttgatattggaata

SEQ ID NO: 2543 - DNA, 101 bp, rice(Oryza sativa)
  misc_feature (71): n=a or c
gaagtttttgcaatgatcattactggttctgctgccattataagtattgtctgctaagtcctttgtggttntgtccttaataatttggagtgaaaaaaaat

SEQ ID NO: 2544 - DNA, 101 bp, rice(Oryza sativa)
  misc_feature (71): n=t or c
gatccttcgggctgatgttttccctgcttgctaccctcttaggtctcggtggcaaagcatgtgtatttgtnactactttccaggggtcgtcattgccaaat

SEQ ID NO: 2545 - DNA, 101 bp, rice(Oryza sativa)
  misc_feature (71): n=a or c
tgtgctagcttcttaatttttcgttcaatcgcaacaacatgcgataacatcaatgctactatctctctctntatatatatatctgggagactctgaataga

SEQ ID NO: 2546 - DNA, 101 bp, rice(Oryza sativa)
  misc_feature (71): n=a or g
acaaacggttagaaggctgttgccaaaggtcaagaaaaaaacaaatactgaaaagataagctactggtggnggtaaggggtctcactgcactctaccctgt

SEQ ID NO: 2547 - DNA, 101 bp, rice(Oryza sativa)
  misc_feature (71): n=t or c
ttaggggattttcatctctgcttcatcatagtttgcctctagggacagttacccctggttttggagggagntccatcttcgaagagctacaaaggagaaga

SEQ ID NO: 2548 - DNA, 101 bp, rice(Oryza sativa)
  misc_feature (71): n=a or g
cgtagatggccgtggaccttccagattcttgatttcaatcaattataaaaagcaccacattagcaaggggnaaaaaaaagagaaaggcttcagttcattga

SEQ ID NO: 2549 - DNA, 101 bp, rice(Oryza sativa)
  misc_feature (71): n=a or g
cggatggcgtcggtgtcggcagcagcggggtggcaacaatggatgggagggaagatgcgcagtcggctacngcgggcggtcggcagcggacgacgatgcac

SEQ ID NO: 2550 - DNA, 101 bp, rice(Oryza sativa)
  misc_feature (71): n=t or c
tttttgtagaccaaaggtcagatgacccagcttatatttgaaagctggaaactagcttgactgcttgaggncttgaggtgagtattaggttggctataagt

SEQ ID NO: 2551 - DNA, 101 bp, rice(Oryza sativa)
  misc_feature (71): n=a or c
aatggagggagcccatgcgtacaataaaaccatcgcaacatttatttaactcctcacactgaacacaaacnaagatctacactatatatcattgatatagg

SEQ ID NO: 2552 - DNA, 101 bp, rice(Oryza sativa)
  misc_feature (71): n=a or t
aaaagaccttatttttagctatatgcctattcaagatgtacagttttcatagtctataattcttctcgtanacttttgaaagcaaaccggtagaatcccaa

SEQ ID NO: 2553 - DNA, 101 bp, rice(Oryza sativa)
  misc_feature (71): n=t or c
cgttgtattggagtagattatgagcctgtttgaggagcatatggtagctggagatttttgtagaagttgcngttgctagaagcttctcaaatagttcactc

SEQ ID NO: 2554 - DNA, 101 bp, rice(Oryza sativa)
  misc_feature (71): n=t or c
gcccattctacaactcatagtaccgtgtcaactttagttcctcgacgatatagtggttgattttggttgangtggtgagacccacatgccagcagccaatt

SEQ ID NO: 2555 - DNA, 101 bp, rice(Oryza sativa)
  misc_feature (71): n=a or g
ctcttctatggctactttctcctcaactattttcagtggcggagccaacgatactgtcgagtcttgtcggncaatcagtagcttttttcgatggttaatca

SEQ ID NO: 2556 - DNA, 101 bp, rice(Oryza sativa)
  misc_feature (71): n=a or g
ctcgctcgctcgctcgctctcccgactcccgtctctcgtctccatgctgaggtgaggactcggagcagcangcaggcgcgtgcggtggggcgggcgaggca

SEQ ID NO: 2557 - DNA, 101 bp, rice(Oryza sativa)
  misc_feature (71): n=t or c
gcgacgtccggcgaggcggacacatgccactaccggacaaccaacacgccaatagttattaccccctcccnctctctctctctctctctctctctctctct

SEQ ID NO: 2558 - DNA, 101 bp, rice(Oryza sativa)
  misc_feature (71): n=t or g
tgcaaatgctagtaatcagtactaagcatgttgtgtggtcctctgtgatttgtactctgtgtgtgtgtgtnttttttatacaagatttgtaccctgtgttg

SEQ ID NO: 2559 - DNA, 101 bp, rice(Oryza sativa)
  misc_feature (71): n=a or c
agagggaagcgaccgggaaagcgggcgtcgatgaagtggaactgtggaagcgagaacgtcagcttgagtancgaaaacatcggtgagaatccaatacctga

SEQ ID NO: 2560 - DNA, 101 bp, rice(Oryza sativa)
  misc_feature (71): n=t or c
tgtgatgaatttgactaaatttgggtgtgtttcataactccaaataaacgcatagaaaatgggctgtttgnacaatagctctgtaactcaaaaaaactcaa

SEQ ID NO: 2561 - DNA, 101 bp, rice(Oryza sativa)
  misc_feature (71): n=a or g
ggcatgatcaagcacatcatgcccaaaacttcaattccaaactacaacattatcctttttcattagcaccntttctcgagctgctaaataatgtgtttttg

SEQ ID NO: 2562 - DNA, 101 bp, rice(Oryza sativa)
  misc_feature (71): n=a or g
gatcgctatcattggctgattttcgtgaaatcaacatttgtccccccgccaaatattggtaattaagtgtnaattgagcataaagttaaaagtgccacctt

SEQ ID NO: 2563 - DNA, 101 bp, rice(Oryza sativa)
  misc_feature (71): n=a or g
aattctctcactttcttggccacagctacctagctaccaacaatctctctctgattgagtgtatgtacgtncgtgcgtatgtatgtatgtacaggtgagaa

SEQ ID NO: 2564 - DNA, 101 bp, rice(Oryza sativa)
  misc_feature (71): n=t or g
ggtaccactacactcgactccagctgccggcctaagctttttttgttggagaagctagcatagcccacagnttcccttgattcctggagctggctcatcca

SEQ ID NO: 2565 - DNA, 101 bp, rice(Oryza sativa)
  misc_feature (71): n=a or g
tttattctcaccagtctaaggtgcaggttacctgagtcaatcctatcttattcttggctgcgtaaatccanttggatgtagaggccgggtttatcccattt

SEQ ID NO: 2566 - DNA, 101 bp, rice(Oryza sativa)
  misc_feature (71): n=a or g
gcgacacattggccaaaccactatatctgggaaaaaggttgaaccgtttaatttcaacggtctaatatttngatattgggagcatatcctatgcacacatg

SEQ ID NO: 2567 - DNA, 101 bp, rice(Oryza sativa)
  misc_feature (71): n=t or g
atttatgtcggggggatttggattctttggattggggctacttaaatgcggggaagaagaagaagaacatnggccgtctcggttgcgtcgcgtcacggctc

SEQ ID NO: 2568 - DNA, 101 bp, rice(Oryza sativa)
  misc_feature (71): n=a or g
gtgtgtgatctgctgctactctgcgctctgcgccgcgacctttttctatagctgtaaacgcgaggcagcantggcagcaggcagtgcgcaacgctgttgct

SEQ ID NO: 2569 - DNA, 101 bp, rice(Oryza sativa)
  misc_feature (71): n=t or c
tgagtactctttggaaattgggacttagggcctgtttggatggcctcctcttgccgcgcttcaagttagangtgccacatatagttagcccactgtttgtt

SEQ ID NO: 2570 - DNA, 101 bp, rice(Oryza sativa)
  misc_feature (71): n=a or t
cagatcaaatttcaaaattttattggtacacaaaaggaaactcttaaactgaaaattagttcatttggatntgatcattttttggagggtgttttctccat

SEQ ID NO: 2571 - DNA, 101 bp, rice(Oryza sativa)
  misc_feature (71): n=a or g
tacctattattgaaatggaattaatttccctggtttatgaaaaaaaaagaaattctcctatcaatatcacnctccttttatttagtcaccttataggttat

SEQ ID NO: 2572 - DNA, 101 bp, rice(Oryza sativa)
  misc_feature (71): n=a or t
tcttatgtggcttaggctgactccagaaaaaaaaacatggcaactcaatggctgttatacaattttgcatntgtggatagtgaattagcacatggtaaaga

SEQ ID NO: 2573 - DNA, 101 bp, rice(Oryza sativa)
  misc_feature (71): n=t or c
aaaaatcaaggtttgtagggttacctgacccacaaattaagcatggatccaccactgcaaagactttctcnagctgcttctcaggaatcatatgtagttgc

SEQ ID NO: 2574 - DNA, 101 bp, rice(Oryza sativa)
  misc_feature (71): n=t or c
ttcttgtagccagctcttttggttgtggaaataagtagagaactacagtctagagacacactctgagcttntttttttttttgaacgaattacacactctg

SEQ ID NO: 2575 - DNA, 101 bp, rice(Oryza sativa)
  misc_feature (71): n=t or c
tgggcttaatagaagctctccaacaaggtcttatccagtgttcggcaacttctcctctcaaattttactcnatcgttttctatgtacacgtatcctgaata

SEQ ID NO: 2576 - DNA, 101 bp, rice(Oryza sativa)
  misc_feature (71): n=t or c
taaattgttagcaagagtgaggacaatacaaagttacaaacacctggacaataagaattaggaaaaagtangaattacccccctgaactatcgcggtcgtc

SEQ ID NO: 2577 - DNA, 101 bp, rice(Oryza sativa)
  misc_feature (71): n=a or c
cccatatgctgcggcactcttatgcagattggggcgtagctaattaggaattagagtagatgtcacggtgngaagcgtacaatgaacgaggttcgatgtaa

SEQ ID NO: 2578 - DNA, 101 bp, rice(Oryza sativa)
  misc_feature (71): n=a or g
caagcaggcaacatgaacatttattggatgcagcccatgtggtatacagtacttatgtgagtactaatatnagctgataattatcatgattatgagttgtc

SEQ ID NO: 2579 - DNA, 101 bp, rice(Oryza sativa)
  misc_feature (71): n=c or g
ttagccatcaaaagatgggagtaaaaaaaaaaactaccaagtgagtaaaaaaagggagaaaaatctatgtngaggcgccgctgccgccgccgccggcgcag

SEQ ID NO: 2580 - DNA, 101 bp, rice(Oryza sativa)
  misc_feature (71): n=a or g
ctttgtcagcttgaattcatactaagggaacacattcaacaagggtttattaggacatagtactttttacnggttctttaaaaaatgctcttaatgtcctg

SEQ ID NO: 2581 - DNA, 101 bp, rice(Oryza sativa)
  misc_feature (71): n=t or c
gccacctcatcaccgcgtgcgatcgctttcaggccggcttggatgctacgtgtgttttccttttccagaangatgccgcatgatctgcctctgtttttccc

SEQ ID NO: 2582 - DNA, 101 bp, rice(Oryza sativa)
  misc_feature (71): n=t or g
tgatgatgccgctgatgggttgccagagaaatgagtactcctacaccattttaattcaggggctctgtgangctaaatgtgtaaggaaggcacttgtgctg

SEQ ID NO: 2583 - DNA, 101 bp, rice(Oryza sativa)
  misc_feature (71): n=t or c
tgctggggcacttaccaggttccattggatttgcaagttccatatgaaagctgcatcaagaatgctgggtngggctcacaacaatcatgtgattaactcaa

SEQ ID NO: 2584 - DNA, 101 bp, rice(Oryza sativa)
  misc_feature (71): n=a or g
aaaaaattttctatcaattttttcctttatgcataaatctcgagaatatttgatggtcataaatctgaatntattggaggtaaaaaaaacttgtaaaagtt

SEQ ID NO: 2585 - DNA, 101 bp, rice(Oryza sativa)
  misc_feature (71): n=a or g
ctgcccacctactaacaacaagcataagtgcagaagatatggggatttttttcacacaactagaaagatanctcgcgcatcgtagattgtatttggaaaac

SEQ ID NO: 2586 - DNA, 101 bp, rice(Oryza sativa)
  misc_feature (71): n=t or g
gacttcttgcggcgtctcatccggttgtttttcttgctctgcttcggtctccgcagccgctgcttcttctngcacggcgacggcggcaggtgacggctcgg

SEQ ID NO: 2587 - DNA, 101 bp, rice(Oryza sativa)
  misc_feature (71): n=t or g
gtctcccgctaccttagcttgtgctggtataaatcagttaaaattgttaggtcgctcgtgcggaggaaagntgaaagtgaaacaagtgggtatgtaaatgt

SEQ ID NO: 2588 - DNA, 101 bp, rice(Oryza sativa)
  misc_feature (71): n=a or g
catatgtccaggtatttaacactagatgaggcggacagactagtcgatcttggatttgaggacgacatcanggaggtgttcgaccatttcaaggcacagag

SEQ ID NO: 2589 - DNA, 101 bp, rice(Oryza sativa)
  misc_feature (71): n=a or g
tttttttttctgtaactgtcgctcgaataaagtcatttatcaactttgctggaagagtggaagattagcantaatcagtgtagtggagtaagttctttctg

SEQ ID NO: 2590 - DNA, 101 bp, rice(Oryza sativa)
  misc_feature (71): n=t or c
ttgcagaattgcattgtagcatgactaggacgctccatttagattagattagtagcactactcctactganactgataggtttactgattaatcatgttat

SEQ ID NO: 2591 - DNA, 101 bp, rice(Oryza sativa)
  misc_feature (71): n=t or c
ctgccatgatctagagcatgaaacatctggaaatcaatcaatcagttcagtcagtcagatcatgcagacanactacacatgcacttgtggatcatgtgtac

SEQ ID NO: 2592 - DNA, 101 bp, rice(Oryza sativa)
  misc_feature (71): n=t or c
tatcaacccgtcctttttctcggggagaacacatgtgtgtcggttggggaaccaacactaatggcttgttntgtactcccttcgtcccgaaaaaaacgaat

SEQ ID NO: 2593 - DNA, 101 bp, rice(Oryza sativa)
  misc_feature (71): n=t or c
aaattttatcgaataagcataagcaaagacgagtctgatggtctccccgttccccttccccccggcggatnggcgggaagcggagggggcttcaccttcac

SEQ ID NO: 2594 - DNA, 101 bp, rice(Oryza sativa)
  misc_feature (71): n=t or c
tggttaaaatatgtgcaagtttaccctctcaaaggaaaagaagtaggaacggaagaatatatcattacagncatcgaaattgtttcctgaagtcaatctgt

SEQ ID NO: 2595 - DNA, 101 bp, rice(Oryza sativa)
  misc_feature (71): n=a or c
aaatgccagcttatctctgaatactctgctggagatgatgcacaatactctcctatctgccatgcagaaancatgctaatcttgctaggttagtgagaatc

SEQ ID NO: 2596 - DNA, 101 bp, rice(Oryza sativa)
  misc_feature (71): n=t or c
tattataggaccgaacagatggagtataatattgttcgacgaaacatggatatgtgaggatctgtagtacnttttccgtttcatattatacttcttctgtt

SEQ ID NO: 2597 - DNA, 101 bp, rice(Oryza sativa)
  misc_feature (71): n=a or g
ttttgaagctagataagattaacaggttattctagaaactagagcttcgcttggaacatgttgaggcatcncaccaagtcattttagtctcaggcttagta

SEQ ID NO: 2598 - DNA, 101 bp, rice(Oryza sativa)
  misc_feature (71): n=a or g
atacctcgattccaacacaaataggcagttgcgggtgcttgtcacctttcccttcagaactcttcttgtcntccagatacatggaatagccgatacatcca

SEQ ID NO: 2599 - DNA, 101 bp, rice(Oryza sativa)
  misc_feature (71): n=a or g
acgcaaaaaaaaaaaatgcatgcaaagttgagaataattccttacatttctggacctggaagaactggagngcgacggcgagcgcgtcggcgtacttgtgg

SEQ ID NO: 2600 - DNA, 101 bp, rice(Oryza sativa)
  misc_feature (71): n=a or g
ccttgaggcccaatcttgatcgcagacgtttaactctatcgaccttttgtcttgtctcactgagaaacacnatatgggaacccgcctccttaaccaaggcg

SEQ ID NO: 2601 - DNA, 101 bp, rice(Oryza sativa)
  misc_feature (71): n=a or c
ctgtgtgctgcgatcgagttgtccatcagtgttgctgttcttagagaagaagactgacatctctctctctntctatatatatagaaaacccttaatctata

SEQ ID NO: 2602 - DNA, 101 bp, rice(Oryza sativa)
  misc_feature (71): n=t or g
gatttaactcttgatgatcatgatagtgcaaagcaacaccaaaaaaattgaacagttgcagtaatttaatncagctattggttatttttttaatttcttta

SEQ ID NO: 2603 - DNA, 101 bp, rice(Oryza sativa)
  misc_feature (71): n=a or t
aaagaacaccctcacctccattcgatgataccttgcaacttccatctccaaacatctcaacactactaccngtagtatactcaattaattaccgctccttg

SEQ ID NO: 2604 - DNA, 101 bp, rice(Oryza sativa)
  misc_feature (71): n=t or g
aacttcaatttgtctcgttatgcaagtactacacactattacattattaattcgatctcttacgtggaatnctctgtgtactgtccaattaaaacgttttt

SEQ ID NO: 2605 - DNA, 101 bp, rice(Oryza sativa)
  misc_feature (71): n=t or c
ttaaattaagcactttcttaacgcatattatggtctgtttagggagtttaagattttaagaagtagttggntggtaactagtttatgaggatctggaaaaa

SEQ ID NO: 2606 - DNA, 101 bp, rice(Oryza sativa)
  misc_feature (71): n=t or g
tacttaccaatatataggatgtaatacctattcaagcatactacaaatatgcagtggcggaggcagcgtgnggttaaaatagactttgtctgagattgcta

SEQ ID NO: 2607 - DNA, 101 bp, rice(Oryza sativa)
  misc_feature (71): n=a or c
ccgatggtctaaatggctatgacgttggacaaaacactcatgagtcttattttcatacaggagataggggntaccataaactctgggatagtcgtctgttc

SEQ ID NO: 2608 - DNA, 101 bp, rice(Oryza sativa)
  misc_feature (71): n=a or c
tgcggaacctgcccatcatgacctcgctctctagggtagaattgtccgtcccaacctggaggaacgaacanaaccatagaaaagcttgagacagatgcata

SEQ ID NO: 2609 - DNA, 101 bp, rice(Oryza sativa)
  misc_feature (71): n=t or c
gccccatagccgtcgcaattgtgcgggagctcaagatcgtgtgttggaggtcatctcccatcatccccccncccctcgcacctcaccttcctatacggtcg

SEQ ID NO: 2610 - DNA, 101 bp, rice(Oryza sativa)
  misc_feature (71): n=t or c
gaaccatttctcctaagactatttaatattcacaaatattttgtttgattggtctcgaggctaatacttgngaaattttaggttagaacaaatattattct

SEQ ID NO: 2611 - DNA, 101 bp, rice(Oryza sativa)
  misc_feature (71): n=a or c
ggatacataagaggaggatgggggtcatgcagcgacggagatgacgctaacgcgacggctcaagcgacaanaaagtgggcgattatggttacatagataag

SEQ ID NO: 2612 - DNA, 101 bp, rice(Oryza sativa)
  misc_feature (71): n=a or g
gacttcggatctagcaacggggaccctgcatcaggccacagcggcgctggatcaacaacctcatggtgggnttggccgccccgagctcctccagcttgcca

SEQ ID NO: 2613 - DNA, 101 bp, rice(Oryza sativa)
  misc_feature (71): n=t or g
tatatatcgattgggcttgctagctagcaaatttcctactgctagtaaaaagtacgagtagtaagatcgangaagcagctgcacgctatcttttcggtcga

SEQ ID NO: 2614 - DNA, 101 bp, rice(Oryza sativa)
  misc_feature (71): n=a or g
ttcgctctccataactcgggagcacgcagcgacttccaacttcaaattggtggattgcgcgaaggggaggnggaggcgccaatcgtgcaagggggtagggg

SEQ ID NO: 2615 - DNA, 101 bp, rice(Oryza sativa)
  misc_feature (71): n=t or c
gaagagagagataagcctgagttattttagagactcttctcctttctctctttctcactacagtaaattcnccttctctctttctcgctacagtcccccct

SEQ ID NO: 2616 - DNA, 101 bp, rice(Oryza sativa)
  misc_feature (71): n=t or c
tatgcaatttttattatattgataactggatgagacggcagcatatacatatcacgacatgattgttactncctccgttttacaatgtaagttattctagc

SEQ ID NO: 2617 - DNA, 101 bp, rice(Oryza sativa)
  misc_feature (71): n=a or g
ttgcccctgacacatattttgtgatgatcgacttgcattgtgtttgtaaccattactccctccgttttagntcataagttgttttaactttgatcaaagtt

SEQ ID NO: 2618 - DNA, 101 bp, rice(Oryza sativa)
  misc_feature (71): n=a or g
taaaactccctactcacctgagtacctcacaatgtctaagtgtccctttaaaaggcactagcaatcgtgcncatgcaatgcacattttcagccatatacat

SEQ ID NO: 2619 - DNA, 101 bp, rice(Oryza sativa)
  misc_feature (71): n=a or g
ctagttagaggtccaaagatcgatgcaagatgacgagagactgaagtaatttatctcaaaatacaaacaanttagttctaattaaggttttgggtttgaca

SEQ ID NO: 2620 - DNA, 101 bp, rice(Oryza sativa)
  misc_feature (71): n=t or c
aaagcacatagcaagctgataacagcccatcccctacttgcctccgttttcgcaattgtttttgttccttnaagagatttacacgtgttgggctgttttgc

SEQ ID NO: 2621 - DNA, 101 bp, rice(Oryza sativa)
  misc_feature (71): n=t or c
gaggattctgggagagcatgtaacagctcatgtgtgcttaaccgcaaacgtggattgtgatttactcgtgntgtttgtatctttgtttctgacgattgatt

SEQ ID NO: 2622 - DNA, 101 bp, rice(Oryza sativa)
  misc_feature (71): n=a or g
aatcacgaagcaaatcctaatgttagaaatttgcaatattttgacctaattttctgccaatagacatttanaaattctcttttttaccatcatttaaatta

SEQ ID NO: 2623 - DNA, 101 bp, rice(Oryza sativa)
  misc_feature (71): n=t or g
gacctacattgttgtttctagaaagcgcaacaaaaaactgcacatgaaaatcaaaattacccatccagtanttgactgattcctatacatggaaatcaact

SEQ ID NO: 2624 - DNA, 101 bp, rice(Oryza sativa)
  misc_feature (71): n=a or g
ttatgtctggagtttgaacgggacaaattaggggcgtgttcggtaatcattcctttacgctgcagtgcttntgttgtgcggctgcagctgcagaaaatacc

SEQ ID NO: 2625 - DNA, 101 bp, rice(Oryza sativa)
  misc_feature (71): n=t or g
accaatttagtgaacacattaatctttcaaaaacaaactctcaggtctcagcctagtccacattgccaagncccactggagaagaggttctgttctaaaga

SEQ ID NO: 2626 - DNA, 101 bp, rice(Oryza sativa)
  misc_feature (71): n=a or g
agatctattttaaaacatacctaaactctaattagtgtgatagaaggttatacaacttacaacagcaaagnaaaaataatttgtaaataagcgaaacggta

SEQ ID NO: 2627 - DNA, 101 bp, rice(Oryza sativa)
  misc_feature (71): n=a or c
actcctcccccacctcgtaagcagctctctgcactggcctctgatgactctggtctcctagtcctagcctntcactccgtgcgcgccgctcacaggaaccc

SEQ ID NO: 2628 - DNA, 101 bp, rice(Oryza sativa)
  misc_feature (71): n=t or c
atttttcattgtttgggtcacaagaatttaacttattaaaacgatacaatattagtgtacatcctctattntaaaatataagcatttttttttacaattta

SEQ ID NO: 2629 - DNA, 101 bp, rice(Oryza sativa)
  misc_feature (71): n=a or g
cacatttccttactgaaaagtacacattttgcattggtgagaaagatatacgtacgtaaattcagaagaanaagagaaaattcagaataaaaatttgtaca

SEQ ID NO: 2630 - DNA, 101 bp, rice(Oryza sativa)
  misc_feature (71): n=a or c
ttagaaggggtgaggtttcgaatccagatcatctaattaacccacgaccttgtgaagttagcaggaagatncctgagataaccgcaaaatatgcaatgcat

SEQ ID NO: 2631 - DNA, 101 bp, rice(Oryza sativa)
  misc_feature (71): n=a or g
cggccccacaacccacgaggtgataaggccaacacctcctcttcctcgatcttatctcctcgtctctcacnccgctctctcagctctccctcccccccccc

SEQ ID NO: 2632 - DNA, 101 bp, rice(Oryza sativa)
  misc_feature (71): n=t or g
agctatgctagagacaaataaatcttcataatattgctagcttgctctccctctagatctggcaaaggganggcaccacggccaggccgcgccatgcgacc

SEQ ID NO: 2633 - DNA, 101 bp, rice(Oryza sativa)
  misc_feature (71): n=a or g
caaaggctctctgggggaaataaactatggcagctcaacaaaggttgtggtttgtggccacaacggcatgntggcaacggctcttccatgagataagcttt

SEQ ID NO: 2634 - DNA, 101 bp, rice(Oryza sativa)
  misc_feature (71): n=t or c
atttgttgatttatgccaaccctgatatagatttggattgtgtgagtgcacttaaggttgattgggatggntacacaattggatactatggtcgcattttt

SEQ ID NO: 2635 - DNA, 101 bp, rice(Oryza sativa)
  misc_feature (71): n=a or g
ctatatatgtgcagccccgtgaaagactgaaagattcttgacattttcacaaacaaacgatcgattcttgncattctgcaatacactatagccaaactatt

SEQ ID NO: 2636 - DNA, 101 bp, rice(Oryza sativa)
  misc_feature (71): n=a or g
ctttcctgtgccaggattttcggctttattcccatccatttcatgttttcaacacatgaacagtagtattnttcagagatagtggcagagctagaaaatct

SEQ ID NO: 2637 - DNA, 101 bp, rice(Oryza sativa)
  misc_feature (71): n=a or g
acataaccatcaaggatatggtaaagctaacattcagacaggtgaatcacatgattcgaagggctaacgcngatatggtaaagctaacattcagacaggtg

SEQ ID NO: 2638 - DNA, 101 bp, rice(Oryza sativa)
  misc_feature (71): n=a or c
atttgccgctttgccattttcgtttttccagtgatttccaaaatgtttttttgcccttacgcgtggtgatnagatgaaaatgcccctatctatggtaagat

SEQ ID NO: 2639 - DNA, 101 bp, rice(Oryza sativa)
  misc_feature (71): n=t or c
tacataactaagctaaccagaattaagcttttaattagctgggcattaattgtactccgaagcacccccanaactcctatgaggtatactactcactccgt

SEQ ID NO: 2640 - DNA, 101 bp, rice(Oryza sativa)
  misc_feature (71): n=t or c
tttgcttggacgatcaagtatcaacatctgattctttggtctactcttcccatttagatacaagcttcctngagttttgcatcaagcaaccaactgttgag

SEQ ID NO: 2641 - DNA, 101 bp, rice(Oryza sativa)
  misc_feature (71): n=a or g
tcgtttcttatctcgctctccctcttcctcgcttctctcgctccctcttctatggacgcggccgagcttcncggcgttgacgatggcggcggcgcagttgt

SEQ ID NO: 2642 - DNA, 101 bp, rice(Oryza sativa)
  misc_feature (71): n=a or c
ttagtgttttatcattgtttttgttttcttttttgtcatgtgtaagctcaagctatcctacacgtggctcngccccttcatcaaagcaaagggtaaattct

SEQ ID NO: 2643 - DNA, 101 bp, rice(Oryza sativa)
  misc_feature (71): n=t or c
attttcttcaggtggttctgaactggctgatctgccaaggcaacgttgtgccgatccccggagcgaagaangcagagcaggccagggagttcgctggtgcg

SEQ ID NO: 2644 - DNA, 101 bp, rice(Oryza sativa)
  misc_feature (71): n=t or c
gtgaccttcaatcaaccaatctctagaactctaatactctaatactggtactgactctaaccgatgatgantttggaggttaattactaaatttttgtatt

SEQ ID NO: 2645 - DNA, 101 bp, rice(Oryza sativa)
  misc_feature (71): n=t or c
tattggtcatgctcaagctctaaagtcattcctaacactccatgttatctagtgtctgtagcattaaatanattatcacgtaagaaaaaatatgatgtgac

SEQ ID NO: 2646 - DNA, 101 bp, rice(Oryza sativa)
  misc_feature (71): n=a or g
tgaaggacctataaaaggatttagccttgaaggatctaggtgacttacactactttcttggcatagagatnaacaaggcatctagtggcattgttctaacc

SEQ ID NO: 2647 - DNA, 101 bp, rice(Oryza sativa)
  misc_feature (71): n=t or g
ctggaaaatgaagtgcgaaacctatttccgtgtgagtggaatttgctctgaagtgtgggtaggtgttgctnctttgcaattttccgggggggggggggggg

SEQ ID NO: 2648 - DNA, 101 bp, rice(Oryza sativa)
  misc_feature (71): n=a or g
tctctctcttcactcactctctcggcgagatcgcgaggacacagagagcggcggttacagcagcgttgtcntcgtgggacacagaggaatgcggaggccgc

SEQ ID NO: 2649 - DNA, 101 bp, rice(Oryza sativa)
  misc_feature (71): n=t or g
tgaatttcatacttggcaatcctccatgcatcatagttttctatagccaacctttcattcagcacgacttncccctataaattggccccgttttgttagcg

SEQ ID NO: 2650 - DNA, 101 bp, rice(Oryza sativa)
  misc_feature (71): n=a or g
ggcggcggcgggcgtcggatgcatgacagcccagccggatttgatggctccgttggtcagttggttcgtcngctccgttcttttctccaacaagagttgga

SEQ ID NO: 2651 - DNA, 101 bp, rice(Oryza sativa)
  misc_feature (71): n=a or g
gtattcttcaatgcaaatccgtcagtgctggatatctaacttgaccatgtcttcatctccgtttcaatacnttcctagctagctacggatccctccgtccc

SEQ ID NO: 2652 - DNA, 101 bp, rice(Oryza sativa)
  misc_feature (71): n=a or g
gctgcttatcccacggccatggagtcacgacgcagaggttcgattgtgctgcgaccttctgttagccactngattcactagcatgggataggtctcaatcg

SEQ ID NO: 2653 - DNA, 101 bp, rice(Oryza sativa)
  misc_feature (71): n=t or c
gagtgctatttagtaaaggacgaagactgaattcaagaaagcagaagatcaaagacaaacgttggtgttantcctttatcaacactctgtgaagatacaaa

SEQ ID NO: 2654 - DNA, 101 bp, rice(Oryza sativa)
  misc_feature (71): n=a or c
ctctttgatggtatctagagggtcaatgacattccccagtgtcttagacatttttcgtccctgaaaattancttgctaattagtccatggaaacagagagc

SEQ ID NO: 2655 - DNA, 101 bp, rice(Oryza sativa)
  misc_feature (71): n=t or c
gccttctctctatcgctgctggcctatatagcaatacgctatcaagcctcactcactagccgtggcccagncgatagttactgggtccactcactcgctgg

SEQ ID NO: 2656 - DNA, 101 bp, rice(Oryza sativa)
  misc_feature (71): n=t or c
ttttcaaataaaaaagagaaaatactttccattggcatgatttttgagtcagaagtagctggtttaaagancacatttcgattagaaatcaatgggaatcc

SEQ ID NO: 2657 - DNA, 101 bp, rice(Oryza sativa)
  misc_feature (71): n=a or g
gtgagtgatcatggtcctcatgttcatccataatgttagtggggtatgggcacatggctcgtgtcctgagnggcatgtgtgcgtgtgctcacttggggctt

SEQ ID NO: 2658 - DNA, 101 bp, rice(Oryza sativa)
  misc_feature (71): n=a or g
aaccacttctcttccatcttttctctgcacggtggtgacattcacggagccaataaagtcataggtgtccngcagtagtacgtggcttcctacttccatcg

SEQ ID NO: 2659 - DNA, 101 bp, rice(Oryza sativa)
  misc_feature (71): n=t or c
ccatatttttcatccattcatgagattacaaccggatggaatttggttcccaacatgcaaactattactanacgtacgcggccagctccatcgcgtaggca

SEQ ID NO: 2660 - DNA, 101 bp, rice(Oryza sativa)
  misc_feature (71): n=a or g
ctgccatccaagaagatatagatagtatagatagatggataccaaccgaggcctcgcggcggtggtggcgncaggcccggcggcggaggagagggtgcggg

SEQ ID NO: 2661 - DNA, 101 bp, rice(Oryza sativa)
  misc_feature (71): n=t or c
tttttgatgccggtggcaacgcccatccaatcgattttcgtctcggatttatatcaaattgttacactatntctgttattgaaaatgatgggttcttttat

SEQ ID NO: 2662 - DNA, 101 bp, rice(Oryza sativa)
  misc_feature (71): n=t or g
tttctgattaagtttcaaaaaaaatacaagctaatatttaaaatttgatcatattgtgttgggattcaacngtttttaaacattttttataacattaggaa

SEQ ID NO: 2663 - DNA, 101 bp, rice(Oryza sativa)
  misc_feature (71): n=t or c
gcagcaactacttcggctgtgcgaattcgggatgccattgttgccaccccgcaagttcagataatggcgcngccgaggccgccgccgccgacgacgacgac

SEQ ID NO: 2664 - DNA, 101 bp, rice(Oryza sativa)
  misc_feature (71): n=a or g
tgaaagacctttcagcctacacatacattcttgttaaagtaccgcataaaacttgatattttataactccnaatctccccccccccccaaaaaaaaaaagt

SEQ ID NO: 2665 - DNA, 101 bp, rice(Oryza sativa)
  misc_feature (71): n=a or c
cttctctgagaaacatttagtagcacgaactaaaccggtgtatctaaaggctataattccaccatcattancttgactgccatataatggcacaccacacc

SEQ ID NO: 2666 - DNA, 101 bp, rice(Oryza sativa)
  misc_feature (71): n=t or g
cataattttctaagcattgaagcaaatgcttggaggtggacagacgctaagacaaaagaactacatccatngtctgctacatcggattggtacaaaatttg

SEQ ID NO: 2667 - DNA, 101 bp, rice(Oryza sativa)
  misc_feature (71): n=a or g
tcacccctgtggaattaacagtgggattgaagttgtggtacctcaagaacggtaaaatttctcttggatangtgctatgaaattatcaagtctgaagttca

SEQ ID NO: 2668 - DNA, 101 bp, rice(Oryza sativa)
  misc_feature (71): n=a or c
tttctgcggattagttgacatgccatgatctaaattttttgtagttggcttcgataagttgattttcaccncacacacacacacattcactttttttgaac

SEQ ID NO: 2669 - DNA, 101 bp, rice(Oryza sativa)
  misc_feature (71): n=t or g
acctgaagaaggcgttcatcacatcgagcttgccatcctcaccttctaccctgtcgtcggtgacggtggcngcaccgggatcggcgatgacggtgtgttga

SEQ ID NO: 2670 - DNA, 101 bp, rice(Oryza sativa)
  misc_feature (71): n=a or g
gtagcatggtggtatagctctagtaacaagtcttcgggatcacacatgggttgatatgacatgagaaattnttgggtttagtctcacattggtaattgata

SEQ ID NO: 2671 - DNA, 101 bp, rice(Oryza sativa)
  misc_feature (71): n=t or g
aattaatctatctatcgatcgatcacgccagcaaagacgtgtgtcagttaattgcatatcgaggacaaatncaggacactatggaatctgcttgaaatcaa

SEQ ID NO: 2672 - DNA, 101 bp, rice(Oryza sativa)
  misc_feature (71): n=t or g
aagatgatttctagataaacttggtatcttatatttgtagcttgaaaatcgccgcaaaaataaactgcgtntaaaaatactgattcacaaattcacaattc

SEQ ID NO: 2673 - DNA, 101 bp, rice(Oryza sativa)
  misc_feature (71): n=t or c
gtactttctactttcgaaggttggctctctatgtgcctcattttgcatctctatccgtttcccttaagcgngattcggcgattgttgcatagatttttacc

SEQ ID NO: 2674 - DNA, 101 bp, rice(Oryza sativa)
  misc_feature (71): n=a or g
actgatagtgagccgtgaagtagccgtcgaagcagccagactggtagaacctgacatcgtgccggtattcnaccggccgaagcgtgttgttgaacttctcg

SEQ ID NO: 2675 - DNA, 101 bp, rice(Oryza sativa)
  misc_feature (71): n=a or c
atagaacatagacttattgcatgttattgccccttttgttatgatgcaagtttagtttatggtgcttgaanccccccccccccccccttttgctgttatag

SEQ ID NO: 2676 - DNA, 101 bp, rice(Oryza sativa)
  misc_feature (71): n=a or g
tgaggaaagacttacagttctcacttgtactccaacagataagttcacaaaacaaattggaagcaaatatnagtaaaaaaaatgatagcaaaagcaaggat

SEQ ID NO: 2677 - DNA, 101 bp, rice(Oryza sativa)
  misc_feature (71): n=t or c
tgccagcacgtccgctccggacagctgacttcatcctcggttttcttcggtaagccatttttctctatacngctctttcttgctgttgcttcctgaagaca

SEQ ID NO: 2678 - DNA, 101 bp, rice(Oryza sativa)
  misc_feature (71): n=t or c
acaaggaagggaagcagctgcatgcgcgtttccgaaagctgtggtcccttatttggccaggttcaggtgtnaggcgacgacgaccctctgcctctgcctct

SEQ ID NO: 2679 - DNA, 101 bp, rice(Oryza sativa)
  misc_feature (71): n=t or c
aaatgactttatgtaaatgatgcagataaaaaatcgtcataggattgtggaaataactgatggtatattanaggattcaggtgaaacatacatagactact

SEQ ID NO: 2680 - DNA, 101 bp, rice(Oryza sativa)
  misc_feature (71): n=a or c
ctaatcgggtttcagtgatgaatgaattttgtagatcctacttaagtttcaaattactactaggcgttccngatttgtgctatttttgggaaatacatgta

SEQ ID NO: 2681 - DNA, 101 bp, rice(Oryza sativa)
  misc_feature (71): n=a or g
tttttacccttccttttatactttggaccacctaaactttgatagtacattaacagcctctaagcatatcngcactctcatgccgatgatctatacttgtc

SEQ ID NO: 2682 - DNA, 101 bp, rice(Oryza sativa)
  misc_feature (71): n=t or c
gaaaatcataattgtttctcaaaaaaaaggaaaactattattgtggatataagtcaaactaggaagaactngtgttgtttattggaaaaaaaagacattat

SEQ ID NO: 2683 - DNA, 101 bp, rice(Oryza sativa)
  misc_feature (71): n=a or g
tagtgtccatgttgccatgatgaactttgtttcaaccctcaacccctgcttgatttgcaaagagcatcagnaagttgcaaaatgggtatagcttagacaaa

SEQ ID NO: 2684 - DNA, 101 bp, rice(Oryza sativa)
  misc_feature (71): n=a or g
ttcaaatcactgatgagatctagatatcactaacggcaagaaacattaaagatttgcccttcaaatcactnatgagactagatatatcactgtttcaacat

SEQ ID NO: 2685 - DNA, 101 bp, rice(Oryza sativa)
  misc_feature (71): n=t or c
gagggacgacggtagtggcgcaagagacacatgatcctctaaggttgatgtcatgtgactttttttatggnaaaaaaaactcggatttacatgtcagaaat

SEQ ID NO: 2686 - DNA, 101 bp, rice(Oryza sativa)
  misc_feature (71): n=a or c
aagtttcagggtataaagatttttctaactgctatcaacattcagcaatacatccttgcaaaaaaaaaaancccaacaaaatgatcctgccctgatacatg

SEQ ID NO: 2687 - DNA, 101 bp, rice(Oryza sativa)
  misc_feature (71): n=a or c
cagcataagatttctctattacaaacatgcttttaccaaagacaggaaaaacaaagcatatgtccacgggnctcaccactttcatgtgatgttttatatct

SEQ ID NO: 2688 - DNA, 101 bp, rice(Oryza sativa)
  misc_feature (71): n=t or c
cggcttatgaaccgcgcttcaggctctcttggtttggcttaagcttttaactgacattttagcttccatantaaattttaagtcattggcttttaagagcc

SEQ ID NO: 2689 - DNA, 101 bp, rice(Oryza sativa)
  misc_feature (71): n=a or g
ataaatattgaatttcagtgagacaccaaaaattcatagaaccaaaatcttaaatgtgcaacatggtcaanttacaaaaacattttccttctcgtacatga

SEQ ID NO: 2690 - DNA, 101 bp, rice(Oryza sativa)
  misc_feature (71): n=t or c
atgagtctaaaactatgatgtgctatgtaatattgcagaactcttgggctagaacttattattacctatcnatataactaatttatttatttatttaaaat

SEQ ID NO: 2691 - DNA, 101 bp, rice(Oryza sativa)
  misc_feature (71): n=t or g
acgagatgaatggagaactatccagttcatgctttcttgacatcctactgtttggatgcataaacgggatnatatgtgtttggagacagcaagatattacc

SEQ ID NO: 2692 - DNA, 101 bp, rice(Oryza sativa)
  misc_feature (71): n=a or g
tccatccatgtttgacggagcacaccatggtcaaaactcaagattgagaaagggtagtagtgagggttctngtatcagtaacccctggagcttgtgtacaa

SEQ ID NO: 2693 - DNA, 101 bp, rice(Oryza sativa)
  misc_feature (71): n=a or g
gaccacactgaagttatcagtactgcagactgatattggccagccatatcaaataattgcaatgaaagatntatgtagttcaagtcttcacatattcgaac

SEQ ID NO: 2694 - DNA, 101 bp, rice(Oryza sativa)
  misc_feature (71): n=t or c
gcgcatgccacagatctcgggtattgccattttatctttttcatgagtcctctcgttatttgtatatcagnttggttaaaatttgaattttaaaactaagg

SEQ ID NO: 2695 - DNA, 101 bp, rice(Oryza sativa)
  misc_feature (71): n=t or c
agttgttctcgcaactatatatagtgttgatatgtatgtgtctttctgtagtagtgacatctatctcgttnaatctcctcagctctgatcagatcagtgta

SEQ ID NO: 2696 - DNA, 101 bp, rice(Oryza sativa)
  misc_feature (71): n=t or g
tatatgcaggtgtttttactgcgcctttctttatatacacagtattgcacttcatgttttgtatcttgatngctaagagccataaaaatcttactttatct

SEQ ID NO: 2697 - DNA, 101 bp, rice(Oryza sativa)
  misc_feature (71): n=a or g
atctacaaccttttgttttattgtgtctgaaaagccataaacattatagccgtatcttgttgtagagaatntggtttctggtttaattataatcatcatgc

SEQ ID NO: 2698 - DNA, 101 bp, rice(Oryza sativa)
  misc_feature (71): n=t or c
ccggttgtaaagcatccgcaattatcaaaccaatacaaatcgaatcccttaacgatttagacagtgatttngttctacgtgacacattgacctagttttta

SEQ ID NO: 2699 - DNA, 101 bp, rice(Oryza sativa)
  misc_feature (71): n=a or g
tatttttttaaaaaaatatgtattcctaaaacaatggaatgtgctttttaaaattgattcggctcatatcnatgggagaggtttaggccctatttggggag

SEQ ID NO: 2700 - DNA, 101 bp, rice(Oryza sativa)
  misc_feature (71): n=a or c
gtcgcacactataatattttttataagaaatggaggaataaacctataagtcactgatatgatatactctntctgtctcacaatataataattttcaggtt

SEQ ID NO: 2701 - DNA, 101 bp, rice(Oryza sativa)
  misc_feature (71): n=t or c
ctcatcacacctttacacctttatagttgtggtcaaaattggagcagtacattatcctgaatagtacctgnatataagatttcattagggatttgttaaaa

SEQ ID NO: 2702 - DNA, 101 bp, rice(Oryza sativa)
  misc_feature (71): n=t or c
agtccacaagctgagcaccactctctgccggcagctgaaactacaaaatatttttcttagatgttctcaanactgtagctaggcttaggaggcatcaagaa

SEQ ID NO: 2703 - DNA, 101 bp, rice(Oryza sativa)
  misc_feature (71): n=a or g
agatattgagagaagtaggagaacatgtgcaaagtctcatgctaactttatgtagtccgaaacagaggaancacataactgttgtacatgctaatccaact

SEQ ID NO: 2704 - DNA, 101 bp, rice(Oryza sativa)
  misc_feature (71): n=a or g
tgatgtctatgcagttgtactatttgttggccacaaacacatggatgtgtattatcttaagacaattaatncgataacattatccttgtctctacacgcca

SEQ ID NO: 2705 - DNA, 101 bp, rice(Oryza sativa)
  misc_feature (71): n=a or c
taaagttggaggcctatggaggttcttcctctgtagcattatatttttctctgatacatttttcaatatcntcacttccttaatccttgtgcaaagtcaaa

SEQ ID NO: 2706 - DNA, 101 bp, rice(Oryza sativa)
  misc_feature (71): n=t or c
agcgaatatttaatgtattaaaaaattatttggattcaatctttgtagattcgatcattgagttttcatangagtactcccttaacatatatatcaatgta

SEQ ID NO: 2707 - DNA, 101 bp, rice(Oryza sativa)
  misc_feature (71): n=t or c
cgaaacataaaagattagcacgaaaacactaaatcatgctacgacaagtttagtgtaaataagtttcattnatcggattatctactttatagtacaaataa

SEQ ID NO: 2708 - DNA, 101 bp, rice(Oryza sativa)
  misc_feature (71): n=t or c
gtgccattagcccaagtggaacgccagttggttaaccttgccaacactcagaagcaaatccctagaagggntgcacaagaacaatataggcgtccattcaa

SEQ ID NO: 2709 - DNA, 101 bp, rice(Oryza sativa)
  misc_feature (71): n=a or g
gacggttactaaattttaattattgagaagaagccaagctggctagcttaagtgttgtgtagatgttctantggaaaatgtgaaatgatatatgtttgttg

SEQ ID NO: 2710 - DNA, 101 bp, rice(Oryza sativa)
  misc_feature (71): n=t or c
tcctttattttttgacaacaaaattaaataagcctctcaggatgcttccaaattgtaaaccatcatgaggnaactagttatatactttgcattttgccgtg

SEQ ID NO: 2711 - DNA, 101 bp, rice(Oryza sativa)
  misc_feature (71): n=t or c
aacatggtcgctgccaatttgttgatttgaggctgatagcctcaggccctaagttctccaaaacttttccnaaaaatatcacatcaaatctttgaacatat

SEQ ID NO: 2712 - DNA, 101 bp, rice(Oryza sativa)
  misc_feature (71): n=a or g
tctgtgtctccttttttgatttttagatgtaaagatctctgtggtcttgcaaataactcaagttcagatcntgataccgaagatattgaaactggaaatga

SEQ ID NO: 2713 - DNA, 101 bp, rice(Oryza sativa)
  misc_feature (71): n=a or g
gatcatctagtgtgcgcctcatactgcgacgaactttatttcttgtaagaaacacaaccagaaatttttanaactacaaattttttacattgaaactttta

SEQ ID NO: 2714 - DNA, 101 bp, rice(Oryza sativa)
  misc_feature (71): n=t or c
tgacagacccacttctcctcctcctgctccccaatctccccgtctcctcatcctccccaatctagtgaaanagcggagggatccatgcggcccgcgtcggg

SEQ ID NO: 2715 - DNA, 101 bp, rice(Oryza sativa)
  misc_feature (71): n=a or g
tcggacatcgagcactcatcgatccaacgaaggtcccctcgccgccatcctccgagcactcatcaatcctngggaaaactctgcatgggatccttgtttgc

SEQ ID NO: 2716 - DNA, 101 bp, rice(Oryza sativa)
  misc_feature (71): n=t or c
gcacacaactcgttaccaaggcctaggctctcctgattatccctcaaaggggctcgaaaggattacctganacccttggaactcggtgacgctcagggcct

SEQ ID NO: 2717 - DNA, 101 bp, rice(Oryza sativa)
  misc_feature (71): n=t or c
atatcttctggttaaaagattcaaccacctgatctatgtgaaacctcaagtactacaaaattttcaactanctaaatagaagcattctaaatcttgtttga

SEQ ID NO: 2718 - DNA, 101 bp, rice(Oryza sativa)
  misc_feature (71): n=t or c
attgtaaaaaaattgactgaattttaatgtcttttcagttgactgaaaatttgatagcaccttgctttttnaaaaaagcaaaagctatttcttattactaa

SEQ ID NO: 2719 - DNA, 101 bp, rice(Oryza sativa)
  misc_feature (71): n=a or g
ggaggagaaagcccggccggcaagctcgacggtcggccgctgtcgcatgctttagcgaggagaggaattcnagagaagagatagagagggatacggattga

SEQ ID NO: 2720 - DNA, 101 bp, rice(Oryza sativa)
  misc_feature (71): n=t or c
ccgcttatgtggtccgcctgcaaaaattgtacctaccaaaaaaatctaactccttatcttctcctccaccncctccccaccactcatttccctctctctcc

SEQ ID NO: 2721 - DNA, 101 bp, rice(Oryza sativa)
  misc_feature (71): n=t or c
tttccgctaaaagacctaggtgagcctaatatgattagctctcataagtaaatttgtgaataatttaaaanattttccttaccaacctacatataaagcta

SEQ ID NO: 2722 - DNA, 101 bp, rice(Oryza sativa)
  misc_feature (71): n=a or g
gttgtactacgttgcatatgaattattcgcgaacaataatggtacatatatatatatatttggggtgattntgcatttgaccctgttataatgtccaatta

SEQ ID NO: 2723 - DNA, 101 bp, rice(Oryza sativa)
  misc_feature (71): n=t or c
gcctacaaactccatagtccattctacgagaatccagaagcttccgtaaacagagcctaaataatatagtngaaaaagagaagaattcaacaaacagacaa

SEQ ID NO: 2724 - DNA, 101 bp, rice(Oryza sativa)
  misc_feature (71): n=a or g
gaattcatatctcttggcagcatccaaattcacctgttcctgtaatagtgaaggcaaaaggtccatgggcntatgtggtttaaaaccataaacaatttcaa

SEQ ID NO: 2725 - DNA, 101 bp, rice(Oryza sativa)
  misc_feature (71): n=t or c
gagcattcgtcaaaccaaagggcatcacaagccattcatataaatcaaatttagtcttaaatgctgtcttncattcatcaccaattttcatgcgaatttgg

SEQ ID NO: 2726 - DNA, 101 bp, rice(Oryza sativa)
  misc_feature (71): n=t or c
tggttttgctttctatgaccaagaatgttaataggcatagggcagctaaggttgaagccctatgttaaccncataactctcattatatatttaaaaaaaat

SEQ ID NO: 2727 - DNA, 101 bp, rice(Oryza sativa)
  misc_feature (71): n=t or c
gttccattttactcacactggagatggtcttaagagatatgcatacatcatagtattagtaaggtgaattnggattaggtgcagttgcagtaggtaccata

SEQ ID NO: 2728 - DNA, 101 bp, rice(Oryza sativa)
  misc_feature (71): n=a or g
cagacagtcggttagccttaaaaacaaaattcttggtggcacatgattcaagaatttattggaatgcctcngaagcattacattactttctctcaaaatgt

SEQ ID NO: 2729 - DNA, 101 bp, rice(Oryza sativa)
  misc_feature (71): n=a or c
tcctccaatcctccacccaatccggcgccgaagctttctttgtgctgcacgaccccgtcgccgtcaacgcnactgcacatgagggagccatggccacattt

SEQ ID NO: 2730 - DNA, 101 bp, rice(Oryza sativa)
  misc_feature (71): n=t or c
gcatggtcccgaagaaaaatggatgggggctatagggtattacatttggcttgtccagtgttcgactgctngttcaatggacccaaaataacacactagaa

SEQ ID NO: 2731 - DNA, 101 bp, rice(Oryza sativa)
  misc_feature (71): n=a or g
ttggaggtggtgtggttgggggcaatgcggctccaggtagggtgtggcggtggcatggcccaagcaagacnagacggcgctgtgcgaaaaacgacacgcgg

SEQ ID NO: 2732 - DNA, 101 bp, rice(Oryza sativa)
  misc_feature (71): n=a or g
ccgtagtagcactgggaacaagtttcctcaccaaggaacagcctcaccgcttccttggcggcatgctccgncgacgacaaaggtttctaatttcttttaac

SEQ ID NO: 2733 - DNA, 101 bp, rice(Oryza sativa)
  misc_feature (71): n=a or g
agatatatatggaatgtttgcgaggcttaattgttgcttcaaaccagtaggctgtgttcatgcatactttntttatcagcctacaatgtttggttaggctt

SEQ ID NO: 2734 - DNA, 101 bp, rice(Oryza sativa)
  misc_feature (71): n=t or g
gttctgagcttgtggcttgggaagcatcgagaatcgttgatgtgccaagttttctggtgcaggcagcacgngctgtcaatccatttctcggtctaccacca

SEQ ID NO: 2735 - DNA, 101 bp, rice(Oryza sativa)
  misc_feature (71): n=a or g
ttatcctctccttgacttgctctcatcctctcctctcaaatattgcagcagctaggagtgagcgcagcacngggacggaggcggtggcccgcgcgtggggc

SEQ ID NO: 2736 - DNA, 101 bp, rice(Oryza sativa)
  misc_feature (71): n=a or g
atccagattggaataaaccaagagcggatctaacgttccagacctacagcagaagcttgctaggggtaacncaaatacgagaacaggtgcatattgtagag

SEQ ID NO: 2737 - DNA, 101 bp, rice(Oryza sativa)
  misc_feature (71): n=a or c
cttcaatcaaaacaggtgaaatgtgtgggatattgtgtgagaaacaactttgaatgtgtacataacttagntttccttgaatttaactttattgagtttta

SEQ ID NO: 2738 - DNA, 101 bp, rice(Oryza sativa)
  misc_feature (71): n=t or c
tctaactcaatataggttattttatatattcaagttggtttcattattactgtccctgatgctacaagtgnagaagaaaactgtgcacagtgaaattacac

SEQ ID NO: 2739 - DNA, 101 bp, rice(Oryza sativa)
  misc_feature (71): n=t or g
ttatcgtaagttcgtacgcgagtttcttttttcatgtgaaaagtaggtaaacttcaatgtttagttaagtntataccacggttatacaaaatccgtatgta

SEQ ID NO: 2740 - DNA, 101 bp, rice(Oryza sativa)
  misc_feature (71): n=a or c
caaccacctgctgccttcagccctttagctcccccaaccccaggctcaatttcagctggcaagtttgtccntgttgtctcgctttttctcctttcaagtgt

SEQ ID NO: 2741 - DNA, 101 bp, rice(Oryza sativa)
  misc_feature (71): n=t or c
gggaggcagggtgacgtgggataggaagaggcgctggacctcgctggaagccacacagcggcctccccatngttgtcggtggccatacggcggccgtgagg

SEQ ID NO: 2742 - DNA, 101 bp, rice(Oryza sativa)
  misc_feature (71): n=t or g
aatcagatccgggcttggctggtcatagctgtcgttgactcttctctatggcaacaagatgaccgagatcngtcggtgactaaggagccaggtgcacatcg

SEQ ID NO: 2743 - DNA, 101 bp, rice(Oryza sativa)
  misc_feature (71): n=a or g
ggtgtcaatgcccattaaacgcaagaacgacggtctagcctgtggttatttgcatatccacggtagtgatncagttaactctcatgcgatatactccctcc

SEQ ID NO: 2744 - DNA, 101 bp, rice(Oryza sativa)
  misc_feature (71): n=a or g
gttgcctttttttaggacggaggaagtagaccgccagtgacaccaaacatcgaaaaaaatctggtatctcntgccaaaatggcccctttgctttgcggatg

SEQ ID NO: 2745 - DNA, 101 bp, rice(Oryza sativa)
  misc_feature (71): n=t or c
aaaatttggacttagtttgtttcttcttgttcttttccatctctaaatttgaatttgacccactcccatangcaaaagccaagtttagagccttgacttgt

SEQ ID NO: 2746 - DNA, 101 bp, rice(Oryza sativa)
  misc_feature (71): n=a or g
ctaaatacatatatgtaccaacactccagtacctttaatgagaaatatcggatatgctttcatgatagtanatcactaaatcaagtattggaaaaatattt

SEQ ID NO: 2747 - DNA, 101 bp, rice(Oryza sativa)
  misc_feature (71): n=a or g
acaaggaggacatccgagcgagaatcgagaccatgatgatcgccagaaccgccgcgaacatactaatcgtnagcagcggttgccgggcgataccggtcaag

SEQ ID NO: 2748 - DNA, 101 bp, rice(Oryza sativa)
  misc_feature (71): n=t or c
cgatcgatatagataacaaactctaaaactcacaacccattgctgcacagtgctctcccatcccatccaancctcccaccgtcccacaccgaccactggtg

SEQ ID NO: 2749 - DNA, 101 bp, rice(Oryza sativa)
  misc_feature (71): n=a or g
ttcaatcattcaagaatacatgctacaaatctgaaagaaacaatagaaggattgagagagcacatgagaancaatcataaatcggagacaaccctcacggc

SEQ ID NO: 2750 - DNA, 101 bp, rice(Oryza sativa)
  misc_feature (71): n=t or g
taagaggtcatcagtgacgggtctatatgtggacacgtcaaagatgttgtgtgtcgggtctgttggttgantttgtcgacttgtgtcgataagggttagga

SEQ ID NO: 2751 - DNA, 101 bp, rice(Oryza sativa)
  misc_feature (71): n=a or g
cggtggccacagggttttccacctcatgctaatttaaggagattccttgcttcggtgagtgtcacatcctnatttttgtttcaggatttataaattattta

SEQ ID NO: 2752 - DNA, 101 bp, rice(Oryza sativa)
  misc_feature (71): n=a or c
ttctcttctctaggaggccagaagcgaatccacgatcaggagcaattaacaggcccgtcgggcttcgcagnagtgtgctctgttatgaaacgccacgagat

SEQ ID NO: 2753 - DNA, 101 bp, rice(Oryza sativa)
  misc_feature (71): n=t or c
atatttgatagtacatctgtaccgaacaggtcggtttttgcaaatatttgattgatatagacagtactttnctatttgctagtttctttttcataataatc

SEQ ID NO: 2754 - DNA, 101 bp, rice(Oryza sativa)
  misc_feature (71): n=a or g
ctcgactagggatttggggttgacgtccgatagacaatttcaacggtagtcattgtgattgcttgaatgantgaacgacggtaacacagaggggtgttggg

SEQ ID NO: 2755 - DNA, 101 bp, rice(Oryza sativa)
  misc_feature (71): n=a or g
tgttcttgaagtgaaatttctcgatgcatctactcaaattgagccgatggattgagccggctttttttgcnttcctgaggcttaatggtgccggtccggca

SEQ ID NO: 2756 - DNA, 101 bp, rice(Oryza sativa)
  misc_feature (71): n=a or g
tttgtgtgcgacttgaacaaaatatatagcatacgcattttattttgtactttcaattggttgaaccagcngtaagggaatttttttattattttttgaac

SEQ ID NO: 2757 - DNA, 101 bp, rice(Oryza sativa)
  misc_feature (71): n=a or g
gggccaggatgtcgacatcctctacagaaggaggcttgcaaggtaagcctcactgaaaacttcctctccanttcggtgtggactcagctctttcttttggc

SEQ ID NO: 2758 - DNA, 101 bp, rice(Oryza sativa)
  misc_feature (71): n=t or g
ggtgtgcaataaatccaaatccccctcaatccacttatatatgaaagggattagttgaacaaggcctcacngaaattaattctagctaatatatactacct

SEQ ID NO: 2759 - DNA, 101 bp, rice(Oryza sativa)
  misc_feature (71): n=t or c
taatatcgttaagaaataccaacaatgacatatctccttaaccgggagcacggtgtattcaaatacggtangactctgcagcgtctgcccagctttaccca

SEQ ID NO: 2760 - DNA, 101 bp, rice(Oryza sativa)
  misc_feature (71): n=a or g
gagggagtcaatgtggacttattcctgaggtgtcgcatgccagcctgggcatgattggggcacgtgggtcntgtgttggtatttcgtacgttcatagataa

SEQ ID NO: 2761 - DNA, 101 bp, rice(Oryza sativa)
  misc_feature (71): n=a or g
ccagagaacgaggagaaagcaggacctcacatcctttgacacatgttgcagaatcatcaacagccaaccgnccctgatctcaccaacagatttcagccggg

SEQ ID NO: 2762 - DNA, 101 bp, rice(Oryza sativa)
  misc_feature (71): n=a or g
ggagggctcggcgcgttagtgaggatgatggtgcgcactgttgctcgttgatgcatcaaggagaagagacnacgtgaggggcagaggcgacattgcgtggt

SEQ ID NO: 2763 - DNA, 101 bp, rice(Oryza sativa)
  misc_feature (71): n=t or c
gttgagctagaagaaggagcccaaaggggtattttggtcagcccgggtacaaaaattgatgaaaatggagngaaatggcgaatatggcaaaacaaatgctt

SEQ ID NO: 2764 - DNA, 101 bp, rice(Oryza sativa)
  misc_feature (71): n=a or g
gtattttcccaattgcatgtacttgttgtccgccaaaaccttgtagaggcactcctgcatttgtcaatctntcttcgggtatttgcatctttttgaaagca

SEQ ID NO: 2765 - DNA, 101 bp, rice(Oryza sativa)
  misc_feature (71): n=a or g
gctgcttagttttatgtagtgagcttgagagtgagaatgctgaagtcaagaaagcaaggtatcacattttnctttgcccttatccttttacacttacagtt

SEQ ID NO: 2766 - DNA, 101 bp, rice(Oryza sativa)
  misc_feature (71): n=a or g
ggtggtggtatgtaacaaaaaggaagagaacttatacctgagctacttagcatacctctacagataaaaangaaatacatcacagagcaacgtggttgtgt

SEQ ID NO: 2767 - DNA, 101 bp, rice(Oryza sativa)
  misc_feature (71): n=a or t
agatataacccgtcgaccaatatattgttataaagatgaaattgcaaataatagaagggtttaattgaaanataaataatttagaagaaaacatttaaagt

SEQ ID NO: 2768 - DNA, 101 bp, rice(Oryza sativa)
  misc_feature (71): n=c or g
agccggccggtgtctctagcgatacaggacaaaaaaaaagcttctgttcttgctaccatggttgctatganaggagcctcgccggttgttgttctggtctt

SEQ ID NO: 2769 - DNA, 101 bp, rice(Oryza sativa)
  misc_feature (71): n=a or g
caggtggctctaaattcgggatagtagtttcgttggcagagtgcaggtcaccactaacagacagacttctnccatcaacttctttggctggttcattacaa

SEQ ID NO: 2770 - DNA, 101 bp, rice(Oryza sativa)
  misc_feature (71): n=t or c
ccttaaacctggctgacgtacgatggagcgaggaacgacgggctcgaccaggacgcgtgcgcgttgatgancacggccgcggcagacggcgctgagccgct

SEQ ID NO: 2771 - DNA, 101 bp, rice(Oryza sativa)
  misc_feature (71): n=t or c
atgatttatggcagatcatgtacattaaaaacagcaggttcattcatatcattccataatccatcaacgcnattagagacgaactgccttactaagccaga

SEQ ID NO: 2772 - DNA, 101 bp, rice(Oryza sativa)
  misc_feature (71): n=t or c
gcggagcaacacgggcaaagcagcaattcaacttggggaaaggcaaattgatgcaatggtcagcatctagnaatctactgcttacataaagcctcttgatg

SEQ ID NO: 2773 - DNA, 101 bp, rice(Oryza sativa)
  misc_feature (71): n=a or t
cacaaaaaatggataaagaaaatgattaattgggttaagagatcagaggttaattaattaaggatactgangttggagttgttccaaattcacttcaagat

SEQ ID NO: 2774 - DNA, 101 bp, rice(Oryza sativa)
  misc_feature (71): n=c or g
taaaaaatgactccaattgaagtggtggggagggttttaaagcaaccagtcgaatgcccattgttcggggncctattgaacagccagttcgatagggcttg

SEQ ID NO: 2775 - DNA, 101 bp, rice(Oryza sativa)
  misc_feature (71): n=a or c
cataagatcagaggcttaatcaaaatggtggaggagatcaagtggtaacaaccctttgtcagaatgtggtntatcttgatttcttgagtagatgtaactaa

SEQ ID NO: 2776 - DNA, 101 bp, rice(Oryza sativa)
  misc_feature (71): n=a or g
gttgggggttggggtagggtttggttttttccttcttatatatgctgattcccatgggctttttgggtctncattcttgtaatgggctacatatcaagtat

SEQ ID NO: 2777 - DNA, 101 bp, rice(Oryza sativa)
  misc_feature (71): n=t or g
caccaagatggagacaattgttttccgtcgtcaagctgagcatttgaactagcttttaagatgcagatctntttatgatttttataacgtcgggtttgatt

SEQ ID NO: 2778 - DNA, 101 bp, rice(Oryza sativa)
  misc_feature (71): n=a or c
attttaccaaattcacacatatttgaaaaaatgcgaaaatttgacaggtgatgcctgtgaggcctccagtncgtctcactttaagggcccctttgaatcac

SEQ ID NO: 2779 - DNA, 101 bp, rice(Oryza sativa)
  misc_feature (71): n=t or c
gctataagctccacaacaaaagcctacataatattgcagctactcgctcaagctaaataccatgatggccnatggagtgcaagagaactgaaacgaagtag

SEQ ID NO: 2780 - DNA, 101 bp, rice(Oryza sativa)
  misc_feature (71): n=a or c
gatagaaaggatggagaaaacaatctccatcggagtgcagatgtggcgcccgagatagtcgaggaggagcngcctctgctgctcaccgcccttagtcgcct

SEQ ID NO: 2781 - DNA, 101 bp, rice(Oryza sativa)
  misc_feature (71): n=a or c
aaatcaggttgtcccagagcacttggttcaccacatacaatcagatggcacagtggttcctcaagttatcnctgaacatttggtgcgcaatattcagccag

SEQ ID NO: 2782 - DNA, 101 bp, rice(Oryza sativa)
  misc_feature (71): n=a or g
cattcggtctgaccgaaattttcggtctcggtattcggtctatcggttatcttggtctttgaaaagtgaangccgaatttcaacgtaaaaatgtcaggacc

SEQ ID NO: 2783 - DNA, 101 bp, rice(Oryza sativa)
  misc_feature (71): n=t or c
gggacagcgaccgttgcaccattcggtgctgctggggccacgcctctctgtgctgctttgtttcctccgcngatgtgaaaccaagagaggagagagagggg

SEQ ID NO: 2784 - DNA, 101 bp, rice(Oryza sativa)
  misc_feature (71): n=a or g
atcgaccgatcagttgtttatatacttgttttgcattttgactagtttcaaaatgctgtcatttgtactantgctactccctgttgtgcaatccggatata

SEQ ID NO: 2785 - DNA, 101 bp, rice(Oryza sativa)
  misc_feature (71): n=t or c
acgaaagacttatatccagatatctgctgcttatttgcatctgatgttgtactagctacaggttgtttttnttttcttgaatgcaaattgactgaaatcgt

SEQ ID NO: 2786 - DNA, 101 bp, rice(Oryza sativa)
  misc_feature (71): n=t or g
gaagatgaatcaatactacacgatcgaggcgtatcgctgtatcaggtgtaaggcagggccggccgattcgncgaatcgggacagggatcgcgctcgatctc

SEQ ID NO: 2787 - DNA, 101 bp, rice(Oryza sativa)
  misc_feature (71): n=a or g
attgttgccttctttgattctgtcctctgtgacacctgaaaaataattagtgcacaactaaatgattttangaataaacaatggactgaaatttaagttgt

SEQ ID NO: 2788 - DNA, 101 bp, rice(Oryza sativa)
  misc_feature (71): n=a or g
tgttacaatagctgtgtgtgatgtcggcacttattaggattaattcaacttgatgacacttcgtcgttgtntagttatatatatcaacaaaattttacccc

SEQ ID NO: 2789 - DNA, 101 bp, rice(Oryza sativa)
  misc_feature (71): n=t or c
attcacatgaagaaaaagttaataacgtttcttagaaaaaggttaaagcaaatgctggtggaaaagcactnacttttaactgctgatatccagagcaagtt

SEQ ID NO: 2790 - DNA, 101 bp, rice(Oryza sativa)
  misc_feature (71): n=t or c
gaaggaaaagtagtcgagatttatcataacaatacccaacacggaactgaagataaacacttcaagtcacntgggtatacacatgtgcagagtgactaagc

SEQ ID NO: 2791 - DNA, 101 bp, rice(Oryza sativa)
  misc_feature (71): n=a or g
aataatcaatagttttagttggagataactgctatttaacaacctatgtaaggcatattctatttggcagnaatttttcacgttttcctactggaattaaa

SEQ ID NO: 2792 - DNA, 101 bp, rice(Oryza sativa)
  misc_feature (71): n=a or g
gttgatggccagaaagaaacaaaaggttaacacaaaatttgtctatatgaagtaactagcaattctccttntgtgatggcagaaatttaccagatcgcgct

SEQ ID NO: 2793 - DNA, 101 bp, rice(Oryza sativa)
  misc_feature (71): n=a or t
atatatctcaatcgggccaaataaacgagatctctaacaagcgcacattcatctctaacgggcataaatanaagaccgtcaccgatgtctgtgacgggcat

SEQ ID NO: 2794 - DNA, 101 bp, rice(Oryza sativa)
  misc_feature (71): n=t or c
tatatatatcatatcgaaaatttaatcctagacaagtatggagctatggacgcactgcacgctcatatgcnataaattctttttactaatgattaagtttg

SEQ ID NO: 2795 - DNA, 101 bp, rice(Oryza sativa)
  misc_feature (71): n=a or g
ttgtcacaaactgatcaaagaccgcaaaacagctaacatgtatattttagctttcagatctgttatatctnaaaaggaataactctccccccgcgtcgccg

SEQ ID NO: 2796 - DNA, 101 bp, rice(Oryza sativa)
  misc_feature (71): n=a or c
cgtgccgctgaagtggtgctccatgaaagactttaggattggtcataggtaggacatgaaaacagtgaatncagaatattcttgttattttgatttccttg

SEQ ID NO: 2797 - DNA, 101 bp, rice(Oryza sativa)
  misc_feature (71): n=a or c
caccgatgcggtcgatctttggatggatgttgtctctaccaatggacaaaaaaaattcttgaaacttatcnaatcaaattgtgatcacgaattggatatat

SEQ ID NO: 2798 - DNA, 101 bp, rice(Oryza sativa)
  misc_feature (71): n=t or c
tcaacttcaagagtcgctggatatttcttccctcgaggcaagcttttcgcttcagtgacttcgatttcttngccgatgactacgtacagcaagctttctct

SEQ ID NO: 2799 - DNA, 101 bp, rice(Oryza sativa)
  misc_feature (71): n=t or c
atatctatcattggagagtagccaatatagttagattttgctgttaatttagattatagggcatatctacnatctcttagaggttttcatcatcttgtcca

SEQ ID NO: 2800 - DNA, 101 bp, rice(Oryza sativa)
  misc_feature (71): n=t or c
cggaggtgtcgagccacttctacctggcgccggagtcggagatggggcagggtagcatctacaggttcacngtgcctttgtttgggcccgaggttggctac

SEQ ID NO: 2801 - DNA, 101 bp, rice(Oryza sativa)
  misc_feature (71): n=a or g
ctagctccttaccccacatcctgcgcctgttgaggtcgttctccactacgtaggcgcctttgacaaggcangcagcgacgcaacggcggtgctcctccttg

SEQ ID NO: 2802 - DNA, 101 bp, rice(Oryza sativa)
  misc_feature (71): n=a or g
ggcttatagcctgctattgtacctgctcttagcacaccaactgtctgcagcatttggttcctgcaactgcngtgcgcttaaggccagacttgtttctggtc

SEQ ID NO: 2803 - DNA, 101 bp, rice(Oryza sativa)
  misc_feature (71): n=a or g
gtggtttttcttttaccgtaccctttcagtaagcgcggtaaccatgcggttaccaatggtttgggaaacangatgaattttctagctggttaatttgatat

SEQ ID NO: 2804 - DNA, 101 bp, rice(Oryza sativa)
  misc_feature (71): n=t or c
gtctgcaggctgcaggtgtttataattcagctggggctttacctccatggtattcatagttggtagtactncctctgtttctaaataacatatttcaggtt

SEQ ID NO: 2805 - DNA, 101 bp, rice(Oryza sativa)
  misc_feature (71): n=a or c
atcaagaacccaaagaaatcaaggtggtgcaaacaaatcaagaacccaaagaacaaaaacgaacaaaaaanacaagaacggcgaccaccaactccttcctc

SEQ ID NO: 2806 - DNA, 101 bp, rice(Oryza sativa)
  misc_feature (71): n=a or g
taccgcggcgagcaggatctagtcacgcacgttgcgcaagtcgacgagctggctgggaaaaaaattctctncaacggtgtgccacaccacgcctttccttt

SEQ ID NO: 2807 - DNA, 101 bp, rice(Oryza sativa)
  misc_feature (71): n=a or g
gcttttttctagtataaacatatgcatacagtttgactgataattagtcaatgtgtacagagtttaataangttcattggaaggaacaattttttaccgct

SEQ ID NO: 2808 - DNA, 101 bp, rice(Oryza sativa)
  misc_feature (71): n=t or c
atatataatgaagtgagtgatgagctttgcttatgctgaatcttgtctgttagtttattttaagccgcatnttaatttcaaaaagttttccaagaaaaact

SEQ ID NO: 2809 - DNA, 101 bp, rice(Oryza sativa)
  misc_feature (71): n=t or c
tttcaaccgcgaaaccggatataggccatcttccaacttaaaaaactaatacaaattgttggcaacttttntggtaagtcgacgagcacgatcgcagcacc

SEQ ID NO: 2810 - DNA, 101 bp, rice(Oryza sativa)
  misc_feature (71): n=t or c
cactttactcccctagactattttggcaaagcacttaactccctgccccaaataattttttatttcttttnatacccccgaactattgaaaacggttccct

SEQ ID NO: 2811 - DNA, 101 bp, rice(Oryza sativa)
  misc_feature (71): n=a or g
tcctttgacacaattatggttgctaggttgggacaatcggggtcatcgcctgggagatcatacggtggtgntggtgatgatgatgatgatgatgatgatga

SEQ ID NO: 2812 - DNA, 101 bp, rice(Oryza sativa)
  misc_feature (71): n=t or g
ccatgaaacctctttgtatcagataagcgtgtacgtccacagtccactctgctatcaaatatattctcatntttgtaatctgcacatgtacaacacatgta

SEQ ID NO: 2813 - DNA, 101 bp, rice(Oryza sativa)
  misc_feature (71): n=a or c
ttttcaggaatggggtgttttgtcctaagctcatgaaatctcagttgtccgatcaatatcctaccgacgcngtcaatcgtgccgactcacaccacgacttt

SEQ ID NO: 2814 - DNA, 101 bp, rice(Oryza sativa)
  misc_feature (71): n=a or g
gaccggacatagcttttggacatccctggaccgatttggccctggagcttggtccgtctggccttgtccanaagggctagccaaccttctggaccagccca

SEQ ID NO: 2815 - DNA, 101 bp, rice(Oryza sativa)
  misc_feature (71): n=a or g
gagaggacaatttgttttcccttttttagatggacaaccttgactatttctgtacgcgtgtgggtggtttngttctcagtgaaaccaatatttgtaaatat

SEQ ID NO: 2816 - DNA, 101 bp, rice(Oryza sativa)
  misc_feature (71): n=a or g
agagatgaatgattcttgtatttacttttcacttgtacatggcattactggggaagggctctttagtctcngtttataaccccttttagtcccaggttgta

SEQ ID NO: 2817 - DNA, 101 bp, rice(Oryza sativa)
  misc_feature (71): n=a or c
tcaaaaatcaagctgcaacaacaaggtagtagaagagagtagtgcagatgggagaaagagtagggggacanagaagtagggcgtacgcggtggttgggaga

SEQ ID NO: 2818 - DNA, 101 bp, rice(Oryza sativa)
  misc_feature (71): n=a or g
gtttcgcattcgttgaactgcatgaatctttttgtgaaaacacatctctccaggtgaaaacagattatatntcaggacaaatgcctgaaacgatggtttgg

SEQ ID NO: 2819 - DNA, 101 bp, rice(Oryza sativa)
  misc_feature (71): n=a or g
tggatgggtgttgctttggttgtagcctatctacatccatgtgtgtatggtaaattggggagaggggaatngatagttgagggtaaaattcttggggcttt

SEQ ID NO: 2820 - DNA, 101 bp, rice(Oryza sativa)
  misc_feature (71): n=t or c
aatgccaccaccctatcatctccatctcctctctctctctctctagatctggtgcttaggaaagctcatgncatcatggactcctcgaccgccgccgcggc

SEQ ID NO: 2821 - DNA, 101 bp, rice(Oryza sativa)
  misc_feature (71): n=t or g
aaacctgaatttgcaaggcaacctggcatgattcccaagatgacaaacaaaaaacaccacctcgacaaacnattttaaattaccgacagatcagcaaacca

SEQ ID NO: 2822 - DNA, 101 bp, rice(Oryza sativa)
  misc_feature (71): n=t or c
tagcaaaaatagaactatttttttggtaggcctcttagcttggctgccagcgaaattttcgctggcggtcngtaactcctcacccctcattatatttttag

SEQ ID NO: 2823 - DNA, 101 bp, rice(Oryza sativa)
  misc_feature (71): n=a or g
cctgcagtgcagcacaaatgaacgagatcaattggatgagatctgccctccattgttgaggcgttttgctnattgtcgtcatgtagatatggtgcgggcta

SEQ ID NO: 2824 - DNA, 101 bp, rice(Oryza sativa)
  misc_feature (71): n=t or c
attcaaatgagtgagataaactagtttcaaattttattttcacaaaatgagtttattttttgcatgcaganctcttaagagcccgcatggaaaaaaatcga

SEQ ID NO: 2825 - DNA, 101 bp, rice(Oryza sativa)
  misc_feature (71): n=a or g
tactagtgctggttagggaaaaaactagcactggtagcggtttttggtccctcaaacccacacgacactcngaggataagaaaaaccacacatgagaccat

SEQ ID NO: 2826 - DNA, 101 bp, rice(Oryza sativa)
  misc_feature (71): n=t or g
ggggatcgattaggaatgagcacggagaagagtaaagaaggtaaggggtcatctgcaaatttgtatggagnatgcgggcgcttttctgaaaaaaacacctc

SEQ ID NO: 2827 - DNA, 101 bp, rice(Oryza sativa)
  misc_feature (71): n=a or g
gaagccaacccatcccacccagtcccacaaccaaacacctataaaatttcgaaaaggctacggggcaatcnatcgccctagcgatcggatcagccgatacc

SEQ ID NO: 2828 - DNA, 101 bp, rice(Oryza sativa)
  misc_feature (71): n=t or g
actgtactgctggcaaagaactctggggtttttaaagctagaggtgtgttagttcatgccaaaattgaaantttggttgaaattggaacgaagtgacggaa

SEQ ID NO: 2829 - DNA, 101 bp, rice(Oryza sativa)
  misc_feature (71): n=a or g
attgtacgtttttatttataagaaatggacatgtacattagatatttaatgtttagaatatgagctggtcntatcttttgaaactttgaacacaaataatt

SEQ ID NO: 2830 - DNA, 101 bp, rice(Oryza sativa)
  misc_feature (71): n=a or g
gctttcaatagtaatttaacgagggcaaatatttgctactgacactacttagaaaaaaatgttttttcagncggtcaaaacatgttctcacaggcggcaaa

SEQ ID NO: 2831 - DNA, 101 bp, rice(Oryza sativa)
  misc_feature (71): n=t or g
ttatgtccaatacggctaaaatatgtagactagtggcaggtttcaacttacatgcaaattgtaatggcgcngatccaaatacacaaattataatggcatat

SEQ ID NO: 2832 - DNA, 101 bp, rice(Oryza sativa)
  misc_feature (71): n=t or c
agaactagttaacgctggtcaccggccaccgttaacggtagcactagcgtccatgcctatcttccttcttnccccaatttcttgccctaaccggccaccac

SEQ ID NO: 2833 - DNA, 101 bp, rice(Oryza sativa)
  misc_feature (71): n=t or c
tatctggtgttaatgttttcatcatgcctagtgacggaaactatatatggagctaaaaataggtaagtagnaaaagccccatattattcagttcatgtttg

SEQ ID NO: 2834 - DNA, 101 bp, rice(Oryza sativa)
  misc_feature (71): n=a or g
cagctttaaacttgccttgaaggcttgcatatctgatagaagttgagaacacccagcaccaacactgagantataaatacaaacagcatcacaaccattgc

SEQ ID NO: 2835 - DNA, 101 bp, rice(Oryza sativa)
  misc_feature (71): n=t or c
tttgtaaaagtaagttagaatagtaaaattatcctaatttgtggtcttttcatgctgaacggatatttaangttaagaaatgattaaagattatatatatt

SEQ ID NO: 2836 - DNA, 101 bp, rice(Oryza sativa)
  misc_feature (71): n=t or c
ctcattagcatatcgtaagtcaattccgtttatgcgatcttggtattctattgggattcttggacggaagngattttagataatacttcctccgtctctaa

SEQ ID NO: 2837 - DNA, 101 bp, rice(Oryza sativa)
  misc_feature (71): n=a or c
tgccatgcactttggttctcatcgagcaacaacaacttcttaatttgacttgtcatcatgtaatctcctcntttttctttttctgcttcttccccattgca

SEQ ID NO: 2838 - DNA, 101 bp, rice(Oryza sativa)
  misc_feature (71): n=a or g
cattcgaaacatgacgcttcagtgattcatgagcgtaggagtagcaatttatgagtagaaactacataggntctgtttagttcacgaaataaaaattttta

SEQ ID NO: 2839 - DNA, 101 bp, rice(Oryza sativa)
  misc_feature (71): n=t or c
gtgcattcaggctcttgaagctgctgaagtaagtaaagcatgagtagaaaagttatgcccatgagtttttnttttttttttgccaagtttcgtttgatgca

SEQ ID NO: 2840 - DNA, 101 bp, rice(Oryza sativa)
  misc_feature (71): n=t or c
attgttttttcacaatttcttttctcaaacgtatttacccctggctcaatcgttctgcgcgaaaaagaaantgaaattgagaaaaaataatttgcaaatgt

SEQ ID NO: 2841 - DNA, 101 bp, rice(Oryza sativa)
  misc_feature (71): n=a or c
tttaaggtacccttggatagatatagaccgtctgtttaatttgattcaacgtgttagaattagttatactnctaccgtcctacgtgtagtaggattgataa

SEQ ID NO: 2842 - DNA, 101 bp, rice(Oryza sativa)
  misc_feature (71): n=a or t
actgggccgggcttggccaacggtttttttgttcgaccatgccatcgctttttctctccggagttgctatntaagagtattaaacgtagattactgataaa

SEQ ID NO: 2843 - DNA, 101 bp, rice(Oryza sativa)
  misc_feature (71): n=t or c
acaatcatggaaaattcctttacaaatcctcggtttcaaatgaggcctaaagttagtactccctccatccnaaaatataaggaattttgattggatgggat

SEQ ID NO: 2844 - DNA, 101 bp, rice(Oryza sativa)
  misc_feature (71): n=t or c
tgaggagctaaagcgagtccgcagtgctctacagggctatctgaggctagagatggtgacgaagtatatgngtaagatggatgaggaggtcaggaggcaca

SEQ ID NO: 2845 - DNA, 101 bp, rice(Oryza sativa)
  misc_feature (71): n=t or c
aaatatgcctcaagttggtgtgatacatatggcacttcaaaacgattcaactggctcaatattgaggtatnttttatcacgatttcttttactgaaataag

SEQ ID NO: 2846 - DNA, 101 bp, rice(Oryza sativa)
  misc_feature (71): n=a or c
acgtctgaagagaaaggaagaaaaaaaaagggctataagaactgcggtggataacaaatcttgaggactcnaacaaatagaggcctactgttcttgcacaa

SEQ ID NO: 2847 - DNA, 101 bp, rice(Oryza sativa)
  misc_feature (71): n=t or g
gagggtttcggatacaacgaacgggatgcaaagtgcacacgtgtcacgtgagcgcatcaaaaacaactttntgactgtttttcaacgagagaaaatataat

SEQ ID NO: 2848 - DNA, 101 bp, rice(Oryza sativa)
  misc_feature (71): n=a or g
gttatttgactttccttggtcttggtgcattctattatgatcaattgaaaggcaaaggagtactccctccntttaataaaacaaacacaattggtgtccaa

SEQ ID NO: 2849 - DNA, 101 bp, rice(Oryza sativa)
  misc_feature (71): n=t or g
tactcgttagctagtagtagcaactggagtagctcagttagcttgttgcaggccacgagatagataggttntgtggtgtgggtgcgtatatatatacaaac

SEQ ID NO: 2850 - DNA, 101 bp, rice(Oryza sativa)
  misc_feature (71): n=a or c
tatttctgctataattttgttgtccctgtgatttgtattttcatgaaatttgtatagttgttttaagaacngttctttccactgctacaagaaccctcata

SEQ ID NO: 2851 - DNA, 101 bp, rice(Oryza sativa)
  misc_feature (71): n=a or c
ttactgatcttgaatgacctcttgtgtacagccagtaggaagcaaaccgaacaggtgagtccggacttgangctggagttcggcagtggcggcggcggcgc

SEQ ID NO: 2852 - DNA, 101 bp, rice(Oryza sativa)
  misc_feature (71): n=t or g
ttgatattcatttattaattagatagacaattcatagttggaatgtgaggttggagctgagcttatcctancaaccaaaccgtggcggatcattagcacac

SEQ ID NO: 2853 - DNA, 101 bp, rice(Oryza sativa)
  misc_feature (71): n=t or c
ctaatactacaaatacgggaatatctagattcggagtaatatgatgtgtcaatatccatataaaatagganaagatatatcataatactatgaatttaggt

SEQ ID NO: 2854 - DNA, 101 bp, rice(Oryza sativa)
  misc_feature (71): n=t or c
gaaacgaaattgtcccaaatagtatattgctgaaacagtaaaaaaaaaacctctacattttcatccatttncagataatacagaaactaaaatagttgata

SEQ ID NO: 2855 - DNA, 101 bp, rice(Oryza sativa)
  misc_feature (71): n=t or c
ctctgccgccaccccttcatttctatacccaacattactttcactagctaagcatctactccctccgtttnacagtgcaagattttctatcattgtccaca

SEQ ID NO: 2856 - DNA, 101 bp, rice(Oryza sativa)
  misc_feature (71): n=a or c
gggagggggtaattcgtactttttcctattcttttatacattggtacaatagcaagtcagattattaacanttcggttgtgtggaattatataatcatata

SEQ ID NO: 2857 - DNA, 101 bp, rice(Oryza sativa)
  misc_feature (71): n=t or c
accttcggaacaacagaacttacataattagcttaccatctacgatttaagagcgttcttcaaaataactngaagaggattaatcaaatacaataaaacag

SEQ ID NO: 2858 - DNA, 101 bp, rice(Oryza sativa)
  misc_feature (71): n=a or c
caatcttcgtccaaaattatacttaacaatttacaatttagacatacagttgtgtagattcatatctatanatgcttatatttcggaacggatggagtaga

SEQ ID NO: 2859 - DNA, 101 bp, rice(Oryza sativa)
  misc_feature (71): n=t or c
ctatcccttgtcgagaactttgcgatagccttttcactgctatttcttgatcactagggaggactccctgnacagatagagaatttttactggctgaaact

SEQ ID NO: 2860 - DNA, 101 bp, rice(Oryza sativa)
  misc_feature (71): n=t or g
tctatgttcgtgtatcccggcatatgctttgatatgccgccttcattgatttttctcggttgactatcttntgccgcactgccgcctacgaccctgcgtct

SEQ ID NO: 2861 - DNA, 101 bp, rice(Oryza sativa)
  misc_feature (71): n=t or c
caaggctgagctgcatcaccatcaaggcatcaagacctgcatttgttttctttgttgtcatcatccttgcnggactcgtccttatttgttattcccacgat

SEQ ID NO: 2862 - DNA, 101 bp, rice(Oryza sativa)
  misc_feature (71): n=a or g
aggacgtggacgtttatatttttgatagtatattgaaatgttcgtatattcccacgactgtgaattgttanctataaatttctttcagtaatataagataa

SEQ ID NO: 2863 - DNA, 101 bp, rice(Oryza sativa)
  misc_feature (71): n=t or c
cctatagtgtaccatatatgatatattcgacatcattccgtccaggcgagataatgtggcacataagtctnaaataagtttaaactaatggtttgagtata

SEQ ID NO: 2864 - DNA, 101 bp, rice(Oryza sativa)
  misc_feature (71): n=a or g
atcttgtctccaatgattcttggtatgattgaccctgtgttcgtgttagccgaccttgctgattacagctnactctagaatttgctgatttggccttcatt

SEQ ID NO: 2865 - DNA, 101 bp, rice(Oryza sativa)
  misc_feature (71): n=a or g
ccctggcagctcctttgcatctgccaatgaaggaggaaggtaagaagccggggtggtcggtggctcaccgntggcaattatagagggagagatgacgccgg

SEQ ID NO: 2866 - DNA, 101 bp, rice(Oryza sativa)
  misc_feature (71): n=t or c
ttgcagaactgtatgatgttcaatgggcaccattgttgttcccgacgatagtggtgatagcagtgaatatntgtgccattggcgcggcaataggcaaggct

SEQ ID NO: 2867 - DNA, 101 bp, rice(Oryza sativa)
  misc_feature (71): n=t or g
ttccctatagggtagtctgatttttaaaatttcctctgcatcaacattccaaaagtattgagagaccttanctacatcccaagcaacattctcatcaatta

SEQ ID NO: 2868 - DNA, 101 bp, rice(Oryza sativa)
  misc_feature (71): n=t or c
ggagagagatgacaagtgcgtccatggatttcctttctattttttagctgattggattgccacgctgacgncatgtgtgcaatctcaggtcaaaaccgctt

SEQ ID NO: 2869 - DNA, 101 bp, rice(Oryza sativa)
  misc_feature (71): n=t or c
aggacgaggtcggcggcgcctcgttccgggtgatgtacatggcgcgcggcctgaccaagctgatggcgttnatcttcccttgggaagctggggaatggcgc

SEQ ID NO: 2870 - DNA, 101 bp, rice(Oryza sativa)
  misc_feature (71): n=t or c
tataaaaattgttgatgagaacgaacagcccaagctgaccttcctctgtctccaggaatacaatgtctttnttccagctgccgggaaccatctcaattgtg

SEQ ID NO: 2871 - DNA, 101 bp, rice(Oryza sativa)
  misc_feature (71): n=t or c
ggtgatattttgacaaaaccaaatgttgagaaaacagtttttaagtatgccggaattttgccttatctttntgcaacactaaaaaaacaaaaacaaatctt

SEQ ID NO: 2872 - DNA, 101 bp, rice(Oryza sativa)
  misc_feature (71): n=t or c
cgacaatccattgtccctcgctgctgtgtagtagccactcctgtggctcggctgggaaaaataggctgccngtctatttgttccgactgccaacagcctgc

SEQ ID NO: 2873 - DNA, 101 bp, rice(Oryza sativa)
  misc_feature (71): n=a or g
tgtatattggtgtagacatggtgacttgtcgagtcaaaagcgaagagatcatctgctgattagtatagatnctatagattatttggtgcatatatggatag

SEQ ID NO: 2874 - DNA, 101 bp, rice(Oryza sativa)
  misc_feature (71): n=a or c
aatcaattgaaaaggaaaaaaaaaagtatttcatcatctgggaaactacactagactactccatgtacctncatgtagtaggctacatggatgatggataa

SEQ ID NO: 2875 - DNA, 101 bp, rice(Oryza sativa)
  misc_feature (71): n=t or c
tgtggccatgttgacgtgggttataaagtgggttcaattttccaacctctgattcccactcccaggccggnacaggccactcttggtctcgctccccgctc

SEQ ID NO: 2876 - DNA, 101 bp, rice(Oryza sativa)
  misc_feature (71): n=a or c
cgaggtcgacatagcaagagaggcgggcgatgacgccaaggaggatgttgtcagggagatccctggccccncctcaccctgtccatggcggccaccgtagg

SEQ ID NO: 2877 - DNA, 101 bp, rice(Oryza sativa)
  misc_feature (71): n=a or t
ttccttagtacaaaatctttttatatataatttgattggtccataaagtaggaattatattcatcgcgggntttattagaattggataggagaatgatcat

SEQ ID NO: 2878 - DNA, 101 bp, rice(Oryza sativa)
  misc_feature (71): n=t or c
tgcatccgtcactcactctcactcacaccaacatccccaaatcgcaatcgatggctgcaagataaccaccntttttttttcgatcggtaccacgcaacgca

SEQ ID NO: 2879 - DNA, 101 bp, rice(Oryza sativa)
  misc_feature (71): n=t or c
cacgttacaaatgtagacgcttacaacacatacgtacttaggccctgtttaatttccagaaagttttttcnaaaaacatcacatcgaatctttgaacacat

SEQ ID NO: 2880 - DNA, 101 bp, rice(Oryza sativa)
  misc_feature (71): n=a or g
tgggctaatctagtctctatcagcctagagacgcaaagctctcatatttggttgacagctagaggttaagntagtcaactttcttgaataagaactcagtg

SEQ ID NO: 2881 - DNA, 101 bp, rice(Oryza sativa)
  misc_feature (71): n=a or g
aaatctcgcagcaaagcgcggggtatcacctagttaatatgttggttgacaaggcaatggcatatcatgtngataagaaaaaagtaagaagttacccacct

SEQ ID NO: 2882 - DNA, 101 bp, rice(Oryza sativa)
  misc_feature (71): n=t or c
atgagaatgcattggatttaatacatatcgagtttagtgacaggatcattcaattacttaataatattgtncagttgaacacaacagaaaactgaattgtc

SEQ ID NO: 2883 - DNA, 101 bp, rice(Oryza sativa)
  misc_feature (71): n=a or t
caacaatgagaaattactattgatacacacacaataagaaacaatgatttaaaatagtgaaaatgcaaatnaaaatagatgccattattgctaacatccta

SEQ ID NO: 2884 - DNA, 101 bp, rice(Oryza sativa)
  misc_feature (71): n=t or g
tcctacgcatgacggcgacgcatgctactactactcccaagtcgtgtaggagtactccagtatttatgggnggggccagtgtgatgtgacagcgtatcttt

SEQ ID NO: 2885 - DNA, 101 bp, rice(Oryza sativa)
  misc_feature (71): n=a or g
ggctgcgtgcagtgcagcttctgcgccaccgtgttgctggtaaggaagagcgaaaccgatcagtttacctntctggctggctccccatggccatgcataag

SEQ ID NO: 2886 - DNA, 101 bp, rice(Oryza sativa)
  misc_feature (71): n=a or g
agcaacctcagatgaaacttgaccttcaaggtggagtgacatactgacatgtgcaaatgtgtggtgttggncgtcgggtttgcttcgtcatgccacaaagt

SEQ ID NO: 2887 - DNA, 101 bp, rice(Oryza sativa)
  misc_feature (71): n=a or c
atccgttatgattccaaccatgtcactctgttaaccctatcacattttaacggcggggattggatggaacnctaatactaatagcaataagttgactagta

SEQ ID NO: 2888 - DNA, 101 bp, rice(Oryza sativa)
  misc_feature (71): n=a or t
tcatgtgcgcaccgttgatcgatcggtggagttactgagagagacgagccgtcttggcatcttgcaggctngcagctatgggcaaatcgtggagaccatgc

SEQ ID NO: 2889 - DNA, 101 bp, rice(Oryza sativa)
  misc_feature (71): n=a or t
tacccaccgctactgactggtagccatcgccgaaggaggaggaggtaacggctgtcgggctattacaactnactagtactgccaatacaaatattcatgcg

SEQ ID NO: 2890 - DNA, 101 bp, rice(Oryza sativa)
  misc_feature (71): n=t or c
gatccaattagccttatgtttttctatctgtaatcaatcagagcaatagtacacaaaaattactcgtgctnagcggcaggtaacatcgcattgacgttttt

SEQ ID NO: 2891 - DNA, 101 bp, rice(Oryza sativa)
  misc_feature (71): n=a or g
aaccaaaccacaacaagcaacacatgcttcggtgcatccatatgacatttgttcctcatgcaattttccangagcatcttaaaatgtctcaaagcattcat

SEQ ID NO: 2892 - DNA, 101 bp, rice(Oryza sativa)
  misc_feature (71): n=a or g
ttatgaagggtatcagggattcttggtccaaccagaaactaaattgtggtgactagttccttaatcacgtngtgaattaacaagtcaactagaagttacat

SEQ ID NO: 2893 - DNA, 101 bp, rice(Oryza sativa)
  misc_feature (71): n=a or g
cggttcgaagtccaggagttgatcggcaaatcagccggcatgtgcgcatgtgcttgttggacccgtcttgnagggcatcccgccggtgctccctgcgcagt

SEQ ID NO: 2894 - DNA, 101 bp, rice(Oryza sativa)
  misc_feature (71): n=t or c
caccgcaagaggactgacgcctggagaaaagatcgccgcagccttcaactcccacctcatggcgttaccgncgtcgccgcctcaaccaagctgcccttgag

SEQ ID NO: 2895 - DNA, 101 bp, rice(Oryza sativa)
  misc_feature (71): n=t or c
gtaggctagggctacgggtctaaattttgagttctttacgatgcaagtggctctaggagtggctataattntatatttcagctccccaacatcttttgttt

SEQ ID NO: 2896 - DNA, 101 bp, rice(Oryza sativa)
  misc_feature (71): n=a or g
tggttgacattcataacattctgttttacctttgacatgaacagtaacctgcaaaatatggaatggaaatnattttagaagagaattaacttgaaaatata

SEQ ID NO: 2897 - DNA, 101 bp, rice(Oryza sativa)
  misc_feature (71): n=a or g
catacacaatgcacctacatggtgaaactgtagaagcctttagctcaccccataagagccgcgctgctagngcgagtgggttcatcaggctccccgtgtct

SEQ ID NO: 2898 - DNA, 101 bp, rice(Oryza sativa)
  misc_feature (71): n=a or g
atggtctatgcaatggactgtaacacagtaacacactactaatactcacgtgcaatgcacgttttttgacnaaatatatcgcccgagtacataattgcact

SEQ ID NO: 2899 - DNA, 101 bp, rice(Oryza sativa)
  misc_feature (71): n=t or c
agacagatgaagtagcatgcaattgattcccctcattgtccttggcaaaggtattataattctctctcgcntcctagagtcctaatagtaagaactagtat

SEQ ID NO: 2900 - DNA, 101 bp, rice(Oryza sativa)
  misc_feature (71): n=a or g
agttgaaaaatgtgacaaccgctttgaagatccgaagaacaggggttgggtagcctatacctctgctaatnttctgtattattcctgttttgtaatagatc

SEQ ID NO: 2901 - DNA, 101 bp, rice(Oryza sativa)
  misc_feature (71): n=a or t
atccaatccatcgattccaatttcacgcctccaacagaagggaagaagaccatgaaagggagaagatgccngatctgttgaagcagatctgttgaagcgac

SEQ ID NO: 2902 - DNA, 101 bp, rice(Oryza sativa)
  misc_feature (71): n=t or c
catacttacatgtctagttcgaacctcaatgttcgaaactcttttcctcagcaaaaagaaaaaaatgatgnatattagcacataattaacctgatccatgt

SEQ ID NO: 2903 - DNA, 101 bp, rice(Oryza sativa)
  misc_feature (71): n=a or g
ccacgttttcggtttgaaagattggttaatgatcaacaatttgaaaatgaatttggaggtctaacaatcancagtgttcacttgatatattgttcaatgat

SEQ ID NO: 2904 - DNA, 101 bp, rice(Oryza sativa)
  misc_feature (71): n=a or g
attggttaatttaatactttacgattatatccatcaatattctattagttgattatatacataaaattctnccgtgttgcgcacgtcattacaataaaaat

SEQ ID NO: 2905 - DNA, 101 bp, rice(Oryza sativa)
  misc_feature (71): n=t or c
ttgcatattttatctaagctgtagtgcaatgtcagaaactcaagacataaagagtattcagcatagacaanagaaattggttaggggtaaaacagcactta

SEQ ID NO: 2906 - DNA, 101 bp, rice(Oryza sativa)
  misc_feature (71): n=t or c
gtacgtgtacaccccgtatatacgtactcggatactcctgtacgccatacggtaacggtagtatatactcnctccgtagtcgtaaaggaagtttttgacag

SEQ ID NO: 2907 - DNA, 101 bp, rice(Oryza sativa)
  misc_feature (71): n=a or g
taaacattatttgagatagtcagttataaggttcaaaattagacagtcaaaattcacattacatttccgancgtacggacggaagtaaatatgcgtacacg

SEQ ID NO: 2908 - DNA, 101 bp, rice(Oryza sativa)
  misc_feature (71): n=t or c
tgtttatttcttaatcttgtgacacccctcacttcaatatataaacatatttgggatgtggattttcatcncacgaggggatatcccctcgttgcttgcat

SEQ ID NO: 2909 - DNA, 101 bp, rice(Oryza sativa)
  misc_feature (71): n=a or g
ttgattttgaaggttaataatctgtgcttgctaaagttacctaaccatcttccatcctacacctttcaacntaaaattcgcttgctctaagatatatattc

SEQ ID NO: 2910 - DNA, 101 bp, rice(Oryza sativa)
  misc_feature (71): n=a or g
aaaattgagtacttattgcagttaggcaagaaaccaacatgtgttttaatctcttcactttcatcctgttnagtaattttaatactactaaaattgtaaaa

SEQ ID NO: 2911 - DNA, 101 bp, rice(Oryza sativa)
  misc_feature (71): n=a or c
gactagctcagtagttatgtctctgtaggtaatggcttcaaaaatagatttctgatttgtgagtctgtgantaagtgaataactgaatatacaatttgtaa

SEQ ID NO: 2912 - DNA, 101 bp, rice(Oryza sativa)
  misc_feature (71): n=t or g
agcgcgtcgccaaggttgctctcaactgcgtgttggaagtggtgattacagtagtgaccagcgggaatgantagggtaaatccatttattcactgaatcta

SEQ ID NO: 2913 - DNA, 101 bp, rice(Oryza sativa)
  misc_feature (71): n=t or c
agtatccagtacatcgcatgccattcgcatgtaccgttccaaactcctccatctcacacactttttttttncccttcaaaacgcagtagagacgtacaaat

SEQ ID NO: 2914 - DNA, 101 bp, rice(Oryza sativa)
  misc_feature (71): n=t or c
ccagatcaataacaataatgtattggtagaatgcccatgaaacttgagcagaggttgcaagatggagtgtnaacttaaacagcatgcagggatcataaaga

SEQ ID NO: 2915 - DNA, 101 bp, rice(Oryza sativa)
  misc_feature (71): n=a or g
ttattggatagtgggagtaccaatgtattttagcatactagtagtctactagtagagtacatatatggatntattagtacatctgaacataagatacagta

SEQ ID NO: 2916 - DNA, 101 bp, rice(Oryza sativa)
  misc_feature (71): n=a or c
gttagattgcttttgcatcctgcgaaaaccaggaatttttgtacatctcaaattaattcggcaatacctantgttggatgtttatggagtgatatatcata

SEQ ID NO: 2917 - DNA, 101 bp, rice(Oryza sativa)
  misc_feature (71): n=a or g
taaagcttgagtgatacgtgttcctgcacgccatgctgcatttacaagcaaaggaaaggggagaagaaaanggatgcaaatcatgcgcagtgcaatacaat

SEQ ID NO: 2918 - DNA, 101 bp, rice(Oryza sativa)
  misc_feature (71): n=t or c
tgcctaactgctcgatccaacgtcaaagctgtcgtcgttgcctccttggtattaacagtaactgacgatgnaagagtggtacggtgtgtttagttcacgtt

SEQ ID NO: 2919 - DNA, 101 bp, rice(Oryza sativa)
  misc_feature (71): n=a or g
aaacgcttgcccctggtttttttcgccgggagcttaccccctggtttttactcctgaacagtttgattganccctagcgaagattaaaaagaacactttaa

SEQ ID NO: 2920 - DNA, 101 bp, rice(Oryza sativa)
  misc_feature (71): n=a or c
tgtcaaccaaattcttcttttgcttcactttgccgccgagattctatttgctgattttttttggaagatanataagtgattctgctgattagtagtcccta

SEQ ID NO: 2921 - DNA, 101 bp, rice(Oryza sativa)
  misc_feature (71): n=t or g
ttgattcgtgttagtacgaggtatatacttcaatactctgttgagaagtatggccgtattttgtttttttngcaaaaacattttgacgtatacggacacac

SEQ ID NO: 2922 - DNA, 101 bp, rice(Oryza sativa)
  misc_feature (71): n=a or c
ttttaaaaaattgaggtccgagtagtagcaaactggttcggttgagctcaatattgcaaaatgctccggcnggaggacctgggtactacaatcaaatcatt

SEQ ID NO: 2923 - DNA, 101 bp, rice(Oryza sativa)
  misc_feature (71): n=t or c
tgaccacaatctgtaagatttattttttattggagaatcagcaagattaattagagttaatgtagtacatntaaagctccagatatacccacagctctaga

SEQ ID NO: 2924 - DNA, 101 bp, rice(Oryza sativa)
  misc_feature (71): n=t or g
attattatttaagtggaagtctccggcatatttatgaactactgacaagtggtccgttattaggactccanagaaatttttccgtcttaattttcttttta

SEQ ID NO: 2925 - DNA, 101 bp, rice(Oryza sativa)
  misc_feature (71): n=t or g
tattcatgacactatcaattacaccagcttaatcagaattaattagcactagagcgactagtggtggtggngatggtggtggggatgtgacgggcggcgtc

SEQ ID NO: 2926 - DNA, 101 bp, rice(Oryza sativa)
  misc_feature (71): n=t or g
catcttgttcgttgacatgtaaatttcctgaatggtggggtctacatgtcacccattatggctgtatttanttcaatataaaatttagattttagttgaaa

SEQ ID NO: 2927 - DNA, 101 bp, rice(Oryza sativa)
  misc_feature (71): n=t or c
aacaaggccaaacttcgtgacaaaataaggtgatcagagaattaattatgcaaataactactccctctgtnccagaataaattaatttaatattatatgtg

SEQ ID NO: 2928 - DNA, 101 bp, rice(Oryza sativa)
  misc_feature (71): n=a or c
cttcaggctttgtactatactattttcgagtactaaatgttctcagcaaactcagcgaaacctagatcaantaataaattttgtgtgatataactttgtat

SEQ ID NO: 2929 - DNA, 101 bp, rice(Oryza sativa)
  misc_feature (71): n=t or g
ccatcacattgttggtcaggaggatcacggcgagctcgtcggccatcggagttgcccacaccggtgcgaantggcggcggcggcggtggagggttctcgtt

SEQ ID NO: 2930 - DNA, 101 bp, rice(Oryza sativa)
  misc_feature (71): n=a or g
taaactcggccttactgaaatctttagactggcaaacaaggaaaatggatatctacttgggccgagtttanttataaactttttcttcaaacttctaactt

SEQ ID NO: 2931 - DNA, 101 bp, rice(Oryza sativa)
  misc_feature (71): n=t or c
gtcaaaagctcgctgttgggacatagatatgcaactataatgagcgatactgatgctcgcgactcacgacngctttggacatgggccttaaccaggggaag

SEQ ID NO: 2932 - DNA, 101 bp, rice(Oryza sativa)
  misc_feature (71): n=t or c
ttataaagatattgtcgttatatttgtttcgaggaaacgatgtaggtatggaaggaaaattcttgtactcnctccattccctccattctagaatgtagcaa

SEQ ID NO: 2933 - DNA, 101 bp, rice(Oryza sativa)
  misc_feature (71): n=a or g
gtacctgcagttttgtgaaatttactctgaaacattttttggtagaagcacactgtatacgcagactctcntagcacacgtatactcactcatatgaacgt

SEQ ID NO: 2934 - DNA, 101 bp, rice(Oryza sativa)
  misc_feature (71): n=t or c
gttttcaaaatttttcatcactatatgggttgacatgcaaacaagaggatgtcttctcgagggtgaaaatncactcccgtagtagctagctatactgagca

SEQ ID NO: 2935 - DNA, 101 bp, rice(Oryza sativa)
  misc_feature (71): n=t or c
ttttgagtgtacaacatccctagcccaacattgaaccctaactccgcaatccactagatttatgagctcgnggaagttcaccggagatggatcgagcagga

SEQ ID NO: 2936 - DNA, 101 bp, rice(Oryza sativa)
  misc_feature (71): n=a or g
taaggaaacagcaaaaatctggcgttatgaagtgcaatgcagcattgtgcccagagcaaaaatacacccanacaagttaatgtactgatgagaggttctag

SEQ ID NO: 2937 - DNA, 101 bp, rice(Oryza sativa)
  misc_feature (71): n=a or g
gacagcgacacgttagtacaatcactgtactcctcatttacgggacggcgataacgtgcccatttcggaancagcgttgcgtgatcacgactcacaaatcc

SEQ ID NO: 2938 - DNA, 101 bp, rice(Oryza sativa)
  misc_feature (71): n=t or c
catgactatgattgtaggttagtttggggaaaagggttaaatgaatacagaaaaatcataatgtgacatgntgtcattagtttacaagataacatggcatg

SEQ ID NO: 2939 - DNA, 101 bp, rice(Oryza sativa)
  misc_feature (71): n=a or g
gatggtttccagtccattggtgatacaactcgataccatctagaatcactgcagaagagtaagggaggatnataacaaatcaaaaatagaaaaagagagat

SEQ ID NO: 2940 - DNA, 101 bp, rice(Oryza sativa)
  misc_feature (71): n=a or g
gtggggcctggtcaacctcggtggttcgaacgctgcaagtgggacccacctagggttttaagaggaggagnttctcgtcggcggcggcggcgggcaaaggt

SEQ ID NO: 2941 - DNA, 101 bp, rice(Oryza sativa)
  misc_feature (71): n=a or g
aaaagcaacatctccaggtttccaaataacccagcaaacaaatgcaatcgcaacaattaaaaaagtttgtnggaaagctactcggccgttgaccaaacaaa

SEQ ID NO: 2942 - DNA, 101 bp, rice(Oryza sativa)
  misc_feature (71): n=a or g
taagttgtctatcgatgggaatctaaaaaaggatcccaatctatttcgcttttgcattctcaacatattcnctctaagagcaaaattatgttagtgataaa

SEQ ID NO: 2943 - DNA, 101 bp, rice(Oryza sativa)
  misc_feature (71): n=a or c
cgacgcgttcgccaagtggaggtggcagcctcgccattgcactctcccaaggttttcttctccttccaacnccaaaaattctctcgcgatcagttcatcga

SEQ ID NO: 2944 - DNA, 101 bp, rice(Oryza sativa)
  misc_feature (71): n=t or c
caccgcatgtgtcacgcggcacgaggcttacgtacacacatatactcgtggagttttcggttacccatatnctctaataataaattatttataaaggtaat

SEQ ID NO: 2945 - DNA, 101 bp, rice(Oryza sativa)
  misc_feature (71): n=a or c
cattgaacaagtcccatgggataccactcatcagtcctgaaccgtcaccggagtcattgtccgctccacanccaccacggtgctccatgcagccaagagcc

SEQ ID NO: 2946 - DNA, 101 bp, rice(Oryza sativa)
  misc_feature (71): n=a or g
cgccgctgctcgccaacccgcaccgctcgtcgctctactacgtcaacatgaccggcatccgcgtggggaanaaggtggtgtcgatcccggcgtccgcgctg

SEQ ID NO: 2947 - DNA, 101 bp, rice(Oryza sativa)
  misc_feature (71): n=t or g
tacgatgaaaacaagggccagagatgcaataagcagtaaaaccataatcaaatcggtacaaattgaacganaattgttcaaaacaggcatcatcaccaaat

SEQ ID NO: 2948 - DNA, 101 bp, rice(Oryza sativa)
  misc_feature (71): n=a or c
cgtgcgcgacgccctcatcaaatttctgccatcgacgccttctcccactgagagcatcaccaacagtcccnttatttcatccccaatcctaatattttgat

SEQ ID NO: 2949 - DNA, 101 bp, rice(Oryza sativa)
  misc_feature (71): n=t or c
aagtcggcgggggtatgcctggcagcaaaggatgctctcgtcatggcttctcgtgtcatggtaactagtanggtggttcgtacagattgcgcggctagcat

SEQ ID NO: 2950 - DNA, 101 bp, rice(Oryza sativa)
  misc_feature (71): n=t or c
tgtttattttaggagcagagctctttcattgagcttgtttagcgaatttaacattctaaaaagcatctgantgaaaaccatctgaaaaagctaggtttttc

SEQ ID NO: 2951 - DNA, 101 bp, rice(Oryza sativa)
  misc_feature (71): n=t or c
catcgatccctgtactgctgtcaagagagaagagagtggagtagcaggttggtggggagtactgtatttanttactcgctgcgcggcgtggcgtcgaaagg

SEQ ID NO: 2952 - DNA, 101 bp, rice(Oryza sativa)
  misc_feature (71): n=a or c
tacaagtacgtgcttttcttgtaccttcactactctcagttagatgggtcaaatcatgacccaatagtacnccgaagatccctcaacttgtcattcagtta

SEQ ID NO: 2953 - DNA, 101 bp, rice(Oryza sativa)
  misc_feature (71): n=t or c
ggtcctgttgagatatgggactaaggagcaacaaaagcagtggcttgttcctttgttggaagggaaaattngttctggatttgcaatgacagaaccacaag

SEQ ID NO: 2954 - DNA, 101 bp, rice(Oryza sativa)
  misc_feature (71): n=a or g
tctctaagtcattttgttcctgccatagtccaagtcttcttcctctatttttgctaggagggttattgtcntggtctccttgttagaaattttgttggttc

SEQ ID NO: 2955 - DNA, 101 bp, rice(Oryza sativa)
  misc_feature (71): n=t or c
gtattgggcagttgggctagggtttttttcccggaaccaccagtaccactcctgatccgcctatgatacanatacgtgagtgcgagtgcatttcttaacat

SEQ ID NO: 2956 - DNA, 101 bp, rice(Oryza sativa)
  misc_feature (71): n=a or t
aagaaaaaacgatcccatccgaaacggaagcgcccatcaactcatcatcccacaagcgagtgcttattctncttttttttttgtttgcggcacggcacttg

SEQ ID NO: 2957 - DNA, 101 bp, rice(Oryza sativa)
  misc_feature (71): n=a or c
tttgagacttttcgacatgacatacactaacaactagggggtttggttaattggcgcgccagcccctcccncacgcgatttttttcttttttttcatgaaa

SEQ ID NO: 2958 - DNA, 101 bp, rice(Oryza sativa)
  misc_feature (71): n=t or c
gacagatgggctgttagccacaggccggtatcagaaaatccaatggcccatggacgagctaccagtttgtnacggcctactaccgtaagagcatgtataat

SEQ ID NO: 2959 - DNA, 101 bp, rice(Oryza sativa)
  misc_feature (71): n=a or c
cactagaaataagacaaacccaattctgaaagaatgttttacctgcccaatcaacaaattacacaaacgcnaatatgaacattacacggcgatacaacaac

SEQ ID NO: 2960 - DNA, 101 bp, rice(Oryza sativa)
  misc_feature (71): n=a or g
tttaaaaataattaaccataaatagtactcccttcatcccaaatagattaaccataaatagtatgtttatncaccaagaacaagaataatttaaatcgcat

SEQ ID NO: 2961 - DNA, 101 bp, rice(Oryza sativa)
  misc_feature (71): n=a or t
atgtatcgccaccagcaccggcaccaagctgcagcagatcgagtaaagcacaagattgttttttttttttnattttaacgcaaggaaagactgttgaaaga

SEQ ID NO: 2962 - DNA, 101 bp, rice(Oryza sativa)
  misc_feature (71): n=t or c
gtcgaggctctcgtcctcatctccgtcattggctcaatgctgccattgccacgccccacggctctagtctncaccgccgctgcacgccctgctcctcgatt

SEQ ID NO: 2963 - DNA, 101 bp, rice(Oryza sativa)
  misc_feature (71): n=a or c
ataaagtatattagttaattaagtaatattggatccctattacatatcccgtatagtctatttatagtttnactgtcctagatttacaattctaggttttt

SEQ ID NO: 2964 - DNA, 101 bp, rice(Oryza sativa)
  misc_feature (71): n=t or g
cagtactgatcacatcacatcggcagttgcatattgcatacagtaatacagatcgatacatgcatggtagncaccttatttgcactgaaatgaaaatacat

SEQ ID NO: 2965 - DNA, 101 bp, rice(Oryza sativa)
  misc_feature (71): n=t or c
gtatatgtttcctaggtttgggcttaatcgaaaatagcgaatgtgtgaagagtaaagttgtacccacggtncaacaattggcatgtggatgtgatattgta

SEQ ID NO: 2966 - DNA, 101 bp, rice(Oryza sativa)
  misc_feature (71): n=a or g
gaatgtaatgatatactagtatgtaggaagagtggaaggtagttttgggaagagaaatggggatgtgagtngtttgtggttgggagtgtaacgggtggggt

SEQ ID NO: 2967 - DNA, 101 bp, rice(Oryza sativa)
  misc_feature (71): n=a or c
tgcgccagagcatgatttgggagcaatcggagtccggcatccccctcgtcgtcgactggttgtattcctcnaccgccacccgctgcacgaacttcactgat

SEQ ID NO: 2968 - DNA, 101 bp, rice(Oryza sativa)
  misc_feature (71): n=t or c
tgtacaatcaaatgttcctctcctagcgttattaatggctgcaagttctggtccaatagaaaatttggttncaccgctccacgtggacagcgtggtgtttg

SEQ ID NO: 2969 - DNA, 101 bp, rice(Oryza sativa)
  misc_feature (71): n=t or c
taatcttgtgcggtggaaggtttatctttggaccagatgccaaggccactctgctatctttctctctaatngcaatcccggttgccgtcttctgctacttt

SEQ ID NO: 2970 - DNA, 101 bp, rice(Oryza sativa)
  misc_feature (71): n=a or c
taacgcaaacaagcgaagcgtccgaagagacgcgacgcgtggcacagtactctagctagctaccgcctccnaaggaagaggagaaatcgaaggcatccaac

SEQ ID NO: 2971 - DNA, 101 bp, rice(Oryza sativa)
  misc_feature (71): n=a or g
gtcaggccccagcggcgccaaggccaccgtgctgtccatcgacgaggacctcaaattccaggaggtcgccngcgagtcgtcgagcgccgccggagcaggga

SEQ ID NO: 2972 - DNA, 101 bp, rice(Oryza sativa)
  misc_feature (71): n=a or g
ctgctgcatgctcaccaccacacctcactcccctctctacagcaaccagcattccatttccatagcaatgnctttcaaccctggctctcctggcttcggct

SEQ ID NO: 2973 - DNA, 101 bp, rice(Oryza sativa)
  misc_feature (71): n=a or c
taaaaatgtaatttcgcatgggagaaatagacgggcggatagggttgatagggttcccaccaacgctgccnccgcctggagtgcgtcaacctcgtccacac

SEQ ID NO: 2974 - DNA, 101 bp, rice(Oryza sativa)
  misc_feature (71): n=t or c
cccccctcttcgtcttcctgtcgaaatcccaatccttccaactccgcacctttgcctgcctcctccgatcncttcctccgccgccgctgctgtacggggcg

SEQ ID NO: 2975 - DNA, 101 bp, rice(Oryza sativa)
  misc_feature (71): n=a or g
aggagaaaatctcgttctgtgcatggttctctcaccccgtcacccgaggtgtatacctcccaatatttganagaaaaaatattaaaccgattaaactgatt

SEQ ID NO: 2976 - DNA, 101 bp, rice(Oryza sativa)
  misc_feature (71): n=t or c
tgttccatataatctatcatggttagcatagtcaacacacgcacttgattaacttaggccctgtttagttnccaaaataaaaacttttcacccatcacatc

SEQ ID NO: 2977 - DNA, 101 bp, rice(Oryza sativa)
  misc_feature (71): n=t or c
aagagggattatcgcgtaattagtcttaatccgagactaattaccccttcggatccgtaataatctcaccntaatttggatttttctcttctctccgagta

SEQ ID NO: 2978 - DNA, 101 bp, rice(Oryza sativa)
  misc_feature (71): n=a or c
agcagcagcaaaattgtttaaggaacatggagtttttttttgtatcaattttcaatgattgacatgtatcncatgatatcttctcttgtttttttttatgt

SEQ ID NO: 2979 - DNA, 101 bp, rice(Oryza sativa)
  misc_feature (71): n=t or c
aaagtaaagtggttcgttttaaacagtgtgtttggtcaagtgagccaaaaaggtcagggttaattatgtgntccgtcgaaatagtttagaggagtactagc

SEQ ID NO: 2980 - DNA, 101 bp, rice(Oryza sativa)
  misc_feature (71): n=a or c
atctcatcgtcagatcaggtcaggtgcacactgaatcttgcttgactattcccgacgcgtcattctcatgnatctcatccccttatccactccacccaatc

SEQ ID NO: 2981 - DNA, 101 bp, rice(Oryza sativa)
  misc_feature (71): n=t or c
agaagattaaattcaaagaagaaccttcagctcctgctcctgcaactgaatcccatcatgtaatatgtgtnagtgtgaacgcaaaatatgatcttgcggct

SEQ ID NO: 2982 - DNA, 101 bp, rice(Oryza sativa)
  misc_feature (71): n=a or g
tcattgtcagcatttcgtcaagcaaatagatgaattggaacttccagtgctgtttccagtcttcgttaccntggaagagcgaagtctaatgtttgtttcaa

SEQ ID NO: 2983 - DNA, 101 bp, rice(Oryza sativa)
  misc_feature (71): n=a or g
accaatgagtctactggatgatcaaaataatggtctcttccgactagtcgagtgggtctgggatctatacngccagggagccattcacaacgcagctgaca

SEQ ID NO: 2984 - DNA, 101 bp, rice(Oryza sativa)
  misc_feature (71): n=t or c
cggtcgaccccgtaccgtacacgctcaccctctagttactgattggactaactgtatttatggcgtcatanttttcattaaaaaatagtcgatatgtattt

SEQ ID NO: 2985 - DNA, 101 bp, rice(Oryza sativa)
  misc_feature (71): n=t or c
ataggtgactaggtgagggttacctcataacctcaacttaatgtgagaaatgctagtggttgattggtcanaatggtacattggtactgctgttttttttt

SEQ ID NO: 2986 - DNA, 101 bp, rice(Oryza sativa)
  misc_feature (71): n=a or g
ctgccattgacacaacatattaaagtccatgctacaaatctgtagtcctctcatcttttattttttttccncatgtgtttatatttgacttatttttttcc

SEQ ID NO: 2987 - DNA, 101 bp, rice(Oryza sativa)
  misc_feature (71): n=t or c
aatattattaatatatagtataaaacttgatcgatcaccgtgaaacaccgtgctggctccaccaggaccancactgccaagaagaagaggagagtgataga

SEQ ID NO: 2988 - DNA, 101 bp, rice(Oryza sativa)
  misc_feature (71): n=t or g
gtgagaccagccaaacaggctagaatgtacgtaaagtatatattgtgtcgtgtgagagtacatatgtcaanatttggatcttgagaagatcaagctagata

SEQ ID NO: 2989 - DNA, 101 bp, rice(Oryza sativa)
  misc_feature (71): n=t or g
ttgaacagcccggccattcatcaatcttctacctggagttaagcaatctcgccacaagctatggacagctnatgtccgcgatttcatctgaggctgaggtt

SEQ ID NO: 2990 - DNA, 101 bp, rice(Oryza sativa)
  misc_feature (71): n=t or g
tagaaactaatagtagtaaaaaaaatgctacttacgacaaaggttaattatcgttacttgaaaaggatcangaagtgtttatattaatgtataaacatgcg

SEQ ID NO: 2991 - DNA, 101 bp, rice(Oryza sativa)
  misc_feature (71): n=a or g
taaagcaggcaaggagatgatcatgttgtgggcggttttttttaagactatgggcagttgattctcactgngaatattgaaacttacatgtggcgcgcata

SEQ ID NO: 2992 - DNA, 101 bp, rice(Oryza sativa)
  misc_feature (71): n=a or c
aaatcccctaatctaacaaaatcaaccggtgctaatctgtcgcagacccacacccgagagtcccaacgcanccaaatcccggccaaagcagccaccaacca

SEQ ID NO: 2993 - DNA, 101 bp, rice(Oryza sativa)
  misc_feature (71): n=a or g
ttgaaataacaatagataccgccgatagctatttgaaaacagagggagtagagtagtagactccacgaaanttagtcaaatctcaaaaaagaaaaaagaca

SEQ ID NO: 2994 - DNA, 101 bp, rice(Oryza sativa)
  misc_feature (71): n=a or g
gtttggtcgaccaagtctgttgcgttagattaattaatgaaaaaaacacacctgtgaaatgatccaacatncaaaggacatctatactaatataaaaagga

SEQ ID NO: 2995 - DNA, 101 bp, rice(Oryza sativa)
  misc_feature (71): n=t or c
gccacaccatcctgtgcgcttccactcgaagctgcacgtacccctccccacgttttttttgctcttttttnccttttctcctttccttttgtcctggtctt

SEQ ID NO: 2996 - DNA, 101 bp, rice(Oryza sativa)
  misc_feature (71): n=a or g
attacataattttttttgaataaaacgaatgattaaacgtatatagaaaagtttatggtgtcatacattanaaaacgaagggagtatataataacttcgag

SEQ ID NO: 2997 - DNA, 101 bp, rice(Oryza sativa)
  misc_feature (71): n=a or g
tagcccgcagcagcccactcttcctctcttagccgaagtctagttgttatccctctaggaatcagacctantaaagaataggaagcccgaaaagaagtctg

SEQ ID NO: 2998 - DNA, 101 bp, rice(Oryza sativa)
  misc_feature (71): n=t or c
ttatttagtgttaaatgtagcacattctttaatacacatccagataatgcaagcgattgagtaccccaagnaattttttggttggtgggatatattgtagg

SEQ ID NO: 2999 - DNA, 101 bp, rice(Oryza sativa)
  misc_feature (71): n=a or g
aatccaaaggtaggtcattgactggtactttacttgccactgtggtctaagatatcgcaaaacttaatttnaagggttaattcttggctagtaagtattct

SEQ ID NO: 3000 - DNA, 101 bp, rice(Oryza sativa)
  misc_feature (71): n=a or g
attagcaaacatattaggaaaaatacagctgaaacaatccatggcttctgagaccaaagggggaagaagangaagaggggagaaagagaggagcgtacgat

SEQ ID NO: 3001 - DNA, 101 bp, rice(Oryza sativa)
  misc_feature (71): n=t or c
gaaaaaacaggtaaagctattttacaatataaataagatacgcagatgcagttttgaatcccccccccccntcccattagaagctgccaggagcttgttca

SEQ ID NO: 3002 - DNA, 101 bp, rice(Oryza sativa)
  misc_feature (71): n=a or g
gtggagatggagagcgccattggtggaggtggggatcggaggaatggcgagatgctaactgtgggagagantgagggaggagtggaactgtggaagagaaa

SEQ ID NO: 3003 - DNA, 101 bp, rice(Oryza sativa)
  misc_feature (71): n=t or c
caattggttccatgttatcaggagttgaacgagaaggagtgggtgagtatccacttctatccacttcatcnggactgggtcgctcaattttctcctcttgc

SEQ ID NO: 3004 - DNA, 101 bp, rice(Oryza sativa)
  misc_feature (71): n=t or c
tggcgccaccacggctcatctcatcggcccaatccctacatcagtacccatgtctttatggtggaataagntaaaatgtatatatttgtaaacgagaatta

SEQ ID NO: 3005 - DNA, 101 bp, rice(Oryza sativa)
  misc_feature (71): n=t or c
atgacattgcctgttggtaggtgagtgacgcccacaggcatcactaacgtccaaggtaataaacagagtanaacgggttggtagcggattagtgtctggat

SEQ ID NO: 3006 - DNA, 101 bp, rice(Oryza sativa)
  misc_feature (71): n=t or c
caagtgaccgtacgggatcaggcacaacgtgaccaaaataaaagtctacggtttgttttttcatacataangaaattctagcgtttatgtaagagttgtta

SEQ ID NO: 3007 - DNA, 101 bp, rice(Oryza sativa)
  misc_feature (71): n=a or g
tttttttatatattttatagcaacttctatacagaaagtcttaagcacggaatgcaccgtttaaccatttnaaaaatgtgttgacgaaaattgatataaaa

SEQ ID NO: 3008 - DNA, 101 bp, rice(Oryza sativa)
  misc_feature (71): n=t or c
caaatatgtgttggggaatctgttcagagcaactcagaacatcatgtgatgcaaatggatgccaaatcgangtcaaaattcagaaactgaaagaaatatct

SEQ ID NO: 3009 - DNA, 101 bp, rice(Oryza sativa)
  misc_feature (71): n=t or g
tagcagcctagttgtttgtggtgggggagaagaagatccacagcaattcaatccgatcgatcgatcgattnatgatgagcacccgtcggtttgtttatctg

SEQ ID NO: 3010 - DNA, 101 bp, rice(Oryza sativa)
  misc_feature (71): n=a or g
tctcactaagagggaaggacaagttttgaccatcgcgggacgcgatgctatgattgtcggttccggaaggnccactatcatacttccaatgggtacacaaa

SEQ ID NO: 3011 - DNA, 101 bp, rice(Oryza sativa)
  misc_feature (71): n=c or g
atgttacatgcctatgctttagctataactatatatcctaacctataacgctatctgctatcaaagaccanagttttagtggtgcgataagtatttatcct

SEQ ID NO: 3012 - DNA, 101 bp, rice(Oryza sativa)
  misc_feature (71): n=a or c
aaaaaaatggtgtcttggttgaacacagctctgccatagcctgctgtatgggtctcagatgttaattgaancagtgaacctcgccccagggccggtcctga

SEQ ID NO: 3013 - DNA, 101 bp, rice(Oryza sativa)
  misc_feature (71): n=t or c
ttgagttaacaccgtcacgttgacttcacgaaatagggccaagtctcatcttcgtttgtaaaaaagagggncaaatgatcaaactcaaaaaagcaaggcta

SEQ ID NO: 3014 - DNA, 101 bp, rice(Oryza sativa)
  misc_feature (71): n=a or g
cttatattgttgttgtctataaggaataatattgctgaattatttttttcaaggagatatagatgaacatntgggctacaacttcaaatttttaagcttga

SEQ ID NO: 3015 - DNA, 101 bp, rice(Oryza sativa)
  misc_feature (71): n=a or c
aactgcatcgtacttggagtatagcatctacgcttagcttaagtcaatctcccctatctctttctacgctntctctctcctataactcaaaacaaattcta

SEQ ID NO: 3016 - DNA, 101 bp, rice(Oryza sativa)
  misc_feature (71): n=t or c
tatgtacaacttaaaaaaaaatagcaactcgtcttattctttattcaagggagccatggcttaacttgtgntgttgtttctcatttaccgccatcaagttt

SEQ ID NO: 3017 - DNA, 101 bp, rice(Oryza sativa)
  misc_feature (71): n=a or t
cctaaaagccgtaactgatgtgtcttacacaatcgttcagaaggacagtttaagaacgaatttgatttttnaaaaaaaaaactagaaaaaaatcaataatg

SEQ ID NO: 3018 - DNA, 101 bp, rice(Oryza sativa)
  misc_feature (71): n=t or c
ttagattctaatgtatacaagctttggcttttcttacatcagtggtggtctcctagtgctcttaacaaccntctcattataagaagagggaagaagcaata

SEQ ID NO: 3019 - DNA, 101 bp, rice(Oryza sativa)
  misc_feature (71): n=a or g
ttatccgctgctaattttcgttcaacaacagcagttttctcaatctccgaaaggtatgcacggtcaacaancattccctctgtttccatctttacaagaag

SEQ ID NO: 3020 - DNA, 101 bp, rice(Oryza sativa)
  misc_feature (71): n=t or c
caaaattagttttactaatctatgttgttggacttaaaccacatgctgtcaaacactaaagattccatggncggcgccgcgtgggtgccatcctgccctgc

SEQ ID NO: 3021 - DNA, 101 bp, rice(Oryza sativa)
  misc_feature (71): n=a or c
gcttgagattgatatttttttcaaaactcattttaaagatggtataatagcaaaacctaaagaggggcagncatgaacaccttttgcatcttaaataaaag

SEQ ID NO: 3022 - DNA, 101 bp, rice(Oryza sativa)
  misc_feature (71): n=t or c
agattggttgatcccgtcgattaggggtgtcccgcggcgagatttggtcccgttgcgcatttctgtttttntttttttgaaatgacctgattaattcaatc

SEQ ID NO: 3023 - DNA, 101 bp, rice(Oryza sativa)
  misc_feature (71): n=a or g
ctgctgtacgtgaaataatcagggagctgtttcatgaatattgcggccctgtggataaaggtgttcacacntcaaacaatgaagctcgtgatgttgaaatg

SEQ ID NO: 3024 - DNA, 101 bp, rice(Oryza sativa)
  misc_feature (71): n=t or c
agaatagtacatctgaggagtttgtcgacagtgacaacacctaattaagcaagacctgactgtagttgtantacgtatgacaatggcgaggccatgattaa

SEQ ID NO: 3025 - DNA, 101 bp, rice(Oryza sativa)
  misc_feature (71): n=t or c
tagatcctgagttcaggactcaaacccgcttacccgcgtcacaatgtttattaaaaacagaaactggaacnagggaccttcccggttcggtttggttcaag

SEQ ID NO: 3026 - DNA, 101 bp, rice(Oryza sativa)
  misc_feature (71): n=a or g
gctgtttaaattgatctctggaactcttgtacatttgtgttcgaagcaagaatattattataagggtggcnatttctcacgcggggtcaggtcccctgcgg

SEQ ID NO: 3027 - DNA, 101 bp, rice(Oryza sativa)
  misc_feature (71): n=a or t
tgttctagtcgtcgacgtttatccttactataccagtttaattatattggttacgtagctagctggctacnccctccgtcccacgatataaaggattttga

SEQ ID NO: 3028 - DNA, 101 bp, rice(Oryza sativa)
  misc_feature (71): n=a or c
agaataaaacaaccttgattttctttatttacgctgtttacatatgtagttttgtagtctaaaccaagcanattttcatacttataattttatttttaaga

SEQ ID NO: 3029 - DNA, 101 bp, rice(Oryza sativa)
  misc_feature (71): n=t or c
gtgccctaataagtacggtggttgaacattacacaattctcaatccagcacagtaattaccaaatcactcnagttagaaaacacattatctctcatttccc

SEQ ID NO: 3030 - DNA, 101 bp, rice(Oryza sativa)
  misc_feature (71): n=t or c
atttattcttgttcatagagcggaaaccgcttctttattacattgcactggcattactacataaggtttgngctttgcctcctagcacagaacttgggcca

SEQ ID NO: 3031 - DNA, 101 bp, rice(Oryza sativa)
  misc_feature (71): n=a or g
agcgggggaaaggtggggcctagcgcgacgccagctgggagccggcaaattgcaaaagcgaccaggaaacngacccacacaagcagagcagggggagtgtg

SEQ ID NO: 3032 - DNA, 101 bp, rice(Oryza sativa)
  misc_feature (71): n=t or c
ttagcaacacatacaactatatgttcatttgtaatccataccctttcactaattgtcggtgacatggggcngggggtatcgtgactagaggcttgggtagc

SEQ ID NO: 3033 - DNA, 101 bp, rice(Oryza sativa)
  misc_feature (71): n=t or c
aacaatggttcacaacataacagtggttcacatgcaccatggttcacaacatagtagtggttcatatgcancatggttcacaaaagacctcacataacagt

SEQ ID NO: 3034 - DNA, 101 bp, rice(Oryza sativa)
  misc_feature (71): n=a or c
agttttgtttctgttacttcctcaatttttgtttatgacacaatatataaagggaaatgcctaatttatcntaattattcttggttttcttcttaacataa

SEQ ID NO: 3035 - DNA, 101 bp, rice(Oryza sativa)
  misc_feature (71): n=a or g
ttctgttggtgatgccaatgcagtgaaaaggtagtttcttttcttacttcctcagtttattttttaagctntgatgtataattgtataaatggtaccttgg

SEQ ID NO: 3036 - DNA, 101 bp, rice(Oryza sativa)
  misc_feature (71): n=a or g
aagttgatgtgtccacttgaataaactcgtctcattatgcctcgatgtaacactgtcaaacaacgtaagcnaaaattccatcagaattgtattttttcccc

SEQ ID NO: 3037 - DNA, 101 bp, rice(Oryza sativa)
  misc_feature (71): n=t or c
aatgccgtcatttctccaataaatgccggtaaagatcctgtcaaataattttgctgtaaattcctgaaagnacaacaattaaaaagcaaaaaataagatat

SEQ ID NO: 3038 - DNA, 101 bp, rice(Oryza sativa)
  misc_feature (71): n=t or g
tatgtgatcatcttataattaacatctattttgtttcattttatcctactgcaggtggcaacaataaggtngatcctggtcctattaaaaacagtgctggt

SEQ ID NO: 3039 - DNA, 101 bp, rice(Oryza sativa)
  misc_feature (71): n=t or c
catttgtcccttgactgttgggaaggccaaacttgtcttaatagtgccaaatacacatatgcagacggatnggtgatattgtaaatgggagctcttcattg

SEQ ID NO: 3040 - DNA, 101 bp, rice(Oryza sativa)
  misc_feature (71): n=a or c
aatttgatcccaagtgagttagatttaaaacaaatcccactaacacaataaattctacatttttttctttnacatgctaatataagatttacaataaattt

SEQ ID NO: 3041 - DNA, 101 bp, rice(Oryza sativa)
  misc_feature (71): n=a or g
caaggacattaccgtcacacttagttttgatggaggtttggatatagaactcttcacatccgcactcttcntaaaaacagaaactacaaaaggacctgctg

SEQ ID NO: 3042 - DNA, 101 bp, rice(Oryza sativa)
  misc_feature (71): n=a or g
gatgtgcatctacatcttcatcatcggttttctttcttaaccaccgattggtccacttgccttcacggctngattattatgctattgctgttgctgagcgc

SEQ ID NO: 3043 - DNA, 101 bp, rice(Oryza sativa)
  misc_feature (71): n=a or c
acagtatttttcattctgaactctaggattaatttttatctacgtgtacgtacagagattaaaaggaagangaataagaaatagtgtatactcatctgagt

SEQ ID NO: 3044 - DNA, 101 bp, rice(Oryza sativa)
  misc_feature (71): n=a or c
gataattcaagcattgaaaggacgtaaatctagtcgatcggcaccatcgacggggagcacaacccaactanctgatgtcgttgctaatcccatccgtctga

SEQ ID NO: 3045 - DNA, 101 bp, rice(Oryza sativa)
  misc_feature (71): n=t or c
tactaggatgtgtcatgtctagtattagattgattttttataagtacggaggaagtatgtgtattctacgntttcataagtacggaggaagtatgtgtatt

SEQ ID NO: 3046 - DNA, 101 bp, rice(Oryza sativa)
  misc_feature (71): n=t or c
aatatcaacccaattgatgagagagaaccacataaaataatagttttgtgcttatgtttctctcttctttnggtcttcttctgacgctcctctcagttctc

SEQ ID NO: 3047 - DNA, 101 bp, rice(Oryza sativa)
  misc_feature (71): n=t or c
aaggggtaatttggtcctaaaaaaggttagaaaatgttgtgaaggggtacgtagtggcatatctccaatanttatgaaattgtgatgacatggttaaaaat

SEQ ID NO: 3048 - DNA, 101 bp, rice(Oryza sativa)
  misc_feature (71): n=t or c
gtccctactcaagtccattgatgtggcgagggtgtccacaaatgtgaacaatgacggcggactcaatctgnagcagcaacaacacattccgctaggagctt

SEQ ID NO: 3049 - DNA, 101 bp, rice(Oryza sativa)
  misc_feature (71): n=t or c
tccttggccagtggcacttaacccttgtttattgtcattatgtttcacaaaaccccaggcttaactaaatntcgactcgttagccttggaatgaattgctg

SEQ ID NO: 3050 - DNA, 101 bp, rice(Oryza sativa)
  misc_feature (71): n=t or c
aacagaattcagccaacttatctcttgtgaacagaagagttgactaggcaaccaagatgacttggttcctngaagttcagttgtaatttaactacaaccat

SEQ ID NO: 3051 - DNA, 101 bp, rice(Oryza sativa)
  misc_feature (71): n=a or g
tagcttatctgactagctaattagaactcaggctcacactactacaaaatggaagaattgtaggaggtcanaatcagttttcacatacgaataaatggacc

SEQ ID NO: 3052 - DNA, 101 bp, rice(Oryza sativa)
  misc_feature (71): n=t or g
aacaatctgttcctgtcttcttgcataatactttattttgtggtatgttagcaaagcaataactaatccgntatgctttggctattaagcatttgtatgca

SEQ ID NO: 3053 - DNA, 101 bp, rice(Oryza sativa)
  misc_feature (71): n=t or c
cacgttggacaactctccacagtttccccacccgcatgtcgttagcaacagatttggtcactccctccttnatgatgccattagttgatctctctaaacac

SEQ ID NO: 3054 - DNA, 101 bp, rice(Oryza sativa)
  misc_feature (71): n=a or c
tcgtttgggatcccggcaacgaaggtgctcattcatgatttgttttccttttctctcttttgtaatctgtnttttttcgatctgtacttgtttgatgatcc

SEQ ID NO: 3055 - DNA, 101 bp, rice(Oryza sativa)
  misc_feature (71): n=t or c
tccaatggtccagatcatttgctacagtgaattcggaaattatatttttttttgcagtaaagcgctacaanacttgctactccctctgtttgacaatataa

SEQ ID NO: 3056 - DNA, 101 bp, rice(Oryza sativa)
  misc_feature (71): n=t or g
ccttattctctgaagcacttatctattctctgtgctatttatatgtagctaagagaacaattcaagttatnttacaaatgcattacagcaacttcaaataa

SEQ ID NO: 3057 - DNA, 101 bp, rice(Oryza sativa)
  misc_feature (71): n=a or g
caactcggttctggcatgcttgccttttgattttggtttattttgcccacccctagacccaaattcccagntgcacacactaatgtgctaacaaaggtaga

SEQ ID NO: 3058 - DNA, 101 bp, rice(Oryza sativa)
  misc_feature (71): n=a or c
atcccaggataaccggtgtagtttattttcattttctcgttggggccagaaaaactggcatatcacagtanttatctcatcgcacagggtttttgttagat

SEQ ID NO: 3059 - DNA, 101 bp, rice(Oryza sativa)
  misc_feature (71): n=t or g
taccaaagttagtttttgctaccataatgtcaacagttaatagtcatttacatttacaatatgctctaagnttagcgactcggtcagttggtgaataggat

SEQ ID NO: 3060 - DNA, 101 bp, rice(Oryza sativa)
  misc_feature (71): n=t or c
cgaaaacaagaacaagaagcaattacaaatcattgccaagaactcatcaatggaggaggatttgaatcgancgagttcaaaatcacttgcggtagcactcg

SEQ ID NO: 3061 - DNA, 101 bp, rice(Oryza sativa)
  misc_feature (71): n=t or c
acattacaaaaaccatatttggctatagctgataggacactgcaaatctgcaatattgtgacaatttaccntgggtcactattcattataatcgcatcatt

SEQ ID NO: 3062 - DNA, 101 bp, rice(Oryza sativa)
  misc_feature (71): n=a or c
ttccaatgtatttacatgttcagttggtggaaaaactaatgaagttgatagctacatttttaaggccgtanctaattttttttccccagtttgttgtctac

SEQ ID NO: 3063 - DNA, 101 bp, rice(Oryza sativa)
  misc_feature (71): n=t or c
aaatgatgattgacaggggaggtagtggttttatgaacaattcctctgtggaacactaaattgttgaggangcgttctcaccatttgaatttagttaattg

SEQ ID NO: 3064 - DNA, 101 bp, rice(Oryza sativa)
  misc_feature (71): n=t or g
ttttttggggctaaataattccgtatcaagaaggggataaaataacccaaaaggttgtgtccaaaatattnaaccctgttcatatgcaaagttgaatattc

SEQ ID NO: 3065 - DNA, 101 bp, rice(Oryza sativa)
  misc_feature (71): n=a or c
tagataaagatgggctgaggaagctgggattacagtggggtccaggagatggtgacagtaaaacatcctanagttattatggaagtagtattgaaactttc

SEQ ID NO: 3066 - DNA, 101 bp, rice(Oryza sativa)
  misc_feature (71): n=a or g
tttggagaggacttatggctcctattccatgagccacgaccagagatcttctttgcttgtcttctattccntctcatcttgcctcctttcttcttcggcac

SEQ ID NO: 3067 - DNA, 101 bp, rice(Oryza sativa)
  misc_feature (71): n=t or c
ttctacaatggatggagtatttattccatatcctaaaattttccatttacattttgatcttcaactaaccngaacttaaaaccaacccagagaaaccatgt

SEQ ID NO: 3068 - DNA, 101 bp, rice(Oryza sativa)
  misc_feature (71): n=t or c
aagttaaatattatttcctgattaaatttgacacaggtcattggatagctccgttgtgtgcacatcatctntatttctttgtattaactgttatgtaagat

SEQ ID NO: 3069 - DNA, 101 bp, rice(Oryza sativa)
  misc_feature (71): n=a or g
ctaaaaattagctatttttttccatataacacacatacctgacaaatttctctgaaattgcacctccaccnaggcggccaaagaagttaccaagcgcaaac

SEQ ID NO: 3070 - DNA, 101 bp, rice(Oryza sativa)
  misc_feature (71): n=a or g
ccgggggtttggcagtacaaacttgtgcagtgtttgttcatgcttttctcttggcttcttcatacctgtantctgttctgttcttctgcttgtggtcttgt

SEQ ID NO: 3071 - DNA, 101 bp, rice(Oryza sativa)
  misc_feature (71): n=t or c
ttcatatgattttattttcttttatagggtgtggccatgagttctgcaccaaatgtgcgctctacttgtgngccaccgctagcagctcaacatctatccgt

SEQ ID NO: 3072 - DNA, 101 bp, rice(Oryza sativa)
  misc_feature (71): n=a or g
aggcaggcagctttgcatgcatgtgtcatgtgtatccccattagcaagaggggtttccttgactttgcatngtacttggtggccagagagagagagagaga

SEQ ID NO: 3073 - DNA, 101 bp, rice(Oryza sativa)
  misc_feature (71): n=t or c
ggaacagttttggcaggattcgacgtttccggatgcatgatcttgtacgtgaactagccattaaaatgtcngaaaaagagagtttcagttcacttcatgat

SEQ ID NO: 3074 - DNA, 101 bp, rice(Oryza sativa)
  misc_feature (71): n=a or g
aggcaggagtttctccaagtcttgatttcggagttccaccagcaccaggagttttgaaaggagaattgtcntctcttattggagatggaatattttgtggc

SEQ ID NO: 3075 - DNA, 101 bp, rice(Oryza sativa)
  misc_feature (71): n=a or c
cctctagggtgtttaggacaagcaaacggatactaagctcgagctcgaggatgccacaagatctggcaagngtatttatacttttggagcaaatgaagtat

SEQ ID NO: 3076 - DNA, 101 bp, rice(Oryza sativa)
  misc_feature (71): n=t or g
tcaacggcggcggcgtggacacgtgggccatcagagcgcccaaactccggaagctctacatcaccatgganatgggtgacgacaacggctgccgaatacca

SEQ ID NO: 3077 - DNA, 101 bp, rice(Oryza sativa)
  misc_feature (71): n=a or g
cccaattgtcactctaattttgagattccaccccataagcccatcaccaacacacatgagtagttgattcngcccattccttctgacatggattcgtagca

SEQ ID NO: 3078 - DNA, 101 bp, rice(Oryza sativa)
  misc_feature (71): n=a or g
tagaacacctgtaaccatatattaagttggggtatcaatttcaatagaaggatatagaaagtgtataacanattgaaatccaatactacatggtttggaat

SEQ ID NO: 3079 - DNA, 101 bp, rice(Oryza sativa)
  misc_feature (71): n=a or g
ttgggctaatagctaagcccaataatatggggtaagggatttattggagttatttacggaagaaacaacanttcaagatgtgcgatattatgcgtataatt

SEQ ID NO: 3080 - DNA, 101 bp, rice(Oryza sativa)
  misc_feature (71): n=a or g
ggtggtgggtatgggcaatgaaggccatttggattgccaggataggaaaagttactactccctccgttccnaaataagtgtagttttagcactgttcatgt

SEQ ID NO: 3081 - DNA, 101 bp, rice(Oryza sativa)
  misc_feature (71): n=t or c
gggagagggtgaggtctttatataggccccaaatgacagttaggcagctggaaatgtctgaaatgtcccgnaaccatcattggggagtgatcaggagcatc

SEQ ID NO: 3082 - DNA, 101 bp, rice(Oryza sativa)
  misc_feature (71): n=t or g
ccagagaagttgttgcacgcggatctcacctctacgcatctcgcaagaagttctcatctttctgagagagngagtgaatagccatgatgacattggcgcgt

SEQ ID NO: 3083 - DNA, 101 bp, rice(Oryza sativa)
  misc_feature (71): n=a or g
agcaatagttaccacaccacacaacaactaggagtccgatatggagccagcaaactagcacgacaagggcncatcactctattatagcagcagtcatcacg

SEQ ID NO: 3084 - DNA, 101 bp, rice(Oryza sativa)
  misc_feature (71): n=t or c
catgtacattttgctttttaaagtgtatgttacatatacatgatgtacacttggaaccatgttaaaatgcnattgtgtgcccatggaaaaatttactgtac

SEQ ID NO: 3085 - DNA, 101 bp, rice(Oryza sativa)
  misc_feature (71): n=a or c
gtcgttgacttctagttgttgcagtagtatatactccaatagaaacctctacactgttctttcaaacaacnaaaacaaatacaccacactacacccatttc

SEQ ID NO: 3086 - DNA, 101 bp, rice(Oryza sativa)
  misc_feature (71): n=t or g
gcgccacagcacacatccttcgatcagatgtgttacgcaacaaatagcgagcagactatgagcgcctggcntgattgcattgcagatgtggtgttcaatca

SEQ ID NO: 3087 - DNA, 101 bp, rice(Oryza sativa)
  misc_feature (71): n=a or g
atattttgaaaaaaggggccggataaactgtcatttttttcagtagtgaaaaggccagacacattgcatgntcagttgatcacacgtacaacgatatgaag

SEQ ID NO: 3088 - DNA, 101 bp, rice(Oryza sativa)
  misc_feature (71): n=t or c
aaacaaaatgaaagaagacctatatagctaagagttaaaacctcaacaaatgtaagggactcagatccctnatcctgttagttgtctgggagatttggaaa

SEQ ID NO: 3089 - DNA, 101 bp, rice(Oryza sativa)
  misc_feature (71): n=t or c
tgtggaaaactaactcccgcgccagggaagaagatggtgagagggtggacgcgggagaagaggacctactnggaaagcttcgccgccttgagcaccgccgc

SEQ ID NO: 3090 - DNA, 101 bp, rice(Oryza sativa)
  misc_feature (71): n=a or c
tttctcaaggtccataagacaaatttcaccctcatagcaacagctgtaaatctgcaacgcaaatttatcanagaaaatcaataaaaataacagtagaatag

SEQ ID NO: 3091 - DNA, 101 bp, rice(Oryza sativa)
  misc_feature (71): n=a or g
ggaatctgatcacgaaggctagcattccctaccatttttacctttgccttcccctttatccaagatactantagtatcaccactaaggctgtgtttagatc

SEQ ID NO: 3092 - DNA, 101 bp, rice(Oryza sativa)
  misc_feature (71): n=a or g
cttaccagaattaacgtgtcgagttccctcaagttcggcctctctttaatctccattgctctcagtagctnctctgggtggcaataggagctcgggccagc

SEQ ID NO: 3093 - DNA, 101 bp, rice(Oryza sativa)
  misc_feature (71): n=t or g
cttcttggcgccgatatggtggtctaaactcagagaggaggaagaagtgtatcgttctgtgattttttttntatgttttagcgcagtgtatctagggctgt

SEQ ID NO: 3094 - DNA, 101 bp, rice(Oryza sativa)
  misc_feature (71): n=a or c
caacattttacttgaatttacaagattttagccattaaatccgatattgcggtaacgtaggaaaaaaaaangggattgctatatggcattcgaatgaaatt

SEQ ID NO: 3095 - DNA, 101 bp, rice(Oryza sativa)
  misc_feature (71): n=a or t
ttgactcttgtgaagagagaaatgtttgggcccatatgttagctcctattgtggcaaagcagagagatatnttttttattttattttaatatacatgtaac

SEQ ID NO: 3096 - DNA, 101 bp, rice(Oryza sativa)
  misc_feature (71): n=a or c
agcgccggggggactggatctccgctcggatgagattcacgccctgaaacaacgacgccgtccgccgccanatcctcagtcctcgtcaccgcctgaaggtt

SEQ ID NO: 3097 - DNA, 101 bp, rice(Oryza sativa)
  misc_feature (71): n=t or c
aacattggccatatgcgcttagttgagctattaccttgttttctgttggcacgatttataaaccattaaanggtgtatcaattttgtgcaaaattttctgt

SEQ ID NO: 3098 - DNA, 101 bp, rice(Oryza sativa)
  misc_feature (71): n=a or g
agtggtgccgtctcaaggacatcctcgcgctgccttcgcccatgccatcttcttctggttctgaggggacnatcaacgaccatggtgccggcaacgctgcc

SEQ ID NO: 3099 - DNA, 101 bp, rice(Oryza sativa)
  misc_feature (71): n=t or c
catatcacgacgtttggggtgaattcgctgtcagatgccgacgcttgcggggacaataaaaaaacctgcgngataataaaaatctatactagactactaca

SEQ ID NO: 3100 - DNA, 101 bp, rice(Oryza sativa)
  misc_feature (71): n=t or c
catctcaatctttaaatattctttaatcttaaaaatctactaaatttcagtctaaccctttttatccggtncttatattttgtaggtcaaaaaattgggct

SEQ ID NO: 3101 - DNA, 101 bp, rice(Oryza sativa)
  misc_feature (71): n=t or c
tttacttttcagccatttttttctactttaacctagattcgtccatctgtgtcgatttgcagttgtaaatngcctgcctttgttgcgagagtgtgatactc

SEQ ID NO: 3102 - DNA, 101 bp, rice(Oryza sativa)
  misc_feature (71): n=t or c
ggtggattgcggtggtggtggtggtggggtgtggttcattgaggccgctatccgggctagctcgaggatgnggatgatgtcgacaagggtttctgatcttc

SEQ ID NO: 3103 - DNA, 101 bp, rice(Oryza sativa)
  misc_feature (71): n=a or g
atgacgaagatgatgaggatgatgacgatgacgatgagttactcggttccggtgtgcgattacaaggatgngacctgggttctcgagaatcctgtcatcgc

SEQ ID NO: 3104 - DNA, 101 bp, rice(Oryza sativa)
  misc_feature (71): n=a or g
atgtcacttcatcacctcttttatttcccttcctctcccttcatcctctttctctcaatgttctcactggncaagcggcagggcggccgacgggtggggag

SEQ ID NO: 3105 - DNA, 101 bp, rice(Oryza sativa)
  misc_feature (71): n=a or g
gggaaccgtgcatcaatcggactcctggaataagtgctcaactgcgatcctctccaatttctttccgatgngcaaaacaaatgctctttgtagaagaatat

SEQ ID NO: 3106 - DNA, 101 bp, rice(Oryza sativa)
  misc_feature (71): n=t or g
atcacaattctggaaaggggtgctaagcacaagaaaatggttgagcttggggacagaatggcaggtgggtnatggaaaacacatctatttctggaaggatg

SEQ ID NO: 3107 - DNA, 101 bp, rice(Oryza sativa)
  misc_feature (71): n=c or g
accctgagcgacggcgtcgtttcttaacttggttggcatcttatatctgagactgcaagtgatgtagtatntacttggtgtgttttggaacttgaacctgt

SEQ ID NO: 3108 - DNA, 101 bp, rice(Oryza sativa)
  misc_feature (71): n=t or c
atatttgatcttactccttagtttaccaatgtagatccttcaacgtgttcaacaggttttctctttcttcnccacacacaaactgagctcctcaagctctc

SEQ ID NO: 3109 - DNA, 101 bp, rice(Oryza sativa)
  misc_feature (71): n=t or g
ttataatcttataaagtatacgttagatggagaccatgttatatgttaggtggagaccatgttatatgttnttgtcttatctgtcatatactccaatgtca

SEQ ID NO: 3110 - DNA, 101 bp, rice(Oryza sativa)
  misc_feature (71): n=t or c
gggggaggagtgcggagggaatggggagtcatctgggccattggattatacgtagatgagtatgagtcganggatttgatgaataaatcagttggtgaatt

SEQ ID NO: 3111 - DNA, 101 bp, rice(Oryza sativa)
  misc_feature (71): n=t or c
aattaattgtacctttggttgtccctgcatgattacgagctgcactcactgataccgtaagtatagatttntttttttttgagaaggcaagaactttcctt

SEQ ID NO: 3112 - DNA, 101 bp, rice(Oryza sativa)
  misc_feature (71): n=t or c
aaaacgagaggggagtgttgggaatttactcttccgaacacggccaggtgtgttcaccacccctgactccnaacaccaacaccttgcacggaaaacggagc

SEQ ID NO: 3113 - DNA, 101 bp, rice(Oryza sativa)
  misc_feature (71): n=a or g
ttcataccatggatgactgttgctgtgccaaaattgaagtacaaaacatggaagcagcagtagtattgccntgtttagttctaaaatatttcttcaaactt

SEQ ID NO: 3114 - DNA, 101 bp, rice(Oryza sativa)
  misc_feature (71): n=a or g
acatggtggcatgctcccctgctactattactaatatattttcgaaaattctctaaattcggcgcctgatncgggcgcgcatgcatcgggcgcctcgcgcc

SEQ ID NO: 3115 - DNA, 101 bp, rice(Oryza sativa)
  misc_feature (71): n=a or c
tgagccatacacacgtgaggacgtggcatgcgtcggtacgaagaccagcacatgtgtcctcggccaccccnacagcgtggttactgggaacttcttcaagt

SEQ ID NO: 3116 - DNA, 101 bp, rice(Oryza sativa)
  misc_feature (71): n=a or g
agggtttcattcgacacagcagctctccttggggctgtcccgttctttttgctccaaaaagtgatggtacncttcggctgtgtgttgactaccgtccacta

SEQ ID NO: 3117 - DNA, 101 bp, rice(Oryza sativa)
  misc_feature (71): n=t or c
gggcaaggatgggaataaagttaccacagggtaaggatggtgatgcatttcccgacggtgaatgttgtcanctcttttgtgtgagggaggagattatggca

SEQ ID NO: 3118 - DNA, 101 bp, rice(Oryza sativa)
  misc_feature (71): n=a or g
ctctccctccgttcaagtagctgccgaggaggtgaggacgaccgaccgtcaatgaagagcgaaagcagccnctccagggcctccggcctcctcaaccgcca

SEQ ID NO: 3119 - DNA, 101 bp, rice(Oryza sativa)
  misc_feature (71): n=a or c
ctggcgaggccatagcgacgagcagacgcaacagctcgtttccgaccgaagcggcacggcggcgcagcatntcccccaactcctcggcggtgtggcgccgc

SEQ ID NO: 3120 - DNA, 101 bp, rice(Oryza sativa)
  misc_feature (71): n=t or g
aaataaagtggattgctggttagtgctaatgtcctaccacgcatgatgcagtcacgtcttttttttttttngttatttctctgaaaagctaccgatgagtc

SEQ ID NO: 3121 - DNA, 101 bp, rice(Oryza sativa)
  misc_feature (71): n=t or c
atctcctctgatcccctttagtgtccaactcggtatcctcttgccttgccaacgtgccgcttgcggtgatnggaatcgtatccgtatcctcctccacgcag

SEQ ID NO: 3122 - DNA, 101 bp, rice(Oryza sativa)
  misc_feature (71): n=a or g
aaaaggcggaggaacccgagatgcataaggaaaatatagtcccggaagtggcaccgaagattgaagtgccngaggtgcccatggagattgcactgccggat

SEQ ID NO: 3123 - DNA, 101 bp, rice(Oryza sativa)
  misc_feature (71): n=a or g
tgtgtggttcagctgtatatgcttaacatcataaggttaattaacaactactgcaaggtatgcaagcgccntagcaatcgtgtcgaccatatgacctggaa

SEQ ID NO: 3124 - DNA, 101 bp, rice(Oryza sativa)
  misc_feature (71): n=a or g
agcggtggcggtttgggtgcgcagagaaggcgacactcggcctcgatgctggtcggcgcacgccatagatngaggatgatgcggatctaacggggaaagac

SEQ ID NO: 3125 - DNA, 101 bp, rice(Oryza sativa)
  misc_feature (71): n=t or c
ctcccttctgtcttcctctgtgaggaccatctcctctcctctcaatttaaccctgtaagcgcattggattngaacgctacagcggttacaaatggccggca

SEQ ID NO: 3126 - DNA, 101 bp, rice(Oryza sativa)
  misc_feature (71): n=t or g
cagtccagttctgtcccaagataggggtcatggtgattgaattgtgtttacaggccacaagatgagatganacgattcttttccttcatgatctttggggt

SEQ ID NO: 3127 - DNA, 101 bp, rice(Oryza sativa)
  misc_feature (71): n=a or c
gtttttttttatcagaacgtgccagagaaagcaaggaaaaaccaacacactagatacttgttctttctgcnggcagggacgaaacttgtgaaattctaaag

SEQ ID NO: 3128 - DNA, 101 bp, rice(Oryza sativa)
  misc_feature (71): n=a or c
atgattcctgtaaacctgccacacacaggcccttacaaaatacaaagctccacgtttggtgaaattttacnaaggagaaaagatctcgcagctgtagcagc

SEQ ID NO: 3129 - DNA, 101 bp, rice(Oryza sativa)
  misc_feature (71): n=t or c
agtgagaaaaaaaaaagcgatcctaccctttttatggcaatctaacctctaaccgttcagaatgtctttcnaggcgaggaaaaccgatttggctctcccgc

SEQ ID NO: 3130 - DNA, 101 bp, rice(Oryza sativa)
  misc_feature (71): n=t or g
atggtatggcagcttccatagctatgccacagccaaacttagatgattaattgactatttggttttggtanaaactctatttgtttgattacttggatgta

SEQ ID NO: 3131 - DNA, 101 bp, rice(Oryza sativa)
  misc_feature (71): n=a or g
ataataaatattaatcatcaaattaaataattagtaaatgtttacttctattaaacaaaataggaaggacnctatctctaacagcgtccaggtatggacgc

SEQ ID NO: 3132 - DNA, 101 bp, rice(Oryza sativa)
  misc_feature (71): n=c or g
aacatccaactcagacttcacagtcaaactagataaaaccataatgtgcatgtctagtgatatgtgaaaanaatcatgcatttgagattgagcgatttgca

SEQ ID NO: 3133 - DNA, 101 bp, rice(Oryza sativa)
  misc_feature (71): n=t or c
aagagaatcctcgcctaaactggacgaaattaagcctggtaataatttaattaccttgtgcgccttgagcnctgggatctccccgtattaaacccgctgcg

SEQ ID NO: 3134 - DNA, 101 bp, rice(Oryza sativa)
  misc_feature (71): n=a or g
atttgtcattataattgtgctgcctgcaattacttgtcatcatcttttatttaaaaatgagcaaacatganacaattgcgaccactgttccagtatagaat

SEQ ID NO: 3135 - DNA, 101 bp, rice(Oryza sativa)
  misc_feature (71): n=t or g
atcaggcctatttatacatcagttaattttttactcctcacaagtgaggggcatgataatacttgttaagntcagtaatattttcactcccgtatagtttt

SEQ ID NO: 3136 - DNA, 101 bp, rice(Oryza sativa)
  misc_feature (71): n=t or c
actgacgctgcgtattttctcatatattactatgcctgcgtatctatgtgtaagcatatcagttcgatttnaatagatcaatatgcataatatatatctct

SEQ ID NO: 3137 - DNA, 101 bp, rice(Oryza sativa)
  misc_feature (71): n=t or g
ttgtacaagttttaatagctgagggagtcattataccttgtttgacggttgagggatataaatcaaattcnatatatatatatatatatatatatatatat

SEQ ID NO: 3138 - DNA, 101 bp, rice(Oryza sativa)
  misc_feature (71): n=t or c
tcgatgagttgcctgaagctagtacttcactagatagtctccatcaagattagcatgcacgttgtttgcangcggaactctcttttgtaaggcttttggtt

SEQ ID NO: 3139 - DNA, 101 bp, rice(Oryza sativa)
  misc_feature (71): n=t or c
caaccctctcagcaacaccgatctatcatctcactatgcttccacaaataaaatgggttttcaaaagaatnggtcgtttcagaagagctttgatgtggaag

SEQ ID NO: 3140 - DNA, 101 bp, rice(Oryza sativa)
  misc_feature (71): n=t or c
tgatagatcggtgttgctgagagggttgtctttactagaacctctctgcccgtagcagtgaaaaattttcnattccaccccggtatatatcctggcaccgt

SEQ ID NO: 3141 - DNA, 101 bp, rice(Oryza sativa)
  misc_feature (71): n=a or g
tccatctttttaaaatttttggttcaaacttgctacaaattcgttccaacgctaaatttggtcgtcaacantttgttaaaaaattatgacatattcaatct

SEQ ID NO: 3142 - DNA, 101 bp, rice(Oryza sativa)
  misc_feature (71): n=t or c
atgtctatcaaaagggcaatttggctaataccccggcctggacaattcctatctcccaacatttaatgcangtagttttgaaacaaattctcccaacattt

SEQ ID NO: 3143 - DNA, 101 bp, rice(Oryza sativa)
  misc_feature (71): n=a or g
gtcccaatagaaaatttagtaccactggttttctttgaagcagggagctcttgatgtttgtgaggggtatncatagagaatgagaagtatatatgaaagct

SEQ ID NO: 3144 - DNA, 101 bp, rice(Oryza sativa)
  misc_feature (71): n=t or c
atattctgcttcggattacccattaaccaatatttttaattgaaccgggtattttacctttgcaccacttnaaaccattctcaacttttttttattcattt

SEQ ID NO: 3145 - DNA, 101 bp, rice(Oryza sativa)
  misc_feature (71): n=a or t
tgtcatttttaaataattcaatctcttactgtcaattttaaatactaggagagctcaggttaggccatctnctttcaacctattcaccggatgtggttcga

SEQ ID NO: 3146 - DNA, 101 bp, rice(Oryza sativa)
  misc_feature (71): n=t or g
aggtggcatggattccatggaaaatcaacaaggtggctgacaagttagctaaagaagctagaaccagtctnttttcaaatcctgttattaactgtccaaat

SEQ ID NO: 3147 - DNA, 101 bp, rice(Oryza sativa)
  misc_feature (71): n=t or g
atttcattaaacttgaccctattcacaaccatggttgctgacctgtggactgataataaaacctgggatgntgagaaacttaatttaatctttgaaaatca

SEQ ID NO: 3148 - DNA, 101 bp, rice(Oryza sativa)
  misc_feature (71): n=t or c
ctacaaggtatcaagaagagtgtagaaacctacaaagaagtacatattcaaggtactaaagtggatacatntggacatcagcatatcccccaaggttacgt

SEQ ID NO: 3149 - DNA, 101 bp, rice(Oryza sativa)
  misc_feature (71): n=a or g
ataagcttgtaacccttagctaccttcctcaattgcatttgtatttgttgaagtggttgccaacctttctnacatcctatataatcctaggctatggacta

SEQ ID NO: 3150 - DNA, 101 bp, rice(Oryza sativa)
  misc_feature (71): n=a or c
ctaccgcagtctcgcaaagcaaaagaggaagcgcggcacaaagaacgccgcatctgaaatcccccaaattncggcttaggctagacggtgcagcagccgcg

SEQ ID NO: 3151 - DNA, 101 bp, rice(Oryza sativa)
  misc_feature (71): n=a or g
cttaagctgacagggaaagacacgcaacactagaattgtaggtcaattacctcttctcggcctcggccttntcggtggtggcgaaggcgtcctcccaccct

SEQ ID NO: 3152 - DNA, 101 bp, rice(Oryza sativa)
  misc_feature (71): n=a or g
cgcacataggtcacaccctagccccatttggtgaatggtgagcaaaccctcgctttgctagatctcttccngttcccttttccacaatcatggactcatgc

SEQ ID NO: 3153 - DNA, 101 bp, rice(Oryza sativa)
  misc_feature (71): n=a or g
tatctgaagtattgatgaggctcctcttgcggaagtcacaggatgtgtatctctgccttatcaaaccatcngggtgggcctcatagaagagttgcttccct

SEQ ID NO: 3154 - DNA, 101 bp, rice(Oryza sativa)
  misc_feature (71): n=a or c
catatcggttggtcgctgagaataatatgtatagtattatacatgtgtttgtatatatagtacgaccgatngatatatcgatcgatcgatctgcagatcaa

SEQ ID NO: 3155 - DNA, 101 bp, rice(Oryza sativa)
  misc_feature (71): n=a or g
tcatgtccctatattggttaccgatctatccgtatatatggatgagatcatataacttatttcacaacagntacaagaacttgttttttatatttttgtga

SEQ ID NO: 3156 - DNA, 101 bp, rice(Oryza sativa)
  misc_feature (71): n=t or c
atttgagttacatataaacaacgaggtaacatccatttaaaagttcaaaatcgagaacgacgatgtatccnggtggtagattgtgtgcctatcaaaagggt

SEQ ID NO: 3157 - DNA, 101 bp, rice(Oryza sativa)
  misc_feature (71): n=t or c
ctatttatactgatcactacgtaaggttgcttcctcctcctatctaccaattgaaacaatacatgctctcnccttgtcattacctttttcggtcttgtaac

SEQ ID NO: 3158 - DNA, 101 bp, rice(Oryza sativa)
  misc_feature (71): n=t or g
ataaatcatactgtggaggaattatatccaacaaagaatggctgatttctttcatcgaaaagcgaattatnttcaacaatcatatcaacattcaacaattc

SEQ ID NO: 3159 - DNA, 101 bp, rice(Oryza sativa)
  misc_feature (71): n=t or g
ataacaaaatgagaatataagtttaccattgaacgatgccatcaatcttcagacttgtgccttggaattanatttcataatgatcttttctagaatcggta

SEQ ID NO: 3160 - DNA, 101 bp, rice(Oryza sativa)
  misc_feature (71): n=t or g
gaagcgaatacctgctgtggcaatggcaaaggtttcatataccaaatgcaaaatcttgaagatcaatactncaagacaatagctcttggggaggcaccttc

SEQ ID NO: 3161 - DNA, 101 bp, rice(Oryza sativa)
  misc_feature (71): n=t or g
agaaatccttggctcttgaagtcggcgataaatcccgataaggtctccaatttactattttcagataactntttgagcgtactcttgctatagccatgata

SEQ ID NO: 3162 - DNA, 101 bp, rice(Oryza sativa)
  misc_feature (71): n=a or c
atatgagcttggtcaatatgcattctctggaaatgcaatgggaacaaatggtatggagtggactaatctgngggactctgagaatggaatgcgcaatgtct

SEQ ID NO: 3163 - DNA, 101 bp, rice(Oryza sativa)
  misc_feature (71): n=t or c
tcttattcccacccttataacccttatacaaatggtcattcatcaccgctgaattccggcaccacagtganaaaccttgaacgcacttcacatctattaca

SEQ ID NO: 3164 - DNA, 101 bp, rice(Oryza sativa)
  misc_feature (71): n=t or g
cctataatcagtgagaaatcagcatagccatatgtataccactaaaaggatcatgatattacagttttgcngatgtgtggcaattaaatgaacagccaaat

SEQ ID NO: 3165 - DNA, 101 bp, rice(Oryza sativa)
  misc_feature (71): n=a or g
agtggttcgctactttcattgaaagccccatagcaaatttggaaaattctactgatagtgtaatacccttnctcccacaaaatcttaaaaaaaaaaaaaac

SEQ ID NO: 3166 - DNA, 101 bp, rice(Oryza sativa)
  misc_feature (71): n=a or g
agtccatggcatggagtaatcggacaaggaggcgaatgcccctgcagttcccatgatgatttctcatggcngcccgtccgactgcgagggcggggaatgag

SEQ ID NO: 3167 - DNA, 101 bp, rice(Oryza sativa)
  misc_feature (71): n=a or g
caaacttcattttttagaatgaggtccaccgcagcgatatccatccatcgagatccgcgatgtgacggctnaggagagggacgaaagctgaaatcccacaa

SEQ ID NO: 3168 - DNA, 101 bp, rice(Oryza sativa)
  misc_feature (71): n=t or c
attgaacactgtgggctggttacagatgagcgtacgagtctatcttgctagcttgcatctttggttatatnaatggaacttataattatctagtatcatat

SEQ ID NO: 3169 - DNA, 101 bp, rice(Oryza sativa)
  misc_feature (71): n=a or c
acagatttgccactattttaatagcaaagcttttgttggatctcttgccttttagggaggccatctctcgntgtggatcagccttttggtgagctttttgt

SEQ ID NO: 3170 - DNA, 101 bp, rice(Oryza sativa)
  misc_feature (71): n=a or t
tatagtgctatgtacggtcaagggatcaaggtggcaacaaggtagctaggccacatggggacgtttttttnaaaaaaaaaaatcatggaatcattcttatg

SEQ ID NO: 3171 - DNA, 101 bp, rice(Oryza sativa)
  misc_feature (71): n=t or c
tctcaatcttctaccagggactaatataatgatccaaacatacccaaattcgttttattggacagggagtnagcgatgacattggcgacgcaatacgtgca

SEQ ID NO: 3172 - DNA, 101 bp, rice(Oryza sativa)
  misc_feature (71): n=t or c
tatatgcatctatcgagtgagccgtggttatatcgcccaactaccaatcaaatcaatgcgtgtgtgcgttnatagaggtgagtgtgcgaggtgagtctaca

SEQ ID NO: 3173 - DNA, 101 bp, rice(Oryza sativa)
  misc_feature (71): n=a or g
ataagttcacttcatgtcttttaatttgacagcttaattttacagcgagtttgattttcgtctttgaatcncaataccagatacaacaggtctttcaacta

SEQ ID NO: 3174 - DNA, 101 bp, rice(Oryza sativa)
  misc_feature (71): n=t or c
atcagaaacggcagctggaactgccaacgccggtggagagttcatcccagccgctgtaatcgctcgccgtnagccgatgcctgggcgtggtcgcttgacct

SEQ ID NO: 3175 - DNA, 101 bp, rice(Oryza sativa)
  misc_feature (71): n=a or g
tggtgtcataatatgtgctaggcccgtcaccctgatttcaagaacagtaattatcatttattttaattctngcatggtttgtctaatctaagtatgaatcg

SEQ ID NO: 3176 - DNA, 101 bp, rice(Oryza sativa)
  misc_feature (71): n=t or c
gagaggttcgtcgtgaagcggatggacggcagcgtcgcggtcgccgtcgactttgtgcacttcaacaaggncagggagaagctggtgtaaattgtaatcgt

SEQ ID NO: 3177 - DNA, 101 bp, rice(Oryza sativa)
  misc_feature (71): n=a or c
gacggataagaattgacggacaaaaatagatcagtttgccatctctcctaatgtctagaggctaggaatgnagagtaaacaatacaaatgtgtgcaactgg

SEQ ID NO: 3178 - DNA, 101 bp, rice(Oryza sativa)
  misc_feature (71): n=a or g
tgccatcagcggagattatttcaagaagacttgctctttttgcttttattgctgggtggagcattgtaacntccgctgagactgggcctactttccaggta

SEQ ID NO: 3179 - DNA, 101 bp, rice(Oryza sativa)
  misc_feature (71): n=t or c
tgactttctatattcttttcccccacttgttttctactaatatcaatatgattaggaatctacctgacatnaatttctaccattacattcttgaatgaaaa

SEQ ID NO: 3180 - DNA, 101 bp, rice(Oryza sativa)
  misc_feature (71): n=a or t
gtgcgaaacaggattttcgcataaggaacattaagccgcccatctgcaaaatcaaaattaggcaaaaaaantccaaaaaagaaacccaaaaccctaactcc

SEQ ID NO: 3181 - DNA, 101 bp, rice(Oryza sativa)
  misc_feature (71): n=a or g
ggaaggagacgaaatggaggagagtaatacaagtcaccagcgacgacttcctagtagcaacaacagtgccngaagtatatatatggtagagaacttacagt

SEQ ID NO: 3182 - DNA, 101 bp, rice(Oryza sativa)
  misc_feature (71): n=a or g
tctattccacttcacatgccatttggattacatgaacacaagtactccttttccaaaacaaacaaacctcnggaaagatgtgacacatcctagtataataa

SEQ ID NO: 3183 - DNA, 101 bp, rice(Oryza sativa)
  misc_feature (71): n=a or c
tcgtctcgtcttcttcttccggtagtgaacctgttcagcgcgtcgccgatgagcgagttccatttcatggnggccgagctcctcgtcgggccaagcacgtt

SEQ ID NO: 3184 - DNA, 101 bp, rice(Oryza sativa)
  misc_feature (71): n=a or c
tgcgaatgtatttagtcgtcttcaaattaaattattttctgtagccgcagtgaatgtatttcgtatgtcantacagtacatggtagtactgtattaaacta

SEQ ID NO: 3185 - DNA, 101 bp, rice(Oryza sativa)
  misc_feature (71): n=t or c
gtagatgcaaaaggcattaagtgtttgcttttgactcatttttggtccttttatgtatgtcgttttcgcgnggctgccctcaaccaactttggcctctcat

SEQ ID NO: 3186 - DNA, 101 bp, rice(Oryza sativa)
  misc_feature (71): n=t or c
aaattatgtttaactcacataacacacaactttatcccatgggagtactttagatccagcgacttgattantgtccttttgcacctgggatatgaatgaag

SEQ ID NO: 3187 - DNA, 101 bp, rice(Oryza sativa)
  misc_feature (71): n=a or g
agggaagcagaaagttctacacctgtacatttgtagatctctttttcagttgtacaataagatgtgcatantagtgtttgatgatcaagtaatcatgaaca

SEQ ID NO: 3188 - DNA, 101 bp, rice(Oryza sativa)
  misc_feature (71): n=a or g
tgctgcttcgccgacgagctcgaattcgagtagttgacgtgagctcgcgaggcaagaggaagaggagagangagcatataaagggaggcacacgcatgtga

SEQ ID NO: 3189 - DNA, 101 bp, rice(Oryza sativa)
  misc_feature (71): n=t or c
tcagtgtttgagaaatcagcttaatatcaaacaaattgtgttataaaaaattctgcatatgaaatagagcnctgttttttttacaaacattaacctctcta

SEQ ID NO: 3190 - DNA, 101 bp, rice(Oryza sativa)
  misc_feature (71): n=a or g
cgcaaccaaaccgcgaaaccatcaattttttttaattcaaatgtttgccgccgaaattaacacggttttcngcggttaccacagtaaccgccttatagcag

SEQ ID NO: 3191 - DNA, 101 bp, rice(Oryza sativa)
  misc_feature (71): n=a or g
taaaagtttaaaacttactccctccgtccgaatataagtatagttctgcatatccaatatttgaccgttcnttttatttgaaatttttttatgattagtat

SEQ ID NO: 3192 - DNA, 101 bp, rice(Oryza sativa)
  misc_feature (71): n=t or g
acaagagtctacaactgcttccgcagtttgcaaatttttcctccacgcatttgtgaaatattagggtaccntgggcctgtggggatgtagtaaataaacca

SEQ ID NO: 3193 - DNA, 101 bp, rice(Oryza sativa)
  misc_feature (71): n=a or c
tggtcaccacttgccggcactgctatggatcggaggtgtgtcttaagcccccactattgaccctcggactntaggagtctccactgagttttttctaatat

SEQ ID NO: 3194 - DNA, 101 bp, rice(Oryza sativa)
  misc_feature (71): n=t or c
ttggactccgcttgaattgttaatatctataccgatcccctttctaccaccacctctcacgtcactcctcntcttctccagtgaactcatcggcagaaagt

SEQ ID NO: 3195 - DNA, 101 bp, rice(Oryza sativa)
  misc_feature (71): n=t or c
agtatgagcattgagcagaggcatggtagagcttgttaaaccacagatcatatcctattcacacaagtttnccgttcacaccaattagcaaatatcataaa

SEQ ID NO: 3196 - DNA, 101 bp, rice(Oryza sativa)
  misc_feature (71): n=a or g
gtgggtacgtacgtgtgtgaatgtggcataccgcacacgtgcgtgttgctgcccgtgcaaaaaaattaaanaaagaaagaaagaaagaaagaaagaaagaa

SEQ ID NO: 3197 - DNA, 101 bp, rice(Oryza sativa)
  misc_feature (71): n=t or g
gttgtttttgactttacaaatgctgccttcttgtgagcaactctaaactgtaaacttccttattttttatntggcaaaatttgctacaagacaatgaaaga

SEQ ID NO: 3198 - DNA, 101 bp, rice(Oryza sativa)
  misc_feature (71): n=t or c
ctcgtcccctccctccttgcagtgcacctgaccatctcacgcgacgccagcgtcgctgccatcatcgccgncgcgtcgctcgtcgccggccgccgacgccc

SEQ ID NO: 3199 - DNA, 101 bp, rice(Oryza sativa)
  misc_feature (71): n=t or c
aaatcgggccgtccatccatctcgcgtcacacggtccaccaccaccccgcccttcaatcatagagcccgtngcgcgtcgcgacaccgccgcccccgccgtc

SEQ ID NO: 3200 - DNA, 101 bp, rice(Oryza sativa)
  misc_feature (71): n=a or g
accaaagtaaagcatagcactgcaggtcatgaacacattttaccagaaaaaagtgtagcaatgcagatgancaaatcgaagaattattggagaaacccaag

SEQ ID NO: 3201 - DNA, 101 bp, rice(Oryza sativa)
  misc_feature (71): n=t or c
ttggttcgcacgcaccaaacaagtttgtgcattaaaacaagcgtttttcaagttcatgcgctagattgcanccacctaacaaattcgtttaccgctaatgc

SEQ ID NO: 3202 - DNA, 101 bp, rice(Oryza sativa)
  misc_feature (71): n=a or g
cggcgacgtcggcggcagggcggtgtagttgatgtgcgcatgcattgtgtagtggctcatggcggcggcgncgtgcaagcgagggaagaacaacggggagg

SEQ ID NO: 3203 - DNA, 101 bp, rice(Oryza sativa)
  misc_feature (71): n=a or c
gcaggagcccagcccacacaagcggaggcgatctttttgggcttagtctactgggccatcgcatgcgctanaaaaaacaagactatatggccaaggaataa

SEQ ID NO: 3204 - DNA, 101 bp, rice(Oryza sativa)
  misc_feature (71): n=t or c
gcggaattcttttacacaacaaagtcctattgccatccctgaagtagccaatgttcgagtatgtatttttnccttctattttttcctttactaaaatgctc

SEQ ID NO: 3205 - DNA, 101 bp, rice(Oryza sativa)
  misc_feature (71): n=t or c
aattctacatactgttgcttgtccatgagcacaacgtgtcttatgttaatcgggaaaaagacgtgtcttangtatgttgccgtggaaccagtaaaaatcag

SEQ ID NO: 3206 - DNA, 101 bp, rice(Oryza sativa)
  misc_feature (71): n=a or g
tcctccccatcatcctcatcacataaagcaccatcatggtcgtcctcttcatcctcaggttcaggaggcanccagagtgagctattgttttcaaaatctac

SEQ ID NO: 3207 - DNA, 101 bp, rice(Oryza sativa)
  misc_feature (71): n=a or g
agcaaggtggagcaagactttttctgccaactggagctaatgatgttgttattccagtatttgatgatganccgaccagtataatttcttatgcacttgtt

SEQ ID NO: 3208 - DNA, 101 bp, rice(Oryza sativa)
  misc_feature (71): n=t or c
aaaatataggacccacatataggccccactgacatataggccacggccccactgacatataggatccacangtcatcctctttctcttcttcctcctccct

SEQ ID NO: 3209 - DNA, 101 bp, rice(Oryza sativa)
  misc_feature (71): n=a or t
ggccacgcatggtggtcttgggcaccatggcgccggtctctgtcccattccgttccattgatttttttttntaaaaaaacatttgatccggttgtctcttc

SEQ ID NO: 3210 - DNA, 101 bp, rice(Oryza sativa)
  misc_feature (71): n=t or c
agccccgcctctagggcagtttaaaagctagggcttgttggtctaggtcttccaagatgagacccactacngcaatctcatcacattgtgtaggatcgaat

SEQ ID NO: 3211 - DNA, 101 bp, rice(Oryza sativa)
  misc_feature (71): n=a or g
atctgaacatgcatgcactatgtccagattcatagtccgaatgagtcataggttcatatccagattcatantcctagaataagtcataggttactatattt

SEQ ID NO: 3212 - DNA, 101 bp, rice(Oryza sativa)
  misc_feature (71): n=t or g
ccaaacctactatgtggcatccacaattcgacatgccacctcccctccaagcggccgtactcgattcattnttgcttaatatcatatcacacattaaatat

SEQ ID NO: 3213 - DNA, 101 bp, rice(Oryza sativa)
  misc_feature (71): n=t or c
cccgacagaaattaacccgaccatcaacgatggcgaacggcggagcggaacttgtgcctctatttcgtctnaggcctcgattccttgtatgttagtcattt

SEQ ID NO: 3214 - DNA, 101 bp, rice(Oryza sativa)
  misc_feature (71): n=t or c
acaagctttagttccctatcaatagaaaatgatatcctactccatctaccatttgtgtgattcttcttttnctattttaaataaaatttaaatgctgaggg

SEQ ID NO: 3215 - DNA, 101 bp, rice(Oryza sativa)
  misc_feature (71): n=a or g
cgcggccatggcaaatcttggcgagagcaggagacgccatgtgaccgtgttcctgcctatccggaagagangaaaaaaaaaacagccgtcttttgaagtga

SEQ ID NO: 3216 - DNA, 101 bp, rice(Oryza sativa)
  misc_feature (71): n=t or c
caagcactatgtaaggtggggtacagagctatcctagtattaatagagtatcaatggtgactgatgtactnatttactcctctaatgtatatgttctaaaa

SEQ ID NO: 3217 - DNA, 101 bp, rice(Oryza sativa)
  misc_feature (71): n=t or c
atgcatgcatccggcagggaaaagactgtagccttcgcaccgagtccggccggccacccaccacccaaagnccccccccccccttcccgctactaccgttt

SEQ ID NO: 3218 - DNA, 101 bp, rice(Oryza sativa)
  misc_feature (71): n=t or g
gctagtcggctgccatgatgctacagtgctgcacccagaaggaataattacgtagccaatcctttatgaancagcaacctgtagtgaaaaactaccctcga

SEQ ID NO: 3219 - DNA, 101 bp, rice(Oryza sativa)
  misc_feature (71): n=a or g
gtacggacgttttggttggcggttgaccgggtaagactatgttttgacctgtatagatactactccctccntttcataatataaatcattttagcattttc

SEQ ID NO: 3220 - DNA, 101 bp, rice(Oryza sativa)
  misc_feature (71): n=a or c
tacaacaggactttattttggtgatcaaaagcatgacaatgtcagctcaagctagactattcatgtattcnatgcttgaatatgaaacatcgtttgccctt

SEQ ID NO: 3221 - DNA, 101 bp, rice(Oryza sativa)
  misc_feature (71): n=a or g
catcaccatcatcatcatcatcatcatcatcatcactggatgtggaggagtcctcacggaaggagtgaganggaccctcaccggcagccacatccctagca

SEQ ID NO: 3222 - DNA, 101 bp, rice(Oryza sativa)
  misc_feature (71): n=t or c
tccgtaacccccccatatgcatgattcaattccattccgtttccatgtagcagctagctagcaatgcatgnatattctgctatggtacagcttgttttcgt

SEQ ID NO: 3223 - DNA, 101 bp, rice(Oryza sativa)
  misc_feature (71): n=t or g
taaatggtgtaattactgaaaaaaaaaagaaccaccgatgttccttggaaaactttttcataattaatttnttaattatttccaatatttaatttatccgt

SEQ ID NO: 3224 - DNA, 101 bp, rice(Oryza sativa)
  misc_feature (71): n=t or c
ggcaggattgagttgtacatatatatacctcctttaaatagggatgtcatcggagataaccacatggtganaagtaacatgcacccttcatccataaaaaa

SEQ ID NO: 3225 - DNA, 101 bp, rice(Oryza sativa)
  misc_feature (71): n=a or c
atttctatctagtgacgctacagaagtgtatatatattgcaacccaataatcccgtggaagtccagacatnaatgctggctatgttggaaaattatactac

SEQ ID NO: 3226 - DNA, 101 bp, rice(Oryza sativa)
  misc_feature (71): n=t or c
atgcatctgcaactcgagagcaaaagataaaagggtgatatggagaaaatctctgacaagagtgagttggntgtttttctttgctgccgcaggcgacaatc

SEQ ID NO: 3227 - DNA, 101 bp, rice(Oryza sativa)
  misc_feature (71): n=t or c
tgaaattgtgagactgaatatgatactgaactcctcactgcactggaaatgttgattttattaagagaagngtattccagtattgattttattagagaatg

SEQ ID NO: 3228 - DNA, 101 bp, rice(Oryza sativa)
  misc_feature (71): n=a or c
taatgagacgatcaccaacgtcgtcatccccaccttcgacatcaagctcctccagcccatcaccttctccngattcgacgtaattaaacgtgtccaataac

SEQ ID NO: 3229 - DNA, 101 bp, rice(Oryza sativa)
  misc_feature (71): n=a or g
ctcgctcgaaatatcagtgtgttgttacagtcaactgattgctattggtctgaagtttcaacttacaccgnccttcttcttctaaccagtagtttagtttg

SEQ ID NO: 3230 - DNA, 101 bp, rice(Oryza sativa)
  misc_feature (71): n=a or t
tacagaaaataaagtggtagcaggtttcactgtttcagcatgtctgcgggtattactctcagttttttttnaaaaaaaattatacgtattgcggattgttt

SEQ ID NO: 3231 - DNA, 101 bp, rice(Oryza sativa)
  misc_feature (71): n=a or c
gatgacttgacaacaaaaggcaaacccatggagggtggctttaaaccagcaaagttaagcattggtagggnccattgccccatgggcacacctgagcgtat

SEQ ID NO: 3232 - DNA, 101 bp, rice(Oryza sativa)
  misc_feature (71): n=a or g
ttgcacctcttccacaacagaaccagaaccgtcaatatatatgtcacaagcaaatttcgtcgtatatttgntttgttcatgtgtaattgtctcgtatacaa

SEQ ID NO: 3233 - DNA, 101 bp, rice(Oryza sativa)
  misc_feature (71): n=t or c
ctcctccatcggtagcagcacactattcctactagcatctctagtagcctatccacataccaggatttttnaaaccgtcgggatcagggttactacgcccc

SEQ ID NO: 3234 - DNA, 101 bp, rice(Oryza sativa)
  misc_feature (71): n=t or c
tacatgtccaatgaccctttggtagttcagtggtaaatgcggtaccagccctacaaaatctattgtttggnagagattatgaaaatctattgtttggtaac

SEQ ID NO: 3235 - DNA, 101 bp, rice(Oryza sativa)
  misc_feature (71): n=t or c
tattccatgaatatagctgcttgtcagtgtcatagggatgcatatgggcaatcatgctaccacataaaaantcatctccatagtttgttttctacagttaa

SEQ ID NO: 3236 - DNA, 101 bp, rice(Oryza sativa)
  misc_feature (71): n=t or c
tcaggttcctcctcatcttcttctctcctcttatccccttcgccttcctcctccccgcctacacgaccagntcctggtttctgctgccttccctcggtctg

SEQ ID NO: 3237 - DNA, 101 bp, rice(Oryza sativa)
  misc_feature (71): n=t or c
cacccgctatttagggttgcaggtatggaaatcagacccttcacactctcttgctgagattgtcaaccttnaaacttcttttaaccaagcaatttgactga

SEQ ID NO: 3238 - DNA, 101 bp, rice(Oryza sativa)
  misc_feature (71): n=a or c
caaagaaatccgccgaaagtgcagttatacgtagcgacaatctgcaatacgtaccaacagccgaaagcatntatggacaagcagccacgcaagccatcagc

SEQ ID NO: 3239 - DNA, 101 bp, rice(Oryza sativa)
  misc_feature (71): n=t or c
agtgtggtgcacattttgtcatctcctaccttttgctctagcttgctagctcatcactatataatctccanatgggagagaaaattaagacagtgcagacg

SEQ ID NO: 3240 - DNA, 101 bp, rice(Oryza sativa)
  misc_feature (71): n=t or c
aaagggcaacgtgcaaaaaaccttcctcaaatccaacctccgaccgcgtcaatggccgcccaatcacacgnccccacgtgtcccccctcacctccgccttc

SEQ ID NO: 3241 - DNA, 101 bp, rice(Oryza sativa)
  misc_feature (71): n=a or g
gccaaaggaacttttcctttgcgtcattcatggctctgcatctatctctttcctagattttttttcactcntccaaacaactcaaatttcaccattcgctt

SEQ ID NO: 3242 - DNA, 101 bp, rice(Oryza sativa)
  misc_feature (71): n=a or c
atgtttatagttggcttatagccgctattgtacctgttcttacggtgggtagaagtggaagtggaagtggnagcggaagcggaagagacccacccccgacc

SEQ ID NO: 3243 - DNA, 101 bp, rice(Oryza sativa)
  misc_feature (71): n=a or t
tgctcgtcgtgacatgttcagatcatgattgtactctcaacgagtgtgacaatcagaattccttttttttnaaaaaaaaagactagtaaatatgtccgtgc

SEQ ID NO: 3244 - DNA, 101 bp, rice(Oryza sativa)
  misc_feature (71): n=t or c
tatcaattcatttgtgttttttttattattgcatgtatcattttgatccgatggtcattgtttatctaaantctttatccaatggccaatatattttttat

SEQ ID NO: 3245 - DNA, 101 bp, rice(Oryza sativa)
  misc_feature (71): n=t or c
ttttggaaaatcagccggtttttttagtggaatcggatttatttttaacattgcgtggaactttttttttnccactaacctttttttgggagggccgattt

SEQ ID NO: 3246 - DNA, 101 bp, rice(Oryza sativa)
  misc_feature (71): n=a or g
agtagattaatggtgtttttgtcgttggtagatgatttctctataaaaatgtaaagataacctttcatgtntatcagcgcaggggcggaatcaggcatggg

SEQ ID NO: 3247 - DNA, 101 bp, rice(Oryza sativa)
  misc_feature (71): n=t or c
gatgttattgctcacaagcaggcaattcccttcagaaggtactgtggaggcgtgggccgtactgcacaagngaagtctcgccaatcaaatgggcagggcag

SEQ ID NO: 3248 - DNA, 101 bp, rice(Oryza sativa)
  misc_feature (71): n=a or t
tgtggtcttagaagaaatgaacttttgttgctcacagtacagactccagaacccattgtcttcaagggganttttttttttttgtcttcaaggaaaaaaaa

SEQ ID NO: 3249 - DNA, 101 bp, rice(Oryza sativa)
  misc_feature (71): n=t or c
cttatatgtggtgtttaatgcgaaaaaaaagacattcaggaaaactttcatattttactctgtctatgctnttgagattttaataattggatgttttttta

SEQ ID NO: 3250 - DNA, 101 bp, rice(Oryza sativa)
  misc_feature (71): n=a or g
gccgtcctgatcggtcacattgaacactgaacatgacatgagccaagtgagaaagggaagaagagaagtcnaccaaactttactgaattactgctccctac

SEQ ID NO: 3251 - DNA, 101 bp, rice(Oryza sativa)
  misc_feature (71): n=t or c
tagactgatttttgtatgacaggttctctcaatcaggttgcagctgtactgtttgctagtaaaagtgttgngctgattggttgtttctaaaggcaaaatgc

SEQ ID NO: 3252 - DNA, 101 bp, rice(Oryza sativa)
  misc_feature (71): n=a or g
acctgataattagttttaattttgccagcaatgcggagcatatgcaatttgtaaattgatggcaatgcaantctgaacttttttcatgtagttgatatttt

SEQ ID NO: 3253 - DNA, 101 bp, rice(Oryza sativa)
  misc_feature (71): n=a or c
atgggtggtttaactcttacgttgccactaaacattaagtgctaaaaatacaatcatcgtgatctttttanattattttttgtatagcttgaatcaaagtg

SEQ ID NO: 3254 - DNA, 101 bp, rice(Oryza sativa)
  misc_feature (71): n=t or c
ctataaaggttgatgggtagcacaagcccaaaacctgattattgttatacccatggcatttcaccgaatanctggtagttataaggctattctcaacccaa

SEQ ID NO: 3255 - DNA, 101 bp, rice(Oryza sativa)
  misc_feature (71): n=t or c
aagacatcggctttgatgacctgtgtttgggttttcacttggaccatccggctggaagaaatgcaaattgnacaaaaggagacaagcaacagtgagggtgg

SEQ ID NO: 3256 - DNA, 101 bp, rice(Oryza sativa)
  misc_feature (71): n=a or g
caagcacacaaggccctcagtgaggtgcaggaggaggtcgaccccattggtggtggcagccctagggatgncagcgggctgggtccgaaaggcagaagagc

SEQ ID NO: 3257 - DNA, 101 bp, rice(Oryza sativa)
  misc_feature (71): n=a or c
ccaatatcgattatcgattattgaccgcaagccaaataaaaaacttgcacttcaattgtgcccagctcttnaaatccttcacaacaaggcagatttgatta

SEQ ID NO: 3258 - DNA, 101 bp, rice(Oryza sativa)
  misc_feature (71): n=a or g
ctagcaaatctgtttattagttgaaaagtttgttctaataaacgaaaggagttgggaatccctcctatccntacgtaaaacaatgtatgcattaacacata

SEQ ID NO: 3259 - DNA, 101 bp, rice(Oryza sativa)
  misc_feature (71): n=t or g
tagcttaatttaagcatggaaagtatttcatctttgtctctggcactgtctgcgatggctttccattcatngagttgttgctttgagctcatcaggccacc

SEQ ID NO: 3260 - DNA, 101 bp, rice(Oryza sativa)
  misc_feature (71): n=a or g
ttgttatgttcttttgcacaataaaactattttatcatgcataaatgggcatcacatgattcacaaaaaanaaaagaaaagaaaagaaaagaaaagggaat

SEQ ID NO: 3261 - DNA, 101 bp, rice(Oryza sativa)
  misc_feature (71): n=t or c
ccgcaccaatcttagaccacctatcttttacctctagctcaagtgcttttttctcattctctcctcttctntgcttatcatcaaccgaagcaatggagccc

SEQ ID NO: 3262 - DNA, 101 bp, rice(Oryza sativa)
  misc_feature (71): n=a or g
gctctgttcgctttctgaataccaggcaccaggtataatgcagttgagagctgatttcacacactctatgnggaaaaaaccgccgcgctaatgatccacaa

SEQ ID NO: 3263 - DNA, 101 bp, rice(Oryza sativa)
  misc_feature (71): n=a or g
ggatcgatgaagacgacgcttggtggtgtggtctctgatactgaattgaaggcaacttttaatttaggccntccaataaaaccgatggacgccttgcagtt

SEQ ID NO: 3264 - DNA, 101 bp, rice(Oryza sativa)
  misc_feature (71): n=a or g
cgtccccaccaccggagcaaagcaaagccgaataaggggggtgttttaatgcagggtataaagttttagcntatcacgtagcatattatataagttatcat

SEQ ID NO: 3265 - DNA, 101 bp, rice(Oryza sativa)
  misc_feature (71): n=a or c
aaaagctcccagatcaacaagtagagaatgtaatgttatgggaaagagagaaaaatgaggcgctcaccggncggcggcgaggacgccggcgccgctggtcg

SEQ ID NO: 3266 - DNA, 101 bp, rice(Oryza sativa)
  misc_feature (71): n=t or g
ccatatcggacacggtctcaagaagttcgtttccatgtgtacgaaacgtattctttttctcgataagaagngtagaaggcgccaggtcgccgtagtctcgc

SEQ ID NO: 3267 - DNA, 101 bp, rice(Oryza sativa)
  misc_feature (71): n=a or g
tgaaggtaactaagtatagatctttatgtatacctttaatcattttgttgctgtatgtcgagtcatcatantattttttttgtttgatttgatcacacaat

SEQ ID NO: 3268 - DNA, 101 bp, rice(Oryza sativa)
  misc_feature (71): n=t or c
aatgaaatcagaacagttttaggccatcttctttttagctactcaattagagcatgtttggtagggactcnaactcttaaatttaacttcaagagccgtgt

SEQ ID NO: 3269 - DNA, 101 bp, rice(Oryza sativa)
  misc_feature (71): n=t or g
ttacacctacctaatcaaacaaatgtaattctagaacttgttcatttgactagtttgaagttccgtatccntatatccggattatccgcttcgaactgtat

SEQ ID NO: 3270 - DNA, 101 bp, rice(Oryza sativa)
  misc_feature (71): n=t or c
tccggtcgtttgaaaactagaaatgcttttctacccgccgaaccccgtttggtgaatttacatgtcgaatnctcccggctcactgtcaagctcaagtgaag

SEQ ID NO: 3271 - DNA, 101 bp, rice(Oryza sativa)
  misc_feature (71): n=t or g
ccctccagagcgagcaacactatcattttcgaactgttccttccacctttcaagtgcgacaccattgcacncctcggctttggtgtagtgaacaagttatt

SEQ ID NO: 3272 - DNA, 101 bp, rice(Oryza sativa)
  misc_feature (71): n=a or c
actaatagcactccagtgaactcactaaccttgtacttggcatcctagacaaggtggatatggcttcatcnggcaaaaggagactaatccctccattcaga

SEQ ID NO: 3273 - DNA, 101 bp, rice(Oryza sativa)
  misc_feature (71): n=t or g
tatccctccatttctctttctatcttacccttacctgcccatctatgattgattgattgataacccatgtntcagattacagttttctttctcgcactatg

SEQ ID NO: 3274 - DNA, 101 bp, rice(Oryza sativa)
  misc_feature (71): n=a or g
agcacaacgcactgcacatatatacagtgcacggtattggatattgatgatgcacaacaccctaacgtagntgaagatgagtcgttgtggacgaacaacga

SEQ ID NO: 3275 - DNA, 101 bp, rice(Oryza sativa)
  misc_feature (71): n=a or g
cacggtaggcagtagtatggcacccatgaatatgatgctttgcttaacaccattactaattaattaccttnacaagtacaataaattgaatgagttgaaca

SEQ ID NO: 3276 - DNA, 101 bp, rice(Oryza sativa)
  misc_feature (71): n=t or c
aattgggattaagacaagaataaatttaaatggtaggtgattaatgagacgctagtagtttaaaagcatangtcgacaactagacgttcgtgataactttg

SEQ ID NO: 3277 - DNA, 101 bp, rice(Oryza sativa)
  misc_feature (71): n=t or g
gtcaaattaaattcaaagcaagttaagagaaatgaaaaaggcaatgttctacacagggaacacaaaatttngaggctacacttaaaaggtaaagcatgatg

SEQ ID NO: 3278 - DNA, 101 bp, rice(Oryza sativa)
  misc_feature (71): n=t or c
gctgtggtaatgacgatggcatgattgatgagccaggccttaaatcagatgacatgaaagttgttgcaganagttttgaggatgatgagcagggttggtgt

SEQ ID NO: 3279 - DNA, 101 bp, rice(Oryza sativa)
  misc_feature (71): n=t or c
aagttgaaagctcagtatctgatattagtgttgtgcattgttcaagttgcaggatgccactggttcaagangcacgtcttcttcgctggaagacatgcctt

SEQ ID NO: 3280 - DNA, 101 bp, rice(Oryza sativa)
  misc_feature (71): n=a or g
atatgagatgtgaatgctccttctatccgcagtaatttgggatgtgaatgctccttttctgaactacaatnaatttgtaacaattctaccttcatgttcaa

SEQ ID NO: 3281 - DNA, 101 bp, rice(Oryza sativa)
  misc_feature (71): n=a or g
aagttcactctaggtccctccatttgttgcccgatctaatttttatctttagtcccaaaaaccagatacancgcatccttcaaattacaaaatcatacaaa

SEQ ID NO: 3282 - DNA, 101 bp, rice(Oryza sativa)
  misc_feature (71): n=t or g
tagtatcatgaagagagcggcaaatcagggtgctgacaaccgggtgctcatcaacgtcggatccggcagtngagcgcattgtcgcaacattgcttgtggag

SEQ ID NO: 3283 - DNA, 101 bp, rice(Oryza sativa)
  misc_feature (71): n=a or c
attgcaaaaagtccatttggactccctcaaacataggtcaaatatgattcataccctctgccgtaatatcntatatattgaccttccaaatattaacaaca

SEQ ID NO: 3284 - DNA, 101 bp, rice(Oryza sativa)
  misc_feature (71): n=a or c
tttttaaggatgacactatacaagctaatttgtctatgaaatacaatcaccatcaagattccgacaattcnattccattagtacgacccatatttttctaa

SEQ ID NO: 3285 - DNA, 101 bp, rice(Oryza sativa)
  misc_feature (71): n=t or c
tttccacattaatacaaattctgaaaagaatattgaatattttttaatcccatgaaaaaaaattagggtgngacaaatctattttcatattcatagatagc

SEQ ID NO: 3286 - DNA, 101 bp, rice(Oryza sativa)
  misc_feature (71): n=t or c
tttttcagcattcaccttccatgaaaatctcctccatttgcaagattcgctcaagaagcatcgacaacggntgctgctccccgccgccacgcctcctgctc

SEQ ID NO: 3287 - DNA, 101 bp, rice(Oryza sativa)
  misc_feature (71): n=t or c
gtggacgctctaccagccagcatcttaccatatttttctaattccttctttaccattactactacctccancccaaaatctacacatatgtgtgaccagat

SEQ ID NO: 3288 - DNA, 101 bp, rice(Oryza sativa)
  misc_feature (71): n=a or c
attagctaaaatttaaggggtgtagaagggattttctcttaatgtaatgttgccgtggaaggcggtgccanatatcctatcagacagtgctatggtcttgg

SEQ ID NO: 3289 - DNA, 101 bp, rice(Oryza sativa)
  misc_feature (71): n=a or g
cactaatttctttctacctccaaaccttgaaattagcaatcaactggtgctaatcaatttctgatgtattnttcaattgaactacatgaatactttgctgc

SEQ ID NO: 3290 - DNA, 101 bp, rice(Oryza sativa)
  misc_feature (71): n=t or c
aactgtcattccaaccgtcttaatttgggggctataaaaggaggaccacactcacttccaaaatgcacaanaaagtggggtatcactcacttttttaattc

SEQ ID NO: 3291 - DNA, 101 bp, rice(Oryza sativa)
  misc_feature (71): n=a or g
attcttttctgattttggatttttcattttctttttcatgttttaaagctttaaaacggtacattttcatntaaaaattttctatatattatttaaaataa

SEQ ID NO: 3292 - DNA, 101 bp, rice(Oryza sativa)
  misc_feature (71): n=c or g
cgggttcgagtcccggcaacggaatttatgcgttttggcccaacataaagaatcactgttgccttcacaanactcaaatccttgtctgatttcaaagaatt

SEQ ID NO: 3293 - DNA, 101 bp, rice(Oryza sativa)
  misc_feature (71): n=a or g
cacacacacatctctaagctagcaccttatcggctggtgtaaaggatccttacgctttatgtttttatccntgcaacctatcggttgatgtaaaagatcct

SEQ ID NO: 3294 - DNA, 101 bp, rice(Oryza sativa)
  misc_feature (71): n=a or c
tcggtgcatcgccaccttttacatttctactttttcgacgaattcttacttcgatttagggtatcagcttngatcttctgacaagaggtatgacttgtctc

SEQ ID NO: 3295 - DNA, 101 bp, rice(Oryza sativa)
  misc_feature (71): n=t or g
ccgtagagaattactaagagcaaaatgaggaattcctttagaacacaacataagatggcggatggccgcangtctcttattctacagcggcagtctcaaac

SEQ ID NO: 3296 - DNA, 101 bp, rice(Oryza sativa)
  misc_feature (71): n=t or c
aacaaccaaagttgggagaaaatctagactagcgtgaaggagaatttcatccatacaagtattgggctgantaagaaggagcagcaggccagtttctgggc

SEQ ID NO: 3297 - DNA, 101 bp, rice(Oryza sativa)
  misc_feature (71): n=t or g
caaaaccactaggaatttttggccaacacttaaacaccttgaaaaacaagggccaagaagttttgggccanaacaccaagaacttccgacccacactttct

SEQ ID NO: 3298 - DNA, 101 bp, rice(Oryza sativa)
  misc_feature (71): n=t or c
ttattatatgcttttcactttgcatcctttgtaacttcttctgtatagtgcaccaacaaacttatgctttngaactcagtatttcaaatttagttctaggc

SEQ ID NO: 3299 - DNA, 101 bp, rice(Oryza sativa)
  misc_feature (71): n=t or c
atctcttttatgctgcgcgaaaaatgatgccacagctcaatatatctcttacatttatatctaactcctcnatactaattattgccggtcgatgcacatga

SEQ ID NO: 3300 - DNA, 101 bp, rice(Oryza sativa)
  misc_feature (71): n=t or c
agagctcactaccagcgtctaggccctccagtgcaaggtcctcaaggaaaaatacaattcactgcttattngcaatcactgtgaaaagaaggcccctagaa

SEQ ID NO: 3301 - DNA, 101 bp, rice(Oryza sativa)
  misc_feature (71): n=a or c
ggggcggcctcctccctctagtcttgagacccccaggcccatatcaccaacaagtataaatcacttagatngaaatatatattaacaacaagactatatat

SEQ ID NO: 3302 - DNA, 101 bp, rice(Oryza sativa)
  misc_feature (71): n=t or c
cccactgtgcgggaaggtcgatatgatgaaagaggatataaaacagaatgcgagggtaaacctgacctagngaggcttggggaaggtggatgaaccctcga

SEQ ID NO: 3303 - DNA, 101 bp, rice(Oryza sativa)
  misc_feature (71): n=t or c
tgaattatgacttatgagatgcactcttacgttagaaattatctatctagccaagctcatttttattgggncacacatagaaaaaaagattttttttttct

SEQ ID NO: 3304 - DNA, 101 bp, rice(Oryza sativa)
  misc_feature (71): n=t or c
cattagcaggcagtaaaccaaatacttcgtctggtcataaatacttgatgttttggataggatctgactancagcgacttctaataaagtactaagtttga

SEQ ID NO: 3305 - DNA, 101 bp, rice(Oryza sativa)
  misc_feature (71): n=a or g
aatatgacaaaaaaatatggctagtccctagtttaatttggcccaatagtttagacgcggttatgaaacancatatatagaataaaacgtgaattgtacat

SEQ ID NO: 3306 - DNA, 101 bp, rice(Oryza sativa)
  misc_feature (71): n=t or c
ggttgtacaaccaggacgcacaatccggaactaaagatggtaattttaggcccggttatttcagtcaggantaaaaatcgatctataccaaccgatactaa

SEQ ID NO: 3307 - DNA, 101 bp, rice(Oryza sativa)
  misc_feature (71): n=t or c
aaatcgccacccgaaccccgttttcccgtgcaccgatgagcactcccttctcaccctccatcaccggcctnaattcctcgccgttccctgtcccctcgcgc

SEQ ID NO: 3308 - DNA, 101 bp, rice(Oryza sativa)
  misc_feature (71): n=a or g
gcggagcttagatgttaacaccaacctgtctacccggattgaagtcccatatttagtggtaggcgatattnatatcaacagtgagctgtctgcggtgactt

SEQ ID NO: 3309 - DNA, 101 bp, rice(Oryza sativa)
  misc_feature (71): n=t or c
ccatatagcatgagtatggagggtgcaaatgtctatataggcaaagctaagcagtgtcgataattgaccangcataagtaatagactcaggaaacaaggat

SEQ ID NO: 3310 - DNA, 101 bp, rice(Oryza sativa)
  misc_feature (71): n=a or g
cgagtcaccatcatcaattgcatctctgatggacggcccttcacctagtgcctacgcccccttctatgttntcccttgactctcctctgttccctcccgca

SEQ ID NO: 3311 - DNA, 101 bp, rice(Oryza sativa)
  misc_feature (71): n=t or c
aatagaaaaggctatatccatgacccatccattatctaaaaaatatccatgaccatttctggcaaccctanactactgcctgaacaattcagacttcttcc

SEQ ID NO: 3312 - DNA, 101 bp, rice(Oryza sativa)
  misc_feature (71): n=t or c
tggtagtgctctaggtgctaaattgatacatatatgttattatgatcaattcatcattaatgcatgttctncttacttttgacctataattaagaaataaa

SEQ ID NO: 3313 - DNA, 101 bp, rice(Oryza sativa)
  misc_feature (71): n=t or g
gcctcacgtttgcttataacaggtcgcttgtgcatattccgatttgagattgcactcattaatgagaggtnttgttctcttcttgttgttgtgggttgctt

SEQ ID NO: 3314 - DNA, 101 bp, rice(Oryza sativa)
  misc_feature (71): n=t or c
tggctttacattttcaggttcttcacctttccaaagaaaagcccttcgcatcttatcgatttttttatganccatttaggggcaggcagagcagtcaagta

SEQ ID NO: 3315 - DNA, 101 bp, rice(Oryza sativa)
  misc_feature (71): n=t or c
tctcctctctcccacatctccacttcatccttcacacaatcatacctgactactgttattgcctcctctcnagtctccagcgccaatcgatgcctcctccg

SEQ ID NO: 3316 - DNA, 101 bp, rice(Oryza sativa)
  misc_feature (71): n=a or g
gcgtggagaactctggaagggacgggcgtggagtttttgtgactatgggtgtttagatgggctaaaataanttttagtacatatcacatcggatatttggt

SEQ ID NO: 3317 - DNA, 101 bp, rice(Oryza sativa)
  misc_feature (71): n=t or c
cattttgttttgttgtacatttatgtagggcagagctttagcctttactacatcagttctaaaataagtgnagcaagttctaaaataagtgcacccataaa

SEQ ID NO: 3318 - DNA, 101 bp, rice(Oryza sativa)
  misc_feature (71): n=t or c
agaaaaaaactgtaacgccctaggtgtctagaacccgtccctatgacagacgcagcgcacatcgtcagtcnccctccctccaaacctagagccgatcccac

SEQ ID NO: 3319 - DNA, 101 bp, rice(Oryza sativa)
  misc_feature (71): n=t or c
caatacatgccaccagctaaaatcggttcttgccagccagtaatggaacataaaataaaattttcagaagntggattttacttcagttttccaacccaatt

SEQ ID NO: 3320 - DNA, 101 bp, rice(Oryza sativa)
  misc_feature (71): n=a or g
actggtgctgttggctgagctggtcgtgcattgggagtagtcggctaattattggtgatcaagggccggtngtttgggaaaacaccccctggcaaatagac

SEQ ID NO: 3321 - DNA, 101 bp, rice(Oryza sativa)
  misc_feature (71): n=t or c
ttgtatatttggaatgtgtgacaatcttaatcactttttgatgaccgaagcctttggcatattgttatttngctcatttcgcattatgccataccttcccc

SEQ ID NO: 3322 - DNA, 101 bp, rice(Oryza sativa)
  misc_feature (71): n=a or g
aaaatagctttaagcttttttggctttcttcatgttgcatccctgctttatgtggcttcagattgctgtanttgtatgatggatgatgggggagacgcagt

SEQ ID NO: 3323 - DNA, 101 bp, rice(Oryza sativa)
  misc_feature (71): n=t or c
acttaattgcaggctgccaaaaacagattaactaagacttaactttgttgttggtactattctcccttacntgagtatgaactttagacccggtttagatc

SEQ ID NO: 3324 - DNA, 101 bp, rice(Oryza sativa)
  misc_feature (71): n=t or c
aaatgtctgcaaccaaaaccccaccccgcgtatcgtcaatctctggaaacccctaacaaattcctgaacanccgccgccaccatagcttcagcctcgtggg

SEQ ID NO: 3325 - DNA, 101 bp, rice(Oryza sativa)
  misc_feature (71): n=a or g
caagtgcctgcatactaagctaacaagaaatgcaaacgtgctgaaaggatggaacaggggcaggatcggantaataaaaaccagaatagagatagctcgcg

SEQ ID NO: 3326 - DNA, 101 bp, rice(Oryza sativa)
  misc_feature (71): n=a or g
ggtcagaggtgccaccaggtatatattaaggttgcctcctcttgcaaagaagaaaataaaaagactacctnttagtagcttgtgagcaatggcaggataat

SEQ ID NO: 3327 - DNA, 101 bp, rice(Oryza sativa)
  misc_feature (71): n=t or c
catgaatttgtattattgtttcgttatgttcttttcagacataataaagataagtgcatggagggtcatcngacttatttagttgtgtcatataggttact

SEQ ID NO: 3328 - DNA, 101 bp, rice(Oryza sativa)
  misc_feature (71): n=t or c
tttatagttaagggatgtaaagcgaactcaggctacagttgaggttgagggaggcaagatggatttttttncttataatgatgtcaagttgattccgggag

SEQ ID NO: 3329 - DNA, 101 bp, rice(Oryza sativa)
  misc_feature (71): n=a or g
gcgtgtgttatccaaatagccacaaaactagagcgccccttggttgagccacaatttttttcttgaaagcncacgagagcattgcaccacattttattgtc

SEQ ID NO: 3330 - DNA, 101 bp, rice(Oryza sativa)
  misc_feature (71): n=a or g
atcactcggcacttcatcaagaccttgttggcaccaatcaaggaaagatctagaacagcctttgaatttgncggcaagcatgaccccaaccgagagaaccc

SEQ ID NO: 3331 - DNA, 101 bp, rice(Oryza sativa)
  misc_feature (71): n=t or c
tcccctcacaccaccagctccacaatcacagaagaaacggcttgaccgagaataaacaacacgatgccctngatggcacaccttggcacagacagaacagc

SEQ ID NO: 3332 - DNA, 101 bp, rice(Oryza sativa)
  misc_feature (71): n=t or c
attaaacatggtgtcatttttctttggtgtgtcgcaccttaaggtgtgccacatctaagagaagatgagangccacctcaaggagggagaccaggatgggc

SEQ ID NO: 3333 - DNA, 101 bp, rice(Oryza sativa)
  misc_feature (71): n=t or c
tattgattaaccaagcatttcattaactcacaaaacatttagctcatttcttgttaactcacaaaactgangctcatctaaaggcttagtgaatatgtcgg

SEQ ID NO: 3334 - DNA, 101 bp, rice(Oryza sativa)
  misc_feature (71): n=t or c
actacctcaaactggattccaattacactgcgacaataagcatgggggggacatctggtgatgtttacttncagaaattgagaatttttaaggcaccccgt

SEQ ID NO: 3335 - DNA, 101 bp, rice(Oryza sativa)
  misc_feature (71): n=a or g
tttttttcaaagaatttggtgctaatctgaatcaacgatgggctgtctgttactttctccgtttcacaatntaagtcattctagcatttctcacatttata

SEQ ID NO: 3336 - DNA, 101 bp, rice(Oryza sativa)
  misc_feature (71): n=t or c
agggaactaagaagaataattgccagtgacagtgagtgattagtcacataaatattcaaattgcatctttnagacactattttaaatatttagcacaagca

SEQ ID NO: 3337 - DNA, 101 bp, rice(Oryza sativa)
  misc_feature (71): n=a or c
ggcgaaacgaaaccaaacgaaataacgactaaatttgtgaactgatgatactggtggaacaacgtacgcantgttcgggctggtttgcactactacaaaaa

SEQ ID NO: 3338 - DNA, 101 bp, rice(Oryza sativa)
  misc_feature (71): n=t or c
cgtatggaaagtgatttttatagtagtgtctggaatggttataatttgaattaattaattaatagtttcgnctccttagaagaagaaaaataaaatggttc

SEQ ID NO: 3339 - DNA, 101 bp, rice(Oryza sativa)
  misc_feature (71): n=t or g
tttctccacaaagccatcagtgtcagtttcgtcctcttgctgtttgtccatataatatgacagtagatttntttttttcaaaatctgaccatatctttact

SEQ ID NO: 3340 - DNA, 101 bp, rice(Oryza sativa)
  misc_feature (71): n=t or c
ccccacacagggagtgtgatcataccattcccttgctgccactaactaaaccaatttcagccagaccttantgacttcttcaccacaaaaaaatgcattgg

SEQ ID NO: 3341 - DNA, 101 bp, rice(Oryza sativa)
  misc_feature (71): n=t or c
tatcagccgacccgatatcgttgtttcaggtatcgactgtctcaggctaagtatcagtgtgtcacaatcangttattattctcactgataaaatcatcaat

SEQ ID NO: 3342 - DNA, 101 bp, rice(Oryza sativa)
  misc_feature (71): n=t or c
tggccatgccgggcctcccgccgatggcgatccgcgacctccctagcttcttcaccgacctcgacgacacnaggctctccgccgcattccatggcgtccag

SEQ ID NO: 3343 - DNA, 101 bp, rice(Oryza sativa)
  misc_feature (71): n=a or g
actaatctgacgtgaccactagtgcccatgacaacgttgttcaaaatacaccatacccaaaaaataaaggnaaaattacaaaaaccaccccaaatgtcact

SEQ ID NO: 3344 - DNA, 101 bp, rice(Oryza sativa)
  misc_feature (71): n=t or g
agtggaatagaattgacactacttaaaaaaactaaatacgtgttgattggaaaccccgcataggtgtcggnttgccaggtggcactgatgaaagaaatcaa

SEQ ID NO: 3345 - DNA, 101 bp, rice(Oryza sativa)
  misc_feature (71): n=t or c
tgaacccttcagtgttatgaggctagaatctaacttagctcctctcttttttaagtggcctttggtctttnctttatagttgcaaggggatatcacaatga

SEQ ID NO: 3346 - DNA, 101 bp, rice(Oryza sativa)
  misc_feature (71): n=a or c
ttaactgctaatcacgatgattaatcactaatcaggaggccatgtcactggttggctacttggctctgcgngaccgcgcaatctcacgccatggctctgag

SEQ ID NO: 3347 - DNA, 101 bp, rice(Oryza sativa)
  misc_feature (71): n=t or g
ttttttaaaacggtaaaaatccaatcaaccatgaaaaaaaaaacaaacgttcagtaagtacggaaataggngccccgtactgacaaaagaaaaagctccgt

SEQ ID NO: 3348 - DNA, 101 bp, rice(Oryza sativa)
  misc_feature (71): n=a or c
tgacacatctagagttctccaggcaccaaacgtgttaagtagactttagcatggccctggaacaggttatntaggtggttgccattgacaaactaggttgc

SEQ ID NO: 3349 - DNA, 101 bp, rice(Oryza sativa)
  misc_feature (71): n=a or g
aagaatatacggccataggatagaattcacttctcaccaatgacgagttccgtagtagattatctttgtcnggccgaaacctaaccccatcaccgatgagt

SEQ ID NO: 3350 - DNA, 101 bp, rice(Oryza sativa)
  misc_feature (71): n=a or c
aacatgaatacaacttgcagtagccaagctggattatgaagaaatgaacttgttcagctctgaatcaatanctggttgcagataactgaagcaaaaagctg

SEQ ID NO: 3351 - DNA, 101 bp, rice(Oryza sativa)
  misc_feature (71): n=t or g
gctcgctcggattggtgcggaggaagtcaacgtgaatcgacggtctctcttcgcccgtggtgattggcttnccagggagagtcacggatcgagagcccacc

SEQ ID NO: 3352 - DNA, 101 bp, rice(Oryza sativa)
  misc_feature (71): n=a or g
ttgcagatacttgattcaactgaaagggctgtggcatatagcttggcaggcactgaccgtgcaaatgcacnagctgtggaggtgtcttcgttaacctccaa

SEQ ID NO: 3353 - DNA, 101 bp, rice(Oryza sativa)
  misc_feature (71): n=t or c
gagacggttaggagccaattaaatgccatataggtgaatagagagtggcgttcagaaaatgctaatttctngcatgtgtccaagtgtgccacaatgccttt

SEQ ID NO: 3354 - DNA, 101 bp, rice(Oryza sativa)
  misc_feature (71): n=a or g
cagcgtgtgcttgtctgtttggagttgatgttggggcagtgtggttgtggctttgttctagagatctggtngcaatggattacatggatcatagaagatta

SEQ ID NO: 3355 - DNA, 101 bp, rice(Oryza sativa)
  misc_feature (71): n=t or g
ttttgtccgtactatgaaaatacttgtttgtattatttcactgatatatatactaacgaagaaaatacggnaattatatgctctgtaacacaatgtgtatg

SEQ ID NO: 3356 - DNA, 101 bp, rice(Oryza sativa)
  misc_feature (71): n=a or g
ttgaaaaaaacatcttaaacttttataataggtaaagataaactaagggcctttgatttgcatgaaaaacntatgaatttcgaagaatttcaattttatat

SEQ ID NO: 3357 - DNA, 101 bp, rice(Oryza sativa)
  misc_feature (71): n=t or g
tcagtatatgatttattagaagacttatttacatgaatttacagtaaaaggttgtacacgcttgatgctcncaaacgcccttgcatgtaaagctattacgg

SEQ ID NO: 3358 - DNA, 101 bp, rice(Oryza sativa)
  misc_feature (71): n=a or c
cttaaaagcatataacacttggaaatgtaacacttctccattagaaaaacatgcgtatgcatggatacatnattcggtagatatgttaacttaaatttgca

SEQ ID NO: 3359 - DNA, 101 bp, rice(Oryza sativa)
  misc_feature (71): n=a or g
tgttaagggttagtctgctttaccctcctcaattatcacaaaagtttgatttacccccaactctaataccngtcattatataccaacttttcagacgagac

SEQ ID NO: 3360 - DNA, 101 bp, rice(Oryza sativa)
  misc_feature (71): n=a or c
tttgttgcaggtgggcacacaacatgtcagaccgaattgcaggaaggttggggtttggaagagctagagtntttggcccaactaaggtggctttccataac

SEQ ID NO: 3361 - DNA, 101 bp, rice(Oryza sativa)
  misc_feature (71): n=t or g
gcgaaatctcttttagcgggtagtttttatcagtatcttgaatatgagataccttatatttgtgtactatncttggtgcgcccaccatataccaaattctc

SEQ ID NO: 3362 - DNA, 101 bp, rice(Oryza sativa)
  misc_feature (71): n=t or c
gctttaggtccaatcgaagcgaggcaaattcttttatggccaagccaactaaaaggcttttttctttgttnttccattccatagggagttgttttaataca

SEQ ID NO: 3363 - DNA, 101 bp, rice(Oryza sativa)
  misc_feature (71): n=a or c
caaggccgatggcgatgaagggacctccaggaagcggacacgcggacaagtcaaattggctcctcggaagngaaaggcccctacctccaccgactctgacg

SEQ ID NO: 3364 - DNA, 101 bp, rice(Oryza sativa)
  misc_feature (71): n=a or g
tgtaaggaacaatatatttatatcgttaacatataataagcccctgaattgcattgccatctaataacatntatacgaattcagtgttttccatcgacgtt

SEQ ID NO: 3365 - DNA, 101 bp, rice(Oryza sativa)
  misc_feature (71): n=a or g
ggccggtttcataaaatgataatgaggtggctgctcttttaggacaaaaactgttccttgcaactctcatnctctactaatcacttctttcatgatgttat

SEQ ID NO: 3366 - DNA, 101 bp, rice(Oryza sativa)
  misc_feature (71): n=a or g
gcacagctacttaggagtacacattttggaacggaaatatgctcatttggccgcaaagaacaaaaaaaaanaaaaggaaaaagcacgccgactgacagccg

SEQ ID NO: 3367 - DNA, 101 bp, rice(Oryza sativa)
  misc_feature (71): n=t or c
ttattgtgagaaaatatagttgcacaaacacacaactttatataaacgcccattaaacttttcctacaaangcttctaaaccatcacgtggcatcctacat

SEQ ID NO: 3368 - DNA, 101 bp, rice(Oryza sativa)
  misc_feature (71): n=t or c
taatgccaagaggaagtacctttgaattactttgtagagaatatgtgaaacaccaaccaaattagggaaantctacaacaatttttcgttgttctagttgc

SEQ ID NO: 3369 - DNA, 101 bp, rice(Oryza sativa)
  misc_feature (71): n=a or g
tagctagttgaaatagaaaatttacaaaactgcaacataagtaatgcagcaaatgaaattaaagtacatcnaatagttaggtaattcacactcagtagtca

SEQ ID NO: 3370 - DNA, 101 bp, rice(Oryza sativa)
  misc_feature (71): n=t or g
caggttcatatttttgcatgttttcgttgctgctgcggatggaattagctataagaagctgatggttttangaggaaacataggtaaagctgatgatttta

SEQ ID NO: 3371 - DNA, 101 bp, rice(Oryza sativa)
  misc_feature (71): n=a or g
gaaatgctgcagcagcaagcagcatcatcaccttactgctggacgaggtcatcagcattgtcatatttttntttcttgacacgtacacgacgactaagcta

SEQ ID NO: 3372 - DNA, 101 bp, rice(Oryza sativa)
  misc_feature (71): n=a or g
tctatgcatatacatacacactgcaccaagcccagatggtttcaatgtgcacttctgtagagccctttganatgtttgatagtgttttttaatggtaccct

SEQ ID NO: 3373 - DNA, 101 bp, rice(Oryza sativa)
  misc_feature (71): n=a or g
atcgtcatagatgagtcatctatgatgggtgtgtaagttatgtgacatgtagtagcttccatccatcaccnatgactcatctctgacaagttgtaactcac

SEQ ID NO: 3374 - DNA, 101 bp, rice(Oryza sativa)
  misc_feature (71): n=a or c
aacatctctatttattttgagtattggttcaaaaagggtagaatgccattttgacatagtttttcttttanctattatttgcttcttactcactccagtgt

SEQ ID NO: 3375 - DNA, 101 bp, rice(Oryza sativa)
  misc_feature (71): n=t or c
ctgcaaatcactagatgttatacaccttgaaagatctgacaagcgcatgccgtgatttgcaattaatcatngtatttttttgtttgttcagtggaatcaaa

SEQ ID NO: 3376 - DNA, 101 bp, rice(Oryza sativa)
  misc_feature (71): n=t or c
tcggcttataggtgccagtttttaatattaaaggttcctaaaaaaaccggcacaaaatatataataggtgncggtttttatttagaaccgacacctataat

SEQ ID NO: 3377 - DNA, 101 bp, rice(Oryza sativa)
  misc_feature (71): n=t or c
aggaacatgtacagagatatatagttgcacagtacatggtccatgcattgcatgcatatatgaaaccatgnatgtctcgatcataagtactatggatgtgt

SEQ ID NO: 3378 - DNA, 101 bp, rice(Oryza sativa)
  misc_feature (71): n=t or c
gtagcgagattaccaacttgcatcctactgtgtatattgctgaataccaaatatatatactactatctatntttatacataaatcactggtggagaaatca

SEQ ID NO: 3379 - DNA, 101 bp, rice(Oryza sativa)
  misc_feature (71): n=c or g
aaaacgaaaatgatgatcagacaaatcatgagatttatgatccgaatgaattttgacatgccactgttttngttgttcttattttactttctatatcaatg

SEQ ID NO: 3380 - DNA, 101 bp, rice(Oryza sativa)
  misc_feature (71): n=a or g
gcagttttagtgtaatatgtggtttggtttgtgtagttctttgagtccatatatatgtatatagttggatnctatttttttccctattattttcctatgcg

SEQ ID NO: 3381 - DNA, 101 bp, rice(Oryza sativa)
  misc_feature (71): n=t or c
cgtaaaaaaaacaataaaaaaaataaaaaaccaacctaacaaagatgagaaattacatagtacaataaatncatatctagattcgttgtactgtaacgtcg

SEQ ID NO: 3382 - DNA, 101 bp, rice(Oryza sativa)
  misc_feature (71): n=a or g
aaatatgcacgagaacctcagttttaaagctcaccaaccatctgtcaacacttggctgcacatgctcaaanatcaaaacatttcgttgcttccatatatgc

SEQ ID NO: 3383 - DNA, 101 bp, rice(Oryza sativa)
  misc_feature (71): n=a or g
agtgcatagcagtccagcccaacacccccatttgctcaatgcatgttttcctggaaggtcgtctgcgatgncatataaagtagtatcatttttgtttcaca

SEQ ID NO: 3384 - DNA, 101 bp, rice(Oryza sativa)
  misc_feature (71): n=t or c
cacatgaccacgtcattgtaggctaaggtgaagccacacactctgatgcttctagcctttgcatcgtcttntctctgcacgatagtaattaaactcctagg

SEQ ID NO: 3385 - DNA, 101 bp, rice(Oryza sativa)
  misc_feature (71): n=t or c
attcacaaatagaatttaataattttgttaacttctcatgttgtgtgcgtttttagtagttagtgtgttcntgttttttttaagactgtttttttattctg

SEQ ID NO: 3386 - DNA, 101 bp, rice(Oryza sativa)
  misc_feature (71): n=t or c
ccggcgatcccttcagcattcagcccttcacagctttgtgcctttgtctgtcgactgtttgccctggacancgtccgaccggcgaccgctgacacaatgtg

SEQ ID NO: 3387 - DNA, 101 bp, rice(Oryza sativa)
  misc_feature (71): n=a or c
caccatcagctaaccaaataagttggaccaaatccaattagtgaaagtcaccaacttgcactgtttgatcncccttacccaaagtagttcaattgaaccat

SEQ ID NO: 3388 - DNA, 101 bp, rice(Oryza sativa)
  misc_feature (71): n=a or c
atctcatgtccgtacatgccaaaatcgatcctcccgttaaattcggtcgaagaaaaaagcggatgaaaaancccggaaaaaaggcgacgaaaaaaagtttt

SEQ ID NO: 3389 - DNA, 101 bp, rice(Oryza sativa)
  misc_feature (71): n=t or c
ttgttcatcattttgtgggagatttcaggaatgagcaatgtaggcgactactgtcttgttgaaatgctaangctaaccttatatgatcaaatctttacagg

SEQ ID NO: 3390 - DNA, 101 bp, rice(Oryza sativa)
  misc_feature (71): n=a or c
acagtgatatgaagaaattagagataatctaggttttaccccttcaaaattgtccttgcaattctctcttntttggaaaatacaatataaacacacatact

SEQ ID NO: 3391 - DNA, 101 bp, rice(Oryza sativa)
  misc_feature (71): n=a or c
gatattattttttttcgactgtcacgctggtaaaaaaacctattttttattataagaaatgtatgggcgcnggttaagttaatcatcactcatttcttgcg

SEQ ID NO: 3392 - DNA, 101 bp, rice(Oryza sativa)
  misc_feature (71): n=a or g
ttgttgcagaatcaattttagtaggtaatctgagccatgcagagaacataagggactcataaatagttacntttggtgaatggatgtcattctgttcacaa

SEQ ID NO: 3393 - DNA, 101 bp, rice(Oryza sativa)
  misc_feature (71): n=a or g
acacaggccacaagcgccctagcatatacattggccagtataccaccgtgtgcgacgagaacagggccacncgagtgcaaagccgcatgcatgcgaagttc

SEQ ID NO: 3394 - DNA, 101 bp, rice(Oryza sativa)
  misc_feature (71): n=a or g
atatgtaaggcacggcacaaagtatagggagaaaaatagacatattatatagcatgctccaaaaagtaggnatgtaaaatagacttattttagagaaaatg

SEQ ID NO: 3395 - DNA, 101 bp, rice(Oryza sativa)
  misc_feature (71): n=t or c
attggaacattaaataaataagacacgcatcatttacaaaagtaactaacggaacatctaaataatactangtgcaacatagtccaattctaattggaaca

SEQ ID NO: 3396 - DNA, 101 bp, rice(Oryza sativa)
  misc_feature (71): n=t or c
ggtctatgtacccggcagtgccgagcacggccttggtcgtctgccatcccttgtcgtggtcgacgagcctngccaacccgaagtcacctagcttggtgttg

SEQ ID NO: 3397 - DNA, 101 bp, rice(Oryza sativa)
  misc_feature (71): n=t or c
cttcacctactcacttagttttcatttccacatcactttgtaattccatgtaacatccatatctaccacanatgaataggatataacgcatctgttcaaca

SEQ ID NO: 3398 - DNA, 101 bp, rice(Oryza sativa)
  misc_feature (71): n=t or c
accggtcagtaaatattaccaaattcgacacataaacttaattaggtcacatgtatataacctaagttcgngactaagaaaattagggaaaatcctcccca

SEQ ID NO: 3399 - DNA, 101 bp, rice(Oryza sativa)
  misc_feature (71): n=a or g
ttcaaaaaaaaaatttcaaaattaaatcggctgctaaagttaattagcatggtcgttcatgctgacaacangacagacacaacatgtgaggtgtggcctca

SEQ ID NO: 3400 - DNA, 101 bp, rice(Oryza sativa)
  misc_feature (71): n=a or g
tgaaatggccatcgatttgacactgggataacagtgatgttttctgaagcgaagaaaatgtgtgaattagnttggtcttaattatttattagtggccatta

SEQ ID NO: 3401 - DNA, 101 bp, rice(Oryza sativa)
  misc_feature (71): n=t or c
cagggcgaagcaaagttaaagaatgtatatatctcctcctcctgatctctatataagctaccctccgaagnagctagctagcacaccaaaactaacagatt

SEQ ID NO: 3402 - DNA, 101 bp, rice(Oryza sativa)
  misc_feature (71): n=t or c
cccatgttagttcgttgaaccaagcgcatggactggctctggatggcattgagagccgggtagagctcgcngccgagcggcctcagctccaccgcggacac

SEQ ID NO: 3403 - DNA, 101 bp, rice(Oryza sativa)
  misc_feature (71): n=t or g
aatagcaattaagggagttatacaacattcatctgctgtgtgtgtgtagtgtgtgaccacacgtcggcagngggagcaataacataaataataaaaatagt

SEQ ID NO: 3404 - DNA, 101 bp, rice(Oryza sativa)
  misc_feature (71): n=a or g
tgtctctcagcattcagttcgacctagagtacagttaggatgcgttagacgaacaacaagatacaacatantgaaacttattctatgtgttcaacatacga

SEQ ID NO: 3405 - DNA, 101 bp, rice(Oryza sativa)
  misc_feature (71): n=a or g
aatttctgcctaattcaggccagacgcggctcagggatcaatgagagcatagaggttgagaagggggcagnctgcaggcacacccaaatctcaagaatctg

SEQ ID NO: 3406 - DNA, 101 bp, rice(Oryza sativa)
  misc_feature (71): n=t or c
tcgtcggcgcggacgaacctgtccgggatgtgcaggtggtgatccgcgaatgccatggctgcgtcctgcgngatgatgtccctgttcatcgccttgacgcc

SEQ ID NO: 3407 - DNA, 101 bp, rice(Oryza sativa)
  misc_feature (71): n=t or g
acaagctcagttagtgatgccatggatgtgttgtcaaaatttggtccatcggcaagatgagtaaagaaacngtacaggtgcattttttttagataatggta

SEQ ID NO: 3408 - DNA, 101 bp, rice(Oryza sativa)
  misc_feature (71): n=t or c
gctttgttcaaatcatgacgaaacttaaaccctccaaatttgttgtttgctgtaattttttcttccgttgnaatgcacgggcatttttttctagtctgaaa

SEQ ID NO: 3409 - DNA, 101 bp, rice(Oryza sativa)
  misc_feature (71): n=t or c
gagtgacagggcaagacccgtcgccacggcacaatgggttaggcaaatcgtcgaacggctgcgatgcggtnccgacagcccggaaccctggccaggggacc

SEQ ID NO: 3410 - DNA, 101 bp, rice(Oryza sativa)
  misc_feature (71): n=t or c
ctgaacaaacaagcccttagctaggcctaatgttggaacagccagaacatcttgctttttggtaggcttgntaggctttgttattccaactagaaatttcc

SEQ ID NO: 3411 - DNA, 101 bp, rice(Oryza sativa)
  misc_feature (71): n=a or g
aatgttaatgtttgcaagcaaaggaaaacccagtgacccacaggaatcaatgatttctctgcatataattnctttcatttttctttttgaaacttctgcac

SEQ ID NO: 3412 - DNA, 101 bp, rice(Oryza sativa)
  misc_feature (71): n=a or g
taaaattatgacttatcactaacagacttatgatgtattggcaatgcatattacaatttgttttgggcttntttgatatccacctcttttaatgctggaac

SEQ ID NO: 3413 - DNA, 101 bp, rice(Oryza sativa)
  misc_feature (71): n=a or g
tattttttgctgatgtcctttggccggaattcctccgagacattttttttcaagtttttttttattcggcngtaaggataaaagggtgacaccataaaaag

SEQ ID NO: 3414 - DNA, 101 bp, rice(Oryza sativa)
  misc_feature (71): n=t or c
aaaaaacaattaatcttgattcagacagagatctcagctggatggatcaaattactcctcccggtctccangtatagacgtacgctaataaacactagcta

SEQ ID NO: 3415 - DNA, 101 bp, rice(Oryza sativa)
  misc_feature (71): n=t or c
acaacatccctatacaacaccaaacttctcaaacttaggctctaatctaaatttgactctactttccatanacacacaacaccacgtgtatgccataagag

SEQ ID NO: 3416 - DNA, 101 bp, rice(Oryza sativa)
  misc_feature (71): n=a or g
tggcaatgtaaaggtcaagctcactagcgttttttaggaggttgttggcgccaagtagtggtggtacagtntgcaacgccgtcgtctcaatttcttgtcgc

SEQ ID NO: 3417 - DNA, 101 bp, rice(Oryza sativa)
  misc_feature (71): n=t or c
tatagaacacagaaatggactgcagtttcttttttatatatataacacagtacagcaacgcaaacactcanaacgcacgcacactctcccctatgaacgca

SEQ ID NO: 3418 - DNA, 101 bp, rice(Oryza sativa)
  misc_feature (71): n=a or c
atcacaatcgttcggtcaaaaagaattactagtccacttgaaacactcactgacacgtggaccccaccctnccctggccccacatgtcagtgtgagggtag

SEQ ID NO: 3419 - DNA, 101 bp, rice(Oryza sativa)
  misc_feature (71): n=a or g
atcactcatgttcttttgaccactagaacccagataagtccaatgtgcccaccaagcaccgccgctcgtcnccgcctccctcctctccctccccaaccgcc

SEQ ID NO: 3420 - DNA, 101 bp, rice(Oryza sativa)
  misc_feature (71): n=a or c
taactatttcctatataaatgtaatttggctacgtgtgtgggagaaccatgcatgtttattaatctgtatnttatatttttactgtatgtttcagagagta

SEQ ID NO: 3421 - DNA, 101 bp, rice(Oryza sativa)
  misc_feature (71): n=a or g
attgctctcatgtctcatctcgtccagggccgtggtatgtgcgggtcgtgcatgggactgtagtgcgttanaaattaggggctccaaatattaattacatg

SEQ ID NO: 3422 - DNA, 101 bp, rice(Oryza sativa)
  misc_feature (71): n=t or g
atgacccccaagaacaagaagcatccaaatagcaaagctagctctgaacgtttgattctcccaagaagatngcttcagtctgctgttgctctctgttgact

SEQ ID NO: 3423 - DNA, 101 bp, rice(Oryza sativa)
  misc_feature (71): n=t or c
acctcgcgaccttggagcgcctccatagcttggtccctcttcacctccaatatagttctctcaagttcagngaccttgaacttcgtcctccagtactgtat

SEQ ID NO: 3424 - DNA, 101 bp, rice(Oryza sativa)
  misc_feature (71): n=a or g
tgttttgttttgctcaaagctcatgcaccaacgaagagggcggacgtagtcgcgcgcaaaaaaaaaaaaanaaaaaaaaaagaagaggaagcagtggtgcg

SEQ ID NO: 3425 - DNA, 101 bp, rice(Oryza sativa)
  misc_feature (71): n=a or g
taacctggacacttagttcttttagaattactgcctgagcatcactcttcatgtgaagtgagtcaattaantgacaatgtggcatgctgaccaaacctgtc

SEQ ID NO: 3426 - DNA, 101 bp, rice(Oryza sativa)
  misc_feature (71): n=a or g
atagtagccctttggtagagtattcaggccggcatcctccccttggataaagagccaccatatattgaccnttcaccattgcaataattttttttaacgat

SEQ ID NO: 3427 - DNA, 101 bp, rice(Oryza sativa)
  misc_feature (71): n=t or c
ggggctagctcgcgtgtgcgcacgagcaaattaagtggcgcgcttgccaggtggaccctcgatctcctcangacctttttttcgcacttttcccctctttt

SEQ ID NO: 3428 - DNA, 101 bp, rice(Oryza sativa)
  misc_feature (71): n=t or c
caggactttgtacactagcctgacaaacgtagcccctgcatttctaagaccgaaagacattctgaagtggnagaaggtgccgaagggcgtgatgaaggctg

SEQ ID NO: 3429 - DNA, 101 bp, rice(Oryza sativa)
  misc_feature (71): n=t or c
ggatatgattcaatcctttaattcaaaggcattaattcaagtgaattctttcaatagggttggaatctttngaaatttctacctttttcctcctaaacaag

SEQ ID NO: 3430 - DNA, 101 bp, rice(Oryza sativa)
  misc_feature (71): n=a or g
ggttctaaaacctgcatctttacggatgtggcaaaggtaccacgccaaattggtgttgattagaaaaccgntatttatgatggcttcccaaccgatatcaa

SEQ ID NO: 3431 - DNA, 101 bp, rice(Oryza sativa)
  misc_feature (71): n=a or g
aaacttatgtatgaaattacgataagaaaagaccagttagttgtgatattatttaatttttcccttcttanattacacggaagacagaagtgcatacacac

SEQ ID NO: 3432 - DNA, 101 bp, rice(Oryza sativa)
  misc_feature (71): n=t or g
gcgctcaattttgatcaaagctttataattgtacaatactcttgcatggtttgatcaaagctttagaattntatatattaattcatagtgtactttttaga

SEQ ID NO: 3433 - DNA, 101 bp, rice(Oryza sativa)
  misc_feature (71): n=a or g
ttctccgaaacctttatgcaatgagccattctataggaattgtatagggtttggaaaactccaatactttnaattgaagggccaaataagaaaaattccta

SEQ ID NO: 3434 - DNA, 101 bp, rice(Oryza sativa)
  misc_feature (71): n=a or c
ataaaagactaatggttcatagcatggtttaatagagacgtcaataagttagcggcttagcaaacgaaaanaaaaacatgaggtaagagctcatgttaaat

SEQ ID NO: 3435 - DNA, 101 bp, rice(Oryza sativa)
  misc_feature (71): n=t or c
agatagaagatagatggagaggcagcgtgcgaaatcttacctccattaatcttcttgttagtggagtgggngcacgtgctggctgagcagggcccaggtgg

SEQ ID NO: 3436 - DNA, 101 bp, rice(Oryza sativa)
  misc_feature (71): n=t or c
acaaaattattgtgtttactagtatataccttaaccgtgcccgcttgagtttgttaagtgcaaaaggcttnaaaactaataccttagcctacatcatattt

SEQ ID NO: 3437 - DNA, 101 bp, rice(Oryza sativa)
  misc_feature (71): n=t or c
cctcacatggatcgagcgagcttggtcgttggcaacttggctggatggatgacaattgccatggtcgatgnctgatggcttgcttcagtagcagccaccgg

SEQ ID NO: 3438 - DNA, 101 bp, rice(Oryza sativa)
  misc_feature (71): n=a or c
cacatcgctctccgcttcctccagatcaccgcggcgaggccacgtccaccaccacacacaccagtcacatntcctccctccgcactccgcacacgatggca

SEQ ID NO: 3439 - DNA, 101 bp, rice(Oryza sativa)
  misc_feature (71): n=t or c
tgaaaaggactagtaacacgccgtcgtacgagccaaccatccaaacagattaaccaaccaaacctttctcncctgcccaaaaaacctttctaacgcccggc

SEQ ID NO: 3440 - DNA, 101 bp, rice(Oryza sativa)
  misc_feature (71): n=t or c
aaagacgaaacaagcgaggaaatcatcttcccttcacaaggattcccatggcgcggcgttgtggtctagcngccgtgccgctcgcctgacaaagtcggcca

SEQ ID NO: 3441 - DNA, 101 bp, rice(Oryza sativa)
  misc_feature (71): n=t or g
tcccttttgtcttttgtctttgttgtcatttgcgccttgttctctactgctcctccgttcttttttttttntgcatttctcggttgaatttgatgtgtctc

SEQ ID NO: 3442 - DNA, 101 bp, rice(Oryza sativa)
  misc_feature (71): n=a or g
ttgcccgtttagttgggaaatggccgttagggaaaatgatacacataaaaaatccttataaagtttttacnattttttttatcttagtttttacaaaaatt

SEQ ID NO: 3443 - DNA, 101 bp, rice(Oryza sativa)
  misc_feature (71): n=a or c
gtggttgtcgagacacggaaagagcgtgttcctggagaagatgctagatggcagagctaacatctgaacanaatcatcgtttcgcttatacagattattat

SEQ ID NO: 3444 - DNA, 101 bp, rice(Oryza sativa)
  misc_feature (71): n=t or c
aattagggattttaattagattatctcatctcaaaagtggcacctctcttggctgttcttgtcctcccttngaagcagaggtaggaggagagggttcttcc

SEQ ID NO: 3445 - DNA, 101 bp, rice(Oryza sativa)
  misc_feature (71): n=a or g
tagcccagcccatttggccaccactggtctagattttgtgataatacttttctctaaaataagccaaaatntgaagaccgacgtgtgtacttttctctaaa

SEQ ID NO: 3446 - DNA, 101 bp, rice(Oryza sativa)
  misc_feature (71): n=a or c
ccaatttccatgaggaatacaaataaaaagtttaagaagaccaaacgagccaattagaggtagctaagagntgtatagtctaaaattcttaattttactat

SEQ ID NO: 3447 - DNA, 101 bp, rice(Oryza sativa)
  misc_feature (71): n=t or c
acatgccgctacccatcacctcccctcttctaggaccgacaccgccgctcccatggccaaatcgtgttgtncatattgagcccttgtcagcgccgcctgcc

SEQ ID NO: 3448 - DNA, 101 bp, rice(Oryza sativa)
  misc_feature (71): n=a or g
gacatgaaaccgaggcaaaatggcaaattagactgttttgtggtataacaatacaaggagaacttaggagntcgaatctttctcactgtttgctacaaact

SEQ ID NO: 3449 - DNA, 101 bp, rice(Oryza sativa)
  misc_feature (71): n=a or t
agagagattgtcatcattcatgtactttgtatttaatcggttaaatcgtaataaagacatgagcttttttnaaaaaaaaaaacaccctcgctactactact

SEQ ID NO: 3450 - DNA, 101 bp, rice(Oryza sativa)
  misc_feature (71): n=a or g
gatatactgtatcatttaatttatttgtatttatgtttgggagcagactgttttttttttcatgggaggangatacttcgtggaattaaaattgaagtgga

SEQ ID NO: 3451 - DNA, 101 bp, rice(Oryza sativa)
  misc_feature (71): n=a or c
cgctggaggtggaacaaaggtggcgacgacattacggttgtgttctttccccccaaggttcccacctcccntttctcgttttccacacgcacgctttttaa

SEQ ID NO: 3452 - DNA, 101 bp, rice(Oryza sativa)
  misc_feature (71): n=t or c
gcgtgcacatccgagacttgaaaatctctcggccttaaaagacagcccatgtgagccaaatgctaattggnacggcgcgtacgctgccaaaagcccaaagc

SEQ ID NO: 3453 - DNA, 101 bp, rice(Oryza sativa)
  misc_feature (71): n=t or g
tacgcgccgtaccaattagcatttggctcacatgggctgtcttttaaggccgagagattttcaagtctcgnatgtgcacgcgaaggcccggcccatttgca

SEQ ID NO: 3454 - DNA, 101 bp, rice(Oryza sativa)
  misc_feature (71): n=a or g
atagttatttaaaccagctagaaagagttatttctgttgtcgggtttagttaattacttctttaatttatntacattgattttagactatactaaatttac

SEQ ID NO: 3455 - DNA, 101 bp, rice(Oryza sativa)
  misc_feature (71): n=t or c
gtggtgaaggtagggtctaaccatgagaagaccaaacttaacaagttattacgataataagaaaacaaacngaaaatatacgtaaattttaaaggttttct

SEQ ID NO: 3456 - DNA, 101 bp, rice(Oryza sativa)
  misc_feature (71): n=a or c
agggaagaaagtaccgtactctagcaaaggagaagtgcaatactgcatttgattgattagtttctgactgntctctacctatctcaagtgaaatgtactca

SEQ ID NO: 3457 - DNA, 101 bp, rice(Oryza sativa)
  misc_feature (71): n=a or g
atgaaccgcgtctctgagatggtctctcagctcagccatccagccagcctcggcattcgtgcgaaaccggngtagtaagggtttcccaaactgtcggggcc

SEQ ID NO: 3458 - DNA, 101 bp, rice(Oryza sativa)
  misc_feature (71): n=a or g
caggtattgacgtcaacatgtagcacccgaacgaagatgaatatgagccatagtgcacgaacaacgagcanttacgcgaagtgctttccaaaaaccttata

SEQ ID NO: 3459 - DNA, 101 bp, rice(Oryza sativa)
  misc_feature (71): n=a or c
gaggaaacctgcacatgctcatcgcctcatccgtagcacattgccatttgccagtgcgcccagcgcagccnagcccagagctccaaaaataccaaaccaac

SEQ ID NO: 3460 - DNA, 101 bp, rice(Oryza sativa)
  misc_feature (71): n=a or g
ctacatattttgaactatataaaaaatatattaaaactcttttaatatagcttttaacagtaaggatgtcnaatatatatcgcaccactaatttttttttc

SEQ ID NO: 3461 - DNA, 101 bp, rice(Oryza sativa)
  misc_feature (71): n=t or c
cgtgtgcatacccaactgatcaaccctacacgcacaaaagtatatttttatcggaaggctaaatggctgtngaatgatttttgatagctaaatcattcatg

SEQ ID NO: 3462 - DNA, 101 bp, rice(Oryza sativa)
  misc_feature (71): n=a or c
ggttggatacgggtattacgaaagtatgttgaattaaatgaggaaatactgtggttggttgagaagaaaantgaaggtgaagaatttgaatggtcaaaggt

SEQ ID NO: 3463 - DNA, 101 bp, rice(Oryza sativa)
  misc_feature (71): n=t or c
gtaaaatccttcgaggcaaaagagaaaatccactctcgcaagagtagggtgttacaccattccttgtattnatctttttatctctcttcttattaactctt

SEQ ID NO: 3464 - DNA, 101 bp, rice(Oryza sativa)
  misc_feature (71): n=a or c
tgccctatggcaccatgggatgacgcgaaatgaggaagccttggtgcccagtatgtgcttttgtggctcgncgatcgtggcgtgcattctggccaaactag

SEQ ID NO: 3465 - DNA, 101 bp, rice(Oryza sativa)
  misc_feature (71): n=t or c
ggaatcacatttctttggctacccattttaggtttacctatgatgcaagcgaaaactttgatcgagagganagtctgtcactaataaggccaggtcccatt

SEQ ID NO: 3466 - DNA, 101 bp, rice(Oryza sativa)
  misc_feature (71): n=t or c
tcattgcataaattatacagggaggttcaaaattctgacatggtacctaagtgcatgcactggagaaaaangctaccgaaagctacaatgttggtttatgt

SEQ ID NO: 3467 - DNA, 101 bp, rice(Oryza sativa)
  misc_feature (71): n=t or c
atggtagagacaggtggctagtgctcctaatttagtcctggtatagagtttctttttctttttttcattgnttttaactgcttgaatattgatttcactac

SEQ ID NO: 3468 - DNA, 101 bp, rice(Oryza sativa)
  misc_feature (71): n=t or g
tgctggtttcctttttctttttcatcccaaggtaattttaacatatggtgatttgctaaggccctgtttanatccatttgaaatagcaaatggcaaatggc

SEQ ID NO: 3469 - DNA, 101 bp, rice(Oryza sativa)
  misc_feature (71): n=t or c
gcttggacataagttggagatgtggataacaagtttgaaagtaactgcagtaaaactatactactttgtcnaaaaaaagacaaactctagcttgtgttcag

SEQ ID NO: 3470 - DNA, 101 bp, rice(Oryza sativa)
  misc_feature (71): n=t or g
tggtggctatgcagaagagagacgttgcttgcaactggccttggacataatcaggccaagagaataagaangctttaggatactgatccgattcgagttca

SEQ ID NO: 3471 - DNA, 101 bp, rice(Oryza sativa)
  misc_feature (71): n=a or c
ggtgttcgtgctggtgcaggcgctggtgtacctcatcctcgcgcagtcgtcggacgtcttctccagggccnagagcctgcagggcggcggcgccccgcggc

SEQ ID NO: 3472 - DNA, 101 bp, rice(Oryza sativa)
  misc_feature (71): n=t or c
caagttcattggttaatcctttttttttcttctcttgtttgtgaaaaagatctcctagattcttcttcttntttttttttaattttgttatgctttgcttt

SEQ ID NO: 3473 - DNA, 101 bp, rice(Oryza sativa)
  misc_feature (71): n=a or g
aagagtgatacgtgcaccacgtgctcaccacccaactgtagccataagcccagtcgtgaaaagaatggacntatatacgcaggccgtactgtcgcgagcgc

SEQ ID NO: 3474 - DNA, 101 bp, rice(Oryza sativa)
  misc_feature (71): n=t or c
tggcgtcgggcgggggaggctgccagcggtgggaggggggatgggagtgaatgaatctagggttagtgttntgattaattttgggtgcccactatttattt

SEQ ID NO: 3475 - DNA, 101 bp, rice(Oryza sativa)
  misc_feature (71): n=t or c
ctgctattgtacatgttctaagtggtttctgcagacaatgttcggcggttgactcgtttgagtcagcagtngagggaggcgattcaatccagaggaaaaga

SEQ ID NO: 3476 - DNA, 101 bp, rice(Oryza sativa)
  misc_feature (71): n=a or c
gccgcaaaagttggtgaatgtagtattctgagcctgtgttcagtagcaacagaattggctatctttatgantcctttgttgcaccttatagtttagtgtgt

SEQ ID NO: 3477 - DNA, 101 bp, rice(Oryza sativa)
  misc_feature (71): n=t or c
caatatggtcctccagatactcttttgacgtcttcaatgtggatccgtgaccaaaccttcgtttttttttncataatggtaatctttttttttgaggacat

SEQ ID NO: 3478 - DNA, 101 bp, rice(Oryza sativa)
  misc_feature (71): n=t or g
tggatttacgcgaatatcgtgggaaaccaaaaaaacccaacccgctctggtgaggttggcttggcttgctnccgctatccacggcagcacagcgctcgccc

SEQ ID NO: 3479 - DNA, 101 bp, rice(Oryza sativa)
  misc_feature (71): n=a or c
gctccgaaagtatgaactgcagtacgattaatttttcacactagtcatactaaaagatcggttttagagtncggttaggtcgcttgtttttagagtactgt

SEQ ID NO: 3480 - DNA, 101 bp, rice(Oryza sativa)
  misc_feature (71): n=t or c
tactatgggacatggttttaataaatagacttcgtgtgcctttctgcagacaggatcaggactaattaccnctgtcgtcgccctggacacttgactagctt

SEQ ID NO: 3481 - DNA, 101 bp, rice(Oryza sativa)
  misc_feature (71): n=t or c
tttatttaattaacatggaatgtacgagccccatcaactggccaagagctgatttgatgccaaaacatggntcattagcgataaaaaataatttataaatg

SEQ ID NO: 3482 - DNA, 101 bp, rice(Oryza sativa)
  misc_feature (71): n=t or c
agtttaattccaaaagagaggctatgattctgttaggcagagcttcactactattagagttggagctcaancaaatagtttcagctgcatttaaaaaagaa

SEQ ID NO: 3483 - DNA, 101 bp, rice(Oryza sativa)
  misc_feature (71): n=a or g
gcatgcagagtggtcagggacacaactttgattgtcaaaggagaaacataaagtgttcagtattccggtgnactggatgaaacataaagcgataaggtcat

SEQ ID NO: 3484 - DNA, 101 bp, rice(Oryza sativa)
  misc_feature (71): n=t or c
catgtttccatctgcataattaattttcagtaccatttttgttatcggctttaccgttctgattccgtttnggacaaaaatatggttgttgtagcaggagg

SEQ ID NO: 3485 - DNA, 101 bp, rice(Oryza sativa)
  misc_feature (71): n=a or t
tcaacaatcccgatgtgcaaaaagcattgcacgcacgagctgacacgaactggtcaggttgcaagtaagtnttttttttttgactaagttgcaagtaagta

SEQ ID NO: 3486 - DNA, 101 bp, rice(Oryza sativa)
  misc_feature (71): n=a or c
gagtccattgtttcaccaaagggtgcaactttcgaggtctcctcagaccaaagggtcggtccccaaaggcnccgaaaatttcgtgtcccatgatgaccaaa

SEQ ID NO: 3487 - DNA, 101 bp, rice(Oryza sativa)
  misc_feature (71): n=a or g
agggctcactcgcctccactcctcttcaatcttccccttttccaccagattgatttcggcaggcgaaacangttttagtaagacgagtcagccgccgccac

SEQ ID NO: 3488 - DNA, 101 bp, rice(Oryza sativa)
  misc_feature (71): n=t or c
tcatctcgtcatgcgcttctcgactgcccctccccgtcgcgtgacacgcggttgctgctttacgtgtgagntgggacgtcacctttcccacggaggcggcc

SEQ ID NO: 3489 - DNA, 101 bp, rice(Oryza sativa)
  misc_feature (71): n=t or g
agggaacaatagctgtgtttgcacgacacatggtagagagattttaacgtggcttagtcccagtttagtanagctctaactttaaaatttagctctagaag

SEQ ID NO: 3490 - DNA, 101 bp, rice(Oryza sativa)
  misc_feature (71): n=t or c
acatgagaagtcagaaattatgagatgcaactagtgaactagaatctatagaagttggctttctcaacttntgacaaatagtttattgagtgaattgcact

SEQ ID NO: 3491 - DNA, 101 bp, rice(Oryza sativa)
  misc_feature (71): n=t or c
aagagaagtgccggttgagcaactgcaggtacagatcatgagagttcccaactagcagtgtgtggtgtgtntgtattctcaacaagacatttcctctatca

SEQ ID NO: 3492 - DNA, 101 bp, rice(Oryza sativa)
  misc_feature (71): n=t or c
tatcaaataaatgattgctagctagctttccatgcccgtaattaacttatctcaagtttctaataaatacntcctcccatttttataattaaagttttaga

SEQ ID NO: 3493 - DNA, 101 bp, rice(Oryza sativa)
  misc_feature (71): n=a or g
aaataaattagatgcccctcgttaaatgaggggtagctaagagtaagatgagaaaattttaaagtacatgnttacagaacaatactattactgtagaatta

SEQ ID NO: 3494 - DNA, 101 bp, rice(Oryza sativa)
  misc_feature (71): n=a or g
gccgacggactatctttgctcttagatgaaaaggtccagcagggggtgctttctcctattcacatatgccntagtgctccgggtatctcacacttactatt

SEQ ID NO: 3495 - DNA, 101 bp, rice(Oryza sativa)
  misc_feature (71): n=t or c
ttactaatataatggttaggggtaactttatcatttatatttttttccggctaaatcgatctacggtcatncattgtgatggcatcgctcatattccatcg

SEQ ID NO: 3496 - DNA, 101 bp, rice(Oryza sativa)
  misc_feature (71): n=t or g
gcgggctgttcgaccgaacagggcccctaaattttaattaagtatgtcctatatatataataatattagangttttaattttgttaatttttagtccaaat

SEQ ID NO: 3497 - DNA, 101 bp, rice(Oryza sativa)
  misc_feature (71): n=a or g
ctgctccagagcgcgccgcctcctcgctcggaggctcgccgtcactctgctcggcatcatcatcatcatcntcatcatcatcatagagaaccttgtgaacg

SEQ ID NO: 3498 - DNA, 101 bp, rice(Oryza sativa)
  misc_feature (71): n=t or g
tttcccatccatcttctgaagcaaaatcttttggtcgacgagctcgagattctgaaaagtaaccgataagnagacggttttcagcttctagtatttatttt

SEQ ID NO: 3499 - DNA, 101 bp, rice(Oryza sativa)
  misc_feature (71): n=t or c
atataaatatccattaatattattaaattttagctctatataaaattgcatgggaagtcgccctatctcanaagataacacaccgacgaaaaaaaaagtta

SEQ ID NO: 3500 - DNA, 101 bp, rice(Oryza sativa)
  misc_feature (71): n=t or c
ttctccatcatcttcttttcaatctctcctaatgcacaactgatagtctaggagagcaacggagaaccagntgcctcctctcctctagctcctccatctct

SEQ ID NO: 3501 - DNA, 101 bp, rice(Oryza sativa)
  misc_feature (71): n=a or g
gagactagcagtattaacgtgcggtgcggactgtttgatttggtgctcctttcgaacacatgagtagaaantcacaaaaaaagaagaaaaacatattaatt

SEQ ID NO: 3502 - DNA, 101 bp, rice(Oryza sativa)
  misc_feature (71): n=t or c
gattagcgattgatgtgaggcaagcaagcgaaaaatgctcactggaatatatcgtagagaaatctcctaanagcatctccagcagaaacactaaatataac

SEQ ID NO: 3503 - DNA, 101 bp, rice(Oryza sativa)
  misc_feature (71): n=t or c
tcctcgcgtcgctttccgcccgctgagctgtctggattagcatggccattcctttccttccggccggcctncccccccccccccccccttcttcttttctc

SEQ ID NO: 3504 - DNA, 101 bp, rice(Oryza sativa)
  misc_feature (71): n=t or g
ttcaaaccaaacaaactaggccttaaatgcccccagcatacaggaacccaccacaagtcttttatggatgnagtgaatttcaatggaatatgaaaccaatt

SEQ ID NO: 3505 - DNA, 101 bp, rice(Oryza sativa)
  misc_feature (71): n=a or t
agagaactacagaagacactccatggctcttattcagcgtataaacgctttcttggacttctttttttttntaaaaaaaaagcaagcaggattgcaaacag

SEQ ID NO: 3506 - DNA, 101 bp, rice(Oryza sativa)
  misc_feature (71): n=a or g
gtaaggtaatgatataaaaccgacatcacagtcgtcatctatatacaaacatggaaaacactataagatcnagattcattctagataagtcatttaaaggc

SEQ ID NO: 3507 - DNA, 101 bp, rice(Oryza sativa)
  misc_feature (71): n=a or g
cattggtttccgcatgttcctctagtgtgagcattgccttcccccgccgccacgatgtttcggaggcgagngggcggcagatggctgccacagtgctcacg

SEQ ID NO: 3508 - DNA, 101 bp, rice(Oryza sativa)
  misc_feature (71): n=a or g
acaggctttcttcctctatattctcagccttctgcaagtaaacttaattctactcatatattaccattccnttcattcattattgattaatataatagctt

SEQ ID NO: 3509 - DNA, 101 bp, rice(Oryza sativa)
  misc_feature (71): n=a or g
tccccgttttaaaatataaacttttttaaaatttcgtttgaaatgtatctagatagacgtgtatagacacntaaaatgtttatattttgaaatagagatag

SEQ ID NO: 3510 - DNA, 101 bp, rice(Oryza sativa)
  misc_feature (71): n=t or c
cctatatatttatatagtatcctaagcaacacctaaataagattagcgattaatgttattttggccctagntcacacacactagatgagttcgtgcaccaa

SEQ ID NO: 3511 - DNA, 101 bp, rice(Oryza sativa)
  misc_feature (71): n=a or g
tttgctgcttcatttggggttcgatgggttttagttgacctgttagggttttggaggcgtttagatgcggncggctagggggagcttacgcgattgaatgg

SEQ ID NO: 3512 - DNA, 101 bp, rice(Oryza sativa)
  misc_feature (71): n=t or c
tagaaaagtatgaaactgaaaagaatggagatagaccactcaatgtttggcacaggcctggtttagttccnaactttttcttcaaacttctaactttttca

SEQ ID NO: 3513 - DNA, 101 bp, rice(Oryza sativa)
  misc_feature (71): n=a or c
ccctactgcttcctctccctcgacctctacccctgcctcttcctctacctctcctcataaaaaatgacttnccatgcttcatctcaatgagcgaatgcaac

SEQ ID NO: 3514 - DNA, 101 bp, rice(Oryza sativa)
  misc_feature (71): n=t or c
catcatcataaacttatgtggtttctcttgagcgctccaagttttctagatcctggaaacacttgttagtnattattgtcctctatgagaatacaactaaa

SEQ ID NO: 3515 - DNA, 101 bp, rice(Oryza sativa)
  misc_feature (71): n=a or g
tcgtcgcaggatttgccaataaatagcaagagagatcgatagattagatcgaagtagaacagcggagaagnagagtaggagcgacggcgaccgcgcggagt

SEQ ID NO: 3516 - DNA, 101 bp, rice(Oryza sativa)
  misc_feature (71): n=a or g
gtcgggagtgcgtgctgccggtgtccgtgtgcgaattaggattctcgcgtccgttcgtactaatttcatangtgagaatcgtacgtgaagcctactatttc

SEQ ID NO: 3517 - DNA, 101 bp, rice(Oryza sativa)
  misc_feature (71): n=t or c
tgatttagttggcttgggttcaaaatctctccccttccacttattcaatatcagatgcttccctagtattnatgtttttttttactacctccatcccataa

SEQ ID NO: 3518 - DNA, 101 bp, rice(Oryza sativa)
  misc_feature (71): n=t or g
aaaagttgataggaaactgtacactacacgattggatgcacaaggtagtcgagcactagcgagttaagcgngtcgatggagcgttgagacaaatagtacat

SEQ ID NO: 3519 - DNA, 101 bp, rice(Oryza sativa)
  misc_feature (71): n=t or g
caaccttcactcttcctctcctctcaaacatagccgataaggagacgtgagttggcttctagtaatagctngttgcggtgcagctgcaaccaatgcttctg

SEQ ID NO: 3520 - DNA, 101 bp, rice(Oryza sativa)
  misc_feature (71): n=a or c
ttgtttttccgcgctgctcctatgtcttgtgtgtcagacatttagctatacctcttccgttataaaatgtngctacttttagctacggatatagatatttt

SEQ ID NO: 3521 - DNA, 101 bp, rice(Oryza sativa)
  misc_feature (71): n=t or c
tacttgaaattattggaacaaatgtgcaatcgacttacattacctgcccggctgatcctgctgctactctnggaattaaacttccatttcttgctttaatc

SEQ ID NO: 3522 - DNA, 101 bp, rice(Oryza sativa)
  misc_feature (71): n=t or c
tcatgagtgtacttgggatttgagatagcaatgccgagaatttaagtactacggagtactccctccgtttnaaaatgtttgacaccattgactttttagta

SEQ ID NO: 3523 - DNA, 101 bp, rice(Oryza sativa)
  misc_feature (71): n=a or g
ttgcccggctcaatggaagatgggcatgggaaaaccttttcaaccaaaatttggcgcacactaaaaattanatgctaagcaaatccatttctcgaaaaaaa

SEQ ID NO: 3524 - DNA, 101 bp, rice(Oryza sativa)
  misc_feature (71): n=a or g
ctgtccaactgaacccttagatgctacataacgtaaccattacattgttgctcacatgggtgacatgaatnttactctctccgtccctactagaaaatatt

SEQ ID NO: 3525 - DNA, 101 bp, rice(Oryza sativa)
  misc_feature (71): n=a or c
ttgattatactttctccgtttcataatatactccctcctgacagaaatctggaactgcgagcttgattacnctttctccgtttcataatatactatgttcg

SEQ ID NO: 3526 - DNA, 101 bp, rice(Oryza sativa)
  misc_feature (71): n=t or c
ggcatcacattttttacttgattttagccattttacctatgcatacatatgtaagtactagcaaaatgccngtgcttcgctacaggtataatgacgggtta

SEQ ID NO: 3527 - DNA, 101 bp, rice(Oryza sativa)
  misc_feature (71): n=a or g
tcccatctggtccggagggagtaacacattttgatggtatatagcgaggtcaggagaatgattttgttctnatataatgacttatgaaccattaacgcatt

SEQ ID NO: 3528 - DNA, 101 bp, rice(Oryza sativa)
  misc_feature (71): n=t or c
tggaccgatcgagatgggcacatgcatcgtttgtgatcgagatgggcacgttttcgctatatactccctcnatttctaaatatgtgattaggagaataaca

SEQ ID NO: 3529 - DNA, 101 bp, rice(Oryza sativa)
  misc_feature (71): n=a or g
tcgaattcgaggtaaacacagacctgaccaaaaaccagtaaaaacgatgaatttcagttagcaccgtatgnaaatcggctaataccgaccggttttcataa

SEQ ID NO: 3530 - DNA, 101 bp, rice(Oryza sativa)
  misc_feature (71): n=a or g
gaataaattaactttcgatcagggttgggcaatcttttgtttaatcgatcggtgatggcttttcggcggtnatcttgttccactccgacggctctttgttt

SEQ ID NO: 3531 - DNA, 101 bp, rice(Oryza sativa)
  misc_feature (71): n=a or g
gacgcggcacccacctgacctgtgctgcatcgtgtcacggccacccgtaaaaatatactctacctccgtcncttattactcgttgctttgagtttttattt

SEQ ID NO: 3532 - DNA, 101 bp, rice(Oryza sativa)
  misc_feature (71): n=t or c
cttaagttccattagaccatagcaaattccatggtagctcagtagctcaccatcatagtatccacgtcacnttaggagaaatcaccaaacgatttaagtac

SEQ ID NO: 3533 - DNA, 101 bp, rice(Oryza sativa)
  misc_feature (71): n=t or c
ttactctccctgtcccagaaagattgatgttctaaggattataggataaattagctcatgtgtaaatttcnaatttatcctccttcatcaaaggtggtttg

SEQ ID NO: 3534 - DNA, 101 bp, rice(Oryza sativa)
  misc_feature (71): n=t or c
agtctttctgaaaaggcagaagagagacaccattcacaaagttagattaatcgagctaagagaacgggatngacattccatagtaacaaaaaagaaatcca

SEQ ID NO: 3535 - DNA, 101 bp, rice(Oryza sativa)
  misc_feature (71): n=t or c
aagcatgaggaatcgaatcatgaccagtgtgctcaccatctccatctcgtgatcagttgatccggcgatcncgccgccactacctcctcctggactcctcg

SEQ ID NO: 3536 - DNA, 101 bp, rice(Oryza sativa)
  misc_feature (71): n=a or g
aacgctctgtagcggtattctacagacaacttatcagaaaaggagttatctatccaacaaggcaaaatttnctatagggcaccaaaaaattacggtttttg

SEQ ID NO: 3537 - DNA, 101 bp, rice(Oryza sativa)
  misc_feature (71): n=t or c
gcgaaggtgatgtgcaatacaattctgccatggctctcatggaaatctgcagtgttgctgagcagaattcngacctgcgacggtcagcatttaagccaacc

SEQ ID NO: 3538 - DNA, 101 bp, rice(Oryza sativa)
  misc_feature (71): n=a or g
atacacagccaaatgatacaagagcacttaggctcacaccacattgaagaggagaacacacaaaaaaaaanaaaaaaaaaagaaaaacctactatctcaat

SEQ ID NO: 3539 - DNA, 101 bp, rice(Oryza sativa)
  misc_feature (71): n=t or g
ccttttgttttctttttcagatagcatggtctatatcctagctagaccactgtatcttggtggttgcaaanattaatggagacaataataattcagctccc

SEQ ID NO: 3540 - DNA, 101 bp, rice(Oryza sativa)
  misc_feature (71): n=t or c
gaaaattatgtagctacaaggtcaatgatattgcaaagtacacaccaaggagatcaatggcaatttttagnccagcatttgaaccatgagtgtactcttcc

SEQ ID NO: 3541 - DNA, 101 bp, rice(Oryza sativa)
  misc_feature (71): n=a or c
ctccaactcaaccataattgattctacaaaacccctgtatcccttggacaatacaaatcgatgtgttctanaatgaatcacccaaagcttccggattaggc

SEQ ID NO: 3542 - DNA, 101 bp, rice(Oryza sativa)
  misc_feature (71): n=a or c
atgtaacttccaatacaacaccaatgtctcaaaaggatgttttcacttttcactctatgcaggtatcatanttagcaatataaacatttcaaaactagaca

SEQ ID NO: 3543 - DNA, 101 bp, rice(Oryza sativa)
  misc_feature (71): n=a or g
cgggcaacgggtacacccgtggaagagggcgtggttttaggggccgtggcaggagaggtggcggctatggngcacaacctgattatcagcaagatggagga

SEQ ID NO: 3544 - DNA, 101 bp, rice(Oryza sativa)
  misc_feature (71): n=t or c
atcttccacacaaatccacatttgaaatttagagcggtttcgctgacttaggtggcattagaattaaaaanatatatgtggggcccattcctcattcacac

SEQ ID NO: 3545 - DNA, 101 bp, rice(Oryza sativa)
  misc_feature (71): n=a or c
gggatggagggagtatttgatattccttaatagatatcgggtgatacccagttaggacggaatgatgcctntgatatatcgtctaaacgggatctcgttct

SEQ ID NO: 3546 - DNA, 101 bp, rice(Oryza sativa)
  misc_feature (71): n=t or c
gtcctcttctcggtctatcagttacagagtttgtaaaaaatggaaatgatatgcaaataaaggcaaatgcnagattgaatttaggccctctttgtttaggc

SEQ ID NO: 3547 - DNA, 101 bp, rice(Oryza sativa)
  misc_feature (71): n=t or g
aatgcttgtttgtgatatatggttggttgctgagcttacggctattgtttctattctagtttggcgattgntttttttttaatgaaaatcattaaataaag

SEQ ID NO: 3548 - DNA, 101 bp, rice(Oryza sativa)
  misc_feature (71): n=a or g
cggcgccgacgatggccaccctcttcttgatcttctccattcgagatcgatcgccccggagctaaagcttncaagtgtaatgagacggtacactgtcgatc

SEQ ID NO: 3549 - DNA, 101 bp, rice(Oryza sativa)
  misc_feature (71): n=a or g
gtttgatgtcacatgaacttaggcccgcatcactgcagcggtgtagccactactaaatgctgataaattcngccaaaaaccccaagcagatcgacagtgta

SEQ ID NO: 3550 - DNA, 101 bp, rice(Oryza sativa)
  misc_feature (71): n=a or c
gtttagcgtttgataagcgaccagcgttactcggctcgctccgcctaccaggcttttttcctcggacaacnatcctttgcttacggtgattttctaggcgg

SEQ ID NO: 3551 - DNA, 101 bp, rice(Oryza sativa)
  misc_feature (71): n=a or c
cgtccatcccttacccacctccccaataaataccctcgtaccccttcccaccccacaccttctctcctcgntctctctctctcttcctctctcgcttcgct

SEQ ID NO: 3552 - DNA, 101 bp, rice(Oryza sativa)
  misc_feature (71): n=t or g
gcttttatttttgttggttttgggtcaaaaagagagccaagtcatgtgcacctacgtgttatgcttcctcntattttcgtgtttctatttcggtgagatat

SEQ ID NO: 3553 - DNA, 101 bp, rice(Oryza sativa)
  misc_feature (71): n=t or g
cccacgcaggactgtggggaccactgggttgggcccacaggtcgcccccatgcgtgtacctcgttattcanggaaatgaaaaaaaaagagttgatgttaat

SEQ ID NO: 3554 - DNA, 101 bp, rice(Oryza sativa)
  misc_feature (71): n=a or g
tggcttgtggtacgatgtgattactgtacagtgtactaatcccatcaaaacttatacactagagacaggtncagttcatttgtacttagtatagtactaag

SEQ ID NO: 3555 - DNA, 101 bp, rice(Oryza sativa)
  misc_feature (71): n=a or g
atctttgcttaaataaagtaacatctaattattgcatatgttataggacgaataaataatttaattaaagncataaaaactacttaatataccacctcaaa

SEQ ID NO: 3556 - DNA, 101 bp, rice(Oryza sativa)
  misc_feature (71): n=t or c
gaaactagttagctagtttttgtgagaaagcaggttggagaattgctacacgtcgccgcagcccacccaantcacagtattacggcccaaccaggcctccc

SEQ ID NO: 3557 - DNA, 101 bp, rice(Oryza sativa)
  misc_feature (71): n=a or g
aactagttacacgatctacagaaattgatcagctagccatgtaagcaagccgaacaacgtacgaggcgagngctaggtagctaggatgtcagaaatggcgg

SEQ ID NO: 3558 - DNA, 101 bp, rice(Oryza sativa)
  misc_feature (71): n=t or c
tttgttctttgtccacaagacagactggacggaaaaccacgtgctttttaatcgacccgatccaaacagantggacggattccggacataaccaattttgt

SEQ ID NO: 3559 - DNA, 101 bp, rice(Oryza sativa)
  misc_feature (71): n=t or g
gcaactcttcttcttttttatttttcccgtcgtacgtgcatgcgtgcatatgcaagatgaataataataanaataagaagaagaagaagatcaagatgcat

SEQ ID NO: 3560 - DNA, 101 bp, rice(Oryza sativa)
  misc_feature (71): n=t or c
tattttaatataaaatttaaatgctaaaatgacaagtaatataaaaccgagagactcagagagtactaagnatgactagtactccctccgtcccaaaatat

SEQ ID NO: 3561 - DNA, 101 bp, rice(Oryza sativa)
  misc_feature (71): n=t or c
catttacatttcgtattctggctcctgatgagccatattcagggagctagagatcgtaagaagtaattagnaatgatagccagcgagaatctagcattgtt

SEQ ID NO: 3562 - DNA, 101 bp, rice(Oryza sativa)
  misc_feature (71): n=a or g
cattcaggctatatatttatatcaaggtagctgctaaaaagaactcaaggtctgacccctcttttgtcganggcagcgacaatatcagccggtttctggac

SEQ ID NO: 3563 - DNA, 101 bp, rice(Oryza sativa)
  misc_feature (71): n=a or c
cccctatgtctactagtgatagtaactaacttttaaatttaaagaagtgcttgtttaaatttgtagtttanaattattatatttcgtgactggtggtggag

SEQ ID NO: 3564 - DNA, 101 bp, rice(Oryza sativa)
  misc_feature (71): n=a or g
agtggatataagcctgcgtttgcggcggggcaaattgaagcttgtgattaggaggcggcaactggtggtgncggatccagcgatgtgaaattgtcgaggct

SEQ ID NO: 3565 - DNA, 101 bp, rice(Oryza sativa)
  misc_feature (71): n=t or c
tccacttcccatcgtcgggccaccgcctcccacatccatccctttaagcctggcgattttcccctcttttnctctccctacatccaccttgaacccaggag

SEQ ID NO: 3566 - DNA, 101 bp, rice(Oryza sativa)
  misc_feature (71): n=a or g
tgcattggtcatcgccaacgacgacgctgttggcgttggcgtcggtggaagaagaggatacaagagagacntgagcagcagcggcagcatgaggtggcaaa

SEQ ID NO: 3567 - DNA, 101 bp, rice(Oryza sativa)
  misc_feature (71): n=t or g
ggctcctccggtgctcaggctcagctgctgctgctgatgctcgcatgtcggagtcgtcggatgatgatgangatgaggaggaggaggaggaggatgacgaa

SEQ ID NO: 3568 - DNA, 101 bp, rice(Oryza sativa)
  misc_feature (71): n=a or g
agggagaagaagtggaggaaggaagaagaagggcaattttgtccaatttttttttaaatgcatctaagtgntaaatagtggcatatatcaaatatgtataa

SEQ ID NO: 3569 - DNA, 101 bp, rice(Oryza sativa)
  misc_feature (71): n=a or c
ctcctcatcttcaagccggacctcgatgaggtggtcaaggctcgccgcggcaagaacctcttattcagcancgatgtcgagggccacgtcctcaaggaatc

SEQ ID NO: 3570 - DNA, 101 bp, rice(Oryza sativa)
  misc_feature (71): n=t or c
aatgacagggtttatgacttctggcgctccatttctaaagagcgcagcagttggcaccatggcattaaagntcaccggagtcttatggactggctgtgcag

SEQ ID NO: 3571 - DNA, 101 bp, rice(Oryza sativa)
  misc_feature (71): n=t or c
tgccaatcggatctaggcctgatgtcaatgaggtacgtacctactagttccatcacctgtagtggagaganagagatggatatagcttagatagatagaga

SEQ ID NO: 3572 - DNA, 101 bp, rice(Oryza sativa)
  misc_feature (71): n=t or c
aattgggctatgtaatggaacaagattattagttacaggtttgggtgaaagaattcttcaatgtatcatantaactggatcaaacatcggtgaaactgttt

SEQ ID NO: 3573 - DNA, 101 bp, rice(Oryza sativa)
  misc_feature (71): n=a or g
atagaaggatttagatctatttatattaccactctagttagtggcagtataaacttgaaggtgtattattntaaaaaaaagtttgaacgggtataatcgtt

SEQ ID NO: 3574 - DNA, 101 bp, rice(Oryza sativa)
  misc_feature (71): n=a or g
attcagcacctagttcatatatgttcagacccaatatatattggttaaaagttgtgcaggtttaacaaagnaagtgttaaatttgtttggaatatttctga

SEQ ID NO: 3575 - DNA, 101 bp, rice(Oryza sativa)
  misc_feature (71): n=a or g
cagaaaataagtcacttttatatgagccatccaattcatcttcaacaactgaagcaagtcataaaattcancccaccaatcaattcaggtacttcaattat

SEQ ID NO: 3576 - DNA, 101 bp, rice(Oryza sativa)
  misc_feature (71): n=t or c
atttatatatgctacggtagcttacaggtttgcaaatgctgtgttagttagtaccaacacaagactaattnatttttaccttttctattttactagtccat

SEQ ID NO: 3577 - DNA, 101 bp, rice(Oryza sativa)
  misc_feature (71): n=t or g
ctttggcactcctccatctccttccacactccctccatgtccatcatcacaaggtcatccttggaatatgncattgactccggatcttcagccaacctcat

SEQ ID NO: 3578 - DNA, 101 bp, rice(Oryza sativa)
  misc_feature (71): n=a or g
acacgagtcaagtgaatacttcctccttgcatccaaaagtcttatgcgtttcttttgtaaccaagaccaanaaaaaaaattatctcaaatgtaaaaaaaac

SEQ ID NO: 3579 - DNA, 101 bp, rice(Oryza sativa)
  misc_feature (71): n=t or c
cacataatgtacatatctattattttttcaaacaaaatcacacatcgtaaaagttatactccctccatccnataatataagggattttaagtttttgctta

SEQ ID NO: 3580 - DNA, 101 bp, rice(Oryza sativa)
  misc_feature (71): n=a or g
cactgcatgtctgagactctgagtcatactagcgtgtaaagcccaatgaaatcaaatcactgagtttgtcncatttctagccttctttattttcctttgag

SEQ ID NO: 3581 - DNA, 101 bp, rice(Oryza sativa)
  misc_feature (71): n=t or c
tgatatgtactgcaaaggcgaggggagtaataaattgggatctatctaattaactactcctagttaggagnagcatgtttgagtgactgttgataaaaagg

SEQ ID NO: 3582 - DNA, 101 bp, rice(Oryza sativa)
  misc_feature (71): n=a or c
atgaataagcatgtaagatgtatggcagttgccacaattcatctttatatgtttcttaggcttttgagagnagaggcgatgacaaccatgaacccttgcta

SEQ ID NO: 3583 - DNA, 101 bp, rice(Oryza sativa)
  misc_feature (71): n=a or g
tagcgaccaaagagcactagctttgaaaagcatcgccactttaaaaaatcggccacattaaaaaaccactncacacatctcctcctcctctccagatccac

SEQ ID NO: 3584 - DNA, 101 bp, rice(Oryza sativa)
  misc_feature (71): n=a or g
aggaggtaacacttgtaagaaataaacacaagctcaagaatctagtagtccctaggagcagcaacctttcngaaattatatttgccaatggttttatttat

SEQ ID NO: 3585 - DNA, 101 bp, rice(Oryza sativa)
  misc_feature (71): n=t or c
gtgaccagcaatgaggccagcaacttgagagatccaatcaataacctcaaggtgatgaccgatggatcacncccgccctctctcagaggctaaacctccca

SEQ ID NO: 3586 - DNA, 101 bp, rice(Oryza sativa)
  misc_feature (71): n=a or g
ccaccttatttgatttcttaaagccggttttgtttgattttaattattgagtgaagtattattgctattgntttacgtactcaattgtgaggataaactaa

SEQ ID NO: 3587 - DNA, 101 bp, rice(Oryza sativa)
  misc_feature (71): n=a or g
catgagtattttagtcctaagatttcacgaaaccacaatgttaaccaatctatcttagtagcaaaataaanaataattcacttacattactacaacattta

SEQ ID NO: 3588 - DNA, 101 bp, rice(Oryza sativa)
  misc_feature (71): n=t or c
aatttcaacattataaaggctccagagatagtcgcggagatcattagcagcaaaatcgtcgtctttcacangacaaagcagcatcgacgtgctcactagtg

SEQ ID NO: 3589 - DNA, 101 bp, rice(Oryza sativa)
  misc_feature (71): n=t or c
tagtaagattgagaagaaaagactacagttgcctcattaaatgatgtgtagttgaggagtaagaggatgtntggggttaatattaggttaaaaattaaaga

SEQ ID NO: 3590 - DNA, 101 bp, rice(Oryza sativa)
  misc_feature (71): n=a or g
ttttctagggtgtagttatatcctctaaaattgtttctccagctggagtaaatatttcgtaaaaaaaaacntagagaaatttccataaacaaaacaaaagt

SEQ ID NO: 3591 - DNA, 101 bp, rice(Oryza sativa)
  misc_feature (71): n=t or c
cattttgactgccatgcatttgtgtcagtgtcacaaaagcccgatttcaagaatatcttcaaggatataanatacaatatgcctacgaaagatggtttcct

SEQ ID NO: 3592 - DNA, 101 bp, rice(Oryza sativa)
  misc_feature (71): n=a or c
cctccctcagatggattcttcctatttaaatagccttttgttcttccgtaatatttttgcggaaaatatancatggagatgccaattattgcagaaatata

SEQ ID NO: 3593 - DNA, 101 bp, rice(Oryza sativa)
  misc_feature (71): n=t or c
gtggattaagatatgcaggtatgaatataaaactatgatgtcatatagattagtggacacaaccatctcanaaagcctagtctgctttggtgggaagactg

SEQ ID NO: 3594 - DNA, 101 bp, rice(Oryza sativa)
  misc_feature (71): n=t or c
tttgaataccatcacttaaatgagtttcgctagaatctcattctcaactaagactacttcgccaaaatgcnatctcggaggaaaatggccgtcattcttat

SEQ ID NO: 3595 - DNA, 101 bp, rice(Oryza sativa)
  misc_feature (71): n=t or c
aaggcacacacaaaggcccaaatgacacgtggacggtgcgaatggcgacgacggtcgagtccactctattnggtcccctacttctccgaggagatccatga

SEQ ID NO: 3596 - DNA, 101 bp, rice(Oryza sativa)
  misc_feature (71): n=t or g
ggataacgatgcaccgatcccagtaataagcgcaaatgtaaatgttattggcttcgttgaggaagcaaatncagttttactgcatgcagctggtagagggg

SEQ ID NO: 3597 - DNA, 101 bp, rice(Oryza sativa)
  misc_feature (71): n=t or c
accaggtcaataaaattcctttacacattaagtgaaaacttgagattttattttcagaagaagctgaagtntcatatatgtcaaatcaatgcatattaatt

SEQ ID NO: 3598 - DNA, 101 bp, rice(Oryza sativa)
  misc_feature (71): n=a or g
ttcaaacaaaacctggtttgacaagaatcgaagcttcagttttgtctcaattaagctgcaaacatttttcnaagtgtagctccttcttggagcaaacgttc

SEQ ID NO: 3599 - DNA, 101 bp, rice(Oryza sativa)
  misc_feature (71): n=t or c
gccttccagacttccagtgcaacggatggtacgctgataaaagctagctaaccggcacagctagcaagcanactagttcttgacaccgaatactatcaggt

SEQ ID NO: 3600 - DNA, 101 bp, rice(Oryza sativa)
  misc_feature (71): n=a or g
gtgagcacccttggcatcggcaggaacttgtcaagctcaatggccctgcgcggtatccatttccatttcgncgcaccatcatcggcaacctcccgcgccca

SEQ ID NO: 3601 - DNA, 101 bp, rice(Oryza sativa)
  misc_feature (71): n=t or g
cccactcacactagtcaacacatcgtctcatgactaaaatgtttttgttactactacaatggcgccgacanggccgccgggcatcaccggagcacgagcag

SEQ ID NO: 3602 - DNA, 101 bp, rice(Oryza sativa)
  misc_feature (71): n=t or c
gagagagaggagtggaggaggaggagaggggataaagaggaattaagtacgtgatgtataaagataaaggnagagagtgaatgtgagagatgctaagactt

SEQ ID NO: 3603 - DNA, 101 bp, rice(Oryza sativa)
  misc_feature (71): n=a or g
agagacatgtatcatcatatcacatattgatttatatatgtgagagatcgattttatagtccttgagaagntaagtaggtacctggatgacgtggttgcgg

SEQ ID NO: 3604 - DNA, 101 bp, rice(Oryza sativa)
  misc_feature (71): n=a or g
caatatactcctactatcattttgcccctgcaaaagagaaagcatatgctcgatcttttgtgattcaattnaaccgtacgtgagtaaaaataccagagtcc

SEQ ID NO: 3605 - DNA, 101 bp, rice(Oryza sativa)
  misc_feature (71): n=a or g
ttaaccttccattttgagcaaacatttgatatgcaacttagattacagctgttgtacaaacatcaaaatancaagtggattgaataggaaatgttgaaact

SEQ ID NO: 3606 - DNA, 101 bp, rice(Oryza sativa)
  misc_feature (71): n=a or g
gttatacatgcatcctgatttcatgaacatttctagttcaactgtttaacagtgacatgcatggctaccancagtagacatatgcatatgaaatagtagaa

SEQ ID NO: 3607 - DNA, 101 bp, rice(Oryza sativa)
  misc_feature (71): n=t or g
ctgtgcttgactgaaagcatataccaggaaaaagaaaaacagagtgatctcaaaaaagaaaaaggaaaagnaaaaatagaagagagaggcgattaaggaga

SEQ ID NO: 3608 - DNA, 101 bp, rice(Oryza sativa)
  misc_feature (71): n=t or c
tacgaatgttcagaggtagatttatgaagtggttgcacgtatatttgagtagaatttgttcatgtgcttgncaaaatattagagttccatcttttgatgca

SEQ ID NO: 3609 - DNA, 101 bp, rice(Oryza sativa)
  misc_feature (71): n=a or c
cacgatagactgtttgatgtatgttgaaccacacaaaaagtcccccactatgatcaaacatacttgaactntgttgcacttgacaaacaaaattggcggtt

SEQ ID NO: 3610 - DNA, 101 bp, rice(Oryza sativa)
  misc_feature (71): n=t or c
tgaaagcttgttgaaaattaactgaatacataaggggtgttcatcttaacagccaacaacataaaatgganggattcggacataaaaatggttgattttat

SEQ ID NO: 3611 - DNA, 101 bp, rice(Oryza sativa)
  misc_feature (71): n=t or c
atgaaatctcggtgaatgaagaaatagtgatcttaacggatccaaccctgattcttaacgagctaatacangagtataacatggcgtgcgcaaaaaataaa

SEQ ID NO: 3612 - DNA, 101 bp, rice(Oryza sativa)
  misc_feature (71): n=t or c
ttctggtctgtctttattcctatttgaaacctctaaaacacttcactttttcttacctaacggtgagcatngtttctactccctcctcgatacatattgtt

SEQ ID NO: 3613 - DNA, 101 bp, rice(Oryza sativa)
  misc_feature (71): n=a or g
cttgacactccacacactagtacagaaaaaggttattggtgctagatgggaaccggtcataggttttccanctgacacccacccagtaggaggcatctttc

SEQ ID NO: 3614 - DNA, 101 bp, rice(Oryza sativa)
  misc_feature (71): n=t or g
aattatagttgccacgaagttgtcttgaccaagttaacttaattaactagcacgaagttgtcttgaccaanttaattaattaagttctatctttatatata

SEQ ID NO: 3615 - DNA, 101 bp, rice(Oryza sativa)
  misc_feature (71): n=a or g
tttgaacacgcttaatagtcgttagctaagtataaatcctaacttcttcaaaaaaatcagtactccctcantttcatatatattacttaccattctagcat

SEQ ID NO: 3616 - DNA, 101 bp, rice(Oryza sativa)
  misc_feature (71): n=t or c
attaacataacggggaagtatgcgtatgatgcaaatatggagcatatctactatcggttgggcgccttccncggctggggactgctttctccccacgcgat

SEQ ID NO: 3617 - DNA, 101 bp, rice(Oryza sativa)
  misc_feature (71): n=a or g
acgccttgggctggcttgtgcacaaatcttgaagaaaaatcccatggccacaaatccagctgacaaaagcncaaaaaaaaaaaaaacagcaggcagctgtc

SEQ ID NO: 3618 - DNA, 101 bp, rice(Oryza sativa)
  misc_feature (71): n=t or c
aacttcatgctaaatataacgcccatatgggttttatctctactattataaaaggaaattgctacacatcngactagtatgtacgacttagcatccgacca

SEQ ID NO: 3619 - DNA, 101 bp, rice(Oryza sativa)
  misc_feature (71): n=a or g
taattactacagtttggggaatgggtggagtgggcaagacaacattggttgcttatgtttactatgctgtnaagacagagtttgatgcagcagggtgggta

SEQ ID NO: 3620 - DNA, 101 bp, rice(Oryza sativa)
  misc_feature (71): n=a or g
ctttcgcgcagaaatactcatagagcctctcaaagaaaatatccaagtcagggatcacctcctccttaaantcttctccatgaagtagccctgatgggctc

SEQ ID NO: 3621 - DNA, 101 bp, rice(Oryza sativa)
  misc_feature (71): n=t or c
cgggagagttttgtgcaagattccaagaaggtggattatcgtcgagttgctcaactctaagttgatcactntttctattctctttaactcatcgtttagat

SEQ ID NO: 3622 - DNA, 101 bp, rice(Oryza sativa)
  misc_feature (71): n=t or g
aataaaagaagatatgatgtatgcaacacaaagtgcataggtgaagcgtccaatttttcttcaaacatcangcgcttgattgtactctgcccgcagaatat

SEQ ID NO: 3623 - DNA, 101 bp, rice(Oryza sativa)
  misc_feature (71): n=t or c
agctagccgacagacaaaaatctgaaagacagtgaccactaatgaaaagtccgcacaccaaacctggctcncgtgcgacccacgccgcgcgtccccacgac

SEQ ID NO: 3624 - DNA, 101 bp, rice(Oryza sativa)
  misc_feature (71): n=t or c
ttatggagatagatattatattcacaatagagatggacttatgaggacaacacaacccacctaattatatnccataatctaaaaataatcattccattata

SEQ ID NO: 3625 - DNA, 101 bp, rice(Oryza sativa)
  misc_feature (71): n=a or g
tgagtgcggtgattgttcagaaaaaaataatttaacaaccacaagactatatatgtttggacaaaataggncgaaaatatttcgattttaagttccccagg

SEQ ID NO: 3626 - DNA, 101 bp, rice(Oryza sativa)
  misc_feature (71): n=a or g
gaattattgtactaaaatatatcacatccaccaaaatacttgagacggagggagtatcttgatgatggctntgaagagcccagtatgtttgaataaagtgt

SEQ ID NO: 3627 - DNA, 101 bp, rice(Oryza sativa)
  misc_feature (71): n=t or c
tcgagcaggcgcgccttggcagtagatcagccgtccatttgccagaattgtttgcgccaagcacgaagtgnggccgaaagatcctgacaactgacttccca

SEQ ID NO: 3628 - DNA, 101 bp, rice(Oryza sativa)
  misc_feature (71): n=a or c
gcttcttccaaatccacaggcatcctcaatatccagatcaagcctaatcctcaaaatattctccatttgantaattctttgtctctgggattggagaaaaa

SEQ ID NO: 3629 - DNA, 101 bp, rice(Oryza sativa)
  misc_feature (71): n=a or g
aactcgggtcctacgtgtacccatctcctctcaatacgttgacatattgtaccagtcttcacctagtttcnctccaatctcaacgtctattagcatggcgt

SEQ ID NO: 3630 - DNA, 101 bp, rice(Oryza sativa)
  misc_feature (71): n=t or c
tcagcactggagcgggagatcgtgacttggtgcttggaggacctggacaccaggttgttgcctaggagcanaggtagcctaaagtagaacatagtgtgttg

SEQ ID NO: 3631 - DNA, 101 bp, rice(Oryza sativa)
  misc_feature (71): n=t or g
acacaaccagaagaagtcacaggccaacgacgaatctataaatgatacatccaccaaactgcacagcactncagctgcaacggagaaatcgacgcaaaaac

SEQ ID NO: 3632 - DNA, 101 bp, rice(Oryza sativa)
  misc_feature (71): n=t or g
aaagattattaactagacatgaagctggatcaaaacacattttattatcaatattgtatcaacaaactttntacgtacttgtcaactttaatatttgagat

SEQ ID NO: 3633 - DNA, 101 bp, rice(Oryza sativa)
  misc_feature (71): n=t or c
cataatcgcttgtcatatccaatatcaagcacagtctttctcatttcttgcaagatgaaaaagtgtcttanttttcagttgggcatggaaaatggcagctg

SEQ ID NO: 3634 - DNA, 101 bp, rice(Oryza sativa)
  misc_feature (71): n=a or g
tagagaaaaccacattactaacagatgaaaataatgatactaacaatttctaacatttggttttgattcgnatgactaatcctaattgttcttgaacaact

SEQ ID NO: 3635 - DNA, 101 bp, rice(Oryza sativa)
  misc_feature (71): n=t or g
gatgaaataatatgcagttctcctatgtattcgagaaaaaaggtatagaaggaaaaaatcacttggttttntttttgtgttttaaccaccaatctggataa

SEQ ID NO: 3636 - DNA, 101 bp, rice(Oryza sativa)
  misc_feature (71): n=a or g
tttacactgggttgatatacaacgaatttttctcagtcccatttgaactctttggtaaatctgcctatgcntgccgtgatccttcttgtgggtaaggagct

SEQ ID NO: 3637 - DNA, 101 bp, rice(Oryza sativa)
  misc_feature (71): n=t or c
tttcatttttctaacactaaaaaaatgaaattacaagtgaaatgagcgtagctcaaccagttagatttatngtggtggaattaatccacatgggttcaagt

SEQ ID NO: 3638 - DNA, 101 bp, rice(Oryza sativa)
  misc_feature (71): n=a or g
aattaaatgggggaaggttgtgactggttgacgagaaagtggatgaataatttgaatggcggaagattttnatcggttgagaagagaatataggtagagaa

SEQ ID NO: 3639 - DNA, 101 bp, rice(Oryza sativa)
  misc_feature (71): n=a or g
atatagatatatattatattaattttgttttcttttccttgttaacaggctggctgttagcatgtgaccgngcagaaacggttgccatgaatccatatcgg

SEQ ID NO: 3640 - DNA, 101 bp, rice(Oryza sativa)
  misc_feature (71): n=t or c
tctggctatatcagatgtgaatcctcctgacttttctggtctccctatatttttatctattactgttgatnctccctctcaatcttcaattgtacgtttca

SEQ ID NO: 3641 - DNA, 101 bp, rice(Oryza sativa)
  misc_feature (71): n=t or c
atctcttccaaaacccttgctctctcttgaggttgggttgggatcaaagagagggtgacattttttttttntgactagtctgccacgttggcgccacatgt

SEQ ID NO: 3642 - DNA, 101 bp, rice(Oryza sativa)
  misc_feature (71): n=a or g
gttcatccaaggacacaatataaatgtaggccaaaggggtatagatgattttctagtgttgtacagggtcntttagaaagcttaactttaatcctatagct

SEQ ID NO: 3643 - DNA, 101 bp, rice(Oryza sativa)
  misc_feature (71): n=t or c
atgatgaggctcgacttcagatcgaagtttgtgtctcctaagttaatttgtggcctaacgggcacgttctnagctgagggagcagcgaactcttgaagggt

SEQ ID NO: 3644 - DNA, 101 bp, rice(Oryza sativa)
  misc_feature (71): n=a or g
ctacgctcaccctgaaggactttgcctaatgtgccacacgtgtccttccttgtaatcatttcatcctactnctctcttcgtactcgtaaaggaagtcgttt

SEQ ID NO: 3645 - DNA, 101 bp, rice(Oryza sativa)
  misc_feature (71): n=a or c
cgtttctagggctaattatacgatttttatcacttataaaggcacggccccaaaaaagtaatggacattcntgagttacagcatattcatgaaaatgtata

SEQ ID NO: 3646 - DNA, 101 bp, rice(Oryza sativa)
  misc_feature (71): n=t or c
cccagggtaatcatgctgcaggacctgatataattactattgagcgtttgaatggctggttggtcatagancaagaacagctcccagtggaatttggccaa

SEQ ID NO: 3647 - DNA, 101 bp, rice(Oryza sativa)
  misc_feature (71): n=a or g
catccaaacgtatgttaaagatgatttgtgcatgcggacggcgcaaccgcatgccaatgatctgattttcncatgtgggcgcttaagccgaccgcatgcgg

SEQ ID NO: 3648 - DNA, 101 bp, rice(Oryza sativa)
  misc_feature (71): n=t or c
gcaaaaactattttcgcaggtatgcaaaaatgagtctattttcgcagccgggcatcttaaggagcattttngcaagtgggcctcttaagtggtccgcatgc

SEQ ID NO: 3649 - DNA, 101 bp, rice(Oryza sativa)
  misc_feature (71): n=t or c
ctccggtgttgattcctccataaaagggagtgtctttcaggttatatctatcggccgatgaaaagtcgatnggctcagttttgattcaggacctagaaggc

SEQ ID NO: 3650 - DNA, 101 bp, rice(Oryza sativa)
  misc_feature (71): n=a or g
cctcccgccgccgccgccggccctgccgatgtccagtacggcgaatgcggcggcggaaacgaggcagtacncggcgaaggcggcgacgagcgcgccgacgg

SEQ ID NO: 3651 - DNA, 101 bp, rice(Oryza sativa)
  misc_feature (71): n=a or g
gacaaatgatctgaaattgagcaatgatctgaaatccgagtattggaattgattcaggttaaaaaactgtnatcgttcttttttttgccgggtcggcgaaa

SEQ ID NO: 3652 - DNA, 101 bp, rice(Oryza sativa)
  misc_feature (71): n=a or c
gaagactgctctaaccagatttacagtttgcatctggtgtcctccttgcctcgcgagcactaccaccaatncggggacgatggttgagacgagaaggcgat

SEQ ID NO: 3653 - DNA, 101 bp, rice(Oryza sativa)
  misc_feature (71): n=t or c
gtacctgttcattggaggttgggtccagtaaaccaagattatcatcatgataaagatgaagataggaaaanacaatggtgtccaacaggcattttcaccaa

SEQ ID NO: 3654 - DNA, 101 bp, rice(Oryza sativa)
  misc_feature (71): n=t or g
aaagggtcggtggatgattttgttggcatgtacttctccaagaaattggatttaaatccaacttggactgnaccataaacaaccatcaaaatccatttaaa

SEQ ID NO: 3655 - DNA, 101 bp, rice(Oryza sativa)
  misc_feature (71): n=a or g
gccgacagttgcagaccagtgaggccttttgtggcagtgaccccggcgaggcacaaagtgccagcaggctngcgccaccaccggtggctcatgacccatgg

SEQ ID NO: 3656 - DNA, 101 bp, rice(Oryza sativa)
  misc_feature (71): n=a or g
aagcaactcacagaggtaaaagctgaaaatatcagcatatcgcagcttataacaaccgaatcgttcaaggnggttggaaagtgatctggttttcttggata

SEQ ID NO: 3657 - DNA, 101 bp, rice(Oryza sativa)
  misc_feature (71): n=a or c
acccataaacctcacacatgcacaattagttagggaaaatcggccaaatacctacacgatgaacaaaagancacttgcggcggcagcactagaacacaaaa

SEQ ID NO: 3658 - DNA, 101 bp, rice(Oryza sativa)
  misc_feature (71): n=a or g
tcaccagaggcctagacacgttcaccaccatgccacttgagagcccataaaaagcccgttagggagcccangatagaatagacactacctaccctcataag

SEQ ID NO: 3659 - DNA, 101 bp, rice(Oryza sativa)
  misc_feature (71): n=t or c
aagtcgaacccaccgacttcgaagtactcttctgctagagggggagaggagagaaagattgagtacaaacngtcgtaatcaacaaaccatgctagaacaat

SEQ ID NO: 3660 - DNA, 101 bp, rice(Oryza sativa)
  misc_feature (71): n=t or c
aaaataattgaatgagattcttcgtccttcaaaaaagggtatccatagcgagaacaattctcaagccatgngtattttgctataaaagaatattacgattg

SEQ ID NO: 3661 - DNA, 101 bp, rice(Oryza sativa)
  misc_feature (71): n=t or c
gtgcctctgtggttaaaatagatttctcaccaaaaacctcacaagcatgctgcacataaaattcattacanagattgctttatgtaaaaaggaattaggag

SEQ ID NO: 3662 - DNA, 101 bp, rice(Oryza sativa)
  misc_feature (71): n=a or g
aaaagactttggtttacataagtgtgatatgaaattatagcataataatctcttaccatatattccctccngattaaataaatacgttacattggaaatac

SEQ ID NO: 3663 - DNA, 101 bp, rice(Oryza sativa)
  misc_feature (71): n=t or c
atagtttatacaggtttaggccacctggaagtgtaataccctgatccctaatcctatgttggttttgttanttttctccgattagcttagtacaagagatg

SEQ ID NO: 3664 - DNA, 101 bp, rice(Oryza sativa)
  misc_feature (71): n=t or c
tggcgacaacggccggaaccacaccaacatcctagtcacagtgtcgggctgcaccttgaacatgttcttcngtacgcgctcctgcttcggcacaacatgcc

SEQ ID NO: 3665 - DNA, 101 bp, rice(Oryza sativa)
  misc_feature (71): n=a or g
tgaagtgagtgagatgatgtccttatataatatagtacaatatagtacaataggtatgacggttggcgaangggaaatgtccgaagtgccctcgaaccgcc

SEQ ID NO: 3666 - DNA, 101 bp, rice(Oryza sativa)
  misc_feature (71): n=t or c
ccctacaaccattaccttactcctatcacctagctcatttgtagtttgaatttaatttgagtcggtaactncccctgtatcagtttcttgcaaccctacca

SEQ ID NO: 3667 - DNA, 101 bp, rice(Oryza sativa)
  misc_feature (71): n=t or c
gagagagtagtacatgcacaactgcaccatcgaaaacccaaatcgttccccactgccctcctagcaaccgncgcttcaccctgcgctcgtgctatggtgcc

SEQ ID NO: 3668 - DNA, 101 bp, rice(Oryza sativa)
  misc_feature (71): n=t or c
tgttagctggtcttctgttttttttctcggccctgcaattgaaagtgatgaaattgcatgtatgcatgttnagatgcttgattgtattctaccatcttata

SEQ ID NO: 3669 - DNA, 101 bp, rice(Oryza sativa)
  misc_feature (71): n=a or g
tttaatctggaggtgctatggtcgtaacattgtatttatgtgctagccctaacctgtctaaattctccatntgggactaatagcctgtgtgttgcaacggg

SEQ ID NO: 3670 - DNA, 101 bp, rice(Oryza sativa)
  misc_feature (71): n=a or g
cagtgtgcagagagagtgaggatgatacgagccatccttatagatggatgagatagaagaagatggagacntgatttggacatgaggcaaagctgcccctt

SEQ ID NO: 3671 - DNA, 101 bp, rice(Oryza sativa)
  misc_feature (71): n=t or c
gttcaatgggtgtttttttagttgttgtgtgtgtttggacgatttggctcaatagaaatgattgggttttngaaaatattctggtcaaatctcctttgcag

SEQ ID NO: 3672 - DNA, 101 bp, rice(Oryza sativa)
  misc_feature (71): n=t or c
ttatttattcagatgtatgggggccggcctccacctcttttggaggaaagaaattttatgttagcttcatngatagctatcgcaagttttcttggatatat

SEQ ID NO: 3673 - DNA, 101 bp, rice(Oryza sativa)
  misc_feature (71): n=t or g
caacatagtgtttgaggacgacaggtaattaatccacaagttcttattccagtgaggctacctaggtatanatagtttgtttcaatatatacattattcca

SEQ ID NO: 3674 - DNA, 101 bp, rice(Oryza sativa)
  misc_feature (71): n=a or c
aataacatgatcggaaatattccgctgtaacacggtgtcactacggtggtttacatcaccactgacggacntatataccatcacttgcgatgtgtttggtt

SEQ ID NO: 3675 - DNA, 101 bp, rice(Oryza sativa)
  misc_feature (71): n=t or c
ttaggaaacagaggaacccgatcagatctcatcgcttagtttccaaatcgttggttcttcctcctcgtgcntgtgctgcttcggttttccccggttctgat

SEQ ID NO: 3676 - DNA, 101 bp, rice(Oryza sativa)
  misc_feature (71): n=t or c
cccaactagctaatgtggaattgttgatttgaacttttgttttgtatcgtgtcagctagtctatgtttttntctctctctctctctgtgtaatataaacta

SEQ ID NO: 3677 - DNA, 101 bp, rice(Oryza sativa)
  misc_feature (71): n=a or g
cttctccttgcctaacatttcatcaaaatgcctcatgagttcacataaaaaatattgacatttgccatggnagccacaagggatcctttgtttgtgctaag

SEQ ID NO: 3678 - DNA, 101 bp, rice(Oryza sativa)
  misc_feature (71): n=a or g
attacgcagtcaaaacgctccatttgttgatgtctgatcaatgagggaagatttattaagatcgaggtcancacactatcagttgttaatacagactgatt

SEQ ID NO: 3679 - DNA, 101 bp, rice(Oryza sativa)
  misc_feature (71): n=t or c
ttgtaagaagctttttgtgatctgaaaacacagagctcaacgtgccgatttgttatgtcattttattattntgatgtgatcttcattcccgagaaatatgc

SEQ ID NO: 3680 - DNA, 101 bp, rice(Oryza sativa)
  misc_feature (71): n=t or g
gaggcgggccgccttttatggggggattgtgaactggtgattagagggtttcggcgtagtaacagattttnttttttttttttgcctttttatgttgcggc

SEQ ID NO: 3681 - DNA, 101 bp, rice(Oryza sativa)
  misc_feature (71): n=a or c
tgttgcctctggtcagtcgccacgattgccggatcggcagtttaattaggattgactaggtatattccaantgaatctgaatctgaatctgaatctcatag

SEQ ID NO: 3682 - DNA, 101 bp, rice(Oryza sativa)
  misc_feature (71): n=t or g
gtgacatagggtgatccggcagtacggtatgactgcctgttcaagtgcccagttagcagcattgtcccatntatcgctgctggtatgcctcatgaactcgt

SEQ ID NO: 3683 - DNA, 101 bp, rice(Oryza sativa)
  misc_feature (71): n=a or c
aatacaattgcgctgaagtggctacgaaaatatttttattgtaaaactattcttattattatttggacctntgctttgttcgcttatagcctagggattgc

SEQ ID NO: 3684 - DNA, 101 bp, rice(Oryza sativa)
  misc_feature (71): n=a or g
gcatcaacatcaaatggacatagctgctgatccagaaggaatctcagctcccatcagtacttgttggaaancgtatggagtctactttcagatggttttgg

SEQ ID NO: 3685 - DNA, 101 bp, rice(Oryza sativa)
  misc_feature (71): n=t or c
aatctaatttagagaaatattgtgcccctgcaagttcatccagcaactcatcaataattgggaggggaaanttgttcttcatagtaatagaattcaacttc

SEQ ID NO: 3686 - DNA, 101 bp, rice(Oryza sativa)
  misc_feature (71): n=t or c
gctctggctgtggcaagagttctgtgagacacttgagagtttagagctaatagaagcctctcaggtaatanatagaaccttgtcctttgattttattgagt

SEQ ID NO: 3687 - DNA, 101 bp, rice(Oryza sativa)
  misc_feature (71): n=t or c
tgcccagccccaatagcataatctccctccgagcagacatcaggcaattcttcgtctgcgacaaagaaagntgcgacatggcccaatccctcgaggccatc

SEQ ID NO: 3688 - DNA, 101 bp, rice(Oryza sativa)
  misc_feature (71): n=a or g
tccttcatctaaaaccgtagatatgaggcttactctcccaccctctcatgtagctaaaaattaaaaagcgntatctataatcttgtattggtgcggcagtt

SEQ ID NO: 3689 - DNA, 101 bp, rice(Oryza sativa)
  misc_feature (71): n=t or c
tcctgaatgacgattttgcaaaacaaaaattgtttacgacgatcgaggaggataagtattagcattattanatatggtggtgtaattaaaaaggtacgatt

SEQ ID NO: 3690 - DNA, 101 bp, rice(Oryza sativa)
  misc_feature (71): n=t or g
gccgtgtcttccatgggcgccggcgacaagcagatggacctggagctgcatctctagatcgacgacagtanatttccatgaattcatcttctagctatcat

SEQ ID NO: 3691 - DNA, 101 bp, rice(Oryza sativa)
  misc_feature (71): n=a or g
attattggttgtgcggttcaaatattcgagttccgcttcatatttgagttcacgattttattcatgtttcnttattttgttgaatgttctatttaaattat

SEQ ID NO: 3692 - DNA, 101 bp, rice(Oryza sativa)
  misc_feature (71): n=a or g
ggaaaagctcacagaatctgaacgatatgttcaggaacatgaatcttgtgaaagcaagtacaaggcctgcnctgaagataggaagagatttgaggaccttt

SEQ ID NO: 3693 - DNA, 101 bp, rice(Oryza sativa)
  misc_feature (71): n=a or g
tgtgcttgctccaaatgtgattgttgctgaccctgggattctcactccaatcgaacaattggatgtaaacnttagggatgctgctacaagggagtatttgt

SEQ ID NO: 3694 - DNA, 101 bp, rice(Oryza sativa)
  misc_feature (71): n=a or g
ttaaggaaagaggtcgatcaaccaatggaagtttatctagaagcgacctaatccaagaaggaatcatgaanaccatggcatagcagtttaattctatctat

SEQ ID NO: 3695 - DNA, 101 bp, rice(Oryza sativa)
  misc_feature (71): n=a or t
ttgcgacggagttaccggtgggtaaatgcaaaaataacgaccacacaattagcaccaccgtccaaacccanttctttatgttgcaccgttaaccacccaga

SEQ ID NO: 3696 - DNA, 101 bp, rice(Oryza sativa)
  misc_feature (71): n=a or g
tctagtttgttcagtagcagatccatcagcacacagcctgtgatcacacatgtttagaccctgtttagatnggactaaaacttttaagtccctattacatc

SEQ ID NO: 3697 - DNA, 101 bp, rice(Oryza sativa)
  misc_feature (71): n=t or c
aatctgccttcttgtgtgcagtgcgctgccgccgacgtctggccgcctgcaccaacaattttaggttttcnacttgtgtaccttttttaatttctagattt

SEQ ID NO: 3698 - DNA, 101 bp, rice(Oryza sativa)
  misc_feature (71): n=t or c
gggcatgtacaaccaaccaacaaagctcgagtccaagctataaggagattccctgtgaaaacaatgaaaanaatgtaataatcttaaatcataaggaaatt

SEQ ID NO: 3699 - DNA, 101 bp, rice(Oryza sativa)
  misc_feature (71): n=t or c
atggtggggagaccttctaacgaaccggcccacttgcggatcagtccaaaaggcactgaaaatctctatcnctactctactatcataaaataaatggaaag

SEQ ID NO: 3700 - DNA, 101 bp, rice(Oryza sativa)
  misc_feature (71): n=a or g
ttgagaaggaatagttatttatttctgagagtgatagcatttatttggcaagtgaaattatgaaagaaaanataaaaacattaatatgtagaagtttctaa

SEQ ID NO: 3701 - DNA, 101 bp, rice(Oryza sativa)
  misc_feature (71): n=t or c
aattctttttctacatcattaggactgcaatcatttttcctctccttcataaagaggttttttattcatgnattccaaagaagtccttaataacacgtgtg

SEQ ID NO: 3702 - DNA, 101 bp, rice(Oryza sativa)
  misc_feature (71): n=t or c
catttaatttcctcctctctcaaaatagatgataatctgttcctgtaaaaccatctaatatccaattcttncggactcaaaagagaagtttcagccttttt

SEQ ID NO: 3703 - DNA, 101 bp, rice(Oryza sativa)
  misc_feature (71): n=t or c
gattccgaaatacaggccactttaaattatgggatacttcccatttcattgaattttgttgtcatctcacnagtttgtgacgtcacaattttgttttcatg

SEQ ID NO: 3704 - DNA, 101 bp, rice(Oryza sativa)
  misc_feature (71): n=a or g
gaaacggaacaagagtaccttttatgactctccacatcaggcctcctagccaggatcaaagaggagggttnggctttggacccttgcgcgcggaggcatat

SEQ ID NO: 3705 - DNA, 101 bp, rice(Oryza sativa)
  misc_feature (71): n=t or g
tgatccactatatagtcaatattctcatgcatcaacatacaccagtactgaatatatgtaaagattatggntaccccatacccgcacggcgtggttatccg

SEQ ID NO: 3706 - DNA, 101 bp, rice(Oryza sativa)
  misc_feature (71): n=t or g
acttgggacacaccggcttgtgtgtggattaggggaggcgatcttggattaaatatggatagttggatttnaggaatgaagaattaatgagtaagagcagt

SEQ ID NO: 3707 - DNA, 101 bp, rice(Oryza sativa)
  misc_feature (71): n=t or c
gaaaataagatcactgaagattctgtttagactaaacagagttgttttcttttgaaaaaaaggaattttantccaaaagctttggaaaacatttcaaacac

SEQ ID NO: 3708 - DNA, 101 bp, rice(Oryza sativa)
  misc_feature (71): n=t or c
aaagtctttgagcaccatcttagtcttgatgagatcatctgaattcttccctaacttcctgaaggtagaanaaggcatcaagttcacagcagccccaccat

SEQ ID NO: 3709 - DNA, 101 bp, rice(Oryza sativa)
  misc_feature (71): n=a or c
tttagagtatattgacttgcttctggtgtccaggatgacaacaaaatatgagtcaggatttgaaccaagcntgcatgtaaattcccctagtttccatggtg

SEQ ID NO: 3710 - DNA, 101 bp, rice(Oryza sativa)
  misc_feature (71): n=a or g
aaatcaaaagaaatcaacctccagaaagaaaaaagagtttgcgtttacaaaattatcaatatatttcaaanggcagctcatatcgagaggaacatgtggtt

SEQ ID NO: 3711 - DNA, 101 bp, rice(Oryza sativa)
  misc_feature (71): n=t or g
cgtaacacttgtctcttcagttgatgcgtattgtgcaaaagacgaacatgtctctgaacactaacaaccanttgtttaaccgtcatgaaatttcgcataat

SEQ ID NO: 3712 - DNA, 101 bp, rice(Oryza sativa)
  misc_feature (71): n=t or c
acacgccattgacgtataccttaagctaattcaaagctttgagctttgcacttggctctcggctcggctcntaccgtgtggtactgtgtgtttggacgtta

SEQ ID NO: 3713 - DNA, 101 bp, rice(Oryza sativa)
  misc_feature (71): n=a or c
attcgccacgagataccaaccaaatttcgaaattttgtttaccccccaactcttccacccacaaaaagccnccagatcgccggcgccccaacgcctccacc

SEQ ID NO: 3714 - DNA, 101 bp, rice(Oryza sativa)
  misc_feature (71): n=a or c
gtgttcaactcattgtctctgctagctgaacaatgatataacataagcattcctatttacaattccaggantattatttttccctttcatatgttgactga

SEQ ID NO: 3715 - DNA, 101 bp, rice(Oryza sativa)
  misc_feature (71): n=a or c
gccccccctttgttaatgtaaacaatagttaatccaaatcatggtctccctaaatataatagcaagactgnaagagagagagagagagagagagagagaga

SEQ ID NO: 3716 - DNA, 101 bp, rice(Oryza sativa)
  misc_feature (71): n=t or c
gtacctcgtatgccacttagactaagaacatgtgagttccacggcgcaaaccactcatagtaggtcccacnagtactactttacttttcacttttcccctt

SEQ ID NO: 3717 - DNA, 101 bp, rice(Oryza sativa)
  misc_feature (71): n=a or g
ttcccggacattattccgtgcggtcatttggcctgcatgcacaccgctgtctgtgaaaatcaatattttcncgtgcgggcaggaggaccgcacgggataat

SEQ ID NO: 3718 - DNA, 101 bp, rice(Oryza sativa)
  misc_feature (71): n=a or g
accaggacaaggaactctttgcaacttcaacatcggtgctcattggagatggaaagaaaagcatccttctnggaatccccgtgggcatcctgtaccacact

SEQ ID NO: 3719 - DNA, 101 bp, rice(Oryza sativa)
  misc_feature (71): n=t or c
ttggacttacactgctacctttaagtaacaatcatgagcaatagtgttgcaatgatatttaggctgcattngtttactctcttgatttccatgagcacgct

SEQ ID NO: 3720 - DNA, 101 bp, rice(Oryza sativa)
  misc_feature (71): n=a or g
caacagatgggatggggcatggctgaatttgattgtatgcatggttgtaggctcgtggatacggttgtcgncgtcatgggtgcagtatctgatgccacccg

SEQ ID NO: 3721 - DNA, 101 bp, rice(Oryza sativa)
  misc_feature (71): n=t or c
gaggaggaaggaaataagaagaggaagaaatgatgacgtggtcaccctgagtgtggggcacgcgtgggtcncatgccaagtcatatgccacgtcggataaa

SEQ ID NO: 3722 - DNA, 101 bp, rice(Oryza sativa)
  misc_feature (71): n=t or c
ccttaattactctaattaaatttgtctttagagttgtaactatgtcagggaacagtgtggaatatggacanaaaaggacttgggcatcatatctacaaatg

SEQ ID NO: 3723 - DNA, 101 bp, rice(Oryza sativa)
  misc_feature (71): n=a or c
atctaatcaagactcatttttttccattgtaactttgtaagtgctgttatagatgcccaaaccggccgccnggcccggcatggcccaggtatggccaggcc

SEQ ID NO: 3724 - DNA, 101 bp, rice(Oryza sativa)
  misc_feature (71): n=a or g
acttgccaaataggccatggacagccaatctgggtcactcatgcatcagctgaaaacaaagaggtgacaanggtgatttatgccttttctgtatggtcagg

SEQ ID NO: 3725 - DNA, 101 bp, rice(Oryza sativa)
  misc_feature (71): n=t or c
cgtgacactgccgatcgagattggaaggcatcaggagttggagcttgcgattaatctcatatacgtccacngtctggatcgtccttccgtcatgcctaggc

SEQ ID NO: 3726 - DNA, 101 bp, rice(Oryza sativa)
  misc_feature (71): n=t or c
aaagagtgacttaggtgctaacatttcccagtggcgatggtcaggataagacttctatgcaaccgcagtcngccgactaatcttttggcagaaaaagaagg

SEQ ID NO: 3727 - DNA, 101 bp, rice(Oryza sativa)
  misc_feature (71): n=t or g
atattttctaaaccgtcaactattacttggtcactgtcggcaaaagaaattcaaatcttgtagtgctcgtngcatttgcctgcatgtgtctccgagaggca

SEQ ID NO: 3728 - DNA, 101 bp, rice(Oryza sativa)
  misc_feature (71): n=a or c
ctatctccagcacaaccacatattagcaaggaacgcgcgaaaagcaacgagatctagacctagaccagccncctcctcctcctccaaacgaaactctcaac

SEQ ID NO: 3729 - DNA, 101 bp, rice(Oryza sativa)
  misc_feature (71): n=a or c
ccatcttccacgacacgcagatcctcgacttccacccgtacaagctctacggtatccaccgcctcgatcgntcgatctccctctctctctctctttgtcga

SEQ ID NO: 3730 - DNA, 101 bp, rice(Oryza sativa)
  misc_feature (71): n=a or g
caattcaatcctcacaacaagaagatgaaatgtgggaataaatcgtggcttgatttttgatttatacctcnttctggggcccgatgatcctggtgaactcc

SEQ ID NO: 3731 - DNA, 101 bp, rice(Oryza sativa)
  misc_feature (71): n=a or g
attgggacattgaaactttcctagttagcctagctgcctgcataaatgtagctctgtactaatcacaaaangaaaaaagaactttttggtgttttgacagt

SEQ ID NO: 3732 - DNA, 101 bp, rice(Oryza sativa)
  misc_feature (71): n=a or g
tctgtgccggctctctctccttctctaccgcagtgtctcggtcgctagcacgcggtggtagcatgcaacancgtgcagcggtgggagggaggcggtggtag

SEQ ID NO: 3733 - DNA, 101 bp, rice(Oryza sativa)
  misc_feature (71): n=a or g
ccctccatcattggcattagcgtcctctcctctattcctcactttccttcataactatgcacatgcctagntggaagcgctagtaatggaggaatcacggc

SEQ ID NO: 3734 - DNA, 101 bp, rice(Oryza sativa)
  misc_feature (71): n=t or c
ttgaggaggctattgtacattgtgaaatgtcgaggagtgtcgagtgtttgatgttgtagttcaggtaactngaactgtctttaataaataatttgtacctt

SEQ ID NO: 3735 - DNA, 101 bp, rice(Oryza sativa)
  misc_feature (71): n=t or c
attggtctattgggaaatcatttttgtaacttcaatcggcaagtatgtgtatatgctcttgatgttttcgntttgatgtggggagaaagtagattcaatgt

SEQ ID NO: 3736 - DNA, 101 bp, rice(Oryza sativa)
  misc_feature (71): n=t or c
cagattgaagttgcgcagtggttgcaccgatggagctgtgagcctggtgtggtgtcatcgatgcttggaangttggccctggggtgatgtataggatcaag

SEQ ID NO: 3737 - DNA, 101 bp, rice(Oryza sativa)
  misc_feature (71): n=t or c
cctggttgggataaaatcttcccaagcaaacagaattagtctaggttaaattgaggagtttagcactaggnaatcttaataccattggatggtctctccta

SEQ ID NO: 3738 - DNA, 101 bp, rice(Oryza sativa)
  misc_feature (71): n=a or g
agcaatggcggcgatcgccggagatatgcacacacgcgcacctgtagtccaacgtgacggtggcctccgcngcgtcgaggtcgatcttgctccggcgagac

SEQ ID NO: 3739 - DNA, 101 bp, rice(Oryza sativa)
  misc_feature (71): n=t or g
tgactgggccatagattttgctgaaaagggccgagatggcatccaaatgcccaactgctaggcccagtccnattcttttaatgcatgggcctcttggtcca

SEQ ID NO: 3740 - DNA, 101 bp, rice(Oryza sativa)
  misc_feature (71): n=a or g
gcaggcggactaaaattttatacccaaaacaccgcctgcattgttatggatggggatacggtgaccatccnaatacatcttcgcaggcgaacgacttaagt

SEQ ID NO: 3741 - DNA, 101 bp, rice(Oryza sativa)
  misc_feature (71): n=t or c
tctgtaggacgataccggattcccctccatgtcgagtaaactgaagatggccttcgcctccacggcctcgntgcaggcctcggcgtcatcgaggcagaggt

SEQ ID NO: 3742 - DNA, 101 bp, rice(Oryza sativa)
  misc_feature (71): n=t or c
catctagaccagtaagaacttttggtgacgagtgcttgacttggggtcatgtgaagttgatcaaaagggangaatttgagaagtccgacgatctcagggac

SEQ ID NO: 3743 - DNA, 101 bp, rice(Oryza sativa)
  misc_feature (71): n=t or g
ggcttattaatgataaaaaataatttatgcgtaaaacttttacacatgtgtcctttgatttaaaaacaatnctaaaaaaaactatgttgaaaaaatgggca

SEQ ID NO: 3744 - DNA, 101 bp, rice(Oryza sativa)
  misc_feature (71): n=a or c
atgttccatgtagcaatattagcaacaaagagtataattagacacaaagttgatgtggacaaaattagtcntagcaaaatattgtcctatttatacttttc

SEQ ID NO: 3745 - DNA, 101 bp, rice(Oryza sativa)
  misc_feature (71): n=a or t
ctccactattacatcctagatacgtgtgggcccgcttctcatttctcaaatatcagtagttctattttttnaaaaaaaatgattgacaacatatataagga

SEQ ID NO: 3746 - DNA, 101 bp, rice(Oryza sativa)
  misc_feature (71): n=t or c
gaatatctcaatgatgactactttgccgttgctgcccatgtaatcatcccaaagaaaaagccatctgtcgncgtaccaccgtcgaacatgcatctgtattt

SEQ ID NO: 3747 - DNA, 101 bp, rice(Oryza sativa)
  misc_feature (71): n=a or g
atagtaacccccggtctaaaacttaaaataattaggtgttacattattgagctgatgagctgattaactancaaactaatacatagaataattgataaata

SEQ ID NO: 3748 - DNA, 101 bp, rice(Oryza sativa)
  misc_feature (71): n=t or c
tctcatatagaaccagttactacaaaataatatgatatatttggaataattgggacatgtcagcagaactnaccatatgccctattacatgaattggtgtg

SEQ ID NO: 3749 - DNA, 101 bp, rice(Oryza sativa)
  misc_feature (71): n=a or t
gtgctttcatgatgatggtttgcggaggtttataagagggcctatgctgtatgcgtgtgtaactctatttnggttgatcgatccttctgatgaaaacgtta

SEQ ID NO: 3750 - DNA, 101 bp, rice(Oryza sativa)
  misc_feature (71): n=a or g
tcgccaacctcccgtcgtcgactgtcacagattaacattagaacattatgaccatgaaccgtcactatccnattttatcatctagctagcttcttcgtttg

SEQ ID NO: 3751 - DNA, 101 bp, rice(Oryza sativa)
  misc_feature (71): n=a or g
tggttgggacgcagggttatatactgtccgatagcggaggaaactgccgaagaagatgggaagaccggtgngatgtgggaatcgcaacaagacaacagaga

SEQ ID NO: 3752 - DNA, 101 bp, rice(Oryza sativa)
  misc_feature (71): n=a or g
cttattcgaacccgctacccgtaaaaacttccgggtacccgaatttttgatccgaaattatcccaaaatantatggccgggcgggcgggcgggaaataccc

SEQ ID NO: 3753 - DNA, 101 bp, rice(Oryza sativa)
  misc_feature (71): n=t or g
tcgagggtggtgaaggcggctctggtctcggacatatggttggtgtcattagtgtcgaccacccaatggtngtcttccttctgtgccacatccccgatctg

SEQ ID NO: 3754 - DNA, 101 bp, rice(Oryza sativa)
  misc_feature (71): n=a or g
tttcttttgcaacttccaatgctctctacgtatctgacctaaacgacaaccagtgtaccactaaaatatanacttgactgtgtttttgtagggtatgtcct

SEQ ID NO: 3755 - DNA, 101 bp, rice(Oryza sativa)
  misc_feature (71): n=t or c
gaatgtctattgaactggtactaatctgatttcaaacaatccaggaacttccataacattggcgtctcgtngcaaggctcatttttagttttgggtcatag

SEQ ID NO: 3756 - DNA, 101 bp, rice(Oryza sativa)
  misc_feature (71): n=a or g
ttgtagtttctttgctaataaaacaagtcacgataaaataaagaaaagtccgatttacccataaaaaatcntggtagatcaaattacccctaaactcgaaa

SEQ ID NO: 3757 - DNA, 101 bp, rice(Oryza sativa)
  misc_feature (71): n=t or c
ataaatcaagaaaaaaatatttacttaatttttttaatagtatgagtagtatgtaaaaagtcaacagcgtnagcgtcgtatattaagaaaggaggtagtat

SEQ ID NO: 3758 - DNA, 101 bp, rice(Oryza sativa)
  misc_feature (71): n=a or g
aaccaaagccacgatgtcttcgtgtaaaatttacctcaggagaaaatcatggtcgagttctacacggccanagtcatctgcctaaaatgggcctaaagcta

SEQ ID NO: 3759 - DNA, 101 bp, rice(Oryza sativa)
  misc_feature (71): n=a or c
atcgcttgccaatatacctgtgaaactccatacagtccaaacagggctaggtgcgtagaaaataacaaagnaaagtaacagaaaattgtcacttatgaaac

SEQ ID NO: 3760 - DNA, 101 bp, rice(Oryza sativa)
  misc_feature (71): n=a or g
gctacttatataagttgtgtcaagatagatggaggtctagcttgatttctcctcttgtgcagtactaatcnagtactgaatggcgtttacttcaaacaata

SEQ ID NO: 3761 - DNA, 101 bp, rice(Oryza sativa)
  misc_feature (71): n=t or c
gtcggcttaggtacgatggggatgagaaacgtacggccgtgataggttgaatgggtggtcacaactaactntaaatgggcacttggattcacttcaaagac

SEQ ID NO: 3762 - DNA, 101 bp, rice(Oryza sativa)
  misc_feature (71): n=a or g
tggtaattgtgctaccagtgctacacatcagcgtgtggagttccaaactattgtttattcgctgggaattntagtcagaggagtacttgcaagaattaaga

SEQ ID NO: 3763 - DNA, 101 bp, rice(Oryza sativa)
  misc_feature (71): n=a or c
ctgctcctttagttaaaaaaaacttttaatcttcacgttagcaaactgatcgattttgcacaaagagaaanggggaggtgtacgcgtgcatgtccgtgtgg

SEQ ID NO: 3764 - DNA, 101 bp, rice(Oryza sativa)
  misc_feature (71): n=a or g
aaacatgcaatttaactcccagttgatcttttgtttataataatatctcaaatagatgtgcacgcctgaantttctctatgaagaacagaagataattcat

SEQ ID NO: 3765 - DNA, 101 bp, rice(Oryza sativa)
  misc_feature (71): n=t or c
acaagcctaggagtttttgcaaatcttgtttcgccgcgctgctgtgagctaagctagcgtccctcacctgnggcttatataaagctcgcaggatggctggg

SEQ ID NO: 3766 - DNA, 101 bp, rice(Oryza sativa)
  misc_feature (71): n=a or g
gggagccggccggtgagcttgttggtgtacagccgcagcgtctcgaggctcgtgaggttgccgatcgtgcnggggatcgcaccggcgagcttgttctcggc

SEQ ID NO: 3767 - DNA, 101 bp, rice(Oryza sativa)
  misc_feature (71): n=a or g
agaacatgggggcagaattaggatcaattttagccattttgttcagttgtgtggactctccggatcaaatnatactagtacgtcgaatcgcaacagtaaag

SEQ ID NO: 3768 - DNA, 101 bp, rice(Oryza sativa)
  misc_feature (71): n=t or c
atggaagaattctagtaaaaagatagaatgggtataatgattaaatctgtaactctgtagcctcatccaangcttatctgctaataataatcaaggatagt

SEQ ID NO: 3769 - DNA, 101 bp, rice(Oryza sativa)
  misc_feature (71): n=a or c
gaagaaaagccggaaaggtctcggtatgcgagtaccctttttcacacgtatccgaggaagggtaaaaatgngattagggcatctccaatgtttacgatcat

SEQ ID NO: 3770 - DNA, 101 bp, rice(Oryza sativa)
  misc_feature (71): n=t or c
atcaatcaatcttatacatcgatacatgctcaatggtgcatatccagcgaaatcccctcgctcatccgcgncgttgtgcgccacccgcgccgtagccaacc

SEQ ID NO: 3771 - DNA, 101 bp, rice(Oryza sativa)
  misc_feature (71): n=t or c
ctgccctctacccccaaaagattatgctccatcaaatttccgcagaactgatctgcttctgctcacaaatncctcctcttctgacctacctcgccgccgtt

SEQ ID NO: 3772 - DNA, 101 bp, rice(Oryza sativa)
  misc_feature (71): n=c or g
tccctatcatatgaaattactgattcatttccatactgactaacttctattgccagtgggacaagagatcngggatagatttaccggtgctgttgaggcct

SEQ ID NO: 3773 - DNA, 101 bp, rice(Oryza sativa)
  misc_feature (71): n=t or g
cgtgcaagagagtattagggggaggaggggcagagagcagggtgtgcggtggataggtgggtcctatatanagagagagagagatgcggaggaatgagaga

SEQ ID NO: 3774 - DNA, 101 bp, rice(Oryza sativa)
  misc_feature (71): n=t or c
tctttgcttttgcaaaaatatatatacatgcatatagtgcatatgcttttgtctgtgctctttcggatgtncttaaatcttaaattctttagtcttttttt

SEQ ID NO: 3775 - DNA, 101 bp, rice(Oryza sativa)
  misc_feature (71): n=t or g
aataagcggcgaaaaggcctatcattgtgtttagtaaaattaatagattcgaaactgttgaattaatgtgntctaaggttcacatatatgaagattaatat

SEQ ID NO: 3776 - DNA, 101 bp, rice(Oryza sativa)
  misc_feature (71): n=t or g
ccaagctcatctccccgcacgacaagctctcccaccacgtcaacgagctcgtcaagggcgtcatcgagggngagacccgcgtgctggccgcctccatgacc

SEQ ID NO: 3777 - DNA, 101 bp, rice(Oryza sativa)
  misc_feature (71): n=t or c
aaaaagaatcgctagggcccactcgtcagaatccccacccacctctctcttctccatcccttctaaagcangcggcggccggcgaaagggtgcgacgcgac

SEQ ID NO: 3778 - DNA, 101 bp, rice(Oryza sativa)
  misc_feature (71): n=t or c
ggtgtgaatagactcccatagaaccgcgatgccggtaccaatcctaagacacgactgctggtacctgcggntaactcgagaggaatcattgcaattaataa

SEQ ID NO: 3779 - DNA, 101 bp, rice(Oryza sativa)
  misc_feature (71): n=t or c
ctcatctcctccatcctaaccctgttgagaaaatcaaagtaggacacctccacgctatacaagtgggatgntatgtggctcatctgccttgagatgacttc

SEQ ID NO: 3780 - DNA, 101 bp, rice(Oryza sativa)
  misc_feature (71): n=t or c
ttgcttcctcagcctgtacaaagttccaaaattcccagtgatgatggtgatcaccaccaccgaggatccgntcaaaatcaacccccgcccaaccacatcaa

SEQ ID NO: 3781 - DNA, 101 bp, rice(Oryza sativa)
  misc_feature (71): n=a or g
tggacaaacattgtttaattgaaagaccctgttgctgcttcaaaatcgaacatcagtttgtaggataaatnagcatctattttcaaactagcaatatgaac

SEQ ID NO: 3782 - DNA, 101 bp, rice(Oryza sativa)
  misc_feature (71): n=a or c
agatcttgagttcttgaagcttgtgaagcatcatcaaggatgctgaatcctgagcactctttttgtcagtncgtcgctcaccttgaaatgtaatggttgtt

SEQ ID NO: 3783 - DNA, 101 bp, rice(Oryza sativa)
  misc_feature (71): n=a or c
tatgtgtccataaactttgcacttggcaccggtgcagaaatccccatgtttgggtcattgatattgcaggngtagataaccaaattacctgtttatatgtt

SEQ ID NO: 3784 - DNA, 101 bp, rice(Oryza sativa)
  misc_feature (71): n=a or g
gtaccccttcctagttcgaattgtacataaatgctactccatctgtttcatattgtccatattcatatagntattaatgaatctagacacatatacatgcc

SEQ ID NO: 3785 - DNA, 101 bp, rice(Oryza sativa)
  misc_feature (71): n=t or c
cggccgcctcgccagctgcgactgcatccgcacgcacatggaggcgcagaaactgatccaagagcatcatnaaaccctaacgactcgacctgctgctacgg

SEQ ID NO: 3786 - DNA, 101 bp, rice(Oryza sativa)
  misc_feature (71): n=a or t
ttgcgttaacaatttttttgggtgcaaattcagtgctcgctgggtacttaagaatgactgatgtttttttnaaaaaaattatttaacccataatgctatgg

SEQ ID NO: 3787 - DNA, 101 bp, rice(Oryza sativa)
  misc_feature (71): n=c or g
tgattaatcggtttattaatttgtgttaacacgtttgctgacctgtgttgtgtgactgacctagctaagcnttgcacatgtgatgtgttgatcacttctag

SEQ ID NO: 3788 - DNA, 101 bp, rice(Oryza sativa)
  misc_feature (71): n=t or c
attaatttcttaggcagtgtgtggttacaacttacaagcagtgctgaatttgccgaggtgtggattcttangaacgttggtgtttggcattctacacgatt

SEQ ID NO: 3789 - DNA, 101 bp, rice(Oryza sativa)
  misc_feature (71): n=t or g
actaatgatgacaaagaaactaagctcatcacatcaacataataccattgttttttagatgttttgtgatngacacaattgtgatgaataccattgtgtcc

SEQ ID NO: 3790 - DNA, 101 bp, rice(Oryza sativa)
  misc_feature (71): n=a or c
ccgttcctgggctcttcttcctcttccgcttcgtcgcccctctcttacctgaccccgcctaggcctcctcntcctcctcctccccttctcatggtacgtca

SEQ ID NO: 3791 - DNA, 101 bp, rice(Oryza sativa)
  misc_feature (71): n=t or g
agtcttctcttcctcatatgtctgaattttgattctcgatagttcggtccgatgatatcgttaacacaaantggttttatatgtaagtttcacgttttgaa

SEQ ID NO: 3792 - DNA, 101 bp, rice(Oryza sativa)
  misc_feature (71): n=t or g
tgatcgaggagaccattcaatgaattgaacaaagtcgcgtggagaatctgttcaaaattacagtgagttangattggaggtagaaaaactcgtatataaac

SEQ ID NO: 3793 - DNA, 101 bp, rice(Oryza sativa)
  misc_feature (71): n=t or g
tctccaacctcaacgcgcgagacggccacaggggaggtaggtttcgatgatctcatcacctgcggcgatcnatcgatctcagctcgtcagcttccgatctc

SEQ ID NO: 3794 - DNA, 101 bp, rice(Oryza sativa)
  misc_feature (71): n=a or g
ctctgtctctgcgcgcgtatggaacacgtacgtagaacaaaacgccgcgcgtgcgtgacagtggtggctgngcgagcatggtggagccgtgtgcggtgtgc

SEQ ID NO: 3795 - DNA, 101 bp, rice(Oryza sativa)
  misc_feature (71): n=t or c
tgttgttgctgtgaccggtgggggcaaagagctaggggtatcgctgctttgtttttttacaacataggagnctgtaagtccgaacatggagaattttaaaa

SEQ ID NO: 3796 - DNA, 101 bp, rice(Oryza sativa)
  misc_feature (71): n=a or c
gtaaacaaaaacatatatcacttgatatctcgaatatgcaatactgaattcgatctatatacagggtttancttattgtttgggatgggttatcacctccc

SEQ ID NO: 3797 - DNA, 101 bp, rice(Oryza sativa)
  misc_feature (71): n=t or c
atctctacacgtatgatttttatatgattctatatacgactgtgcacacctatagaatatatctcttgttngtggatgaagcaagtacagtgtgtgtgtga

SEQ ID NO: 3798 - DNA, 101 bp, rice(Oryza sativa)
  misc_feature (71): n=t or c
cttcaacctcagctcctcaaagaacctcctcctggaaccggaccccgcgccaggggacaagttttcgccancatcgtcgtcggtctcagcccggccgggcg

SEQ ID NO: 3799 - DNA, 101 bp, rice(Oryza sativa)
  misc_feature (71): n=a or c
tttagtaaattagcctgttttgttgcgattttataaatttagtaatttagattcagggggctgctatatancggaatcccgttgggatactgtcccaacgg

SEQ ID NO: 3800 - DNA, 101 bp, rice(Oryza sativa)
  misc_feature (71): n=t or g
catattgcggttgatttcgtgttgatttgattaccgtgtggttcttgttgtaccagtcgccgatgaagatngtgatgtcgccgtcggggcggccgaagggg

SEQ ID NO: 3801 - DNA, 101 bp, rice(Oryza sativa)
  misc_feature (71): n=t or c
caacttccacgcgcgcaacctagctagcaattctgcatgcaaatggcaagcaatctaagtggccacagagngatccacagtgtggccatagatgctgtcgg

SEQ ID NO: 3802 - DNA, 101 bp, rice(Oryza sativa)
  misc_feature (71): n=t or g
ggagggcctggacatggagaggcagttgctcacctaaagaagaggagagaaccgaaccggggatggcggcngcagcaagaaggaggcgaatggcgtgggag

SEQ ID NO: 3803 - DNA, 101 bp, rice(Oryza sativa)
  misc_feature (71): n=a or g
caagggttagaacttaggctgcgttctttttatgaagttgagaacttctcttctccacccataaaacgggntgattcattagcacgtgattaattaaaata

SEQ ID NO: 3804 - DNA, 101 bp, rice(Oryza sativa)
  misc_feature (71): n=t or c
agaaatgtttgagagtaattccttggcgttgtaattgaatacttcggggctattcagattgatgcaatttnaaaccataccattttttatgtaaaattacc

SEQ ID NO: 3805 - DNA, 101 bp, rice(Oryza sativa)
  misc_feature (71): n=t or c
tcttaacaagatggaaagtacagtttaaatcaagcgtttgtctgtttcttataacttgtacttcctccgtngcatttcaagcataaccataatttttcgta

SEQ ID NO: 3806 - DNA, 101 bp, rice(Oryza sativa)
  misc_feature (71): n=t or g
accacagggctcgatgtacattgtcgaggcatacaatgcaatactactaccttaattactgcctttccaanaaaaaaaaaatcattcactgcttgcaagta

SEQ ID NO: 3807 - DNA, 101 bp, rice(Oryza sativa)
  misc_feature (71): n=a or g
acaaactctttttcccatgcaactctgtgttgcctgttggacgtgtcaatgctacgaaagtgattttcacntgctgctaaattcggaccgtgtttagattc

SEQ ID NO: 3808 - DNA, 101 bp, rice(Oryza sativa)
  misc_feature (71): n=a or c
ctgcttctccagaatgcaccagccgtttgcatggacgcgtctctgtaaccaggtgccagccaagtcactantgtcaagagtcagcatctgtaattctcctc

SEQ ID NO: 3809 - DNA, 101 bp, rice(Oryza sativa)
  misc_feature (71): n=a or c
ggttgctgcacatgtgcgcaatatatagctaagctagctcacgtacgagtggcaacatcacgagagtggantctaaaactttcgagccaacttccccttat

SEQ ID NO: 3810 - DNA, 101 bp, rice(Oryza sativa)
  misc_feature (71): n=t or c
taatgactatttatcaagggtatgcatgtactcactcaacttcaaactagatactatggagtacatctgantatctcattttgaacaattggtgaagcgtt

SEQ ID NO: 3811 - DNA, 101 bp, rice(Oryza sativa)
  misc_feature (71): n=a or g
cctaatttatttctcgtaccctgcatattagttttcactatctttgttaattgttatagtttcttgactgntgatccgataactggtgggaaaggaacagt

SEQ ID NO: 3812 - DNA, 101 bp, rice(Oryza sativa)
  misc_feature (71): n=a or g
tctacgtctttgtatcatggcacctattatttgcgtgcgtctctaatagttaaagaagaagctaaaaaatnatagtataattgggatgaaataagtctata

SEQ ID NO: 3813 - DNA, 101 bp, rice(Oryza sativa)
  misc_feature (71): n=t or c
aggaggacgttcgttgcccccggataccatcaccctaacatggcttcctataaggctatgtattaaccaancactcacccactcatcactgtgacttcacg

SEQ ID NO: 3814 - DNA, 101 bp, rice(Oryza sativa)
  misc_feature (71): n=t or c
ctcctactctcctagattagtcaacggtttgagtttgagacaagcaggtaatgtgattttttttcgattanatggcagaagtgcgcacacatcactatatc

SEQ ID NO: 3815 - DNA, 101 bp, rice(Oryza sativa)
  misc_feature (71): n=t or c
ttgctgacaccgttgacatagtgacggtatggtacagcacggagcttaaaacgcaatttattcaccatagnacatggcctacaataatttcgacttatata

SEQ ID NO: 3816 - DNA, 101 bp, rice(Oryza sativa)
  misc_feature (71): n=t or c
ccttataggtgccgattttttaaataaaacgacaccctaaactgttgagccgagtcgatcgaccgagtccnttcgtccttatcctctcctcaccttctcct

SEQ ID NO: 3817 - DNA, 101 bp, rice(Oryza sativa)
  misc_feature (71): n=a or g
atgaaaggaaaaaagatatcattcattcttaatgataaaatgacaagggaaacagctgaaggatgaaagangacaaaattttgctttgagagataaaatgt

SEQ ID NO: 3818 - DNA, 101 bp, rice(Oryza sativa)
  misc_feature (71): n=t or c
tattcccgtccacatggtttcatctcgccagtgtaccggctcctatggtacttgctctaatgtttactccnttcgttctataagagcaagtataatagaca

SEQ ID NO: 3819 - DNA, 101 bp, rice(Oryza sativa)
  misc_feature (71): n=a or t
tcgctattgccgcgggcgtacgtcggcttcggcgaactaattgctgcgtgcaccaagggttgttttttttnaaaaaaaaaagttacacagtacaacacact

SEQ ID NO: 3820 - DNA, 101 bp, rice(Oryza sativa)
  misc_feature (71): n=a or g
tatggagattttgtgttccagggtttgtcatatcaagtgatcagagcgaattaaactttttacactattgnatacctgtgtgcatgtgtggttcatcctat

SEQ ID NO: 3821 - DNA, 101 bp, rice(Oryza sativa)
  misc_feature (71): n=a or t
tccctttaaaccttcctacagctcacaatccccaacccaaaggctcccagcaccaaaatctccaccaaaantctcctcctggaagaaccacttcacttcac

SEQ ID NO: 3822 - DNA, 101 bp, rice(Oryza sativa)
  misc_feature (71): n=t or g
ttatatatgacagcagcaaatcgattttatccgccgcaccttttgccgctcttcctcgatgaccgatccgncgttccggcgctaagcacatgcatctcccc

SEQ ID NO: 3823 - DNA, 101 bp, rice(Oryza sativa)
  misc_feature (71): n=a or c
ttaggaggggcaagcgggtgagcggtagagtttaccttaaacgagacgaagtttccttttttaccatgctntctgacaggggcggaactgggcctagggca

SEQ ID NO: 3824 - DNA, 101 bp, rice(Oryza sativa)
  misc_feature (71): n=a or g
gtaggagctttgcttttcattgaagcagggcgaatgaaagtaaaagagagaataaaaaacaaaagctccancttatttttgagggtgagatacaatagaat

SEQ ID NO: 3825 - DNA, 101 bp, rice(Oryza sativa)
  misc_feature (71): n=t or c
cctgttatgatgcagatgatgcagaatatcatgtctgatccacagtccatgaaccaggtacggtatttctnaacttattttgttatataactttgatgatg

SEQ ID NO: 3826 - DNA, 101 bp, rice(Oryza sativa)
  misc_feature (71): n=t or c
aggggaggacgctgcagtgggacgtgctgacgaggtcgccgttcgtgaggaagctggtgtacatggtgganaggttcgtcgtggcggtgccccacaacctg

SEQ ID NO: 3827 - DNA, 101 bp, rice(Oryza sativa)
  misc_feature (71): n=a or g
aaaaataaaactaaaataaaacccctcaaaatcaaatatttttctggcaacgtatgtaaagccaacagggnaacaatgggagtgcatggcatcagccggcg

SEQ ID NO: 3828 - DNA, 101 bp, rice(Oryza sativa)
  misc_feature (71): n=t or g
tggatcgacctagctagccttttcatactgtgcactcaaaaccatacctttagtgtggaggataacatagnatcccactacaattccactgctataaaacc

SEQ ID NO: 3829 - DNA, 101 bp, rice(Oryza sativa)
  misc_feature (71): n=t or g
cagcatatttgtgaaatgtagattttctttagcagcgcattgcagggttatctgctcactagttgaaatgntgtgactggcaatgaaatttatgtcacagt

SEQ ID NO: 3830 - DNA, 101 bp, rice(Oryza sativa)
  misc_feature (71): n=a or c
agctgtcgtggggcgccatctggaggatggacaccgccacgccactcaaggcacccttctccattcgcgtnaccaccgagtccggcaagagcctcatcgcc

SEQ ID NO: 3831 - DNA, 101 bp, rice(Oryza sativa)
  misc_feature (71): n=t or c
ctgttgaggcgaatgccaacttgaccagttcccttgttgcttagattcgcatgaccaatcaaattgctagntcttccagcaggaatctgagactggatgtt

SEQ ID NO: 3832 - DNA, 101 bp, rice(Oryza sativa)
  misc_feature (71): n=a or g
aaaaaaaagttggtaccaatgtcgccctaaatctgtagtttcttaaatgaaacattaggtgagatggacgncacagtgctcccgtttatacatagtgagtc

SEQ ID NO: 3833 - DNA, 101 bp, rice(Oryza sativa)
  misc_feature (71): n=a or t
acggatagaaaagaaagaacttaaggtgaacgtgtaagctatatggcagttatctttgtgagaacaaaaantactactatatataatgggcgttacaatat

SEQ ID NO: 3834 - DNA, 101 bp, rice(Oryza sativa)
  misc_feature (71): n=a or c
gatttcaatcctatgaactccaccataaattcttcgattcaaatggatcctaaatccaaaaatgcttcctntgttttttcaatacatgatgccttttgact

SEQ ID NO: 3835 - DNA, 101 bp, rice(Oryza sativa)
  misc_feature (71): n=t or c
tgcgtacgcattgttgttttatctcgggcacaaataacttgcatgtactagtgagggggttctaatctttngagatgatgtcccctcctgtatttttttct

SEQ ID NO: 3836 - DNA, 101 bp, rice(Oryza sativa)
  misc_feature (71): n=t or g
cggagaatatcttcagaaaaagatcatggtacagataaattagacaaatgttcacctaaaatgagaaatanaacaccatatggaacagagaaaataaaaaa

SEQ ID NO: 3837 - DNA, 101 bp, rice(Oryza sativa)
  misc_feature (71): n=a or g
tgttcttttcttcctatcaataatggcatgatgcatgacaacacaacacagcttttggcggtcatgaaaancattgccaaggaaggtgcattcacctcaag

SEQ ID NO: 3838 - DNA, 101 bp, rice(Oryza sativa)
  misc_feature (71): n=a or g
gggttcttgagatgagatcatgacaaggtacggagaagtatgacgtcttctatagtaaaaaagagagaganaggtgatatttctatgtacctttccgataa

SEQ ID NO: 3839 - DNA, 101 bp, rice(Oryza sativa)
  misc_feature (71): n=t or c
aagagaatcgagagggatgtcaggtgggagagaaatgaagggagaccgcgggttagcgcgtacggtcgtanaagttaatcaactcacaaatttaaacaatt

SEQ ID NO: 3840 - DNA, 101 bp, rice(Oryza sativa)
  misc_feature (71): n=a or g
gagctaatgtgggcagcagcatggaaaagccagatgagttgtaaaatggggggtgatgcagcacacatgangggggggggggggggttgtgggctggtgtg

SEQ ID NO: 3841 - DNA, 101 bp, rice(Oryza sativa)
  misc_feature (71): n=t or g
tacatatgcattttataagaaaaataaaccccctctataaataaacagagaagaggagtgggagcagtagnctcctccaaaccgtcgagagcccaacaata

SEQ ID NO: 3842 - DNA, 101 bp, rice(Oryza sativa)
  misc_feature (71): n=t or c
ttcatgtgtaataagtcagttgttcatcaaaccatgaatggtgaagtctcagggcttgttcagattgatgncattttaaaccatacaattttttttactaa

SEQ ID NO: 3843 - DNA, 101 bp, rice(Oryza sativa)
  misc_feature (71): n=a or g
atgagaaagccacaaaatttagcttataaacatatataggcatgagcgaaacaatagggctccaggtctcntagaaggcgagacctatgtgcaaatgggcc

SEQ ID NO: 3844 - DNA, 101 bp, rice(Oryza sativa)
  misc_feature (71): n=t or c
ccgcggggtatctccccattgcccacacgttgatgaacaacgacgtcttggccaggatctcttagccttgnacgaccgccgtcgccgtcgactggcgcggg

SEQ ID NO: 3845 - DNA, 101 bp, rice(Oryza sativa)
  misc_feature (71): n=a or g
ttggtctactttttaaatatctgtgtccatctaaaaatggttggttagggacggagaaagtaaaggatacnacagcaaattgcactccccagcactgcagg

SEQ ID NO: 3846 - DNA, 101 bp, rice(Oryza sativa)
  misc_feature (71): n=a or c
cataaacttcccatttcccaatgatcatcgtgaaccggcggaagcggattaccatgtgcgagtgcgagatntgggccgtaaaggcctgatcgagcggcagt

SEQ ID NO: 3847 - DNA, 101 bp, rice(Oryza sativa)
  misc_feature (71): n=a or g
gtcttcacattaggactgtcgagtggtactggtctttttcttgctgtaagcttgtcctaggaaaaaaaaangaaacataaacaatcaaaaaaaaaatccct

SEQ ID NO: 3848 - DNA, 101 bp, rice(Oryza sativa)
  misc_feature (71): n=t or g
tatgtaagtagtactacgattaatctttgaccatgctagtacaattcatgggaattaatcctttactgtantagtagtagtgcaagatatgcctccatgac

SEQ ID NO: 3849 - DNA, 101 bp, rice(Oryza sativa)
  misc_feature (71): n=a or c
ggatggatggatggatggatggatgaggtgggttggttggttggtcctggcctgccatgtccttcatgtcnacgttcattttatctctcatcactaaggtg

SEQ ID NO: 3850 - DNA, 101 bp, rice(Oryza sativa)
  misc_feature (71): n=t or c
aaaaaaaaaggtactacctcaagaattatatggagtatgttcagattcgcagtacttccatccgattctangttcttatttgacagatgtagtaattataa

SEQ ID NO: 3851 - DNA, 101 bp, rice(Oryza sativa)
  misc_feature (71): n=t or c
ttctgcacggaccctccatcgacaagcacctttcttctatctctattatattgctgttttttgaagtgaanatgatatggctccgtttcatatcataagtc

SEQ ID NO: 3852 - DNA, 101 bp, rice(Oryza sativa)
  misc_feature (71): n=a or c
aatatatagatgatggagactagtacagtgaaagtggctgatcgaatatagcacaagcagccaatgcaagnttcgccagaagccagagatattggcaagtg

SEQ ID NO: 3853 - DNA, 101 bp, rice(Oryza sativa)
  misc_feature (71): n=a or g
cactcagagcgctactgtactgtttgtccagcccagcataacccagcccaattcaatggacgcgatttccngtcgggcgcccggattggcaaaaatcggac

SEQ ID NO: 3854 - DNA, 101 bp, rice(Oryza sativa)
  misc_feature (71): n=a or t
cacaaaacttaaatatgtttaggttgaaatctaaatccacttgggcctcctttcaattcaatctttagcantcaaaagaacatctcaccttcttcactgca

SEQ ID NO: 3855 - DNA, 101 bp, rice(Oryza sativa)
  misc_feature (71): n=a or g
taagggctatgtacttatactatctagtagtgataattacacatcatgtaaggcattgttcggtaaatggnaaagggaaatgatttttcacccatctttaa

SEQ ID NO: 3856 - DNA, 101 bp, rice(Oryza sativa)
  misc_feature (71): n=t or c
ctgggactcataaagtgaacttttccttcagtctgtcgctccaaccaagcgtgcaaacaatattcctattngattttgctagatatttgtcatcaaatttc

SEQ ID NO: 3857 - DNA, 101 bp, rice(Oryza sativa)
  misc_feature (71): n=a or g
taaacttaaaaataagattttatatatcgatgcaatattgttgtaagtatagtatgtttacgtgtataggncacgttatgtattaaaagggaaactataat

SEQ ID NO: 3858 - DNA, 101 bp, rice(Oryza sativa)
  misc_feature (71): n=a or g
ggacgtaaatggactttatccgctagttattgattttatgcaatctaagtcagctggcccaaacatttctnggctcataattcagcctcttcttcctttcc

SEQ ID NO: 3859 - DNA, 101 bp, rice(Oryza sativa)
  misc_feature (71): n=a or c
ggaagaataccttcaagtcttggcctgctcttgagaaaacttctcccgagaaaaactggtctgtgtggtantagtgggtatcggctagcaaacaagcccac

SEQ ID NO: 3860 - DNA, 101 bp, rice(Oryza sativa)
  misc_feature (71): n=a or g
aaaaacggtgcctggctgtgttcgctatctccggatcccaaccggaacagtaacgcacggaaaacagaccnatatattagcgcgtaattaattaagtatta

SEQ ID NO: 3861 - DNA, 101 bp, rice(Oryza sativa)
  misc_feature (71): n=t or c
aggaggcttcgtttgtgcacccagaattaaataaatggctaactgcatggttaggtgataaaatggatgtngagcaaaggacaagggaagactatcagaac

SEQ ID NO: 3862 - DNA, 101 bp, rice(Oryza sativa)
  misc_feature (71): n=t or g
tgacctgtactatgaatcaaattaagtaagtggtctgaaggcatttcatttatgtagtatatttttttctnaaagtatacgcaccgcttcaagaatctggt

SEQ ID NO: 3863 - DNA, 101 bp, rice(Oryza sativa)
  misc_feature (71): n=t or g
aaactcagtacaaattaatcggagaaaattagacaagctagcaagctggattaatccatggataagaaaangaaagagaacacaattctattaccatgaga

SEQ ID NO: 3864 - DNA, 101 bp, rice(Oryza sativa)
  misc_feature (71): n=t or c
cgtgcaaatccaaaaataccatcgacaagtgtgagtttcaaaaaaaatccatcctacaaacgactttgtcncaaaaataccatcgtcgttagggttccgta

SEQ ID NO: 3865 - DNA, 101 bp, rice(Oryza sativa)
  misc_feature (71): n=t or g
ccattaacgaaaagagcccacggcctcttctcttctttcttcctcctctgcaagccgccgacgaggcaaangagagaggagggaagaaaatcgtaaaggag

SEQ ID NO: 3866 - DNA, 101 bp, rice(Oryza sativa)
  misc_feature (71): n=a or c
ctagttccggtcggtactagttcggggcgtgacactccaccaaaatatggttagtacacttgcattcgaantttgaattttaccagcagacttacttatgg

SEQ ID NO: 3867 - DNA, 101 bp, rice(Oryza sativa)
  misc_feature (71): n=t or g
tagtcccatctcggaaattagatgagaggatgagtagtgacaagtaacattggctatgatttttttttttnagaagcgagggcaaaaaaaaaaacacaatg

SEQ ID NO: 3868 - DNA, 101 bp, rice(Oryza sativa)
  misc_feature (71): n=a or g
gggtagaatataccatcatatgtttagctccatggaggtgggtggtagtggaagtcatttattagtaggcnaaatttaggattactagcacatcagcacaa

SEQ ID NO: 3869 - DNA, 101 bp, rice(Oryza sativa)
  misc_feature (71): n=t or g
agtgagtgggtggaatcaatgtgggggaagaggaattggttggaaaaacctgtggatggcggggcggtcgngcggcgggaggagggcggcggcggcttgga

SEQ ID NO: 3870 - DNA, 101 bp, rice(Oryza sativa)
  misc_feature (71): n=a or c
taaacaaagtgtaacaacttttgttggcaagtgatgaaaagtgtaaccggaaccaaacaacccttaaaatncattggaaaatttcccaacatgatcttttg

SEQ ID NO: 3871 - DNA, 101 bp, rice(Oryza sativa)
  misc_feature (71): n=a or g
caagttgagggaccttcggtctactttttcctttcacggactctcaaggctgggcctttctgggccttctnctgtagtatttggtccgtggaccgaccgaa

SEQ ID NO: 3872 - DNA, 101 bp, rice(Oryza sativa)
  misc_feature (71): n=t or c
ctctctcctcgttcttttcctcttttctgctttataatcctgccatctctagctttgagcaaacagtcacnggtaaagaaaccatcttcgatcggtcagcc

SEQ ID NO: 3873 - DNA, 101 bp, rice(Oryza sativa)
  misc_feature (71): n=a or g
tcccggcgacctcctccccaccgccgaccggcctgcctagaggaagatgagtgagatagggagagagagangaggaggaagggagagcctgatgacgtggc

SEQ ID NO: 3874 - DNA, 101 bp, rice(Oryza sativa)
  misc_feature (71): n=t or c
cgtactgctcatcgacacagcatcgacgacagacgaactgatcacattgcatgcgtgcatgttcgtcgttngcaagttgcgactgctgcaaattgcaagag

SEQ ID NO: 3875 - DNA, 101 bp, rice(Oryza sativa)
  misc_feature (71): n=a or c
gcaaaattgggttcccaaatcttcatgctatctcccacttgttctatttctggtttatgacgattatattntttcaattgtcccatttctgtcttacaata

SEQ ID NO: 3876 - DNA, 101 bp, rice(Oryza sativa)
  misc_feature (71): n=t or c
agcaagaactcgtgcgtgcgtgcattgcctgggacccctccaatctaattttctagtacaattatggtgancaagctgatcaccttttctgtagaacaatc

SEQ ID NO: 3877 - DNA, 101 bp, rice(Oryza sativa)
  misc_feature (71): n=t or c
gttgttttcataatgcagagacgtcctggcctgcaaaacgatgagtggatatttctgttgttatatatacnatatatctacctcttgcatgtgccaagatg

SEQ ID NO: 3878 - DNA, 101 bp, rice(Oryza sativa)
  misc_feature (71): n=t or g
gaactctgcaaagaatgatgatgaaatcatgagacaaacagaattcgtttgccactgatcaatcttggganggatcatggatgaactttttattgaaaaaa

SEQ ID NO: 3879 - DNA, 101 bp, rice(Oryza sativa)
  misc_feature (71): n=a or g
gaatgtttcatttcattgaaattttgaaggaattggtaggaaacaattatttgtttcaaatggttccatangatttctatgggataaaatcctctgaaatt

SEQ ID NO: 3880 - DNA, 101 bp, rice(Oryza sativa)
  misc_feature (71): n=t or c
tacttgagtgggcagttaatttaatggctgatgttgtccaagaagaacagataaacaagatgaatgctcgnaacattgctatggtttttgcaccaaatatg

SEQ ID NO: 3881 - DNA, 101 bp, rice(Oryza sativa)
  misc_feature (71): n=t or c
tcttttatttatgagaagtctcataattggtagtacagcagcaagcacacatagtactctcacttcatacngcataattttctctttatataaacacaaaa

SEQ ID NO: 3882 - DNA, 101 bp, rice(Oryza sativa)
  misc_feature (71): n=t or c
ctgcctgtcttcttgaaaggcttttgcgccttcctcgctatacgaacaaaagactcaaacttgagctgaanagctgcatgatctcctctcttgaggaccag

SEQ ID NO: 3883 - DNA, 101 bp, rice(Oryza sativa)
  misc_feature (71): n=a or c
tggccatggtttctttcctctacgcggtgatcgtcccatttctgctgtggcgtgccgccgccgacaagccnacatcgctcatctggacatggtcgattctc

SEQ ID NO: 3884 - DNA, 101 bp, rice(Oryza sativa)
  misc_feature (71): n=t or c
cggaatcactggtcattcgatcggaatattagtcttgtggattcatttccttgggtcatgttacacattangcaggattagactctgttttacagttttga

SEQ ID NO: 3885 - DNA, 101 bp, rice(Oryza sativa)
  misc_feature (71): n=a or c
ctctatgtcccttcagtaacaaaactcaactataagaattaatttccccaaaattagagctgaactaggantcacagggtaattaacctgtatgaactcaa

SEQ ID NO: 3886 - DNA, 101 bp, rice(Oryza sativa)
  misc_feature (71): n=a or g
ctagttttactacacaccaacccacacgtataggaaaaacacattgtaaacttatttttggtgcaaactantactccctccatactcgtaaaggaagtcgt

SEQ ID NO: 3887 - DNA, 101 bp, rice(Oryza sativa)
  misc_feature (71): n=a or c
cttcacactgtttctactctgtttcacactaactgttctagatcatgaccaagacgaagcgaattcgcatnaaaactggccgataattacgcaacaaaaaa

SEQ ID NO: 3888 - DNA, 101 bp, rice(Oryza sativa)
  misc_feature (71): n=a or g
attaattgatatttcatatagtcacatacctaagttgatgtttatttaaccaaatatggttagaatgaaangcgattaaagagtcacttgtgatcgtccct

SEQ ID NO: 3889 - DNA, 101 bp, rice(Oryza sativa)
  misc_feature (71): n=t or g
gttttcttctagcactggcccctctaaataactgttagttcgtactattgtactaatcaagaccgattaanaccctgtttagatgggactaaaactttccc

SEQ ID NO: 3890 - DNA, 101 bp, rice(Oryza sativa)
  misc_feature (71): n=a or g
agttgacgtggtacacataaacatctcattagctcagaaaaaaaatggagtttaaattattgccctaaacnatatactcctatcctaccaaaatatagcaa

SEQ ID NO: 3891 - DNA, 101 bp, rice(Oryza sativa)
  misc_feature (71): n=a or g
gagaagttgatctctgtaaactttgcaatgctcagtccatccttaaacatagcgtctattggccgcctacntatgaacaactccaagagaacaactccaaa

SEQ ID NO: 3892 - DNA, 101 bp, rice(Oryza sativa)
  misc_feature (71): n=t or g
ctgcgggtcaagacagaacattagtagactgttgtgaccactcactggaataacacaggaaaatctcaccnggaaaaaaactgtctacaaattaatataaa

SEQ ID NO: 3893 - DNA, 101 bp, rice(Oryza sativa)
  misc_feature (71): n=a or g
ttaattcatagaattaattggcttcaagaattcaaaaacatcgatccaagaacatcaacacaaatgcaaancacaaagaagatggagaggatggacaacag

SEQ ID NO: 3894 - DNA, 101 bp, rice(Oryza sativa)
  misc_feature (71): n=t or c
ctacgactcgacaatgcaatggcacaagtatggttaggtacatgatatattttttttgtatggcaattttntgattataggtagataaaaactcaccgagc

SEQ ID NO: 3895 - DNA, 101 bp, rice(Oryza sativa)
  misc_feature (71): n=t or g
taggcagagcatacactagttctgtaatacctgtagaatcttcagctgcatattctacgctgacatatccncatagatgcagactattgatggcttgtttt

SEQ ID NO: 3896 - DNA, 101 bp, rice(Oryza sativa)
  misc_feature (71): n=t or c
ttaattgttaccgtgtgggagcaacatataagcagatatgctacatacatatacaatgggaacaaatatgntgtgtagtattaatttttcatgtttccctt

SEQ ID NO: 3897 - DNA, 101 bp, rice(Oryza sativa)
  misc_feature (71): n=a or g
aacagcaaacgatgaatccatcagacctttctatgaggaatctgatgccgaataattaagagatagtagcntgttgaaggttgaacacacgaaatcttggg

SEQ ID NO: 3898 - DNA, 101 bp, rice(Oryza sativa)
  misc_feature (71): n=a or g
agcagaatggcatcagacatctggagatgattttgttgttatctgtcagtggagttttcgaggggaaaatngacggtagcggaatgggctattggggttcc

SEQ ID NO: 3899 - DNA, 101 bp, rice(Oryza sativa)
  misc_feature (71): n=a or c
gatagtattgtttagaatatacttcgtctattccatattgatccccatataaatttttatcaaaaccaagnaaattttaactaccatatcggggtaatcgg

SEQ ID NO: 3900 - DNA, 101 bp, rice(Oryza sativa)
  misc_feature (71): n=a or c
tttactctgttttttaccgcaaaacatatgggaaatgccccaaatcaggcgcccgcaatcctccacggccncgtgcgccgcccccgccatgtgtccccacc

SEQ ID NO: 3901 - DNA, 101 bp, rice(Oryza sativa)
  misc_feature (71): n=t or c
aaaaagaataaaatcagcaaatagtatcggagaagtttccgaggaaatgacagcgtcttgtgatctgtccncctcgtcttccccgcctttcctccgccgcg

SEQ ID NO: 3902 - DNA, 101 bp, rice(Oryza sativa)
  misc_feature (71): n=t or c
ctcggcatgtcttctctctgtcttgtgtacattctgtttttccatttcatttttattattttgtttttaantttcgtaattctgggttccaatattgaatt

SEQ ID NO: 3903 - DNA, 101 bp, rice(Oryza sativa)
  misc_feature (71): n=t or g
agatggtgaagctgacgaaggcgatgtgctgggagatggtgtcgaagacgagcgacacggtggaccaggtngggctcgtcacgttccggaagccggcggac

SEQ ID NO: 3904 - DNA, 101 bp, rice(Oryza sativa)
  misc_feature (71): n=a or g
tcgcaggggattgagatcctctaacttcttctaactcatgtcacttatatatggaccctctacccagtggncccacatgtcagtgattcaaagtcagagag

SEQ ID NO: 3905 - DNA, 101 bp, rice(Oryza sativa)
  misc_feature (71): n=t or c
gtgcttgcaacaattcaatgacttgcgaaacatgctttgaagaacgacaggtttatatggcagaagtgttnaattactagaagtgcatagggaaactaaat

SEQ ID NO: 3906 - DNA, 101 bp, rice(Oryza sativa)
  misc_feature (71): n=t or g
taaatcaattttcctttaattcacctattccgatttccgagcccataacgattatataaatcaggagtagnacctcatcttaacgattatataaaacaggt

SEQ ID NO: 3907 - DNA, 101 bp, rice(Oryza sativa)
  misc_feature (71): n=t or c
gcaacgacgagccgacgaggatccatgataatggcggcgtcatacatgggatgactctctgcgtcgggcgnccgatcgaccgatttacgcgaaaaactact

SEQ ID NO: 3908 - DNA, 101 bp, rice(Oryza sativa)
  misc_feature (71): n=a or g
ttttggaaatacgagagataagataaacagaacgataaataaacctataacaaatacacaaaaactattcntcaaagaagaaattgtagtaccaaacacca

SEQ ID NO: 3909 - DNA, 101 bp, rice(Oryza sativa)
  misc_feature (71): n=a or g
agtacacttaccatgagtgatttttatccagcatcggaattatgaatagcatgctgcataccctgcctgcnttgcatgcttgccaagagtggtcagaaagc

SEQ ID NO: 3910 - DNA, 101 bp, rice(Oryza sativa)
  misc_feature (71): n=a or t
tggtcaacacggctagtgagagtcatagcttcaagtccatcttgtttcatcacaatctaacttaattagcngtcaatctattctacctataaagtcttctt

SEQ ID NO: 3911 - DNA, 101 bp, rice(Oryza sativa)
  misc_feature (71): n=t or c
aatttatctaatatttttaagcaacttatataaaataattatttcatatcaagcttatagccttaggttgngttcggtagtccaatgctgccctccagcac

SEQ ID NO: 3912 - DNA, 101 bp, rice(Oryza sativa)
  misc_feature (71): n=a or g
aacatctacccttaaggtttgtgaccctcttctgtttttctacattaacttggcaaagacttaacgcaatnagatctttagtcgataacgtcaataaagtt

SEQ ID NO: 3913 - DNA, 101 bp, rice(Oryza sativa)
  misc_feature (71): n=a or c
gttgtattattatgaacattaatttaataataattagagttggttggatgctaaccctagtttactggcancaatctggattactcatacatagtttaact

SEQ ID NO: 3914 - DNA, 101 bp, rice(Oryza sativa)
  misc_feature (71): n=a or c
gaatcttaaagcacccatcttctgcctctagctcaagtgcttaattattttcccctcccctctcccccatnctttctctgcttctcatcgactagggcagg

SEQ ID NO: 3915 - DNA, 101 bp, rice(Oryza sativa)
  misc_feature (71): n=a or g
tcttggacagtggaaatcttgtcatagaaagcatccctgatgtttatctgtggcagagctttgatgaaccnacggatcttgcgcttcctggcgcaaagttt

SEQ ID NO: 3916 - DNA, 101 bp, rice(Oryza sativa)
  misc_feature (71): n=t or g
cgtgcaatactgaatgccctttcaaagataaggaacaataatttcaaagatgaaggtaaataagaagccanataatgtatcaatgtcagataacaggtact

SEQ ID NO: 3917 - DNA, 101 bp, rice(Oryza sativa)
  misc_feature (71): n=a or g
gacctattaaccttacagggtcccctccttcatatgcataaccatatgatcacaccagcggtgcaagctgnaatgttcattcttgcaggaagccaggaacc

SEQ ID NO: 3918 - DNA, 101 bp, rice(Oryza sativa)
  misc_feature (71): n=t or g
aatcgagatgaaagtgagcattcactgctacagaaatcataatatgtaccggttaggaaccctacataggngctagatttcccaaccgacctcatagacgg

SEQ ID NO: 3919 - DNA, 101 bp, rice(Oryza sativa)
  misc_feature (71): n=a or g
agagaaaactggaagcaaactctgaaagcacatgttgccgctggcagcggccacctccctccggcacaatnagggatgtcagctttaacaacggcaggagc

SEQ ID NO: 3920 - DNA, 101 bp, rice(Oryza sativa)
  misc_feature (71): n=a or g
acccaacccaattttagtgtggttccctggtagcaaaatcactgtttgttgcttcgtagtagtacctattnatctgtggtagcctctctaccaatactggc

SEQ ID NO: 3921 - DNA, 101 bp, rice(Oryza sativa)
  misc_feature (71): n=t or c
ctaccaaagcaaccagatttcaccatcacacacttaaaaggagagatatttactactatttgtcatcgggnaagtgtcaactgtcaataaaacataaaata

SEQ ID NO: 3922 - DNA, 101 bp, rice(Oryza sativa)
  misc_feature (71): n=t or g
tgcacctgttaaagcctgtggcatcacaaaacatatgatgtcacaccatgagcaatggcactatagtaacncgctaaaccattgctcaagaagtggcaaca

SEQ ID NO: 3923 - DNA, 101 bp, rice(Oryza sativa)
  misc_feature (71): n=a or c
ggagaaaaaaaaatgtccctgcacatcccctaaaaattgtctcgaaaccaaacaatctccgaaaaacatcnatgggttttctggctagctccaagctcaaa

SEQ ID NO: 3924 - DNA, 101 bp, rice(Oryza sativa)
  misc_feature (71): n=t or g
gttgggggtggttccccattcggatgaactgtgcttgttcgagtgatttgcgtgtgcagatatgatttttnggttttttttgttttgggctgtttcaattc

SEQ ID NO: 3925 - DNA, 101 bp, rice(Oryza sativa)
  misc_feature (71): n=t or g
aactcaaaagccctggacaggacagtggtttaagatgactagctgcaatgatattcattgtcctgctaaanaaataaaaagaaatatgccaaagatgtaaa

SEQ ID NO: 3926 - DNA, 101 bp, rice(Oryza sativa)
  misc_feature (71): n=a or g
catataggcccacgtgggtctcactcgccacgtcaaccgaaatcgaccactatactgcagagggatcaaanttgatacatgattgtaagttaagggatgtg

SEQ ID NO: 3927 - DNA, 101 bp, rice(Oryza sativa)
  misc_feature (71): n=t or c
ataagcttcaattttgctcaaagcaatgtgctttcctcgggtatagcaatattcacaaaggtttcaaatgncttgatatatcaactggcaaggtctatatt

SEQ ID NO: 3928 - DNA, 101 bp, rice(Oryza sativa)
  misc_feature (71): n=a or c
tgtgttcttgtagctttatttgttacgtgcaagtttaataaaacattattctttgtgcagattactcaggnttttacaggtgaaactacaagtgaaaacac

SEQ ID NO: 3929 - DNA, 101 bp, rice(Oryza sativa)
  misc_feature (71): n=a or g
cggcggcggctcacgtcgacatgcggttagaaatgttgcgcggcagtgtgcggcgatggtgaagacagtgngcatcggtggagaagcggcaggctgcggtg

SEQ ID NO: 3930 - DNA, 101 bp, rice(Oryza sativa)
  misc_feature (71): n=a or g
ctcgagcctgcattgaatatccacgaacttggtgctttgtggcaaattgtgtaaggcagagaaaccttcancacacaataggaacaaatacggcgatagcg

SEQ ID NO: 3931 - DNA, 101 bp, rice(Oryza sativa)
  misc_feature (71): n=a or c
gtacacttagctaagaacaggtaatcgatatcccctcgtatatagtcctttccgattgaacatatatactngtaatcagcgtaaaaccaatttaaaggctg

SEQ ID NO: 3932 - DNA, 101 bp, rice(Oryza sativa)
  misc_feature (71): n=t or g
tgacaagatttttaaataaatgaaaaattcaagggtgctacaaaattacaaagagcctctttaaggtaaanaaagcatgcaacttctagacacagatttct

SEQ ID NO: 3933 - DNA, 101 bp, rice(Oryza sativa)
  misc_feature (71): n=a or g
ttcaagcatgttccggtggatcagttccatgagatttatttcggccacatcttctggtctattgtgttcgnttctcaccgcaaaaccttctgcaacccagt

SEQ ID NO: 3934 - DNA, 101 bp, rice(Oryza sativa)
  misc_feature (71): n=a or g
aaaaagaacataacacaccagaggaggtggccgaaagatatcttcgggaactgatacaacggaatatgctngaagttctggaatatgatgagctaggcagg

SEQ ID NO: 3935 - DNA, 101 bp, rice(Oryza sativa)
  misc_feature (71): n=a or g
caacgccacggcgaggatggtggctaggctacatcgacatggcctccttgctctctcccatccacaagccncatgcatcagtggcgcggtagcatccgacg

SEQ ID NO: 3936 - DNA, 101 bp, rice(Oryza sativa)
  misc_feature (71): n=a or g
tatgggaacgtattctggagcctagatcgttggtgttggggatattaatccaccagcgagggaacgactcngtgtgacagtacacgcgactgtaactttca

SEQ ID NO: 3937 - DNA, 101 bp, rice(Oryza sativa)
  misc_feature (71): n=c or g
ctctcagattcgagctcgccaagtacagatacgtcaagttcttgaggttcccgatgctcgccggcgtctcnccgggatcgtagctgttcatcccgacgctg

SEQ ID NO: 3938 - DNA, 101 bp, rice(Oryza sativa)
  misc_feature (71): n=a or g
cactcctctcactctccatcagctcaagctgccaatctgaccaccaaattcagacccaagcacttctccanttcaaggccggcttgaccgaccctctcaac

SEQ ID NO: 3939 - DNA, 101 bp, rice(Oryza sativa)
  misc_feature (71): n=a or g
tgtcactggattgcgggtcccacatatccaaagtcaaaacaagggaaactttgccaaaaactgctcacatnctaggcacatagtaccagtttcattctaaa

SEQ ID NO: 3940 - DNA, 101 bp, rice(Oryza sativa)
  misc_feature (71): n=a or c
gaactgtttaataactatcctccttggaaccaaatcaacatcatcaaaatatgccctcaagaggactcttnctggaatagcatcaacctcctgccagtaat

SEQ ID NO: 3941 - DNA, 101 bp, rice(Oryza sativa)
  misc_feature (71): n=t or g
aacatagaggtagttagctatgtttacagtggaatttgacatcctttttactgttaacaccacctttgatnatagaattggtgatactttaatttgccact

SEQ ID NO: 3942 - DNA, 101 bp, rice(Oryza sativa)
  misc_feature (71): n=t or g
ggcctccaaatccctttcctcgtcgatgccgaatgctgagcagcgatcatgagatgagtttctttcttctntttgcggggttggggagtcgtttggagcga

SEQ ID NO: 3943 - DNA, 101 bp, rice(Oryza sativa)
  misc_feature (71): n=t or g
ctgcaacacatcatctactgttacaatattaaccccatgataataagaaaaaagttcacacaaaacatctntagacttttacattagatggcaaccttcat

SEQ ID NO: 3944 - DNA, 101 bp, rice(Oryza sativa)
  misc_feature (71): n=t or c
attggattagtaagagataagatggtacatacaatggtacaaactgtcaacttcaggtctgtatactgtgngataatctgttgagaatgattgtgctcctc

SEQ ID NO: 3945 - DNA, 101 bp, rice(Oryza sativa)
  misc_feature (71): n=t or c
ttttttgttcttgcttgtgtctttgattcacacaccgtgattagccttctcgatgaagtcaattgggtttnggcatggttgataaccagaggaggcgtggt

SEQ ID NO: 3946 - DNA, 101 bp, rice(Oryza sativa)
  misc_feature (71): n=t or c
aggtttgcattagtgattattttatagctagcattttagtgatgatgatcattcacatggtctgataatantgttgaaaataaaatctgcatgatttagtt

SEQ ID NO: 3947 - DNA, 101 bp, rice(Oryza sativa)
  misc_feature (71): n=a or g
ccagttggtaattcttctactttatatacattttagcctttttcctgctgaaattcattgtgggagaactntattatacagtttggcagttcagaaattac

SEQ ID NO: 3948 - DNA, 101 bp, rice(Oryza sativa)
  misc_feature (71): n=t or c
cgatctgtgttatagagcgtatatgcattaactttgaaccaggggtcatatagcccaagatcatgaggaanagcaccaagaacttttctcgcaacccattt

SEQ ID NO: 3949 - DNA, 101 bp, rice(Oryza sativa)
  misc_feature (71): n=t or c
ctaaatcttgcatgggcccacaacatcctccaaatccccatttccatccatttaaactagctctcctttcnctccacaaacgcccaccacagtctccccct

SEQ ID NO: 3950 - DNA, 101 bp, rice(Oryza sativa)
  misc_feature (71): n=t or c
accttgtttagctatagatatggctcaatgaagaactaaggcggggagaaggttgatatataaagacaaanggagaaggtggatatcataaaggcaaatgg

SEQ ID NO: 3951 - DNA, 101 bp, rice(Oryza sativa)
  misc_feature (71): n=a or g
tgatggctagctgatgtttgttctaccaggctctagaaaatatttgaacccaccattgattattgattggnatctttccatggccatacctaaaaacctga

SEQ ID NO: 3952 - DNA, 101 bp, rice(Oryza sativa)
  misc_feature (71): n=t or c
attaaattattaatgttcgtttgcgtatctacttatgttgcaccgcccttattttgtcctaaaatttccangtacgtaatcaattacaccaggttgaaaat

SEQ ID NO: 3953 - DNA, 101 bp, rice(Oryza sativa)
  misc_feature (71): n=a or g
gaagaatcgcagagattgacaagtgaatccattgtcatattgaagagggtaattgaaaagttatagaagtnaaagataaatttgactctctgatttttttt

SEQ ID NO: 3954 - DNA, 101 bp, rice(Oryza sativa)
  misc_feature (71): n=t or c
cgccatgtgcacgccgccgccatctgctatttcctcctgtgaggcctggttttagttcccaaatttttttnccccagaaacggcgcatcaaatctttggac

SEQ ID NO: 3955 - DNA, 101 bp, rice(Oryza sativa)
  misc_feature (71): n=a or g
acacgtccaagacagttttgaaggccacatcaacgtgtcgctttaacacaaccaactcttgttgcatcgcnccagcaatcgcatcgcaagcttatcttccc

SEQ ID NO: 3956 - DNA, 101 bp, rice(Oryza sativa)
  misc_feature (71): n=t or c
tattaggctgggcaagtgttaaaccgttgctgggatttgttggatctatcaaagttggtcgggtggtatcncttgggtgaaatagtactactgccaggtac

SEQ ID NO: 3957 - DNA, 101 bp, rice(Oryza sativa)
  misc_feature (71): n=t or c
tgtggaggacatatatgcgctatccttccctaatacaatcaaccgacttattttcagcgcaaaacattgantccagctctaggtacagctttaaaagtgtg

SEQ ID NO: 3958 - DNA, 101 bp, rice(Oryza sativa)
  misc_feature (71): n=t or c
ctgcgcgaatgttttctgtatcagtcaccagtagaaaaacaatttttcccatggttacgatttatttttcnagacgaactataaaatcaccatttgtaaaa

SEQ ID NO: 3959 - DNA, 101 bp, rice(Oryza sativa)
  misc_feature (71): n=t or c
tgcattttcgtggccaattacagaatccatttgtataaatagccgacttttacctgccgtgagctgcaggnggtttacaaaacattcgtcagagttaccga

SEQ ID NO: 3960 - DNA, 101 bp, rice(Oryza sativa)
  misc_feature (71): n=t or c
acctggtcagtccatcgaatccattgtggaattgcgtggaacagaagctcgtcgcagtcggccctgctgcncctcgccgtcgcacatagcggcggtagcca

SEQ ID NO: 3961 - DNA, 101 bp, rice(Oryza sativa)
  misc_feature (71): n=t or g
taaactataaggctttctaaatggttggtagatcttcattttagtccaaataaagccttgtgtttcttttntattttttaacatggtaagcaggtatcgaa

SEQ ID NO: 3962 - DNA, 101 bp, rice(Oryza sativa)
  misc_feature (71): n=t or c
ggtgtggcggaaagtaagcattgtcatctccttgagactactcgagctcttacaattgcttcttctgttcngcctcatttttaggctgaggctgtttccat

SEQ ID NO: 3963 - DNA, 101 bp, rice(Oryza sativa)
  misc_feature (71): n=t or c
attgaaactgacaagatgcaaattcccacagctaaccatgtaagccgaggggcgagcactgtgtataaacnagttgcaaatgccgtagttgttgccatgta

SEQ ID NO: 3964 - DNA, 101 bp, rice(Oryza sativa)
  misc_feature (71): n=c or g
ctttacaaaagttgactagtaaaatcttcacagagcgccagcgtgtcaggggcacttttttcaaataaaanacagggactgctataccatgggggcctatc

SEQ ID NO: 3965 - DNA, 101 bp, rice(Oryza sativa)
  misc_feature (71): n=a or t
gttaattagcattatggtttccgtctactagcatgttttgtacaccagtgtcctaaggtgtggggcacatntatttttcgtatgcatctaacgacaggtaa

SEQ ID NO: 3966 - DNA, 101 bp, rice(Oryza sativa)
  misc_feature (71): n=t or c
aacctaaacaagcagaatcaattcagaactcagaaaatacacacaagtatgttaagcaacgcctcttaaangcggtaaattttgcatgccagtgcaagatc

SEQ ID NO: 3967 - DNA, 101 bp, rice(Oryza sativa)
  misc_feature (71): n=a or g
cacatgcatcacacacgaatgcatgttacaccggcatatattctttcgttttttttctttgatcttttttntatttcatgataattgatttgggatatata

SEQ ID NO: 3968 - DNA, 101 bp, rice(Oryza sativa)
  misc_feature (71): n=a or g
ctataaagataaagagtaaaatggtttaccaagaagacatgcctggatacttattttcgtgctaacaattngacaaaataaagcattagataattctagtt

SEQ ID NO: 3969 - DNA, 101 bp, rice(Oryza sativa)
  misc_feature (71): n=a or t
accgagatgaaggaattagctacttagctaggggtgttttcacaaggtctcagaggggcattgctaattcntctgtttgacaagatgtaaccaatgcttgt

SEQ ID NO: 3970 - DNA, 101 bp, rice(Oryza sativa)
  misc_feature (71): n=t or c
gcatcgacgacaacaggcagcacgacgccgacatcaccaagcgaagcagcgaggcgaggtgcccactgagnggctgcaaggtgccgagacctagccctagc

SEQ ID NO: 3971 - DNA, 101 bp, rice(Oryza sativa)
  misc_feature (71): n=a or g
tcacatgttgtctacctctacaacccatctaacacacaacaaaccactctaacctagacaccacatcaacnttatcgattacttctctagccttggccaag

SEQ ID NO: 3972 - DNA, 101 bp, rice(Oryza sativa)
  misc_feature (71): n=c or g
aacagagagagtagtgataaagtgagcctatgtattaagtttagaagattgtcctaaggtgatgagtttantttaacacttgtaaagatcattggctttta

SEQ ID NO: 3973 - DNA, 101 bp, rice(Oryza sativa)
  misc_feature (71): n=a or g
catcaaaaaattaatttgtcatacgaatgtaatgtatgatggaaaagtgccagttaaaatcatgtatctcnaaacaggagggtagtaccaaattaggaaac

SEQ ID NO: 3974 - DNA, 101 bp, rice(Oryza sativa)
  misc_feature (71): n=a or g
tcatcacttgtcgctaggtttccttctgggtcgaagaactgtcatctttatgacaggactcgcagtggatnaagtggcagagatctctatgtcttcaaagt

SEQ ID NO: 3975 - DNA, 101 bp, rice(Oryza sativa)
  misc_feature (71): n=t or c
tcatgtacctcccattaaccctgaggtaatcgcaggtgtaataaccgtagaggatactgcctcgaggtcgnttgtgacacttcatggcatacacataggat

SEQ ID NO: 3976 - DNA, 101 bp, rice(Oryza sativa)
  misc_feature (71): n=a or g
gtattgctcccctttaagtcggcaaatttggctgaatgtgcactgtaaagctgcactacactgcaaaaatngagcaggacaaaaggctttgatcctctaca

SEQ ID NO: 3977 - DNA, 101 bp, rice(Oryza sativa)
  misc_feature (71): n=a or c
ggaagaatcaagatgaatttttggagttgttgagaagtgcatattgggaatttcttacttgaatttctttnttttaaaaagggggagaagttttcttttgg

SEQ ID NO: 3978 - DNA, 101 bp, rice(Oryza sativa)
  misc_feature (71): n=t or c
cattatatgcccataatctcaacaaaaacatgctaagattattcgatgtttacagtagcagtatagtcgcngaagcaaatacagatcaaatgcttcgaaca

SEQ ID NO: 3979 - DNA, 101 bp, rice(Oryza sativa)
  misc_feature (71): n=t or g
gcacttaattatattacacctcctattttattaattcaagaatattcaacaacatgattaggtctatctcnattattttggacctattgccatttctcttg

SEQ ID NO: 3980 - DNA, 101 bp, rice(Oryza sativa)
  misc_feature (71): n=a or c
gtcattcttttattaataaggagagggcatggccattttattcctttttttatataatatcatgctcatgnttgaaagagcataactttattattttttct

SEQ ID NO: 3981 - DNA, 101 bp, rice(Oryza sativa)
  misc_feature (71): n=a or g
tactcaggtgatttcaagttaatgtatgcttggattgaagcatcattggtgccaccctgatgcatttggcnattgcttttaaattgagcttgtttcaactg

SEQ ID NO: 3982 - DNA, 101 bp, rice(Oryza sativa)
  misc_feature (71): n=a or g
agtccgatttcctagtagtggtaccggtcagaccggggtgataataaatagtgttttcagatgatgaatangttctttggctgagtagagccggtcagacc

SEQ ID NO: 3983 - DNA, 101 bp, rice(Oryza sativa)
  misc_feature (71): n=a or g
cattgctggtagccaggtatgtgcatgcagcaaggcgcgtatagcaagctgctaaaaatcacatagtcccnttgtgtttttagtcccagatttttaagcaa

SEQ ID NO: 3984 - DNA, 101 bp, rice(Oryza sativa)
  misc_feature (71): n=t or c
aaccacctcttggcactaggcgaagatgacatccttgtcaaaaataataaataaaatgaaatgaaactgcnctctgagcgctggggcccactgtcagtgtg

SEQ ID NO: 3985 - DNA, 101 bp, rice(Oryza sativa)
  misc_feature (71): n=t or c
tcacttgagaaatgtcctcgttctagattgagttgtccttcggtggtgccaatggtttatataagtttgtnatataattcttcaaagcttcattacactgg

SEQ ID NO: 3986 - DNA, 101 bp, rice(Oryza sativa)
  misc_feature (71): n=a or t
aatacgtaaaaaaagcgaaaaaaaggccgtcggaaaaaaataaagactgaaaaaaggctgtgaaaaaaacnatatccaaaaagataaaaaggcgaaaaaac

SEQ ID NO: 3987 - DNA, 101 bp, rice(Oryza sativa)
  misc_feature (71): n=a or g
acaagtgtccggtgggccaaaaattgacagggagaaaacttcctccaaaccatcaacagctgatccatcgnagccctcgagccggggaaccaagtgcctcc

SEQ ID NO: 3988 - DNA, 101 bp, rice(Oryza sativa)
  misc_feature (71): n=a or c
tccggtttaatatgtacatgtagttgtgtttagcgagaagaactaaaaaaagacacgaatattagagaaanatctaatatcaaataattataaggggtgag

SEQ ID NO: 3989 - DNA, 101 bp, rice(Oryza sativa)
  misc_feature (71): n=a or g
agtatatattaaaaaactcatggttatatgtgtctcggccatgattgtacaaaagcttttattataacacnttaacacttgactcacgtaagaaaactttt

SEQ ID NO: 3990 - DNA, 101 bp, rice(Oryza sativa)
  misc_feature (71): n=a or g
attgcatctaagtatattaaatctgccctttatcttattctgcatccaggattatgtattgttaatatctntagccgatcaagtagatttagttctttgtt

SEQ ID NO: 3991 - DNA, 101 bp, rice(Oryza sativa)
  misc_feature (71): n=a or g
ctcatgatatttttaccgatgtcatccattttgcagataaatatcacaggtaagaattctctatcataatntccctatgattatagcaactagtgtatggg

SEQ ID NO: 3992 - DNA, 101 bp, rice(Oryza sativa)
  misc_feature (71): n=a or g
agtactgtactatcgtaccgtggcttgtttgcagctcatagctggaccctgctttagggccctttgaatcntaggaataaaaaaacagagaaatatgaaaa

SEQ ID NO: 3993 - DNA, 101 bp, rice(Oryza sativa)
  misc_feature (71): n=t or c
gcggggtggttatgtcggccgcatgcaaaaattttaaatttgaaaagaataaaatccaaaaatacagaacnctaaccctagccgtcgtcgccgccaccgcc

SEQ ID NO: 3994 - DNA, 101 bp, rice(Oryza sativa)
  misc_feature (71): n=a or c
cagctcagactcagaccatccaggttcctaacgatgccgagctgatgcaagcacaggccgacctgtggcgncacagcctctactacctcacgtccatgggc

SEQ ID NO: 3995 - DNA, 101 bp, rice(Oryza sativa)
  misc_feature (71): n=t or c
tcaaattataggtaaatacctttttagtagacaaacatataaatgattttgtaggatcgaaacacaataantaagccaaccaaaggaggggtgaatagttg

SEQ ID NO: 3996 - DNA, 101 bp, rice(Oryza sativa)
  misc_feature (71): n=t or c
tatggcatatttacaatggcatggatccaattaagggaaacgaatgggccatattgttaacatttgtgctngagaagcctacgagcccaggaggccgaaac

SEQ ID NO: 3997 - DNA, 101 bp, rice(Oryza sativa)
  misc_feature (71): n=a or g
taaaataaagattttaaagaagagaacttttaacttagcaaacaaaatctagatccaggttaaagaaaaangaaaaagtaagattactccaacggaagaat

SEQ ID NO: 3998 - DNA, 101 bp, rice(Oryza sativa)
  misc_feature (71): n=t or c
tttctaaaacgcctctaaatctccttaaggacgatctatagcatctctaaactgctaataaagcgtcttcncaagagatttttgttgcagtagcttgtact

SEQ ID NO: 3999 - DNA, 101 bp, rice(Oryza sativa)
  misc_feature (71): n=t or c
attattattggtaccatgaaagagagggataaattagggcattcgccgccgggtgctcatcaagtggtatnagagcgtggttcatcacggtactgttaagt

SEQ ID NO: 4000 - DNA, 101 bp, rice(Oryza sativa)
  misc_feature (71): n=t or c
tcaaatatcagtatgtccactatcattgtcagtaagttccaaacattatcaatggattgtagttcctacantataagaactacctcatccaatatcctact

SEQ ID NO: 4001 - DNA, 101 bp, rice(Oryza sativa)
  misc_feature (71): n=t or c
caaaacagttttattagcgcttctgctaaatggcgaacaagatggttgaggccgggcgtgaagaaacttangttcacaatgcgggtagcctggctgagtgc

SEQ ID NO: 4002 - DNA, 101 bp, rice(Oryza sativa)
  misc_feature (71): n=t or g
taatcatataactaggatatatgtataatatgtattggaggtataccatgaggaccttctgtcacaccctnaagttcttttcccaagcctaaatcaaagta

SEQ ID NO: 4003 - DNA, 101 bp, rice(Oryza sativa)
  misc_feature (71): n=t or c
cgactatatgacgcaatgatacacagggtgtttgagattattaccagatcgaacttaccaaactttgaacngaatcaactataacaaagtattgcatttgc

SEQ ID NO: 4004 - DNA, 101 bp, rice(Oryza sativa)
  misc_feature (71): n=a or g
aaggaatcactagcccaagtagcatcaaagtaaccctgaagatgtaaagatgtggaccaaggaaagaaaanacaacgagagatagtcccatgaagataacg

SEQ ID NO: 4005 - DNA, 101 bp, rice(Oryza sativa)
  misc_feature (71): n=a or g
ccaatgattcaaacgagccatccatctccatgtcttccatctacagcatcatcagcatacatagtcccatntcaagaatatacaatacaatgtttacaact

SEQ ID NO: 4006 - DNA, 101 bp, rice(Oryza sativa)
  misc_feature (71): n=a or g
tcccattgtcaaacccaaataagtaaaaggcattgtgcctatgttgcaccgaagcagaccagcaaaaaacnctgcattctcatgagataaattgattgggt

SEQ ID NO: 4007 - DNA, 101 bp, rice(Oryza sativa)
  misc_feature (71): n=t or c
atcttgtgtcctgatattttgatgatagtttggaaaataagttaacgacttgactataactatatagggangatgcatcttagtgatcattacactaactc

SEQ ID NO: 4008 - DNA, 101 bp, rice(Oryza sativa)
  misc_feature (71): n=t or g
tgatgcggttctaccaaacgcatcacttgtatagggttacccgaggtagagacgcggatcgtaataacgcntcactaatattatccacaatagtgacgcgg

SEQ ID NO: 4009 - DNA, 101 bp, rice(Oryza sativa)
  misc_feature (71): n=a or c
tccatcaaaagcgagtctgcctcggtcatgagcaaaggagagttgatttctccggtcgattgtgtccacantccacagtttccttccctcctcaatccttt

SEQ ID NO: 4010 - DNA, 101 bp, rice(Oryza sativa)
  misc_feature (71): n=t or c
ttgttacgcacgtgctaagcttccttttttcgtcatcgttttttcttgtcggctggaaccctagcatcacngccacgtcgatatgccttcccatgcatttt

SEQ ID NO: 4011 - DNA, 101 bp, rice(Oryza sativa)
  misc_feature (71): n=a or c
agcaatatgaaatgttagaaatagattctgtctaaagaataacaatcattatgcttcgaaatccacatganaatctgcaaccaccagacatttggtgttat

SEQ ID NO: 4012 - DNA, 101 bp, rice(Oryza sativa)
  misc_feature (71): n=t or c
catctttgtcgggtgtaaataaaagaccatcatggataactctcatccgtaatgggtggtagttacgaccngtcgtggatgagagttattcgtgacagttc

SEQ ID NO: 4013 - DNA, 101 bp, rice(Oryza sativa)
  misc_feature (71): n=a or c
aaataagaacaacttctgaatggcagaacatcataactttatttgaagaagtagagaattacatcaagcanaacgtcgtgtaaacgaataaaaaaggtaaa

SEQ ID NO: 4014 - DNA, 101 bp, rice(Oryza sativa)
  misc_feature (71): n=a or g
ttggggattttgggaatctgtgattctttacatatgccttttgtattctgattttaattttccttgctctnaaaaatatttttgctagcactttcgttagt

SEQ ID NO: 4015 - DNA, 101 bp, rice(Oryza sativa)
  misc_feature (71): n=a or c
gacatctgctgcattgactatcagatttctggagaattgattatgttctggaaaggaaaaagtacaccganggtccctcaacttgtcatcgggatacaaaa

SEQ ID NO: 4016 - DNA, 101 bp, rice(Oryza sativa)
  misc_feature (71): n=t or g
tccattgctttcggcttcctattctttatctgaataaccacccaggtcttcatttctatcgccacttcttncgcatctcatgctctgattttattgcagca

SEQ ID NO: 4017 - DNA, 101 bp, rice(Oryza sativa)
  misc_feature (71): n=t or c
gcttctccggatagtatttgcagaacattatggatgctcccaaccgacgaaaaaccgtagcatatttagcntagactagaaaaatactcgtgcttcgctat

SEQ ID NO: 4018 - DNA, 101 bp, rice(Oryza sativa)
  misc_feature (71): n=a or g
tgcatgcattcaaaattcattctatgatggctttactgaacattagtttatagaactatatacagatatantccttaactcaaatgcacttgtagatcatc

SEQ ID NO: 4019 - DNA, 101 bp, rice(Oryza sativa)
  misc_feature (71): n=a or g
ccacctctcgtctctcccggcgccactgcttgccatgtttctctcgcactgattttgcataaaggaaaccnttcatgttgtactaatactagtaatcatac

SEQ ID NO: 4020 - DNA, 101 bp, rice(Oryza sativa)
  misc_feature (71): n=a or c
gctcgattctaggcaactgcaagtacgaaagcaattagagagacttacaatgtcaattcgatgtgcattcnataattgaacttatatttagaggtgagaga

SEQ ID NO: 4021 - DNA, 101 bp, rice(Oryza sativa)
  misc_feature (71): n=a or g
ttattggccttttattccacggactattttctaatgctctaacattggtcaggttcagttaaccaaagganctgaaaaaaaaaatactaaaccccatataa

SEQ ID NO: 4022 - DNA, 101 bp, rice(Oryza sativa)
  misc_feature (71): n=t or c
acttagtggcatagtatgcagctgactaagctggttgtcccgacacgaagatgtttacttaaggctacgtngtgtttttaggtgataaccttgtctctttg

SEQ ID NO: 4023 - DNA, 101 bp, rice(Oryza sativa)
  misc_feature (71): n=t or g
ctaacgaaagaataggaggggagaggggaatggaggttgaaatatctgaccggtcttaaccgaacacaaantttttcataggccgggatcctttccacacc

SEQ ID NO: 4024 - DNA, 101 bp, rice(Oryza sativa)
  misc_feature (71): n=a or g
ccactagagattccggcacagcagctggctaggggcctgtttgggaaggttttagcaaccgcagcttcccncacaatcttcaacttccttcccttaaacag

SEQ ID NO: 4025 - DNA, 101 bp, rice(Oryza sativa)
  misc_feature (71): n=a or g
tagtgcttacagaccgttgtttacaaataaaaatatgatgcgacttaaggaggcttaaaagcccaactacnaaaatccatatcctaaataggcaaggtccc

SEQ ID NO: 4026 - DNA, 101 bp, rice(Oryza sativa)
  misc_feature (71): n=t or g
ggttaattaagtctatattttaggtctgtctactatttttcttcgatcgtgccgtgtcatgccggccaccntgccaaggcatcggcccagacacggcccaa

SEQ ID NO: 4027 - DNA, 101 bp, rice(Oryza sativa)
  misc_feature (71): n=a or t
aggagctattgctggagatgctctaactagccaacacatggatgtcccactcgtataagagcaaatttaanagtatagccaactatcaactctaaatcatc

SEQ ID NO: 4028 - DNA, 101 bp, rice(Oryza sativa)
  misc_feature (71): n=a or g
caccctatgtacgcatgcatgcttggaaattattgggcagttcagcagttgttctatgtacatcgatggantaggttgaacactcagttgatctcgtcttt

SEQ ID NO: 4029 - DNA, 101 bp, rice(Oryza sativa)
  misc_feature (71): n=a or c
ttgatatgtagatatggcacaaaatgttgaaggaacaacttcaacatgctagtagataatgccgtaagggnaattgtgaaagatctcgaatccacagacag

SEQ ID NO: 4030 - DNA, 101 bp, rice(Oryza sativa)
  misc_feature (71): n=a or g
acggttggaaagtaatgtgattttcagatgaatgttttcatatgtttgaagagaaagttttgtgattttgnagatggaagtttcaggaaaactgaaagttc

SEQ ID NO: 4031 - DNA, 101 bp, rice(Oryza sativa)
  misc_feature (71): n=t or c
gagaacgcacgcgagaagagtatcaccatcggcatgagtgcggacatccaggtgctcctcactctgccacnctggcccagtgggaggtgtgcttcaagaac

SEQ ID NO: 4032 - DNA, 101 bp, rice(Oryza sativa)
  misc_feature (71): n=t or c
gactctcttgccatttgcttatcgaagaacttgcacagggagaggacattgtattaattgttccctgctanttgttgttgcatcttgtcctagtgacaaac

SEQ ID NO: 4033 - DNA, 101 bp, rice(Oryza sativa)
  misc_feature (71): n=t or c
tgcggatctcctcaggagtcttccccttgatcatgtcagcaacagtctggcaagtaaggtccagcaacccnttgatgttgaggtagttcgcggcctgtggg

SEQ ID NO: 4034 - DNA, 101 bp, rice(Oryza sativa)
  misc_feature (71): n=t or c
tcgtatgcaacgtatgcccgcatacatgttcatatatatgtatagttgtattggtcggctctgataccatntgtaacgctcaaggcccgaaaacgatgtgg

SEQ ID NO: 4035 - DNA, 101 bp, rice(Oryza sativa)
  misc_feature (71): n=t or c
gagttgtgacagctgtcgatctgattaacgacgcgtgacgttccgttttcagcccttgagccttctcagcnccgccacgaactcccgcacgaacctcctct

SEQ ID NO: 4036 - DNA, 101 bp, rice(Oryza sativa)
  misc_feature (71): n=a or g
agtggacagtggtaaaatcaccaattatgcaattaaattcctatattagatggggaagcacaagcattagngcatatacaaccgtttatagtggtctctct

SEQ ID NO: 4037 - DNA, 101 bp, rice(Oryza sativa)
  misc_feature (71): n=a or g
ttagtaacaacagaaaaactgtgacacgtttgcacgaaaattcttaggatcggtcgaccgggtgagggggnaaatcggtcgctccccctcccccaacacgc

SEQ ID NO: 4038 - DNA, 101 bp, rice(Oryza sativa)
  misc_feature (71): n=t or g
cgccctatgagggatgaaacccccataggacattaaacaggttgcacaggacatgtacattaacagggctnttcaagtcttaccaacaagtggggtttcgg

SEQ ID NO: 4039 - DNA, 101 bp, rice(Oryza sativa)
  misc_feature (71): n=a or c
tatgtggaataccagaaagattacactgggattagattgactaccttaatccaccgactaggatccgccangaatgacttggctagatctagtcgacgaat

SEQ ID NO: 4040 - DNA, 101 bp, rice(Oryza sativa)
  misc_feature (71): n=a or c
aagttctgcataagagaaaaatagttccgcagacttattatacaagagccatcagagaaacttagaaaatntattctatgtaagttagggctaaaagtact

SEQ ID NO: 4041 - DNA, 101 bp, rice(Oryza sativa)
  misc_feature (71): n=a or g
tacgggcccttactgggctagatggcacggcccaacagtttattgaaattccccgaaggagcaacggcccnctgggccttcttccggtggggtttgatata

SEQ ID NO: 4042 - DNA, 101 bp, rice(Oryza sativa)
  misc_feature (71): n=a or c
aatcatctgccatgtccttaaaatagagtggtcacctttaaaaaacaaacatgtctagctttctaacctangaatacaaagtgttgcatgttactctcttt

SEQ ID NO: 4043 - DNA, 101 bp, rice(Oryza sativa)
  misc_feature (71): n=t or c
agtacatgccaagttggcatctatagtagctaactagtttacctcctcctcacgcgcaagccgtaacgacngcaccttcttcgcactgagcaggtgcgtgg

SEQ ID NO: 4044 - DNA, 101 bp, rice(Oryza sativa)
  misc_feature (71): n=t or c
ccatgttgtcagcaaaggggagattaaccatcgctgcagtcgctgtcgtgtgctcctcgttgtgcagtttngtgcatcgatctacctgtgctagcaagcaa

SEQ ID NO: 4045 - DNA, 101 bp, rice(Oryza sativa)
  misc_feature (71): n=a or g
gatggaaaaactgaggctagttttttctggagatcatcttccttctcccatgtggcctcatccatggtgtnatgactccattgtacctttaaaaatctaat

SEQ ID NO: 4046 - DNA, 101 bp, rice(Oryza sativa)
  misc_feature (71): n=a or g
ggctgtggggggggggaggatggaagaaacgtggggaaaaaaaatttgaaactgatgagatggaagagatntgggaggataaacttgtagacggaccttta

SEQ ID NO: 4047 - DNA, 101 bp, rice(Oryza sativa)
  misc_feature (71): n=a or g
tttttttttcgcgaggactatgaatcacgttgaacacggctcttctactgcaaatgagcaagccgacgatnccatagagcttgggatttttctgttctgca

SEQ ID NO: 4048 - DNA, 101 bp, rice(Oryza sativa)
  misc_feature (71): n=a or g
gcacgcgcatggcgtagaatactcggcctaatcaggtaggcatccacttcccacatttgtctggcgcatcngaggcggagaaaggagctctggttaggagc

SEQ ID NO: 4049 - DNA, 101 bp, rice(Oryza sativa)
  misc_feature (71): n=t or g
taattgatcacatatcgctatagcttagcgtatatacatagagtacgtgacttacatatcaagtcaagtgntcttatcttatatagaaataaggcctgttt

SEQ ID NO: 4050 - DNA, 101 bp, rice(Oryza sativa)
  misc_feature (71): n=t or c
ggcttgttgggaacccatggttgccagctggttccttcacgtgtcttaactcttatggtcccttcaagacntgaattgtgtttagttaatctgaaacatta

SEQ ID NO: 4051 - DNA, 101 bp, rice(Oryza sativa)
  misc_feature (71): n=t or g
ttttaggaaggattgcattgttgagtgttggtctgttggatgttttctgcagaggtgttaccatattacanaacttgtagagcaacatgtggcacatttgt

SEQ ID NO: 4052 - DNA, 101 bp, rice(Oryza sativa)
  misc_feature (71): n=a or g
aatatgtgtccacagaattgtagcagaacagttattttaatatccatttctcatcatctatcataatagcnctatcattataaacattgatataataaaca

SEQ ID NO: 4053 - DNA, 101 bp, rice(Oryza sativa)
  misc_feature (71): n=t or c
tatttgtgcatggacatatgatgaaaaagaacacgaggatccagttttaggctgataagcattcatggctngtctggataagtaatttaaagcatcgagac

SEQ ID NO: 4054 - DNA, 101 bp, rice(Oryza sativa)
  misc_feature (71): n=a or g
caagtgacaagaactgatgtaccttcggtgactttgtgtagatgcaaccaagggaggcatttttcaccacngagattgggcaatgagctgtattctgccag

SEQ ID NO: 4055 - DNA, 101 bp, rice(Oryza sativa)
  misc_feature (71): n=t or g
attggcgatactgttgttaattacttggctatctcgaattctagatacattttttcttatactactactanctctgtccgtatcactccactacgatgtca

SEQ ID NO: 4056 - DNA, 101 bp, rice(Oryza sativa)
  misc_feature (71): n=t or g
tatgtaggacgaaagtaccattaattaaaaccacacccatcatgtaacgtgatccggttttaattgttttngagagtctctatacctaccttatggttctt

SEQ ID NO: 4057 - DNA, 101 bp, rice(Oryza sativa)
  misc_feature (71): n=t or c
cttctttctttccttccctcgaggacaccaagaatgaacaaataaaaattgctatgctgccgtaagtgtanagggatatgcatatgactgagttgaggtgg

SEQ ID NO: 4058 - DNA, 101 bp, rice(Oryza sativa)
  misc_feature (71): n=t or c
tttgctcgtggacaacgcaggaggcgaggggggagtcgaagcagaggatatatatccggggacacattctngttgcgtcacgctcgcttcacgtgggcggt

SEQ ID NO: 4059 - DNA, 101 bp, rice(Oryza sativa)
  misc_feature (71): n=a or c
tgccttgcatctcctctctcctctgttgccttatcggcttgtcttgtgagcttacatggtatcctaaggcnaggacgacttagaggcctacttgctctaca

SEQ ID NO: 4060 - DNA, 101 bp, rice(Oryza sativa)
  misc_feature (71): n=t or g
gatactcctataatttttcttttggagggacccatttagtggctacacgctgcgtcatccgagcactgacnataaaaattcaaaatattgcagactagaac

SEQ ID NO: 4061 - DNA, 101 bp, rice(Oryza sativa)
  misc_feature (71): n=t or c
gaatcatttttatattaattcttggctgaaaacaatattattttttgaaatagattacaactgcagacgcnaatgtgcacaatcacccatatgagtgcgtg

SEQ ID NO: 4062 - DNA, 101 bp, rice(Oryza sativa)
  misc_feature (71): n=t or g
tcctgtgtacatgcatgtggtttgtgtacttgttagtacttttcttcatgtactctagaggcactcatttnttttctatgatatgtttgaactcaaaattg

SEQ ID NO: 4063 - DNA, 101 bp, rice(Oryza sativa)
  misc_feature (71): n=t or c
ttttgattcatcattttataagcatgagtttacatgcaggtgatcactgcaaacgatataataaaaacaangtgtctggtgtacagtagctaattagtttc

SEQ ID NO: 4064 - DNA, 101 bp, rice(Oryza sativa)
  misc_feature (71): n=a or g
aaccttggtgattagttggtggttgtagacctgtagtatcatcacacttcttgtgatgcttccccaatccntgtagcatcaaattatatttgtatgcatgc

SEQ ID NO: 4065 - DNA, 101 bp, rice(Oryza sativa)
  misc_feature (71): n=c or g
tcccagagattcgcatctcgctactctcaagcgtatccttcggtatgtccgaggaacacttgaccttggantacacattcggcactctccttcgactgacc

SEQ ID NO: 4066 - DNA, 101 bp, rice(Oryza sativa)
  misc_feature (71): n=t or c
aagaaccagtttattaattagttgacatgcaaccagcttggcttttcaccttaattcgatcgtcaatgaanggccagtctcttctctttcaattttgccgc

SEQ ID NO: 4067 - DNA, 101 bp, rice(Oryza sativa)
  misc_feature (71): n=t or c
tagcatgtctgtgtattgttttgttggtagtcatctgctcgcttcatccaaaaaggttaaatatattactnttgtcatcaaagacaaaggagaaattaatt

SEQ ID NO: 4068 - DNA, 101 bp, rice(Oryza sativa)
  misc_feature (71): n=t or c
tcggtttgaaaataccacattactattcacttatttagagccacaccattataattttatattttttcganatatgccactacttcggctgtgtttggaag

SEQ ID NO: 4069 - DNA, 101 bp, rice(Oryza sativa)
  misc_feature (71): n=a or g
ttcttgaaactttgcacgagatgcataggaaaaagttggatggggtgattctgaagcttgtttcgaaaagncatatgataagataggctggaggttccttc

SEQ ID NO: 4070 - DNA, 101 bp, rice(Oryza sativa)
  misc_feature (71): n=t or c
ctccaatgtaaccttggtgcctattacccttttttgttgatttacccacacggcaaatggactctacgttngacggagagaatcccttctcgttgttgaag

SEQ ID NO: 4071 - DNA, 101 bp, rice(Oryza sativa)
  misc_feature (71): n=t or c
ccccaggaacagaactcagggagcagaaaagagaaaagggcaaggcaaagaaaagctactaaaaacccctnctcaaacagggccgccccaaccacagatca

SEQ ID NO: 4072 - DNA, 101 bp, rice(Oryza sativa)
  misc_feature (71): n=t or c
tcaactgtgaaagggattttttattttttggaataatgtcttagtgagacttggttaagtttagattcctntgtgacacgtccaagagaagaagctagact

SEQ ID NO: 4073 - DNA, 101 bp, rice(Oryza sativa)
  misc_feature (71): n=a or c
agcacggcgaggtgcgtgaagcaataagcttcacctgtcgccatcaccgtctcgggacagctgcctgctcnttctccatctctctcaccgagcgccgcgtc

SEQ ID NO: 4074 - DNA, 101 bp, rice(Oryza sativa)
  misc_feature (71): n=t or c
gtggctaccatgagggcccaaggatgacgctgtatggggcccacctgcagccgtctttttctatgtacagnatctatccgcatatccgaacagcttattat

SEQ ID NO: 4075 - DNA, 101 bp, rice(Oryza sativa)
  misc_feature (71): n=t or c
atataaattctcaacctatcactttcccatcaatcctgtcaatttccctcctccccgatagcaccgacgangcctatccacttttaccagtggctacctcg

SEQ ID NO: 4076 - DNA, 101 bp, rice(Oryza sativa)
  misc_feature (71): n=t or c
aattgtcacataatcaaattaaggtcaaattggggattgaggattgtggatacgttaatgatagagggtgntggtggtagattcactgtcattaccactgc

SEQ ID NO: 4077 - DNA, 101 bp, rice(Oryza sativa)
  misc_feature (71): n=a or g
tctggaaatactctcttcaggtcgacgctagctagagctgaaagatccttgtgctctccagcctataattncacagggcaagactcagaaaataaataaaa

SEQ ID NO: 4078 - DNA, 101 bp, rice(Oryza sativa)
  misc_feature (71): n=a or g
ttagtttgtcgagtcagaaaattgacctgagatcacagcaaaaatatggtgccatatccagttatccacancaaaaacgacactaaaatagccataactga

SEQ ID NO: 4079 - DNA, 101 bp, rice(Oryza sativa)
  misc_feature (71): n=a or g
aactagagaagtgcccgtgcaggagcagcttgaactaaagcctacttcatcttgatattacctttggagcncagagacggagtacggcaggaacacggagg

SEQ ID NO: 4080 - DNA, 101 bp, rice(Oryza sativa)
  misc_feature (71): n=a or g
ctaaattgatggacccttgggtcagataggatcatcggtttttttccatctcctctacggcttttgtttcntcatttattctcctgtattagagaccctgt

SEQ ID NO: 4081 - DNA, 101 bp, rice(Oryza sativa)
  misc_feature (71): n=t or c
ccctttagctacaacatatatttggaccattcatacattttatttctgaaagtggtccaggtcctcaaggntgtctaaagatatcgaaactaattcgcaga

SEQ ID NO: 4082 - DNA, 101 bp, rice(Oryza sativa)
  misc_feature (71): n=a or g
caaatttaacatagatttgataaaaatatgaataaacttcaataaaattttagactccatcatcctcgccncgtcatgcatcgtcgcagaccgctgatttc

SEQ ID NO: 4083 - DNA, 101 bp, rice(Oryza sativa)
  misc_feature (71): n=t or g
atggaaatctgaacaggaatcgctcgcgcgcgtgtgcgtacaatgctatgatagtgataggcgtgcgtgcnctccttcagctcctgctccccacatggcca

SEQ ID NO: 4084 - DNA, 101 bp, rice(Oryza sativa)
  misc_feature (71): n=a or g
aaaaaaatgggaatctttagtcctacattttacatttctaggatggagatagaacatgagcagagaatatntgtttgttctctagtcaccaaaaagatttc

SEQ ID NO: 4085 - DNA, 101 bp, rice(Oryza sativa)
  misc_feature (71): n=t or c
cagcagctagatcaacgtccttggtcgtgttcacgaggttgtccatgaagtagacgaacgcggccggtcangtcgttgacggcgccgggatgcagccgcgc

SEQ ID NO: 4086 - DNA, 101 bp, rice(Oryza sativa)
  misc_feature (71): n=t or g
attataccggtttttactaattaataatcaattatataaaaactctatatgggtcctactttttcgtagtnatttttatcgagcaaaatgagttgttattt

SEQ ID NO: 4087 - DNA, 101 bp, rice(Oryza sativa)
  misc_feature (71): n=t or c
taaaagccagtagtgatggtggcattgagactatctccaccacttccatctaacatgtgggacccaatagnagtggcaagaggagatgtctactaggccaa

SEQ ID NO: 4088 - DNA, 101 bp, rice(Oryza sativa)
  misc_feature (71): n=a or g
accaattaaccattgcatccacatgtacaaaaaaaaaacatattatcacaaatccaacctgagcagccttntatgcattcatggtgctctccgcagcctgc

SEQ ID NO: 4089 - DNA, 101 bp, rice(Oryza sativa)
  misc_feature (71): n=a or g
tctacagacacatgaaacattgaactttttttcgatgctccaaacgcagtgcagatgatggatcaaggccntcaaggcactgtccagtgggtgccgtgccg

SEQ ID NO: 4090 - DNA, 101 bp, rice(Oryza sativa)
  misc_feature (71): n=a or c
tcgcatgcgtgaatgcactgggtggacgtttggttgcttgcttgtagctcccagcctgaccgagtggatgnaaaaagccacgcgagccagtctgagcagga

SEQ ID NO: 4091 - DNA, 101 bp, rice(Oryza sativa)
  misc_feature (71): n=a or g
agagctatgctggcacccaactgactttggcttacttcttttcatcaacttcctcatttttcgttaatatnctttccgaagagttaaatgatatgttttat

SEQ ID NO: 4092 - DNA, 101 bp, rice(Oryza sativa)
  misc_feature (71): n=t or c
aggttattgtaactcaggtccaggtgatttaaacctgtgagcataccaatctcaacgggcagaggcccagngagctgattgttgctagcgtcaagagtgac

SEQ ID NO: 4093 - DNA, 101 bp, rice(Oryza sativa)
  misc_feature (71): n=t or c
attttggccgggtattcaaacatcaatggatccatagacagccacctgccaccaacctttgcggcttctangtcatggggtccctgcacggctgcacccta

SEQ ID NO: 4094 - DNA, 101 bp, rice(Oryza sativa)
  misc_feature (71): n=t or c
tttcttagtttccttgtgtgaaaagggagacccaggtaggttgttattttcgagtaaatttcacaaaaccntgtattttacggcttctgtaacacaaaacc

SEQ ID NO: 4095 - DNA, 101 bp, rice(Oryza sativa)
  misc_feature (71): n=a or g
gtgacaatgcatcttcatctacacatgctgcgaaaccagcgagcgaaccttccaaaacgaggcccacaacnccaacgatatcttgctttgcatcaggccat

SEQ ID NO: 4096 - DNA, 101 bp, rice(Oryza sativa)
  misc_feature (71): n=t or g
agctgctaaattgtgagttagggcatcatgcaatggtcaacagtggtttttcacgctccttatttcacctnagttttgtgcaagatttatgaaatattgct

SEQ ID NO: 4097 - DNA, 101 bp, rice(Oryza sativa)
  misc_feature (71): n=t or g
gcatgagttcagagtttggtgttggcaaaatcaattcccccttgcacaattggtttatgcgccagatacanttttggattttaatcgaacaagctagtggt

SEQ ID NO: 4098 - DNA, 101 bp, rice(Oryza sativa)
  misc_feature (71): n=t or c
caaattataactaaaataaatcttaacaaataattttggtgtagccaaaattttgacaatttaacggtatnaccaagctttcgtaggatttcttatgtatt

SEQ ID NO: 4099 - DNA, 101 bp, rice(Oryza sativa)
  misc_feature (71): n=a or g
cttgtgtatctttgagaaagaggaagcgtatgttattttaggcagcttttttccattagtacgtacagtgntggtgcttactctactggtagtagcagcag

SEQ ID NO: 4100 - DNA, 101 bp, rice(Oryza sativa)
  misc_feature (71): n=t or c
ccccatgcatgcatgcatggtagatttttcctgtgcaaagactcttctatttttttttctcacaccacacnttttcattttaccaatgcgaagcagggcta

SEQ ID NO: 4101 - DNA, 101 bp, rice(Oryza sativa)
  misc_feature (71): n=t or c
cgagtcaacaattaagctgaatttgtactgaactcgaagtcaaaatcagattatggcattgtttagttcgngaaaaaaaaaatttgggtgtcacaccatga

SEQ ID NO: 4102 - DNA, 101 bp, rice(Oryza sativa)
  misc_feature (71): n=a or c
tttggaacatggaagggtaagctacatatctggtacctagtaaaacttgggtattgttactgtagaagttntaataattgattggctctacaggtggaagg

SEQ ID NO: 4103 - DNA, 101 bp, rice(Oryza sativa)
  misc_feature (71): n=t or c
gatatcgagacaagcttataactttgaccattgtttttttttaaagtatatcactacaaaattagcacctnatgaaagtattttcaaataaaacttatgat

SEQ ID NO: 4104 - DNA, 101 bp, rice(Oryza sativa)
  misc_feature (71): n=t or c
cggatgcttctaggaacatggactgatacatctcgatgcaaagattccatcatcaagagaaacttaggaanatgtaacaaagttttaattcataaatctat

SEQ ID NO: 4105 - DNA, 101 bp, rice(Oryza sativa)
  misc_feature (71): n=t or c
tacttggtgagaggacgtgcatgttataaaacagatgccaatccatggttttcctgacgtggcggagatcnctggacgattcgtagaggacttcggcgctt

SEQ ID NO: 4106 - DNA, 101 bp, rice(Oryza sativa)
  misc_feature (71): n=t or g
tgttagccaaatttgttgaattttggatgatcaatagataaatgcgtcctccgtatcttcagcaaatcaantgttagccaaatttgttgaatttttggata

SEQ ID NO: 4107 - DNA, 101 bp, rice(Oryza sativa)
  misc_feature (71): n=t or c
gcaagtaaaccatatcaccaggggcaaactggcgttttgaacgatgcttgtcagcttgtgctttcatgcgntgttgagctcgaaccagatgatggtgaagc

SEQ ID NO: 4108 - DNA, 101 bp, rice(Oryza sativa)
  misc_feature (71): n=t or c
gaacagaagaaggcactgaaggactcgaaagaactaaaaaaggcgttgaaggactcgaaagaacaggggtngcagaaggattcagatgaacttaaaccaaa

SEQ ID NO: 4109 - DNA, 101 bp, rice(Oryza sativa)
  misc_feature (71): n=t or c
tgaaagtttcaaattttgggtcgattttttaaaaatcattgaaatccttgaattatgtaaaatcattgaangcagattacggcctaattattctggaaaaa

SEQ ID NO: 4110 - DNA, 101 bp, rice(Oryza sativa)
  misc_feature (71): n=a or g
gctaggcttgcagatgtgccttcttcacccaatgtgactttggtgccaccacgaatgtactgcagcttatncagcttgacgatgactgttggcaatctgac

SEQ ID NO: 4111 - DNA, 101 bp, rice(Oryza sativa)
  misc_feature (71): n=t or c
attgttcaaaatgcttcaaaaggtgtcaattcaattcatgactcagataactcgtactgtctacatacaancacattttgaacaacttttgaggttctccg

SEQ ID NO: 4112 - DNA, 101 bp, rice(Oryza sativa)
  misc_feature (71): n=a or g
tgctgcaatcaccaagctgcatgtatttattggtctcatttggttttatatgcattaaagtaaaaaaaaangaaaaaaaaagaggatacgatggaatgata

SEQ ID NO: 4113 - DNA, 101 bp, rice(Oryza sativa)
  misc_feature (71): n=a or c
aataagttgtcaaaagtttatttataaaataaacttttatagaagattcaaatgcgcaaatattgccagcntttttgagccctgaactatctgggtttccc

SEQ ID NO: 4114 - DNA, 101 bp, rice(Oryza sativa)
  misc_feature (71): n=a or t
atccaacacgtcatcgtcgctagagctgatttatggtaattaatcgtttgcatttaatgtagcacaatcgnaaggatcaattagcagtatatcgtttgtta

SEQ ID NO: 4115 - DNA, 101 bp, rice(Oryza sativa)
  misc_feature (71): n=a or g
acctacttaaaaacacatgcaactatatatatttgttgtcatcaagatttaaaccctgtttgattccaccnctatgtcaatggtgctttccctatgctctg

SEQ ID NO: 4116 - DNA, 101 bp, rice(Oryza sativa)
  misc_feature (71): n=t or c
tgaaatgcataatgcatatgcatgtgcagatgtgcttcttccaggaagaagatcacatattctcttcatcntttattatcagcaagcagttagcatgtact

SEQ ID NO: 4117 - DNA, 101 bp, rice(Oryza sativa)
  misc_feature (71): n=t or g
ttttccgcagcagctacgtcagctgaaacttctgagggatacgtcgtatccggtactatggttcgacagtntgattcaaactcgacctcaaaataaagagg

SEQ ID NO: 4118 - DNA, 101 bp, rice(Oryza sativa)
  misc_feature (71): n=a or c
taactccaagaaaactctagtagcctcaagcgcctaattaacacgatctaactccacaagtagcccaattngcccattttggcgatccaaaaatttagatg

SEQ ID NO: 4119 - DNA, 101 bp, rice(Oryza sativa)
  misc_feature (71): n=a or g
cctaccaaccaagttgcctataagagcgccactgcctgataggaaaggcctatcatgtgatcctcaccacntacacaaaacaattgcgaaaactcacatga

SEQ ID NO: 4120 - DNA, 101 bp, rice(Oryza sativa)
  misc_feature (71): n=t or c
gagtgcaatgagggttccaaaattttctattcatatgtaagttacttactcccggccctcaagaggcaggnattcttaattgggctagctgtctacagtgg

SEQ ID NO: 4121 - DNA, 101 bp, rice(Oryza sativa)
  misc_feature (71): n=t or c
ctgcaatatgcatttggaatggggttacatgtagtgtcaagaatccatctcgagtcgttgcgttggatctngagtcacagaacatcaccggcccaatattt

SEQ ID NO: 4122 - DNA, 101 bp, rice(Oryza sativa)
  misc_feature (71): n=a or g
gtagaaggcccgtgtacttgtgtcattgtgtgaggccagaacgccagaagtccagaacccgttggagtccncggccgcgcgcggcgacttcgcttcgcgta

SEQ ID NO: 4123 - DNA, 101 bp, rice(Oryza sativa)
  misc_feature (71): n=t or c
aatgctcgcgtatcgcgcaggccatcttcctagttaaattaaagaatgtaacttggacacagataacaganaaaaagaaaattgagccatgtgtttctttt

SEQ ID NO: 4124 - DNA, 101 bp, rice(Oryza sativa)
  misc_feature (71): n=a or g
cttggcgtcgctccaccctgaaatttctccgtcgatgtggtccgccgcctcggcatggtcacaatttgtcnatttccaagcggctgtagagcttttgggag

SEQ ID NO: 4125 - DNA, 101 bp, rice(Oryza sativa)
  misc_feature (71): n=a or t
acaaagcaatgtattttgtttcgattacagaaatgtgatctgcattgcactttggcaggaggtgagatttnaaaaaaaaaagaaaaaaaactggacaaata

SEQ ID NO: 4126 - DNA, 101 bp, rice(Oryza sativa)
  misc_feature (71): n=t or c
tatcttctccaaaatatcttttcttctcatgttgtggcatttgcttcttgtccctggttttccttatgaantgcggttcctcattccctattgttttgctt

SEQ ID NO: 4127 - DNA, 101 bp, rice(Oryza sativa)
  misc_feature (71): n=t or c
acaaaacagggcccatattaggcccaataagccgcctcgagcgagctagggtttcgcaccaccctccccantatataaacctcaccaccaatcccacccgc

SEQ ID NO: 4128 - DNA, 101 bp, rice(Oryza sativa)
  misc_feature (71): n=a or c
gtatatatataggcctttatagttgactgtctattgatttattacatgtgaatatggccatgtttagttcnaaagtttttcttcaaacttccaactttttc

SEQ ID NO: 4129 - DNA, 101 bp, rice(Oryza sativa)
  misc_feature (71): n=a or g
tcaagagtacacaaattaacaatgttacgatgatgtattgacatggttaattatggttcaagagtcccatntcctaactgaatattagaatatgtaaacaa

SEQ ID NO: 4130 - DNA, 101 bp, rice(Oryza sativa)
  misc_feature (71): n=a or g
tcacccgcgcgttgggcgacatgcgagaaggctacaaccaggttgacatcaacatctccttcgtcctcctnggaggagccatcttcttggagacatacgcg

SEQ ID NO: 4131 - DNA, 101 bp, rice(Oryza sativa)
  misc_feature (71): n=t or c
cagcattatctcatgtggaggatagagaggagatgtgagagagaggagcaggtagttatgcaagagactgnattggcacaaactcctactccctccataaa

SEQ ID NO: 4132 - DNA, 101 bp, rice(Oryza sativa)
  misc_feature (71): n=t or c
ggactgcccccattcctattgaatagctagcaatgtacacctgtttcagttataaaaatggattttagcanaactgaactacagataaatttcgaaataat

SEQ ID NO: 4133 - DNA, 101 bp, rice(Oryza sativa)
  misc_feature (71): n=t or g
tccattcctttatggaaagatagtgatttggttattgctagaacacatgggatcagttatctggccctgtngtacttgcaatcgcatagtactacctccat

SEQ ID NO: 4134 - DNA, 101 bp, rice(Oryza sativa)
  misc_feature (71): n=t or g
tcatcgacgatttgttcaaaagaatctcatggtttctttataatcgaatgccaaatctgtatgcgcgctanctctctttcgctaaagttccatggttttga

SEQ ID NO: 4135 - DNA, 101 bp, rice(Oryza sativa)
  misc_feature (71): n=t or c
aggagtagatatagaacgatgggaggttaattagtgaagtatcttccacaagggatcaagctaaggagccngctgaatataatgacatactcactctgtca

SEQ ID NO: 4136 - DNA, 101 bp, rice(Oryza sativa)
  misc_feature (71): n=t or c
catcacggccttctccatggaggactgcgcgctatggaagcgacaccttctgacccttaccgtccaaatgntgatggcaatctacgttgtcagcaagcagt

SEQ ID NO: 4137 - DNA, 101 bp, rice(Oryza sativa)
  misc_feature (71): n=a or g
cattgtttcatgtttgctgataaccagaaaattagtgaccacaaactcattcatcccactatcctattccnttgccgtttcccaaactctcagcacgatcg

SEQ ID NO: 4138 - DNA, 101 bp, rice(Oryza sativa)
  misc_feature (71): n=a or g
tgcatgttagccacagaatgcaaaaacacatttaattgttcttactgatagacatgactacacgaggatangtggctttgaggcgtgtggtacctcggtgt

SEQ ID NO: 4139 - DNA, 101 bp, rice(Oryza sativa)
  misc_feature (71): n=t or c
gatgacccatttgttgttctagaaacaaattctgcctcaggttcaacatatccatcccctagcagcttcanggatcccttggaacatctgaataattctgc

SEQ ID NO: 4140 - DNA, 101 bp, rice(Oryza sativa)
  misc_feature (71): n=t or c
gcacaaaatagatttattctaaccatacaagacagctcaaagatatgagggactaagagtagacttattcngtacggtggaggactagggagcaggcagag

SEQ ID NO: 4141 - DNA, 101 bp, rice(Oryza sativa)
  misc_feature (71): n=t or c
tggcataataaatgatagagaagcctccacttttctagtttagggcctcattactaaatgatgctggatgntgcgggtttctcttttgagtatggctgttt

SEQ ID NO: 4142 - DNA, 101 bp, rice(Oryza sativa)
  misc_feature (71): n=a or c
agtttgaattgtttagattcttttcgaagcatccaatatgcaactagctaggtttgaaattattggagtanttaaaatcatgataatcagtgcaaaaacgt

SEQ ID NO: 4143 - DNA, 101 bp, rice(Oryza sativa)
  misc_feature (71): n=a or g
gtagcatgacaaatcgacaataatttcatctctgttccagtaagaatgttacagttggctgtgtatgtctngtttcgatgtagaggctggcttttaatcca

SEQ ID NO: 4144 - DNA, 101 bp, rice(Oryza sativa)
  misc_feature (71): n=t or c
acatttaaaaccgagagggctacagatacaacacgacccactactcctgcaaggtcgcctcagcaaccctngagcccaccagcctggaaatccaggttaca

SEQ ID NO: 4145 - DNA, 101 bp, rice(Oryza sativa)
  misc_feature (71): n=t or g
tcgcaagtattataaggtcgattaaactaggaacaatcattcaatgtaacttataattcttatgtgcttcnaaaagaggggaatgaaatgtttagtgatgt

SEQ ID NO: 4146 - DNA, 101 bp, rice(Oryza sativa)
  misc_feature (71): n=a or g
ggacaggagatggctgtgagatttgtgaagttcgtgtaaggtactacactactatttagtagcctgagacnagttgacgggcctgaggtgagatgagggag

SEQ ID NO: 4147 - DNA, 101 bp, rice(Oryza sativa)
  misc_feature (71): n=t or c
tccttcagtaattttaatttgttcttgtaacaattaacctaatccagcctctatcatctcttgattgctanactgcgttcattccaaatccaaatcctaac

SEQ ID NO: 4148 - DNA, 101 bp, rice(Oryza sativa)
  misc_feature (71): n=a or g
cagaataacatttcctgctactggagcttggtaaagaatcatcctcacgaagcatacttcttatcatatcncgctcccggtctctaccgaataccttgcgt

SEQ ID NO: 4149 - DNA, 101 bp, rice(Oryza sativa)
  misc_feature (71): n=t or c
tgagatctcatgacgtacactcaaagacagtttgacatgctcgcaattcggaggcaacagatgatgatatnaatatgcacggtatatacggatcgatcgga

SEQ ID NO: 4150 - DNA, 101 bp, rice(Oryza sativa)
  misc_feature (71): n=a or t
tcaggttctgcaacaatttatagttggtgtaaaaatgtgattgaaaatgggagtagatgatgtgctgcttntattttcttatttctggctgaaacaaaaaa

SEQ ID NO: 4151 - DNA, 101 bp, rice(Oryza sativa)
  misc_feature (71): n=a or g
ttggttgggtcgctgtgggcttttactcctctcggaccagattgggctgtagtcgtgtgtagtacctacangaataagttcatctgaggtcccttaacttt

SEQ ID NO: 4152 - DNA, 101 bp, rice(Oryza sativa)
  misc_feature (71): n=t or g
tttaaaaaactcttatagaaggcatccccgaacaatctcgacttcgcgccgtcgcccgtcgtatttgattngcgccgctgactggctcgccgttgcctccc

SEQ ID NO: 4153 - DNA, 101 bp, rice(Oryza sativa)
  misc_feature (71): n=t or c
gctgtaataatagctacagagaagaactcccacgaaccaacatggataggtaaacaatagttgttctcatntgtagatgttggcaaacaaagacacatcat

SEQ ID NO: 4154 - DNA, 101 bp, rice(Oryza sativa)
  misc_feature (71): n=t or c
attgccacttataagagtgacaaatagttaaatatcttggagagggggaatgtaatgggaaagagagaganaatggagaaagagagaggaggaagaaggaa

SEQ ID NO: 4155 - DNA, 101 bp, rice(Oryza sativa)
  misc_feature (71): n=a or g
tcgtcaaatatcaatcttgacattatatcaagccttcatcttcaagttccactatttcgcaaaggaaaaantatgaattacccccctaaactatcgtcgtc

SEQ ID NO: 4156 - DNA, 101 bp, rice(Oryza sativa)
  misc_feature (71): n=t or c
gggcgttcgatggcagtggaaaaatcggacgcctcggacgcccgcgcctactgccactcttactttaaaangattttctcttaaactaattatccaatcta

SEQ ID NO: 4157 - DNA, 101 bp, rice(Oryza sativa)
  misc_feature (71): n=t or g
catatgggctgtttagtcagcccagcccagcgtagggcccatcatcatagattgtgaattaagtctagttnacgtccctcacattttcgtcaagattaatc

SEQ ID NO: 4158 - DNA, 101 bp, rice(Oryza sativa)
  misc_feature (71): n=t or c
ccctcaatcctgacttcctcacacgctcgctaccaatccatctcatcaacttgtgctgcattccattccanagtcttcctcttcgctacttattgcatttt

SEQ ID NO: 4159 - DNA, 101 bp, rice(Oryza sativa)
  misc_feature (71): n=a or c
cgcggctgcatttgtttgtttcagagctactaaaaaagatttcacgcgctacgccgcgtggatacagaagnaggttagcaggctgactatgcttatgttta

SEQ ID NO: 4160 - DNA, 101 bp, rice(Oryza sativa)
  misc_feature (71): n=t or c
gcaagtaacatatccggactccacgccgctagctgcctagctccatgcaccggattattcagagtgttttnaaaagactatgtttccaaaaacaaacacta

SEQ ID NO: 4161 - DNA, 101 bp, rice(Oryza sativa)
  misc_feature (71): n=t or g
tgctgatgcttgaattgaggcacgcagagcagggcctagctaggctgttgaggccagcatgtcgtcgtcgncggcggcgtatttggtgacccagcagtcga

SEQ ID NO: 4162 - DNA, 101 bp, rice(Oryza sativa)
  misc_feature (71): n=t or c
cagccctctaatatatccaaaccaaacactaaactataacatcaacaacaacatgccacacgccttcgagncacgcctagatcatcacgatggttacgtta

SEQ ID NO: 4163 - DNA, 101 bp, rice(Oryza sativa)
  misc_feature (71): n=t or c
tgaaattaattaacagtgactgtcgtcatatatactacagaactatcatccatccaggaatctggggttgngtgtagtgttaaatggctcaatgcaagtgg

SEQ ID NO: 4164 - DNA, 101 bp, rice(Oryza sativa)
  misc_feature (71): n=a or c
agctcgccaagcttggcgctttgttactcaatgaggaacactgatatcaagagacaatgtttatatacacntagtctttttttttcttagcatatcccttt

SEQ ID NO: 4165 - DNA, 101 bp, rice(Oryza sativa)
  misc_feature (71): n=t or g
catcagacacatacaaggttcactgcattttcatcctgctattggctactgacagtcatgagcatgctttnctatgggagtagccagtgaatattcatcca

SEQ ID NO: 4166 - DNA, 101 bp, rice(Oryza sativa)
  misc_feature (71): n=a or g
tgacccaatttcccttgtactataggtcaaccctcccttttcacagtgaattgcaaaaactcactatctcnaagtagggatggatactgagttggtttggc

SEQ ID NO: 4167 - DNA, 101 bp, rice(Oryza sativa)
  misc_feature (71): n=a or g
gtgattaaagttgtagattagatggaatggatgcatggagtaacccaagtcagagtagcaaaggtctgggnctggtcagcaaagggcagcgtggacgtagc

SEQ ID NO: 4168 - DNA, 101 bp, rice(Oryza sativa)
  misc_feature (71): n=a or g
ctgagcatcaacctgattccaattcaaatcgtctgtagcaacaattgcacaagaggatgaacagaaagatnatcatcgcacaaacacaccatgacaccaga

SEQ ID NO: 4169 - DNA, 101 bp, rice(Oryza sativa)
  misc_feature (71): n=t or c
caatatgtactgacatgtttccgtccgtattattttgtttctggctttccaatatttccgatattattttngtttccgactttaccatttttgatttcgtt

SEQ ID NO: 4170 - DNA, 101 bp, rice(Oryza sativa)
  misc_feature (71): n=t or c
ttttcgccacctaatctgtgtgcccttgcaaaagtgccactggaggtgctaatcttttgatttcgtgccantttcgtcgaaggagggtaggaggcggtggt

SEQ ID NO: 4171 - DNA, 101 bp, rice(Oryza sativa)
  misc_feature (71): n=a or c
agctgggtgggagggagtggctctgtggctgcctttagggtttagtagtttactgagcttattgggccttntaggcctattgagccaaaattcggttttct

SEQ ID NO: 4172 - DNA, 101 bp, rice(Oryza sativa)
  misc_feature (71): n=t or c
cttgcctcgacggtgctgtcaccagcgtcgacaagccctcattgaccgttttctatcgcgctcattaaccntgccttcctctgtatatccactcccttctc

SEQ ID NO: 4173 - DNA, 101 bp, rice(Oryza sativa)
  misc_feature (71): n=a or g
ccgagcttctctaccgcatcatccacggcgctgatgcacgcaaggtcgctaaggccaagtccaaggcctgngggggcgacctcgccagactgagcggccgg

SEQ ID NO: 4174 - DNA, 101 bp, rice(Oryza sativa)
  misc_feature (71): n=t or g
ggattgagaattgaggactaggtacgcttaattttgactaggaatcatgaattgggcggcctttatttggntatcaaatgttccgctttggccaattgatt

SEQ ID NO: 4175 - DNA, 101 bp, rice(Oryza sativa)
  misc_feature (71): n=a or g
gcctattttatctttacgttgaattgatagggtgatagaccggagaaaacgtgatatgcctatttcttctnttctcgacaaaaacagatttgttgagtctg

SEQ ID NO: 4176 - DNA, 101 bp, rice(Oryza sativa)
  misc_feature (71): n=t or c
tgtcacgtggagcctcggacccaattaatgctcaaccgcgtgcgtgtccatgtgccgccgttcaccgcttngatcggccgccggcacgcacggcacgggac

SEQ ID NO: 4177 - DNA, 101 bp, rice(Oryza sativa)
  misc_feature (71): n=t or c
tcctctacttattagaaaccaaatttctatatgttttaaacaacttcaactacttttgaagagatccccangtagagagaaggtgaaaattccatttaaaa

SEQ ID NO: 4178 - DNA, 101 bp, rice(Oryza sativa)
  misc_feature (71): n=t or c
tttgaattgttatagagttgtattgtttccagtatatcttggaaaaattgtaaaatgttgcatgatgattnaactaatcgcttgggggggggtacgtatcc

SEQ ID NO: 4179 - DNA, 101 bp, rice(Oryza sativa)
  misc_feature (71): n=t or c
atatgtcagcctctactgcctccttcttcctcctctttctcaccctcccctcctcttcctcttttctcccngacgtcagacctcgacacgcaatggatggt

SEQ ID NO: 4180 - DNA, 101 bp, rice(Oryza sativa)
  misc_feature (71): n=t or c
gtggtggaattgagttactttatactacaaatcttattgttgcttcctttttagccatgctaaataattantcccttcgtttcgaaatgtttgacgccgtt

SEQ ID NO: 4181 - DNA, 101 bp, rice(Oryza sativa)
  misc_feature (71): n=t or c
atgtataatattttctgctgtgggatcaaacaatattgccttgcgcatcaagctttcttagggtgtacganaaggcaacatgtggaattagacggctgggc

SEQ ID NO: 4182 - DNA, 101 bp, rice(Oryza sativa)
  misc_feature (71): n=t or g
gcagccgtcgcagtcggcctaccgaacaggcccttggtttataggatatgacgatcccaattttttgtttngttgaagggacgagggagagatgggatgga

SEQ ID NO: 4183 - DNA, 101 bp, rice(Oryza sativa)
  misc_feature (71): n=a or g
tatgatgccattctggcaagatccaacgttttttcattatttttgactggctatccttccaggttacgctngagaaggcattactcacttagcgctgttat

SEQ ID NO: 4184 - DNA, 101 bp, rice(Oryza sativa)
  misc_feature (71): n=a or g
ccctgtcccgcttgggcatttcatcgaacaggctgcccgcgggacaaccttcacgggtgaagtgaacatangcggcgcgcgcgagccgcgaggacggcgtc

SEQ ID NO: 4185 - DNA, 101 bp, rice(Oryza sativa)
  misc_feature (71): n=a or g
aaaaaaaagttttcaatgtaaaggcaaaaactagtgtcctaattcaaatgccataaatctaaagtgttctnagagcaaaatttgcccaaaataaaaaatca

SEQ ID NO: 4186 - DNA, 101 bp, rice(Oryza sativa)
  misc_feature (71): n=t or c
catctcacaatgcgatcacatgcaaccacatgggttgaataggacccaaagttccctcgtgtggcaatagntgaggaatgcccggatgaggtgttgtgagc

SEQ ID NO: 4187 - DNA, 101 bp, rice(Oryza sativa)
  misc_feature (71): n=a or g
gctccgaagctcaaaatcaagaaccctaggcgcaaccgctgtaaagaaaatcaggtgggtgaaatggggcngggagattcggagggggaggaggagcacgg

SEQ ID NO: 4188 - DNA, 101 bp, rice(Oryza sativa)
  misc_feature (71): n=a or g
gaacatgaggcggcgcggcattcggaaggatcccgggtgcagctggatcgagataaaggacatctcctacntgttctacgctggcatggtatcgcctgccg

SEQ ID NO: 4189 - DNA, 101 bp, rice(Oryza sativa)
  misc_feature (71): n=t or c
aaaggtcaccgctcacggctcacgggctacgttgtgcgtgtacaacaaatcgctgcagggaagtgacacanaatgataagggaacatgtcaacattacagt

SEQ ID NO: 4190 - DNA, 101 bp, rice(Oryza sativa)
  misc_feature (71): n=a or g
ccagccatcaatttagcaactccagattgtaaacttcaaggaactttattggagttttcgctgaagaatgntgctgaaacaccaaattccaagcactcgcc

SEQ ID NO: 4191 - DNA, 101 bp, rice(Oryza sativa)
  misc_feature (71): n=t or c
aattaagcgtaatattaccaaacgataacagtaaagccggtgtaattttgcgtacatgtagctgattttanactattttcacctataattttcttggtcaa

SEQ ID NO: 4192 - DNA, 101 bp, rice(Oryza sativa)
  misc_feature (71): n=t or c
tggaactaatcgcatcaagtcgccaagaaattcaattcaagcagagaattcaagaagaggcatactctcgncctcgaaggtggcgccattggtgccgtagg

SEQ ID NO: 4193 - DNA, 101 bp, rice(Oryza sativa)
  misc_feature (71): n=t or c
agtatgattataaacatcggctatatgtagagtgataaacaaaccatgtttgtttttcacaattaatctantttatatttgcgtgatgtggatgacgcttc

SEQ ID NO: 4194 - DNA, 101 bp, rice(Oryza sativa)
  misc_feature (71): n=a or c
gtgattatccaccccatgctacaccaaagtgggactgatcattcattcctagctgcaggcagtgtcttgcnccttcgtcggttatccatattttttaataa

SEQ ID NO: 4195 - DNA, 101 bp, rice(Oryza sativa)
  misc_feature (71): n=t or g
cgacctgaacagagccaacgcatgcaaaaccgacaaaagtcaggagagacgggtagaaatcggaggagganagaaacattgtagcattttttaaaaacata

SEQ ID NO: 4196 - DNA, 101 bp, rice(Oryza sativa)
  misc_feature (71): n=a or g
agatgcaactacagcagcaacagcagcgacaggccttcttgcagcagcaacagcagcagatgcaacagcancagcagcagctgcagcaacagcagcagcgg

SEQ ID NO: 4197 - DNA, 101 bp, rice(Oryza sativa)
  misc_feature (71): n=t or c
taatgttgtactacatgttaagatgcatacatgcgcacgcacgagatgcccttcaatcatatagcttccanacatgtcacactcagggggcagagctatgt

SEQ ID NO: 4198 - DNA, 101 bp, rice(Oryza sativa)
  misc_feature (71): n=a or g
gtaatttgatcattttaacatgaagcaaattttgttgacaaaccttaaaacatcaagattttttgggacanaggaagtagtatgaaggtttttattataac

SEQ ID NO: 4199 - DNA, 101 bp, rice(Oryza sativa)
  misc_feature (71): n=a or g
ccagagccctaaattatgtaactagacgacccaacctcacaggttgagccagatggtataccaagtacgtnattagatcgaagcatagatcaaagccatac

SEQ ID NO: 4200 - DNA, 101 bp, rice(Oryza sativa)
  misc_feature (71): n=a or c
ggagggggaagacgagaccaaggacgatctactgccacgtatgcagatacgtcactcgcgttacgcaaacnaggcccacggggcccagcccagcccaagtg

SEQ ID NO: 4201 - DNA, 101 bp, rice(Oryza sativa)
  misc_feature (71): n=t or c
agatacatagcacaataaattattgaaattgaagtggccactgacactaattatatttcataacagcaaanactacatagcataaaccaaaatccatacta

SEQ ID NO: 4202 - DNA, 101 bp, rice(Oryza sativa)
  misc_feature (71): n=a or c
aaatgtgtaattgtaaacattcatctttctctcgaaagggaaagcaaaaaggaaacaaaaactttgcgttnataatgtacagtgcagtacgtacgtgctag

SEQ ID NO: 4203 - DNA, 101 bp, rice(Oryza sativa)
  misc_feature (71): n=t or g
taattagagggagagagattggctggctagctggttttggcagtggcaatcactctgatgtttgttgtgtnaccaactcttgctgctttgtttagtattat

SEQ ID NO: 4204 - DNA, 101 bp, rice(Oryza sativa)
  misc_feature (71): n=a or g
accactactattgattaatagttgcaaagggaacatgtggtgcacagtgcgagcaagacaaggtgaagaanaatccatcacctcgaggaagcagcctgcag

SEQ ID NO: 4205 - DNA, 101 bp, rice(Oryza sativa)
  misc_feature (71): n=a or g
ttatggcaatctgtaaactaggttctgagccaacataacacttacaacagaagcttttggagcgtctaagntcacgtggaaaatttattgctcttcatctc

SEQ ID NO: 4206 - DNA, 101 bp, rice(Oryza sativa)
  misc_feature (71): n=a or g
tgccaatagcataaaaaagttacctaaattttgttagtgtttggtcttagaacaatcacctttaaggttcnaggaatataaaaaaaagtcagctcgatgca

SEQ ID NO: 4207 - DNA, 101 bp, rice(Oryza sativa)
  misc_feature (71): n=t or g
tgatgggcctctatgtcttcaccccggctagccttcgccgctatccatggagtcttcgctttcatggttgncctattatgccgctgctcaaggacgtcttc

SEQ ID NO: 4208 - DNA, 101 bp, rice(Oryza sativa)
  misc_feature (71): n=t or g
tatttacttggcttgcttgtaagtcaaaaggagttgacttttaaagtcaacatggcatagttgcgccgaantcatagtgatgacaaccctgctatagaggc

SEQ ID NO: 4209 - DNA, 101 bp, rice(Oryza sativa)
  misc_feature (71): n=a or g
tataggcaactaccgcagatgttgttctgtaaattgctctgctagctagaactcaaacgcatccatgtagntggaatgtgcatgtgataaaaggtaaatta

SEQ ID NO: 4210 - DNA, 101 bp, rice(Oryza sativa)
  misc_feature (71): n=t or c
atccacctcgtctttttcccccaacctagcgagcccacgagcagagcagagcaaagcagaggcagatgcangtgtgcttccatcgacgtcaccagggactt

SEQ ID NO: 4211 - DNA, 101 bp, rice(Oryza sativa)
  misc_feature (71): n=a or g
tagcatttacaccgcacaaattcgtgcaaaccatgttgatcacaacctgggattagtagattacatgactnaaacctgcagctaagctagcagctatcccg

SEQ ID NO: 4212 - DNA, 101 bp, rice(Oryza sativa)
  misc_feature (71): n=a or c
tgcacggagcagaatgcaatgcagtaaaccatagtctcatcaaagaggcccaggaaactggggatcggagnaggccatgcacagcacaaaatctacgggaa

SEQ ID NO: 4213 - DNA, 101 bp, rice(Oryza sativa)
  misc_feature (71): n=t or c
caatctcttgtgcagacttttgtcctctccaatctcttgtgcagacttttgtcctcttgcggtggtgcttntgactgccacaagatgaccatgttgacgtc

SEQ ID NO: 4214 - DNA, 101 bp, rice(Oryza sativa)
  misc_feature (71): n=t or c
tgagggatggggaaaaacagagcgtgagtgcgtgactcttctgccgtacggggtaggcctgtagcttcttnttttttttttttttttgcgggaaggcctgt

SEQ ID NO: 4215 - DNA, 101 bp, rice(Oryza sativa)
  misc_feature (71): n=a or g
aaacaaatgtccccaaaatctagcacagttggtacaagaagctacaggccttcccgcaaaaaaaaaaaaanaaaaagaagctacaggcctaccccgtacgg

SEQ ID NO: 4216 - DNA, 101 bp, rice(Oryza sativa)
  misc_feature (71): n=t or c
aatctaggcaaactctgtttctgttaccatgatctttgctagaagcttgttatttgctaccgttaatagcnttattactcttttcattttaagctacggaa

SEQ ID NO: 4217 - DNA, 101 bp, rice(Oryza sativa)
  misc_feature (71): n=t or c
ctgtcacaccaaggggttggtgatcagaggtggaacgcagctggagagcttacctgaggaatggcttcttnagaatcgtggaaagctccaatccctgaaga

SEQ ID NO: 4218 - DNA, 101 bp, rice(Oryza sativa)
  misc_feature (71): n=t or c
ggaggctcaatcgggtgggtgctctttcgtacgctgaggcgcccgtggacggctgggctaccatttatgtngaggcccatgacccgtcgtaaccggacgaa

SEQ ID NO: 4219 - DNA, 101 bp, rice(Oryza sativa)
  misc_feature (71): n=t or c
aatttaaattgcatcaaactcaggatctaaatttagtagcatcaaaaagtaaaagacgagcattaattacntatacctcaacactatatattacagttcct

SEQ ID NO: 4220 - DNA, 101 bp, rice(Oryza sativa)
  misc_feature (71): n=a or g
gcttcatcttagtaaaagaagagccctgatgactaaccttttgatctttttccttctctttgagatcgtantactcaagctcatcgatggcatcctcagcc

SEQ ID NO: 4221 - DNA, 101 bp, rice(Oryza sativa)
  misc_feature (71): n=a or c
tactactagaagcaagggatgctttgcttaatttgttcttagcaatatcaacttgtagcctaacatatgcntggacaagcctttgagcttgaacccctcct

SEQ ID NO: 4222 - DNA, 101 bp, rice(Oryza sativa)
  misc_feature (71): n=t or c
cctcgcatgtacgacatcttgcctcagaagttggaataatcctcagagatctgcaagacagaaagcccatntgagagggaagttgagaaatctgtcttgaa

SEQ ID NO: 4223 - DNA, 101 bp, rice(Oryza sativa)
  misc_feature (71): n=a or g
cgtattagtaagataaatatgataattttttgaaatcttaaatttttacaaccttttttatactcccttcntcctattttaagtacaaccatgagttttcg

SEQ ID NO: 4224 - DNA, 101 bp, rice(Oryza sativa)
  misc_feature (71): n=a or g
taaggttggcgcatcccgacttagacctcaaagatgctttggaccggggggccgtcgatgacgcgcgtaangacacgatggaggaagtcggtgacttgggg

SEQ ID NO: 4225 - DNA, 101 bp, rice(Oryza sativa)
  misc_feature (71): n=a or g
attgggatctttctattcacgaaataccaaggcctcgatctcaggctctcagcatactacagaaaatgagntaaaaaaatatatagaggttaaaaaagaaa

SEQ ID NO: 4226 - DNA, 101 bp, rice(Oryza sativa)
  misc_feature (71): n=t or c
tcaaatgttgcattggccttcttcctcccgcgttatctatctcgtttggcggcttctgccgacctatcctncacccaactagctaacaaccagctttctat

SEQ ID NO: 4227 - DNA, 101 bp, rice(Oryza sativa)
  misc_feature (71): n=a or g
gcaattatggaactaggagcaacactctgcagaaagacgaagcccggttgctcccagtgccctgtctccanccactgccaagcactcacactttccaacca

SEQ ID NO: 4228 - DNA, 101 bp, rice(Oryza sativa)
  misc_feature (71): n=t or c
attcaaatgaacctaagaagtaaaatccacctcgcgttacttcatcagcagcacaactccgttgtcgtccnaccattttatccatctccctctctctatct

SEQ ID NO: 4229 - DNA, 101 bp, rice(Oryza sativa)
  misc_feature (71): n=a or g
tctgttctaagttcgtatattttagaacggaggaattaccatctttatcaataacttttggcaatttgtcntcgggacccactgagttgtttttattttac

SEQ ID NO: 4230 - DNA, 101 bp, rice(Oryza sativa)
  misc_feature (71): n=t or c
gtttttttaaccgtatgcaacttacggcccatagaaatcgaggatttacacatgcggattccacaacaaantaattttcacggaaggttgtggaatgaatt

SEQ ID NO: 4231 - DNA, 101 bp, rice(Oryza sativa)
  misc_feature (71): n=t or c
ttggtcacatcatacacctgaaacaaaagcaaaaaatatttacaaattcagactcaatcaagaaccagtanacaccacccatcaagaaatcaagccaaatc

SEQ ID NO: 4232 - DNA, 101 bp, rice(Oryza sativa)
  misc_feature (71): n=a or g
gaggcaacagaaaatagaaacttgtcaataaaccttgcatctattccaaatgtctttctttcagaaccgcnccatatgttaacattttatttttgtcatct

SEQ ID NO: 4233 - DNA, 101 bp, rice(Oryza sativa)
  misc_feature (71): n=a or g
cataatcatcttctacagtatggttattgttatgaagatgtgtataagtgaagccacgtcatttgtatgantatattgtgacacaagttgccagctgatcc

SEQ ID NO: 4234 - DNA, 101 bp, rice(Oryza sativa)
  misc_feature (71): n=a or g
caagcaagttaaatttatgactaattatataggtacgatgcatctctcaacttccatcatcttactcgatnttatgatatatatctcacttcaaccagaag

SEQ ID NO: 4235 - DNA, 101 bp, rice(Oryza sativa)
  misc_feature (71): n=t or g
cggcttcacgtcgtgcgccacgcgagggggagcagcgccagtcggggactcaggagagagaaagaggaganaattagaaggtaggatcaggaatgctctag

SEQ ID NO: 4236 - DNA, 101 bp, rice(Oryza sativa)
  misc_feature (71): n=t or c
ttcttgttttacttgcatgcatgctcagagctgctgaacgtgtcatagtgcatgtacttttgttttttttntcttgttttacttgcatgcatgctaagagt

SEQ ID NO: 4237 - DNA, 101 bp, rice(Oryza sativa)
  misc_feature (71): n=a or g
acacgtcttctatgcacgtatcataaaattattgcagataagtataggtgtgtacctgctgcacaacaatnggatcatctctgctgcgattgaaaacaaaa

SEQ ID NO: 4238 - DNA, 101 bp, rice(Oryza sativa)
  misc_feature (71): n=a or c
tgcgtggaaaacaatagattagaaggtggacacatatagttacagaacacaccctcaagaacagcaagtantcttaaggcaatcccagcctaagaaattat

SEQ ID NO: 4239 - DNA, 101 bp, rice(Oryza sativa)
  misc_feature (71): n=t or g
atagataacgacatcggaagctgatttcgatgtagctggtagtacttcctctgtcaaaaaaacgaattagnactgaatgtgacatatcctagtaccagatt

SEQ ID NO: 4240 - DNA, 101 bp, rice(Oryza sativa)
  misc_feature (71): n=t or c
aattagttgatagctctttcattgttttggtcaactcgggcttgttgcttttaatcattaaaactaagtanttcctccgtttcatattataagactttcta

SEQ ID NO: 4241 - DNA, 101 bp, rice(Oryza sativa)
  misc_feature (71): n=t or g
ataacttttgtctttagctattctcatcttatgtgacatattttttcctttgaaactaatattgttctgcnctgtgatcttgttgagaagcaccagattat

SEQ ID NO: 4242 - DNA, 101 bp, rice(Oryza sativa)
  misc_feature (71): n=a or g
aggagtacgttaggttatgagtgcgatcttgcaagatgctacctttggtcagatgctgttttcattgtgtncctcaacgaagaaaaaaaagggtcatatgc

SEQ ID NO: 4243 - DNA, 101 bp, rice(Oryza sativa)
  misc_feature (71): n=t or c
aaaacacttaaaaattgttgacaaatatattgtcattgatctagagtccaccctgaattccataaaaccancagatgcctcacatggcaacctaagctagc

SEQ ID NO: 4244 - DNA, 101 bp, rice(Oryza sativa)
  misc_feature (71): n=a or c
atccatccatcctttgattttcatctcctttaaattttattcaaattccatgttcaagttcaaaaatcccnaaactttcattctttcatctcctttgaatt

SEQ ID NO: 4245 - DNA, 101 bp, rice(Oryza sativa)
  misc_feature (71): n=a or g
acaaaaattaattcacactttaaatgttgcatgagttgagccaattaaaattaatatttattggttgcatncatgcagggcgttgctccatgcacatttac

SEQ ID NO: 4246 - DNA, 101 bp, rice(Oryza sativa)
  misc_feature (71): n=t or c
tggttatagtcgttggtccgaaattccatcggcatcggctgggctcacgatgccatatcggtccattgagngatctgccttatgacctaaccttgttattt

SEQ ID NO: 4247 - DNA, 101 bp, rice(Oryza sativa)
  misc_feature (71): n=t or c
atgcgtcaacttatggaatagctatccagtcgatttgtaaggctatggaaagatgtatataagggttcttngtgtaatgacgcatgaagcgagtgcaacat

SEQ ID NO: 4248 - DNA, 101 bp, rice(Oryza sativa)
  misc_feature (71): n=t or c
tggacttgcaggtactacctgaaggaggcagtgtcggagggagggacagcattcgacaaggcgtacggcangtccttgttccagtacctgggccaggacgg

SEQ ID NO: 4249 - DNA, 101 bp, rice(Oryza sativa)
  misc_feature (71): n=t or c
catttttcagaagacaagtcaattttttcagtgaacgtactattttgacacgcttataattttattaatcngcatgtacatacatagttacatcgttcact

SEQ ID NO: 4250 - DNA, 101 bp, rice(Oryza sativa)
  misc_feature (71): n=a or c
ttaactgtgtgtacgatctgtacgtctgatagcatattttatttttcttgtagggttgtagggaatacgtngtgagaaattacgagttaggctatgtttag

SEQ ID NO: 4251 - DNA, 101 bp, rice(Oryza sativa)
  misc_feature (71): n=t or g
tcaaatcctcctataaaaaagttgacccgtgataatatatgcttcttcaattcgtccttgtcatcactttncacagagtatattggccgtgttcagttccc

SEQ ID NO: 4252 - DNA, 101 bp, rice(Oryza sativa)
  misc_feature (71): n=a or g
acgatcatgaaaagagtttgcgatgaatgcgaccaagaaaatccggccctgtaaattaattataaaatcanaatttagaatttaattaaaatcagcttcaa

SEQ ID NO: 4253 - DNA, 101 bp, rice(Oryza sativa)
  misc_feature (71): n=a or g
tcgaaatcttgcttcgacaaaagtaattaaggccatcgcagaaatatattagtctagcccatgctacattnattgatcacgttggttttacccaacagcac

SEQ ID NO: 4254 - DNA, 101 bp, rice(Oryza sativa)
  misc_feature (71): n=t or c
ctgagatgaaacaagacggaaatgtgtctggctgatcagtgtaaccgtacgtgatgaccaccacccgtctngatcagtagcatccatctcaagttcagttg

SEQ ID NO: 4255 - DNA, 101 bp, rice(Oryza sativa)
  misc_feature (71): n=a or g
tttattctgtttctgtttttaccccctggtaatgagttgatatgcaaaacgcatcttataaatgggaggantgatcaaacggtgggtgtgtgtgtgtgtgt

SEQ ID NO: 4256 - DNA, 101 bp, rice(Oryza sativa)
  misc_feature (71): n=a or g
ttttggtccagtggtctcctctaaagtttctctatgtcagatccttctaatattttggtgtggaatgcacncgggctcaatagtccggacatgcacaattc

SEQ ID NO: 4257 - DNA, 101 bp, rice(Oryza sativa)
  misc_feature (71): n=t or c
aaacacactctaaagaagaattggataaaccctactacgagacgatatatactccacctccagttaccggnaaccgaagccattggagcggcagaaagagc

SEQ ID NO: 4258 - DNA, 101 bp, rice(Oryza sativa)
  misc_feature (71): n=a or g
tgagaacataacattaattttcagatagcatgcataagaatcaatacatttgatgacaattctcttgtganagagagagagagagagagagagaggatgga

SEQ ID NO: 4259 - DNA, 101 bp, rice(Oryza sativa)
  misc_feature (71): n=t or c
tccatgccttcaaccagaagcaaggcagtcgttcaaccccctaatgggtcccagcgccgtcctccgcccangggagacatccctgtcattccctcttaatt

SEQ ID NO: 4260 - DNA, 101 bp, rice(Oryza sativa)
  misc_feature (71): n=t or c
ttactcaatcagctggtctccattgatggagcgggtgtagtttgtgcctgcctcttcttctccagaagctnctgtgcttctttcacgagggaagcgagaat

SEQ ID NO: 4261 - DNA, 101 bp, rice(Oryza sativa)
  misc_feature (71): n=a or c
tcttcctcatctcgtccattcaatagtgtcaggatggatggtgccgtcttaccagtctcgtctcgtcaacngccgccgtccagcgaccactcaccgacgaa

SEQ ID NO: 4262 - DNA, 101 bp, rice(Oryza sativa)
  misc_feature (71): n=a or c
catagctgatgaatcagcaacaacagcttagcattgagtagctgaagatgaccgagcttctacacaagtanttaacgcatgcctcagtgagtaatatgttt

SEQ ID NO: 4263 - DNA, 101 bp, rice(Oryza sativa)
  misc_feature (71): n=t or g
gaggtacctagctatttaaggtggtgggaggacgacctaggtgccctaatagtcatgatccacctggctgnggtgcaccctacatggctggggtgcacccc

SEQ ID NO: 4264 - DNA, 101 bp, rice(Oryza sativa)
  misc_feature (71): n=a or t
cggattcccttctcccctttttccctctactcaaaactctcgagtttggcctttagcttgaaaccttaaanccgtttgacatatttatctgtcgtacataa

SEQ ID NO: 4265 - DNA, 101 bp, rice(Oryza sativa)
  misc_feature (71): n=t or c
aaatcgaggtatatattctccggttaatatttcgcttttagtgtctcaaatttagcatacgacgcatgctngcgcattcgcgcgggctaccttcctagtta

SEQ ID NO: 4266 - DNA, 101 bp, rice(Oryza sativa)
  misc_feature (71): n=a or g
acgaacaccttccaattgaagatttgcttgtgactgtggtcggatcaactgtttcctacccgatgagactnatgaaatcgaaagataagcaagcaaccttc

SEQ ID NO: 4267 - DNA, 101 bp, rice(Oryza sativa)
  misc_feature (71): n=t or g
cttcacacactcttcattctccactctccagtgttacaatgccagcaattgccacaaattttgacaatttnactctctgcaaaaactaattatacaaatga

SEQ ID NO: 4268 - DNA, 101 bp, rice(Oryza sativa)
  misc_feature (71): n=a or g
taatctactcggcctattgcaaggtctattaatctactgttcttacatgattaagtttttcatcatgaatnagcttcggctagcagtggattaagaagaaa

SEQ ID NO: 4269 - DNA, 101 bp, rice(Oryza sativa)
  misc_feature (71): n=a or g
acatgcaaagtttagatagcattgggccatctaatatagctagctagttcattccaaacataataccttcntgttaacccttttatatacctccgtgttaa

SEQ ID NO: 4270 - DNA, 101 bp, rice(Oryza sativa)
  misc_feature (71): n=t or c
ttctacggaagaaaatttggtaggacggccactagaacaggtccggtcatctgtagcgggcctaaagcctnatctttatcgggtagcgcccccatcacaaa

SEQ ID NO: 4271 - DNA, 101 bp, rice(Oryza sativa)
  misc_feature (71): n=a or c
accattgcccgggctattgagctatatgatccgatggaaaatgctggtgcagcattgatccgtgaggtgantttgtttttgttcagatgcattttttatca

SEQ ID NO: 4272 - DNA, 101 bp, rice(Oryza sativa)
  misc_feature (71): n=a or g
agatacagaggatgttacatccttacccttaatggcacattggaagttactacagtactctcataaagtcngaaaccctaggaatctagatgtgcattcga

SEQ ID NO: 4273 - DNA, 101 bp, rice(Oryza sativa)
  misc_feature (71): n=t or c
ttatctataaaccattaatatatagttccacctcttatacacacgtaacatattggagttcgtgttacagntggctacaaattcattccttctctctcttc

SEQ ID NO: 4274 - DNA, 101 bp, rice(Oryza sativa)
  misc_feature (71): n=a or g
ctaaaacccactcccatatccccacatccgcacagcactgcagattaaaccctagagggagcaaaagccgnataaaaagaagaggcaaaagatcgcgccca

SEQ ID NO: 4275 - DNA, 101 bp, rice(Oryza sativa)
  misc_feature (71): n=a or g
ttttgtgttggtgtgcaattatggttaagacatgagttagtaccatgggatatatattatacacgtttgcnctaaaatgcacccaagatgcgcaataccta

SEQ ID NO: 4276 - DNA, 101 bp, rice(Oryza sativa)
  misc_feature (71): n=t or c
taggttcattatatctaagtcacgatcaacttctaacggatcttggaaaactttaaacaatggccatttanattaaagatgttaccttcgtcgtctcgcag

SEQ ID NO: 4277 - DNA, 101 bp, rice(Oryza sativa)
  misc_feature (71): n=t or c
cagcccgtgcagtaatgaatccgctgctgctagcagcagcatcctttggtgcttgcgaggttttctacttncttttctgcagagaagacgcacgagagccg

SEQ ID NO: 4278 - DNA, 101 bp, rice(Oryza sativa)
  misc_feature (71): n=a or c
ttagtgaaatttcccttaatgcaatctacgtaatgatctacttcagaaaaatctgaaggaaggagtatttnttctttaatgagacattcaattctttctct

SEQ ID NO: 4279 - DNA, 101 bp, rice(Oryza sativa)
  misc_feature (71): n=a or g
gcccatcagagaaaaatgactttttgtcagagaaaggaatcgccgcatccaaatccatagcaagaaagccnaagagagagggggagggggaaagctcgccg

SEQ ID NO: 4280 - DNA, 101 bp, rice(Oryza sativa)
  misc_feature (71): n=a or g
cgacggggatgacgtcggggggtgcacgagaaggatagcttgttccacccctaaccatccatttggggggngggggggggataggaaaaaagtgggggaag

SEQ ID NO: 4281 - DNA, 101 bp, rice(Oryza sativa)
  misc_feature (71): n=a or g
aagcctaccactatgttgaatgttttattatttctgtataaattatacaggtattgatggcataaaatcgntatttaacagccgccaacaataaccataac

SEQ ID NO: 4282 - DNA, 101 bp, rice(Oryza sativa)
  misc_feature (71): n=a or g
tgcatgaggatattggattggctccatgattggagagaataggtttctgtagccagcaagaatggtgactngaatggagagttccctatagtgtctccaca

SEQ ID NO: 4283 - DNA, 101 bp, rice(Oryza sativa)
  misc_feature (71): n=t or c
gttcctcttggggcacaagtgagtcgctgttgatgcggaaatggccgaagcgatctgtgtatgattttttncttttttggtttttttccatcttgtttgtg

SEQ ID NO: 4284 - DNA, 101 bp, rice(Oryza sativa)
  misc_feature (71): n=a or g
accctagataaaacacagtcgggagaaaaggattgaagggccgcacagtccatggaggcctttcgccatanttgggccgacctagctagcccattaagagc

SEQ ID NO: 4285 - DNA, 101 bp, rice(Oryza sativa)
  misc_feature (71): n=t or c
cgcaggagatgcaaatggagaaaatcccaacgggacacatccctccggtgaccgctcaccccgagagagangacatcctactccaccgcgtcccgagaacc

SEQ ID NO: 4286 - DNA, 101 bp, rice(Oryza sativa)
  misc_feature (71): n=t or c
acggccatgtacaggatggggacaaggctcttggaggcggtcttcctcctctcattggcaatgcgaacccnagtcctacaccctccaactcctacactgag

SEQ ID NO: 4287 - DNA, 101 bp, rice(Oryza sativa)
  misc_feature (71): n=t or c
tgtcattgaagtgcaaagttatgggaattgcaactctggacaacagatcattttgtcattttgtgcatttntgaacttgcaacaatcaacattacttttta

SEQ ID NO: 4288 - DNA, 101 bp, rice(Oryza sativa)
  misc_feature (71): n=a or g
atcacaaagcaatacgtcatatctgaccggcgacaagctctcgtccgacaagaggattggcggttgtggcngacgaagatggagacgagaggtgagctcca

SEQ ID NO: 4289 - DNA, 101 bp, rice(Oryza sativa)
  misc_feature (71): n=a or g
gaaaaccatcgtcagcgacgctacatagggaagaagatgggaaaaacaagaagaaaatggaaaatgaaggnggtggatggaaaatgtgacggcagtggcat

SEQ ID NO: 4290 - DNA, 101 bp, rice(Oryza sativa)
  misc_feature (71): n=a or g
actgatacggtgagacgataacaataataagtaaaagcaatgactcgtcatgagagaggggagaggttgcngacaaggagggagatgcactacaccagatc

SEQ ID NO: 4291 - DNA, 101 bp, rice(Oryza sativa)
  misc_feature (71): n=a or g
atcattcactagcctggtacttgtcacgatatgtcctgacagcagcggcatgtgaaaggagaaggttatgngctgcgatgtaaggctcggtggcggaattc

SEQ ID NO: 4292 - DNA, 101 bp, rice(Oryza sativa)
  misc_feature (71): n=t or c
ggcacatgatcaatttttggctcaatttacggtcgtctcaccgcaagagatcgctgtgctctttttttttnttttttttttttaaccatagattgctgtac

SEQ ID NO: 4293 - DNA, 101 bp, rice(Oryza sativa)
  misc_feature (71): n=t or g
gtgaatacacgtaccattaatgaaggaacagctagtactaattatatgagggaatactaattatctattcntatgtattctctcacaatcactcctagcaa

SEQ ID NO: 4294 - DNA, 101 bp, rice(Oryza sativa)
  misc_feature (71): n=t or c
gccaggcctcccctcccctgcgctacaccacaggccacgaatcgacccccacccatcagacacagcttttnaaaccaactccccggaggaaatggtggaaa

SEQ ID NO: 4295 - DNA, 101 bp, rice(Oryza sativa)
  misc_feature (71): n=a or g
ccccacctcgactacgagatcgatcgtgtcagtccagctaaaccgaaactggatgcagaatctgatacagnggtagtctcccacacacgatcggagcgaaa

SEQ ID NO: 4296 - DNA, 101 bp, rice(Oryza sativa)
  misc_feature (71): n=a or c
tcgcgggaaagagagattggggtcggtaggtgtggcgtcattcttcctcaaatggagagagcgaaggatgnggggataggatatttgttggaggcattttt

SEQ ID NO: 4297 - DNA, 101 bp, rice(Oryza sativa)
  misc_feature (71): n=a or g
ccaacagtcggtggcggtgtgacctcgcttgaagcagacctggcacgttggcttgcgatctggtcctcctngagcacgcccgcgaccacggccgccaccat

SEQ ID NO: 4298 - DNA, 101 bp, rice(Oryza sativa)
  misc_feature (71): n=t or c
gccagcccatcgtattcgtagttctcatctcgcagagtgccgcaagcctgatcgaaacccttcacaactcngcctcgtgttagtcttctgcggcttcgccc

SEQ ID NO: 4299 - DNA, 101 bp, rice(Oryza sativa)
  misc_feature (71): n=a or c
gagcctaagctaattgcttgctatgatcaagttagatgttgtttggttgcaagtattttcttgcagaaacnctccgtgtattctccaatccatatttgaat

SEQ ID NO: 4300 - DNA, 101 bp, rice(Oryza sativa)
  misc_feature (71): n=a or c
taaaatggagaagggaactattcttcttcacttcctggttctcgctgtgtgatctactgaatcttcttctngcattttagtttgcatcaagttcctttcga

SEQ ID NO: 4301 - DNA, 101 bp, rice(Oryza sativa)
  misc_feature (71): n=a or c
tacatctaagatactccagtaattaattatcccagtgtcactttgagcatgctgagggacttgaaataatnatgtcccaattgtagaatgtttttctttcc

SEQ ID NO: 4302 - DNA, 101 bp, rice(Oryza sativa)
  misc_feature (71): n=a or g
ctatcaaactaatgaccggatgcttgtgattcatgaagttttaagactgacaattctgcagctaatctatncttcctataaagatacaacccactaattct

SEQ ID NO: 4303 - DNA, 101 bp, rice(Oryza sativa)
  misc_feature (71): n=c or g
aatggagaattaaattggtgacttaatttgattacatcatggcgtgggctgtatagttgtataaccgggtngatgattttgagatggatctttaaagaaca

SEQ ID NO: 4304 - DNA, 101 bp, rice(Oryza sativa)
  misc_feature (71): n=a or g
agagttgtggatgatgttgattttttctagccttgtggatgttgttgagattcagttgtcggctcggagcntcgactcgatgcattcgagcctaccatttc

SEQ ID NO: 4305 - DNA, 101 bp, rice(Oryza sativa)
  misc_feature (71): n=t or c
ctagctaacaattggaattatgtttctaattatcattgaattccaagttgcaagagttttgcacgacatantaacataagtatatagaagcgtgtgcttgc

SEQ ID NO: 4306 - DNA, 101 bp, rice(Oryza sativa)
  misc_feature (71): n=a or c
ccatctgtgaaaattatttgttacatccggatgtgatgctcgcacgttaaaataccgattttcgtagacanctcacacctattacttgagagtggaggaat

SEQ ID NO: 4307 - DNA, 101 bp, rice(Oryza sativa)
  misc_feature (71): n=a or g
acaatgggaaataataaggtttcagcttcagcttttttatttctgcatcaaagaattcctgcaccaaaccncataggacttagggaaaaagaacatgatta

SEQ ID NO: 4308 - DNA, 101 bp, rice(Oryza sativa)
  misc_feature (71): n=t or c
gtatctaaaagtttatccaatttttattgaagaaaagaaccgggcttaattggtgttggagatgttgctanatttttatataaacatgatcaaactttaaa

SEQ ID NO: 4309 - DNA, 101 bp, rice(Oryza sativa)
  misc_feature (71): n=a or c
taggaagtcatttatcggcggttcctgtatgtcagtcttgacaaacgatcagccaccatattttctactcntttcttatcttttatttccatatcaaattc

SEQ ID NO: 4310 - DNA, 101 bp, rice(Oryza sativa)
  misc_feature (71): n=t or c
ttttagtctacaaagagattaccctcatataagagttgagacgacagatgctctagcaatttttctgttanctttctcttctttatccttcctcatgcatc

SEQ ID NO: 4311 - DNA, 101 bp, rice(Oryza sativa)
  misc_feature (71): n=t or c
gcgcgccgaactccatgccgacatgaaggcattgatctcatccctggcagccgggcggaggaggagtgagngaaggaatgcgccgagctccatgatggcga

SEQ ID NO: 4312 - DNA, 101 bp, rice(Oryza sativa)
  misc_feature (71): n=t or c
tatagcaacttcattcatagcaatttcagattgactgacatctaaacatataccttgaaagtattaacgcnatggttcagcaatgtaatctattatatact

SEQ ID NO: 4313 - DNA, 101 bp, rice(Oryza sativa)
  misc_feature (71): n=a or g
aacattaatactacagcaaaacaaccagctagagacgatctgcttactacgatttatcaaaccgtctgtantgaactcaactaccgtataccacgagcaca

SEQ ID NO: 4314 - DNA, 101 bp, rice(Oryza sativa)
  misc_feature (71): n=a or g
actcatgaagtggtacaattttaatatagagtttgcctttataagatacatcttgaaaagcttatctaacnagacgcaaatatatatctgttgattcttca

SEQ ID NO: 4315 - DNA, 101 bp, rice(Oryza sativa)
  misc_feature (71): n=t or c
ggcggaggtcagagaagagccggaagatgttgatgccgtgctgcccgaagtcatggagaatctggtggacncggtagacatggcgaagacgtggcacagtc

SEQ ID NO: 4316 - DNA, 101 bp, rice(Oryza sativa)
  misc_feature (71): n=a or g
ctttcccctgctggtattcaaagcatagatcacataaagctgtagaggcgtcagatagatgagctaaaganagcttggtcaaaatagttgactgctgcctg

SEQ ID NO: 4317 - DNA, 101 bp, rice(Oryza sativa)
  misc_feature (71): n=a or g
atttgctgcagtggaaggttttagggcatactgaagaagctagcacgatgatggttgtggcagagaagatnaagaccgctgctgccaactctgaaagtgat

SEQ ID NO: 4318 - DNA, 101 bp, rice(Oryza sativa)
  misc_feature (71): n=t or c
agttcttcaagatccataacgtcatagctatcagaccttctaagaatgtcatctccatctttggcagaatnctgaggattgacaatggacagattccacat

SEQ ID NO: 4319 - DNA, 101 bp, rice(Oryza sativa)
  misc_feature (71): n=a or c
cgagggagatgggttgggatcctatgaaaaagaacaaagccactagtggtgtaaaatgcaacaaataggantatataggatttttcttggttgggctattc

SEQ ID NO: 4320 - DNA, 101 bp, rice(Oryza sativa)
  misc_feature (71): n=t or c
ttgtttttttccattactccattattttgtaaaacaaatattgacctgacgttttctttggtggtacacanatattacgtgttgcacatttaaaaacattt

SEQ ID NO: 4321 - DNA, 101 bp, rice(Oryza sativa)
  misc_feature (71): n=t or c
tttttgtaaggcaagatcgaggccaaagataggctctgtagggattcggatcgtctgatttgcgaagtaangtcacgggcgtgcagttataccacatccag

SEQ ID NO: 4322 - DNA, 101 bp, rice(Oryza sativa)
  misc_feature (71): n=c or g
tccaggaaatcgtcaagatctctctccttgcactaggcatcctcttcatggcgacgtgggtgcctcacatntactccttcatgagggctttgttcatggtg

SEQ ID NO: 4323 - DNA, 101 bp, rice(Oryza sativa)
  misc_feature (71): n=t or c
tctaataggcctctccatcatttgacagcttgcacaatagtccaactcgccatcccataaatactcccatngttgtgttcaaccaatgcacactgaggatt

SEQ ID NO: 4324 - DNA, 101 bp, rice(Oryza sativa)
  misc_feature (71): n=t or c
tttatttgtttttttatttaattggttaaatgaactttgggtctgtttgggacaactccaactctagctcnacccccctagagctggagctcagccaaata

SEQ ID NO: 4325 - DNA, 101 bp, rice(Oryza sativa)
  misc_feature (71): n=t or c
aaaataagattgtctaaaatgttaattattgtggaaccgaaaggaccagtgattagacctgatcaaactcnagagccctgccccttgattatctaaagata

SEQ ID NO: 4326 - DNA, 101 bp, rice(Oryza sativa)
  misc_feature (71): n=c or g
tctccgtgctcccgctgccgcagatccccatctggaacttcctccaccgccccaagggcgccgacctcctncccaccaagaacgccctcctcttcatcgtc

SEQ ID NO: 4327 - DNA, 101 bp, rice(Oryza sativa)
  misc_feature (71): n=a or c
ccttcgccggcgccgcctactacctcctcctctacatgctcgccagccacgtacgtccactaatcttctcnttcgatttgtaaatttcacataacgtaagt

SEQ ID NO: 4328 - DNA, 101 bp, rice(Oryza sativa)
  misc_feature (71): n=a or g
aactgctcttcctgcagagactgtattgaagatggctactattaatggtgcaaaagcagttctgtgggacnatgaaataggttcgctggaggttgggaaga

SEQ ID NO: 4329 - DNA, 101 bp, rice(Oryza sativa)
  misc_feature (71): n=a or g
aactcaaatgacaggtaacatgctttgcggaagcaggtgggcagtatgtttcagaaatggcacgtgcagtngagttgctgggattgcgtgcatgcttgaca

SEQ ID NO: 4330 - DNA, 101 bp, rice(Oryza sativa)
  misc_feature (71): n=a or c
tcttctagtcaaaacagctaacttagcctagtggttggcaaggtttgcatctatcctaacagcctggggtngaatcccacctttgcaccatattttttctc

SEQ ID NO: 4331 - DNA, 101 bp, rice(Oryza sativa)
  misc_feature (71): n=t or c
aaaaatgaatggtgtaatcccataatcgatcttattggttaggatcgtcaaccaaattaatctaaaaattngtgtcgtacttatgaatcgtgtgttgttcc

SEQ ID NO: 4332 - DNA, 101 bp, rice(Oryza sativa)
  misc_feature (71): n=a or g
aaaaaaaaacttttgtgctgaacaattccgcaactatacatctaaaaatcataccacaaatttttaacctnccattgacaataaagtttaactggcctact

SEQ ID NO: 4333 - DNA, 101 bp, rice(Oryza sativa)
  misc_feature (71): n=a or g
gcccccctatcaggggtgggtggcctccgatctagggcgtgcagcgagcagctttccccacagcaagggcncggcttgcacaacacgatgcgtggcagaca

SEQ ID NO: 4334 - DNA, 101 bp, rice(Oryza sativa)
  misc_feature (71): n=a or g
accatactcagcacgtcaccactatggtaatgcatataataattataggggcacattgttggcttggtctngttgcataaacgtatgacctagcagttttg

SEQ ID NO: 4335 - DNA, 101 bp, rice(Oryza sativa)
  misc_feature (71): n=t or c
cgcctaattagggggacaaaagatggccaagatgatttcagcatgggtggtgagctgtcgaccccatggcnatcaacacctaaagaggagcctgtgaattc

SEQ ID NO: 4336 - DNA, 101 bp, rice(Oryza sativa)
  misc_feature (71): n=t or c
aaggaggaggagcaagcaagcaagcaaagctatctgctgaattctgaatggcgctccgtacgttatttgtngagggaggcggctgttgggctgcttgccag

SEQ ID NO: 4337 - DNA, 101 bp, rice(Oryza sativa)
  misc_feature (71): n=a or g
cacgccaccaacccttgccgccgagccaccgaacgtctccagcaaactcggtctgaccaagaccgaaaccnaaaaaaccgagaccggatttgtcggtcctg

SEQ ID NO: 4338 - DNA, 101 bp, rice(Oryza sativa)
  misc_feature (71): n=a or g
tctgcaagacacacacaaaatactcaacaaaaatgaccaactcccttgtattaattgccaaaactacatcnttcactgataaattcatataacttgtgcca

SEQ ID NO: 4339 - DNA, 101 bp, rice(Oryza sativa)
  misc_feature (71): n=a or g
ttacttataaatatatgttacatcattaataactagtcccacctcttatacacataacgtgctaagatccntagttcatttctcttctctctttgttttat

SEQ ID NO: 4340 - DNA, 101 bp, rice(Oryza sativa)
  misc_feature (71): n=a or g
atacactcgggatgaaggctgtgtttagtttctaaaattgggttcaagtttgagaaaagttggtagtttgnaaaaaaagttgggagtttatgtgtgtagga

SEQ ID NO: 4341 - DNA, 101 bp, rice(Oryza sativa)
  misc_feature (71): n=a or c
agatgatgtttggatggccagcaaggtggtgcatgatcctgatctcgcggcggatgaactccacgtcgtcntcaatgacgagcttctgctttgcgatcgac

SEQ ID NO: 4342 - DNA, 101 bp, rice(Oryza sativa)
  misc_feature (71): n=t or g
ataacaaactcggaaacaaaaaagaactaatggcacttacaacaatgccctagtattttgcaccaagcaangatcttggatcagcctccattccagacacc

SEQ ID NO: 4343 - DNA, 101 bp, rice(Oryza sativa)
  misc_feature (71): n=a or t
aagaatttggatcctcaaatgtttgtaagcaagagtaaattgcttgttacaaaaggcatcaggttttcaancatacatgactggggtcaaaattctaaaca

SEQ ID NO: 4344 - DNA, 101 bp, rice(Oryza sativa)
  misc_feature (71): n=a or g
tggttgatgttacaattcctaaaccttatgttggagttcagaacagaagcaaaacatgatctcaacggatnagcaatatgagagatgttctgacagctaaa

SEQ ID NO: 4345 - DNA, 101 bp, rice(Oryza sativa)
  misc_feature (71): n=t or c
gttggcccgtacctcgctgatgccttggcactgtgggccggctcagcacggcacagtcaaaaaaaaaatanttgagggatacaaaacagatttattccagt

SEQ ID NO: 4346 - DNA, 101 bp, rice(Oryza sativa)
  misc_feature (71): n=a or g
ggtcgttaattatttttttaaaagtctgcttaatttcgttgaaaaaaatattgggtgtttattaaaaaaanattttggacctaccgtgggcaagtcgatgt

SEQ ID NO: 4347 - DNA, 101 bp, rice(Oryza sativa)
  misc_feature (71): n=t or c
tgccattgatgtagcttcagcacttgaatatcttcaccaatatagaccagccccaatagttcattgcgatnttaagccaagcaatattctccttgataatg

SEQ ID NO: 4348 - DNA, 101 bp, rice(Oryza sativa)
  misc_feature (71): n=a or g
taataatttgaatctgtagacaatccagatcatgctatatggagtataacattattaattgcctctttgtnaataaccattatcagaactatatattcatc

SEQ ID NO: 4349 - DNA, 101 bp, rice(Oryza sativa)
  misc_feature (71): n=t or c
agggtgacaaaataatcataactgaacttcattgtctatggtataccactatatctcatatgggttattanttacggcatttgggagttcagaaagaacgt

SEQ ID NO: 4350 - DNA, 101 bp, rice(Oryza sativa)
  misc_feature (71): n=a or c
gtttcataggttgtttttccattaatcattatgtgcacttcgtaagggagaaacaaactttcaatatttcnagaatcaaaattcgacatcttatcattata

SEQ ID NO: 4351 - DNA, 101 bp, rice(Oryza sativa)
  misc_feature (71): n=t or g
gatgcgctgcttctgctgctgctttgttttgcttgctgtgcttctgggcttcttgcgttggacagtaactnttgacgtgctgtttattttgccctcaaatg

SEQ ID NO: 4352 - DNA, 101 bp, rice(Oryza sativa)
  misc_feature (71): n=t or g
tcactcaagtaccaactcaacttaaacttctgacagaacaacttccttccaagtacattcagaggcagtgntatgagataatattagattatataaaaaaa

SEQ ID NO: 4353 - DNA, 101 bp, rice(Oryza sativa)
  misc_feature (71): n=a or g
agagtaacataagcacatcgttgcttgagatgaatacacacaattgatctagagtacatgtatgttctgcncattggaattggaggtatccagaaaatgga

SEQ ID NO: 4354 - DNA, 101 bp, rice(Oryza sativa)
  misc_feature (71): n=a or g
gtggttccgcccctgtgtggcggtagtgtaaaacaattatcatgcactatgcaggccacttgaggaggctncagtgacgtctccaccatgagcacatttgc

SEQ ID NO: 4355 - DNA, 101 bp, rice(Oryza sativa)
  misc_feature (71): n=t or c
accaatcaaatcatctccacatggtaagagcaagatcgtcgctgaatcaaccgatgacgtcatcgatggancatcatcgaagaagaagctggtcaaatccg

SEQ ID NO: 4356 - DNA, 101 bp, rice(Oryza sativa)
  misc_feature (71): n=a or g
gaggaatggaagatccagatatgagccttaccagatgcagtacagtttgatcataagcattggcatttgcncaaaatagatatgttgctgacgaacttgca

SEQ ID NO: 4357 - DNA, 101 bp, rice(Oryza sativa)
  misc_feature (71): n=t or c
cactgcacacagtacagtacacaccctctccacctgcagagatcgagcctctaatcctctataaatatcgntggagctttgcagccaggaagcaagctaag

SEQ ID NO: 4358 - DNA, 101 bp, rice(Oryza sativa)
  misc_feature (71): n=a or g
cagtacaggatcatgggagtttcgatcgattctgtttcctgcagtaagttgttggaacgtactttctctcnttgaagttttattttcaggccgcttgatgt

SEQ ID NO: 4359 - DNA, 101 bp, rice(Oryza sativa)
  misc_feature (71): n=a or c
gtggaacagtggaaacctttgtgtaaagagtaagacccatgaatagctgagtagtttcctacaaacattgngatgttgtcagtagcatcatatgaatatga

SEQ ID NO: 4360 - DNA, 101 bp, rice(Oryza sativa)
  misc_feature (71): n=t or g
cccttgcagtaacgcggtcaagggaaaactctcacttggctggtgtgtctagcccatttcaaactttttantccatattacatcggatgtttggatgctaa

SEQ ID NO: 4361 - DNA, 101 bp, rice(Oryza sativa)
  misc_feature (71): n=a or g
gtgcaagcactttaggaataatggggatgaggatactagcaaaaggtgattgtgattggatctggtccgcntcaatagtactttgaattatgctgcatgtt

SEQ ID NO: 4362 - DNA, 101 bp, rice(Oryza sativa)
  misc_feature (71): n=a or g
tgaggaagagataagtgagggcaaatttcttgagtttgctcatgttcatggaaatgtctatggcactagcnttgaagcagttgaatctgttactgatgagg

SEQ ID NO: 4363 - DNA, 101 bp, rice(Oryza sativa)
  misc_feature (71): n=a or g
ctgtgtctggctccagcttcaatggcacttccttcctcagtggtaactccgtaaatgcaccaccagctccngaggtaaaaataaaatacatatcattttca

SEQ ID NO: 4364 - DNA, 101 bp, rice(Oryza sativa)
  misc_feature (71): n=t or g
taatcagttcagtgtcagtttaccagagcttctgcttccccctgcggcttgagcataagattcgcctttantatttcggctttggctgccttcatccccct

SEQ ID NO: 4365 - DNA, 101 bp, rice(Oryza sativa)
  misc_feature (71): n=t or c
ataaatacggattcgttagttgtgtgtttctcaagacttatctttgtatcctatatatttgaagaaaaaanctcaacatgaattgagtaacaatgatctag

SEQ ID NO: 4366 - DNA, 101 bp, rice(Oryza sativa)
  misc_feature (71): n=a or g
ctccaccagtgatagttcaaaatttccaactgaaatttctggcctatatagaattcctacaaaattgtttngtcgaaccttttcgatttctttatgaattt

SEQ ID NO: 4367 - DNA, 101 bp, rice(Oryza sativa)
  misc_feature (71): n=a or g
ctaatgacagtaattaatattaattaccataattagcggcagcagcgcacgaactaattgtcagggggacncgcgcgcgagttaagcagctggcgcgcatg

SEQ ID NO: 4368 - DNA, 101 bp, rice(Oryza sativa)
  misc_feature (71): n=t or c
ttaattttttatagacaacatattgaaaataaaaaggtgctcatttgaagatcatattgatcgtatcaagnatgtagactgcaacaagaaatcttagcagt

SEQ ID NO: 4369 - DNA, 101 bp, rice(Oryza sativa)
  misc_feature (71): n=a or g
ttatggcctatacaacttgactggctgttactgtcagtagatggatgccgccatgcaaagtgaaattctcnagtacacagaaaaaataaattagtccttgg

SEQ ID NO: 4370 - DNA, 101 bp, rice(Oryza sativa)
  misc_feature (71): n=a or c
ttacgatctttgagatacttagcacgtagctagaagtaccaaattttaaactgaaatatgtggtatctctnagttccttctcaagaatgataaaattacgt

SEQ ID NO: 4371 - DNA, 101 bp, rice(Oryza sativa)
  misc_feature (71): n=a or c
gagatatagcaaaatcgaaaaaaaaacggaaaattccataaggacagtaggccgtgggcaacgggggaatnccgtttcgcgcctgaacgcatctggagccg

SEQ ID NO: 4372 - DNA, 101 bp, rice(Oryza sativa)
  misc_feature (71): n=t or g
actagttacataaatatatagatatcacccgcaactgtttcaagaatctaatcagcacttacaggagaatnatattttcttacctgtgttttttgaatgcc

SEQ ID NO: 4373 - DNA, 101 bp, rice(Oryza sativa)
  misc_feature (71): n=a or g
agaaagagctggtacctggcgaggtatttctatgtaacaatctgcatacgtgctgttgtaataatcagatntagtgaggagtggaggaatggaacatgatg

SEQ ID NO: 4374 - DNA, 101 bp, rice(Oryza sativa)
  misc_feature (71): n=a or c
gttatagtgttgtctttggtgaaaagaaaaaaaaagttgcaaaaaaaagggacttgagaaaagattgaagnaaaaaaaaagaaggaaaagtgaatagataa

SEQ ID NO: 4375 - DNA, 101 bp, rice(Oryza sativa)
  misc_feature (71): n=a or g
gtatcatattttttaatgtaaaatttgtatcgttagatacttaagtaccttaaggcagaaaaattttagcntaaaatttagctacttcaaagtatttttct

SEQ ID NO: 4376 - DNA, 101 bp, rice(Oryza sativa)
  misc_feature (71): n=a or c
ttgagaatgggtggcctctgcaaaacatcttggacagagatcttgatcagttgcctggtctcactgccccnctgcaaatctacaacacctttttgttaaat

SEQ ID NO: 4377 - DNA, 101 bp, rice(Oryza sativa)
  misc_feature (71): n=a or g
tgagggttttccaaccggcacacattgttgtttctgcagtatgtggttgtcttggctaaccagtgagttcnacctacatgagtgcattccttgaagagatg

SEQ ID NO: 4378 - DNA, 101 bp, rice(Oryza sativa)
  misc_feature (71): n=t or c
gttagcatgcatagactgaataatattaaagttacgaagtttataagagggtacgatgttatatcatttancgttctatgaattttactttgagcctttga

SEQ ID NO: 4379 - DNA, 101 bp, rice(Oryza sativa)
  misc_feature (71): n=a or c
gctgtggaaaagaatacttacgacaacagattactgaaagaaaatagtagtactcgcgtattgaaaaaaanagaaaaagaattaaaattcttatgtgggag

SEQ ID NO: 4380 - DNA, 101 bp, rice(Oryza sativa)
  misc_feature (71): n=a or t
ttatgcagatgaatgcgttcaaaattatctcaggcagttgaccgatgactgattgtcactgttgtactatngctcccagcagaggtgaactcgtgcagagt

SEQ ID NO: 4381 - DNA, 101 bp, rice(Oryza sativa)
  misc_feature (71): n=a or g
cccgtgctaacgcaacggtgatatttagtagagtaaaatggacgggcggctcttaaacttgtagaggtgtntcatctaggtccctaaactcttaaaatgca

SEQ ID NO: 4382 - DNA, 101 bp, rice(Oryza sativa)
  misc_feature (71): n=t or c
ctcgtcaaatgccaccactttactcctttatgaccagcccaccgacttatctctttattgcgattgatatnttaaaagacaaacataattatcatttaggt

SEQ ID NO: 4383 - DNA, 101 bp, rice(Oryza sativa)
  misc_feature (71): n=t or c
cccaactaattcagcatgaggccatgagccggcctgcaagcgccgcagttttatgggcttgtaaatgggcnatctggcccatgaaggcacatttttaagga

SEQ ID NO: 4384 - DNA, 101 bp, rice(Oryza sativa)
  misc_feature (71): n=t or c
tgatttctgtttttttttcagaaatctaattaatatatcttaattggtttatcagttcccctgatatctantcctacccttccaaaataagatcattttta

SEQ ID NO: 4385 - DNA, 101 bp, rice(Oryza sativa)
  misc_feature (71): n=a or c
tttacttggagtgcctcttaattttaggatttggcaaaatatcaatgactggttactattttgccaggttnagcaattttgtcccaaggtgttacatcaca

SEQ ID NO: 4386 - DNA, 101 bp, rice(Oryza sativa)
  misc_feature (71): n=a or g
aggtgataaaacagaaagcacaattagcagaatctggtggactggtgcctatttagggagattggcatatncagctttgtttccctgtggagttcactttc

SEQ ID NO: 4387 - DNA, 101 bp, rice(Oryza sativa)
  misc_feature (71): n=a or g
tgggctggagtaggctgtagttacagctgtgtttgcatcccatgtttctaactcatcttactcgtttttcncgcgcacgctttttaaactactaaataata

SEQ ID NO: 4388 - DNA, 101 bp, rice(Oryza sativa)
  misc_feature (71): n=t or c
taataaaaaataacacctacatattagcaacagaccgattaaaaaattaataaaataaatacataaggccnacatgtcggtgtttcttcccacccattcct

SEQ ID NO: 4389 - DNA, 101 bp, rice(Oryza sativa)
  misc_feature (71): n=a or g
gctagttatacaggtggagacagatttgtaagatggttagatgtaaagttctggtagtttcattctgaagnggaaaaaattgagattggccgaaagtattt

SEQ ID NO: 4390 - DNA, 101 bp, rice(Oryza sativa)
  misc_feature (71): n=a or g
atcgacgctactacttgtaggtgggtagccttctttaacatcgctctagttatcgccatcacatataaganctcatttttttttagagtgaagtgcaccag

SEQ ID NO: 4391 - DNA, 101 bp, rice(Oryza sativa)
  misc_feature (71): n=t or c
acttaaagtatttgatttatctgattatttaatagtagactgaagtaaaatgaggtttgggggtgtggggngacacggatcgtagttggaccgactgactc

SEQ ID NO: 4392 - DNA, 101 bp, rice(Oryza sativa)
  misc_feature (71): n=a or c
gcacctgtacactattgtgattttaaagcttagttttgtgtcaactctaaatgaacatattagtgattgtnagacataaaaacaacatcacagtatataat

SEQ ID NO: 4393 - DNA, 101 bp, rice(Oryza sativa)
  misc_feature (71): n=a or g
ttgtcgtcgtcgtcttctccttcgatctcttctcccctcctcttctttagggttcccgcatcgcatgcacntataaaaaggcggcgctcgtgcgcgtgaga

SEQ ID NO: 4394 - DNA, 101 bp, rice(Oryza sativa)
  misc_feature (71): n=t or c
cttaggtgtttggattcctgtcatatgataaattggaagagcagcgagaactgatttaacgagagtttcangtcctgctgaagtgaaaaactttcctttcc

SEQ ID NO: 4395 - DNA, 101 bp, rice(Oryza sativa)
  misc_feature (71): n=t or c
tatgtaacccatgtacagtccatttaagtgggttggcccattaacccacataggcctacttgtatccctanagttaaatcagagaagagagagatggggat

SEQ ID NO: 4396 - DNA, 101 bp, rice(Oryza sativa)
  misc_feature (71): n=t or c
ttttttctgtggctgaatttttatattgttttttttcctgtgccaaagatactcttgtggcagacagaaanaggagtatactccctccgtcccgaaaaaag

SEQ ID NO: 4397 - DNA, 101 bp, rice(Oryza sativa)
  misc_feature (71): n=a or g
cggcatagagacatttttttttgtcataattgatatatcaatttacaagattgatccatcaataactattngaccaaaagtagaaatagataatcacttga

SEQ ID NO: 4398 - DNA, 101 bp, rice(Oryza sativa)
  misc_feature (71): n=t or g
gctgtcagtgttgtcactgaaaacaagcaaaggtgcatttccatgtgtgaaatgtacctgatgatgatgangggagagatgagatgagatgagatgagatg

SEQ ID NO: 4399 - DNA, 101 bp, rice(Oryza sativa)
  misc_feature (71): n=t or c
agtggattaaaactcggcctctgcatccaaatcggacgtacacaaccaaaatttctaaaccgtttcaatgnccaaatcatcaagtaaaaaaaaactaaaga

SEQ ID NO: 4400 - DNA, 101 bp, rice(Oryza sativa)
  misc_feature (71): n=t or c
aaattgctgctcctagacagaggaagaaaaaaggaaaaggaaccccctatcctcccaataggtcccaaaangaagcggcactagctaaagactagagcgct

SEQ ID NO: 4401 - DNA, 101 bp, rice(Oryza sativa)
  misc_feature (71): n=a or g
gtcacttgattaagagagatatgatgacaattctgctgcctaattttgtatgttatctgaatatattcctnatcatgatgatctatcgcatttgagattaa

SEQ ID NO: 4402 - DNA, 101 bp, rice(Oryza sativa)
  misc_feature (71): n=a or g
cgatcaatcgatccaaatattcgtacgatttgcattgcatgcgatggcaattattcacggtgtcgatcccntccttgcgtccaaaggcacatgtaggcccc

SEQ ID NO: 4403 - DNA, 101 bp, rice(Oryza sativa)
  misc_feature (71): n=a or c
gcctctccaccacattggtcctctcttcagcacggctccgccgtggatttcatcgccatgacacgagaccnccgccctccgcccatgcacggcggtggtgg

SEQ ID NO: 4404 - DNA, 101 bp, rice(Oryza sativa)
  misc_feature (71): n=a or g
agtgatgattaaaccgggatgaagggagtatatatatgataattaagaagagcacatcgaagctaacgaantagattataaataggcgtgatttttaaaga

SEQ ID NO: 4405 - DNA, 101 bp, rice(Oryza sativa)
  misc_feature (71): n=t or c
ttctcagttaaccgaatgacccaccctatttgagatctcatcactatcttgaagagtatttctactccacncaaaaaaggagcgaagccgacaggttcggg

SEQ ID NO: 4406 - DNA, 101 bp, rice(Oryza sativa)
  misc_feature (71): n=a or g
agaaagcgagcgacaattttgtagccgggcaatagcacgggttcacatgcgctacaactcgcatgcagccngtgaagacgattaacgacgcgttttgcggg

SEQ ID NO: 4407 - DNA, 101 bp, rice(Oryza sativa)
  misc_feature (71): n=t or g
tttggcgtttgcaggatacgaacggtgagagccaaagtggacttttttccttctccttttcctttgtgttntttcgtggcccatcggcccacggcctgcgc

SEQ ID NO: 4408 - DNA, 101 bp, rice(Oryza sativa)
  misc_feature (71): n=t or c
cttatgtcgttcgcctatgaaaaaggtcatgaaaaaaataagtcctcaaaaccaaaaccctagctcctatntgtcggtatcaccatagccgtagtagccgc

SEQ ID NO: 4409 - DNA, 101 bp, rice(Oryza sativa)
  misc_feature (71): n=a or g
ctgctacaaccaaactatgttggttttctactctctgctgtgaccgaactatgttggttttttataagatngagggagtacgtagtagcagcagtcattct

SEQ ID NO: 4410 - DNA, 101 bp, rice(Oryza sativa)
  misc_feature (71): n=t or c
taccataatttatttttcaaatggccggatattatcctgagatctatatatgctagattgatttcaattanccccatataaaaaaatataatttctactac

SEQ ID NO: 4411 - DNA, 101 bp, rice(Oryza sativa)
  misc_feature (71): n=a or g
tcctatgatttagagtagtaaatgataaaactgcactgaattatcccctgcaggagactgtcatttcttcntgatctgtaacaactgaaaaaaggtaatta

SEQ ID NO: 4412 - DNA, 101 bp, rice(Oryza sativa)
  misc_feature (71): n=a or t
cattcgtttttttttctaaaaaaaatcttcgcatcattgtcaacgctagagaggggttaacattttttttnaaaaaaaactatgcttataagaatgtgaag

SEQ ID NO: 4413 - DNA, 101 bp, rice(Oryza sativa)
  misc_feature (71): n=a or g
gaaaaaactaagcggttttcgtcagtttaaacccatttcctgctcttcccttccatcttcctctcgagaanatggaagggaaaaaaccaagcggttttcag

SEQ ID NO: 4414 - DNA, 101 bp, rice(Oryza sativa)
  misc_feature (71): n=a or c
atcaactcaaaagcagacaacaaattactgccaggtcaccccaaccccttggccccactgtcagtgactancccccctccatcgtcctggcccactgaccc

SEQ ID NO: 4415 - DNA, 101 bp, rice(Oryza sativa)
  misc_feature (71): n=t or g
agttgtaatatcaggtggctaattaatgaaatctgtgtattcagttgatccttgcgtctcctggtattctnaaataaaactgtgcaaatgcaagtgtaaag

SEQ ID NO: 4416 - DNA, 101 bp, rice(Oryza sativa)
  misc_feature (71): n=t or c
atataggagaactaaaggagaactaaattgggtgcataagccacatgtttcatgcaaaaaaatttctatgntaatttttctccgaatgttttttctaaagc

SEQ ID NO: 4417 - DNA, 101 bp, rice(Oryza sativa)
  misc_feature (71): n=a or g
tctttatccggccaagaagcatccatacatgacactaaccctaaacaaaaaccaaactgaacctgtaacanagagagagagagagcaaagagaaaaaccgt

SEQ ID NO: 4418 - DNA, 101 bp, rice(Oryza sativa)
  misc_feature (71): n=a or g
ttgagaaaactgtgccttttgcaacttcagtgctggatgggtacaatgtttgcatatttgcttatggacanacgggcactggtaaaacatttacaatggaa

SEQ ID NO: 4419 - DNA, 101 bp, rice(Oryza sativa)
  misc_feature (71): n=a or t
attgtttcttccaatcactggttatttcctccgtcaagttgaaccatggaaggcaccaacgttttgttttnaaaaaaatattttgtcttttttgcatctga

SEQ ID NO: 4420 - DNA, 101 bp, rice(Oryza sativa)
  misc_feature (71): n=a or g
aaaccatattacataccccttcatcctaaaaaacccaatcctagctaactatgaatttggatacatgtgtntataaattcgtaattaggattggccttttt

SEQ ID NO: 4421 - DNA, 101 bp, rice(Oryza sativa)
  misc_feature (71): n=t or c
ctcctcccagtgaaacagcgttcttatccccctcccatgaagcaagaggcggcggcagcgtcagcaccganggtcgaagcagtggtagacgagcccacaca

SEQ ID NO: 4422 - DNA, 101 bp, rice(Oryza sativa)
  misc_feature (71): n=a or c
cataagattattatctacagtagtaaaaacattgcattgtacccttaagcttaagttacagttacactgtnaattgcacccaaatcatatccctcaatggc

SEQ ID NO: 4423 - DNA, 101 bp, rice(Oryza sativa)
  misc_feature (71): n=t or c
ggcggtccactgtcagtctcttaccatctttcaaagaagtccctagactttaggcctgttcactttgatgncatttttaaccttaccaaattttggtaaag

SEQ ID NO: 4424 - DNA, 101 bp, rice(Oryza sativa)
  misc_feature (71): n=t or c
caaataataacaggaagcgctaaaggttctaaagcttatatccctagaattgtttctgtttcgacagaccngaaatggcctttcaagatgagacgtcgtca

SEQ ID NO: 4425 - DNA, 101 bp, rice(Oryza sativa)
  misc_feature (71): n=t or c
attctgaattcccagttctgctttgctgcacaaaactcaagtatcagctccccaattcagaaatgtactcnctctgtcctaaaatataagcattattagaa

SEQ ID NO: 4426 - DNA, 101 bp, rice(Oryza sativa)
  misc_feature (71): n=a or g
aagtgagtcgggttgccattagaaaaccagctccatgcatgcatgcctgcgtcgtactacgtccatatttntgtacgacgccgttaacttttttgtctaat

SEQ ID NO: 4427 - DNA, 101 bp, rice(Oryza sativa)
  misc_feature (71): n=a or t
cttttcatccatttatccatgcaggcaggcagcatgtcatgtgcccaattacacattgaataataattaantgtcgcgttgattggcttgatcagctaatt

SEQ ID NO: 4428 - DNA, 101 bp, rice(Oryza sativa)
  misc_feature (71): n=a or c
gtatagatgtacgtactgtacgtctctcactcaaatgtctacattatatatacgatgtatactcacatcanagaaattttttgagcggtaatatataaaat

SEQ ID NO: 4429 - DNA, 101 bp, rice(Oryza sativa)
  misc_feature (71): n=t or c
aattttattagaatactatttaaaacaactttgttaacataagaattcagattatattactcaattttagntatcagattaaaaggagtactaaaagaaat

SEQ ID NO: 4430 - DNA, 101 bp, rice(Oryza sativa)
  misc_feature (71): n=t or c
aggttgaggggttcggagattaaaacgacgaccctttgtttcttgttttttaacggcacattttctactanatattctctttattttttctcatgttcctt

SEQ ID NO: 4431 - DNA, 101 bp, rice(Oryza sativa)
  misc_feature (71): n=a or g
aatctgcgcgggccaccatgctagttatctttggatatcacaattttttacaagcgtgcaccttaaccacncgtataaaaaatgatttttcatacgacctc

SEQ ID NO: 4432 - DNA, 88 bp, rice(Oryza sativa)
  misc_feature (71): n=- or a
tacaccagcgcccacgccgaccgcttcgcctccaagctcccatggaaggagaccctctccttcggcttccncgaccgcgccgccgccc

SEQ ID NO: 4433 - DNA, 89 bp, rice(Oryza sativa)
  misc_feature (71): n=- or c
gccgactacttctccagcaccctcggccccgacttcgcgccaatggggtaattaaaacgatggtggacganattgcatttcaaattcaa

SEQ ID NO: 4434 - DNA, 84 bp, rice(Oryza sativa)
  misc_feature (71): n=- or c
gctcgaaaaataggatcgacctaacccatctcattccatatcccactaaccaaacacaagctaaaagtctnaccctaaccttat

SEQ ID NO: 4435 - DNA, 86 bp, rice(Oryza sativa)
  misc_feature (71): n=- or g
cgaatcctgcccctgagtaacaatgactgacttttaatttgtttgcagctagggtggggatcgagatggtnatcttggagcagcca

SEQ ID NO: 4436 - DNA, 86 bp, rice(Oryza sativa)
  misc_feature (71): n=- or t
ccgagccagcacggcggagtcgctgcggccggtagcccgcagtacggctgtcgctacgactacctcctgcngatgatgtgcaatta

SEQ ID NO: 4437 - DNA, 90 bp, rice(Oryza sativa)
  misc_feature (71): n=- or c
agaagcttaagacggtggtggtggtgttgtcggacgacgacgacgactacgaggaggagttccggaggtantgcgaaaacaccacactcc

SEQ ID NO: 4438 - DNA, 82 bp, rice(Oryza sativa)
  misc_feature (71): n=- or a
gaagtgatccccgccgacatgccggcggcgccgttcacgccacgccacggcgacggcgagacatgggttgncagaaagagga

SEQ ID NO: 4439 - DNA, 71 bp, rice(Oryza sativa)
  misc_feature (71): n=t or c
cgtggccttgacgaagcagttgagcatgaggagcactgccatcctgacctgctcttgcttcattatcaatn

SEQ ID NO: 4440 - DNA, 71 bp, rice(Oryza sativa)
  misc_feature (1): n=t or g
ntttgtgtgtgtcagtgtgtgtgtgaatttgtgtgttcttgcaccattgtagaagggacaaggtggcctat

SEQ ID NO: 4441 - DNA, 141 bp, rice(Oryza sativa)
  misc_feature (71): n=t or c
gatcttctgctgccccactcaagatataattctaaggtcacaatcagccgtgccaccaaaatgcgcatttncggttacctggacaccggcatcaacactttggtgatcaacgaaaccacagttaaggtatttgtccctttg

SEQ ID NO: 4442 - DNA, 71 bp, rice(Oryza sativa)
  misc_feature (71): n=t or g
atttggagggagcactccctagcctaataactgcagcctacttcactgattattttttttctttgattcan

SEQ ID NO: 4443 - DNA, 141 bp, rice(Oryza sativa)
  misc_feature (71): n=t or g
tgcgcgcgcgtgttagattcgcgtgcgaatccaacacaagcagatcgatcacgcacggtacgccatgggcnaggcggtgaaggggccagtggtggtgacgggcgcgtcgggcttcgtcggctcatggctcgtcatgaagct

SEQ ID NO: 4444 - DNA, 141 bp, rice(Oryza sativa)
  misc_feature (71): n=a or c
gtgtacgtgttgttgttgttgttttcagctaacgttgggaagacgaagccgttgctggagctggcggggtngaaggagaggctgacgctgtggaaggccgacctgggcgaggaaggcagcttcgacgcggcgatcaggggt

SEQ ID NO: 4445 - DNA, 141 bp, rice(Oryza sativa)
  misc_feature (71): n=t or g
cgtactactactacgtacactacgtacgggtagggttcggcgatgatggtattgatgtatactggacattncatgatacacgtaccaccaaatgctaaggatctttggacgagatggctagtgtttggtgcaaagatctag

SEQ ID NO: 4446 - DNA, 75 bp, rice(Oryza sativa)
  misc_feature (5): n=a or t
gcgcngcgaggagatgaaggagctgtcgctgacgatcatggaactcctggagctgagcctgggcgtggagcgagg

SEQ ID NO: 4447 - DNA, 141 bp, rice(Oryza sativa)
  misc_feature (71): n=t or c
gacgctcggcacgggcccgcactgcgaccccaccgccctcaccatcctcctccaggacgacgtcggcggcntcgaggtcctcgtcgacggcgaatggcgccccgtcagccccgtccccggcgccatggtcatcaacatcgg

SEQ ID NO: 4448 - DNA, 71 bp, rice(Oryza sativa)
  misc_feature (71): n=a or c
tggcagttggcaatctatattcctttttatgaaaaaaatacttaaccaataaagatgtccattctgcaaan

SEQ ID NO: 4449 - DNA, 71 bp, rice(Oryza sativa)
  misc_feature (71): n=t or c
agaggtacacgaggccgcaggggctgtacgagcacagggacatcgaccagaagaagctccggaagctgatn

SEQ ID NO: 4450 - DNA, 141 bp, rice(Oryza sativa)
  misc_feature (71): n=t or g
gcatggtaagagtaaagacgagaagaaatggaagtagtacaaaaagaaacagcaggctggcttactctctncagcatctggaggcagcgtggatcccttcgattgaatttatttcaccctgcaagaaatatatatacagtt

SEQ ID NO: 4451 - DNA, 71 bp, rice(Oryza sativa)
  misc_feature (1): n=a or g
ngaggatgagcagccgccggcggcgctgctgcagcagcagatccaggagaggtagctgaggcagcacgcac

SEQ ID NO: 4452 - DNA, 71 bp, rice(Oryza sativa)
  misc_feature (71): n=t or g
gcaggtgcagtgcggtgggtgggcatggcgacgaaagctggggtgatcgccacgctcctggccctgaaccn

SEQ ID NO: 4453 - DNA, 141 bp, rice(Oryza sativa)
  misc_feature (71): n=a or t
ggtgcagtgcggtgggtgggcatggcgacgaaagctggggtgatcgccacgctcctggccctgaacctccncttcttcaccttctccgacgcgtgcggctgccagtgcggctcatgccctagtcccggcggaggaggcggt

SEQ ID NO: 4454 - DNA, 141 bp, rice(Oryza sativa)
  misc_feature (71): n=a or t
gtattgttgacatattcaaagatcaagctaggagtcttagaatgttgatctctgacaatatcaagaagctncacaatgtttggacctccacaaagattctgaagtattttaatctcccttttgatctgttcaaacatatga

SEQ ID NO: 4455 - DNA, 141 bp, rice(Oryza sativa)
  misc_feature (71): n=a or t
caatctcagcgctgccacttttcaatagaatcgagacaatggcattggcgatagggagagtcggaaagtancacagactgagcattaggtcgaacaccttcagtgcaagttcaaagttagagccactaacagctttcttga

SEQ ID NO: 4456 - DNA, 141 bp, rice(Oryza sativa)
  misc_feature (71): n=t or c
cttagtttgacaatcctttctttgtcccttctctccatctcttggtcagggccagtcaattttgctatttnagcccttaggctctcagcaccttcaaatgcttcctgacaattgttcaacagcacacgcttgaatgtaatc

SEQ ID NO: 4457 - DNA, 71 bp, rice(Oryza sativa)
  misc_feature (1): n=a or g
ntcgagatccccgaccactccacgtacgtcaagttcgacgtgttcgtgaacgcgcccgagagcggggacgg

SEQ ID NO: 4458 - DNA, 141 bp, rice(Oryza sativa)
  misc_feature (71): n=a or c
gcggcgacccggcgccgccgccaccagccgccgcgcccccaacgccggcgcggcggtcgtcgtccagacgnttggcggtgatgaggatgagcgtctcgtgcagcgtccagttccccttgcggtagtcccgcggcgccgacc

SEQ ID NO: 4459 - DNA, 71 bp, rice(Oryza sativa)
  misc_feature (1): n=t or g
ntatacatatatgtttataattctttgtttcccctcttattcagatcgatcacatgcatctttcattgctc

SEQ ID NO: 4460 - DNA, 71 bp, rice(Oryza sativa)
  misc_feature (1): n=a or g
nttcagatcgatcacatgcatctttcattgctcgtttttccttacaagtagtctcatacatgctaatttct

SEQ ID NO: 4461 - DNA, 71 bp, rice(Oryza sativa)
  misc_feature (1): n=a or c
nctagctaacgatgatcccgatcgatctgctgcatgctcactatcatcatccagcatgctatacattgcag

SEQ ID NO: 4462 - DNA, 141 bp, rice(Oryza sativa)
  misc_feature (71): n=a or c
tcggcagcagcagcttctctttcttcgagcagctggcagggtaccctgatattctgagttacaaggcattnagctactgcttgcccactgacgagaccaagcccggatacatgatcctgggaagatacgaccgtgccgcca

SEQ ID NO: 4463 - DNA, 141 bp, rice(Oryza sativa)
  misc_feature (71): n=t or c
aacagggttactcgatccttcggaacaaccttcgacatccaggggaaacaattcggcttcaaatatgccgnttgctgatcgtcgattattcctcatcctatgatatcttatagcttgcgggtacgtaccaagtatatatca

SEQ ID NO: 4464 - DNA, 141 bp, rice(Oryza sativa)
  misc_feature (71): n=a or g
gaacccggaggtggacgtgcacctgcagtccgacggctacgccaactacaccgtggcctcgctggactccngcaagccgcggtgcaaggcggcgctgcagcgcgagctggggctggaggtgcgcgacgacgtgccgctgat

SEQ ID NO: 4465 - DNA, 141 bp, rice(Oryza sativa)
  misc_feature (71): n=a or g
caaccagctctacgccatggcgtacggcaccgtccccgtcgtgcacgccgtcggcgggctgagggacaccntgtcggcgttcgacccgttcgaggacaccggcctcgggtggacgttcgaccgcgccgagccgcacaagct

SEQ ID NO: 4466 - DNA, 71 bp, rice(Oryza sativa)
  misc_feature (71): n=t or g
acaacaacagcaacagcagcaacaacggcatgtattttggtgaagtcgatgagtactttgatcttgtcggn

SEQ ID NO: 4467 - DNA, 74 bp, rice(Oryza sativa)
  misc_feature (71): n=c or g
ccccggccgcgctcgcgtgccgcgccgacgccgccgcgctgtgcgtggcgtgcgacgtgcaggtgcactcnggg

SEQ ID NO: 4468 - DNA, 71 bp, rice(Oryza sativa)
  misc_feature (71): n=a or g
ccagggtgctcaggtacagggagaagaagaaggccaggaagtttgagaagacaatacgttatgaaacaagn

SEQ ID NO: 4469 - DNA, 71 bp, rice(Oryza sativa)
  misc_feature (1): n=t or c
ngaccccggatcaagggccgtttcgccaagagatcagatgtgcagatcgaagtggaccagatgttctccac

SEQ ID NO: 4470 - DNA, 71 bp, rice(Oryza sativa)
  misc_feature (1): n=t or c
ntctcatcaatggaggcgggtatagtaccagacagcacggtgatagatatgccaaattccagaatcctgac

SEQ ID NO: 4471 - DNA, 71 bp, rice(Oryza sativa)
  misc_feature (1): n=a or g
nataatgacaataataatggtattgtgcttcccactgccactatcactcccaccttttcctctgcttgata

SEQ ID NO: 4472 - DNA, 71 bp, rice(Oryza sativa)
  misc_feature (1): n=a or g
ntgccatccaaggtgatttcagtgccaaccatgtgctgaaagagaggagaagaagagagaagctcaatgag

SEQ ID NO: 4473 - DNA, 73 bp, rice(Oryza sativa)
  misc_feature (71): n=a or t
tcccagtagtcactgcagttacaggggagcagaaacacctgaatcaaggggcgggaaaggcgcaagtggangg

SEQ ID NO: 4474 - DNA, 141 bp, rice(Oryza sativa)
  misc_feature (71): n=a or c
tagtcatcgaacagccaggccacgctctcgccgtcgtcgccgccgccgtcgttgccgaagaactggaactngtgcaccggtggcgccggggcgccgatcccctggcacgcactcggcgggaagacgaaggggaatccatca

SEQ ID NO: 4475 - DNA, 71 bp, rice(Oryza sativa)
  misc_feature (71): n=t or c
ggccggatcaggattattggattgatactcacgatggtggcgctggccgcggcctcggcgtgccggccgcn

SEQ ID NO: 4476 - DNA, 71 bp, rice(Oryza sativa)
  misc_feature (1): n=t or c
nttcagctgctcctatggttaaggtttgtttccaaatttctgtggatattttttgttctctttctactaac

SEQ ID NO: 4477 - DNA, 71 bp, rice(Oryza sativa)
  misc_feature (71): n=t or g
ggacgcggcggtggcggcggcgcgggaggcgctgaagaggaaccggggccgcgactgggcgcgcgcgccgn

SEQ ID NO: 4478 - DNA, 141 bp, rice(Oryza sativa)
  misc_feature (71): n=t or g
gcagcctggttgtggctggcagcggcactgtgggtagtagtatcccatggctgggttgacagaagagaganagcacagctcgagtcggtggcggcaccgacccctgcgagacatccacctggagggagatttgggccagcg

SEQ ID NO: 4479 - DNA, 71 bp, rice(Oryza sativa)
  misc_feature (71): n=t or c
cttgatgccctccaaatcgtcgctgaaattgcagcacagcttcacctcgccctgcgcgacgccgacgatgn

SEQ ID NO: 4480 - DNA, 74 bp, rice(Oryza sativa)
  misc_feature (71): n=c or g
gacgatgccgttgatcttccgggcgacctggctcaccgccgcggccacaagcatctcggcgccaaccatgnccg

SEQ ID NO: 4481 - DNA, 76 bp, rice(Oryza sativa)
  misc_feature (6): n=a or t
gccgcngggttgtcgatgcccacggtgtcgtaacccatgctgtctcagtggttgcttatgttgatctagatccttt

SEQ ID NO: 4482 - DNA, 141 bp, rice(Oryza sativa)
  misc_feature (71): n=t or c
tgtcgacgatatgcatggatgtttctcttgagcaaggaatccgaagcgtgaggatggatccaacaaatccngcaaaaggtgaaagggaatttctttagtcagttcctgatcaagacgtattgtcggccagaaattttgtag

SEQ ID NO: 4483 - DNA, 141 bp, rice(Oryza sativa)
  misc_feature (71): n=t or c
cgcgtcgagcgcctccctcaccggccgcagcggcgagaagtcggcgaccagcgtcgacgcaccaaggcgcngcaccagcgccgggatctccgcgggcccacctgtcagcgagccagagaaaaagccacgtcacatttcgca

SEQ ID NO: 4484 - DNA, 141 bp, rice(Oryza sativa)
  misc_feature (71): n=c or g
taacaaatcagttaaagaacagcaccttgggactaagatgtcggcatttctttgcctcgagcgcacaccgntgtgccgaaatgtgcccaaaatgaaggtatggtgaaagcccagacaatgcccgtggtttcgtgggatcat

SEQ ID NO: 4485 - DNA, 141 bp, rice(Oryza sativa)
  misc_feature (71): n=t or c
atgtatacatatgaaaagtgattgaaatggtactgcaaagaagtttaatttgatcactcactgtcttctcngaggtggttcactgctgcaatgaactgacggtgcaactgcgtggtccaggtcagcctggactttccgagg

SEQ ID NO: 4486 - DNA, 141 bp, rice(Oryza sativa)
  misc_feature (71): n=a or c
ccggcgtagaacttgaactcgagaagcttgaggttgggcatggcgtcttcatggaaggctatccttggcanccggctgtcgacacggaagctctccagcatctggaagcctgtgccgttgatggttatgggttgtcttggt

SEQ ID NO: 4487 - DNA, 141 bp, rice(Oryza sativa)
  misc_feature (71): n=a or g
gcgcaacgattgggagatctggccagcttgccatggcagctctctcaccctcgtgtttctcacgtccagantctgtagatgattcagctccccaatctcctttgggagctccctaaccccagtgctcctcacgcacataat

SEQ ID NO: 4488 - DNA, 141 bp, rice(Oryza sativa)
  misc_feature (71): n=a or c
cagtgctcctcacgcacataatcttgagattctgcagcttgccaacctgcggcgggagctcactgattggngtgttcctcacgtccagagtgtgcagatgctgcagctcccgtatctgcagtgggagctcagtgatgtccg

SEQ ID NO: 4489 - DNA, 141 bp, rice(Oryza sativa)
  misc_feature (71): n=a or c
acaacaataacatttaacttccattaaaattggtttcaaacaatcatcaagtcaggttgaagatgcatagnaggtaaagatagaagccacggcagagaaagaaagaagctcaataatccttgtaagttgtaacctgggaat

SEQ ID NO: 4490 - DNA, 51 bp, rice(Oryza sativa)
  misc_feature (51): n=a or g
aggcgctggagcggtgcggcgtcagcgacgtgttcgcctacccgggcggcn

SEQ ID NO: 4491 - DNA, 51 bp, rice(Oryza sativa)
  misc_feature (51): n=t or c
ggcgctggagcggtgcggcgtcagcgacgtgttcgcctacccgggcggcgn

SEQ ID NO: 4492 - DNA, 51 bp, rice(Oryza sativa)
  misc_feature (1): n=a or g
ncgtccatggagatccaccaggcgctgacgcgctccccggtcatcaccaac

SEQ ID NO: 4493 - DNA, 51 bp, rice(Oryza sativa)
  misc_feature (1): n=t or c
ngtccatggagatccaccaggcgctgacgcgctccccggtcatcaccaacc

SEQ ID NO: 4494 - DNA, 51 bp, rice(Oryza sativa)
  misc_feature (51): n=t or g
ggtgaaggtgatggtgttgaacaaccaacatttgggtatggttgtgcaatn

SEQ ID NO: 4495 - DNA, 61 bp, rice(Oryza sativa)
  misc_feature (51): n=a or t
cggtgaaggtgatggtgttgaacaaccaacatttgggtatggttgtgcaangcgcgcgcgc

SEQ ID NO: 4496 - DNA, 51 bp, rice(Oryza sativa)
  misc_feature (1): n=t or g
nggaggataggttttacaaggcaaatagggcgcatacatacttgggcaacc

SEQ ID NO: 4497 - DNA, 61 bp, rice(Oryza sativa)
  misc_feature (11): n=a or t
gcgcgcgcgcngggaggataggttttacaaggcaaatagggcgcatacatacttgggcaac

SEQ ID NO: 4498 - DNA, 51 bp, rice(Oryza sativa)
  misc_feature (51): n=t or g
gtgaaggtgatggtgttgaacaaccaacatttgggtatggttgtgcaatgn

SEQ ID NO: 4499 - DNA, 51 bp, rice(Oryza sativa)
  misc_feature (1): n=t or g
ngaggataggttttacaaggcaaatagggcgcatacatacttgggcaaccc

SEQ ID NO: 4500 - DNA, 51 bp, rice(Oryza sativa)
  misc_feature (51): n=a or g
gttggatatcatcgtcccacaccaggagcatgtgctgcctatgatcccaan

SEQ ID NO: 4501 - DNA, 51 bp, rice(Oryza sativa)
  misc_feature (1): n=a or g
ntgggggcgcattcaaggacatgatcctggatggtgatggcaggactatgt

SEQ ID NO: 4502 - DNA, 51 bp, rice(Oryza sativa)
  misc_feature (51): n=a or c
agaactaccacaggatgcatgactggcttgtcgagtacttgtcgaaggacn

SEQ ID NO: 4503 - DNA, 51 bp, rice(Oryza sativa)
  misc_feature (1): n=a or c
ngcaccgtgaccgtcgacatgcctttcacctcctacacctacattgccgac

SEQ ID NO: 4504 - DNA, 61 bp, rice(Oryza sativa)
  misc_feature (51): n=c or g
aactaccacaggatgcatgactggcttgtcgagtacttgtcgaaggaccgngcgcgcgcgc

SEQ ID NO: 4505 - DNA, 61 bp, rice(Oryza sativa)
  misc_feature (11): n=c or g
gcgcgcgcgcnaccgtgaccgtcgacatgcctttcacctcctacacctacattgccgaccc

SEQ ID NO: 4506 - DNA, 61 bp, rice(Oryza sativa)
  misc_feature (51): n=c or g
taccacaggatgcatgactggcttgtcgagtacttgtcgaaggaccgcacngcgcgcgcgc

SEQ ID NO: 4507 - DNA, 61 bp, rice(Oryza sativa)
  misc_feature (11): n=c or g
gcgcgcgcgcngtgaccgtcgacatgcctttcacctcctacacctacattgccgacccggt

SEQ ID NO: 4508 - DNA, 51 bp, rice(Oryza sativa)
  misc_feature (51): n=t or g
acgatggtgacgaggagcaaggagagctggtcgtcattgcaggtcccggcn

SEQ ID NO: 4509 - DNA, 51 bp, rice(Oryza sativa)
  misc_feature (51): n=t or c
gcgtccaagtacggcacggcggcggagctcaagtccctgatagcggcgttn

SEQ ID NO: 4510 - DNA, 51 bp, rice(Oryza sativa)
  misc_feature (1): n=t or g
ngtcatggtgaagatcgggacaaggtacggcgtgagcagcgtggtcccgtc

SEQ ID NO: 4511 - DNA, 51 bp, rice(Oryza sativa)
  misc_feature (1): n=t or c
ncagtacggctccaaggtgtacgtgaagcaccccgccgacatccccgacta

SEQ ID NO: 4512 - DNA, 51 bp, rice(Oryza sativa)
  misc_feature (51): n=t or g
aacttcccctccgacggccccgtgatgcagaagaagaccatgggctgggan

SEQ ID NO: 4513 - DNA, 101 bp, rice(Oryza sativa)
  misc_feature (71): n=t or g
tctatcgtaggtggattatttacctgcatgaaagaaagattggtggcaagcagttgagtgaaaattcaatnaagcatgagactaaatgcagtacagtagta

SEQ ID NO: 4514 - DNA, 101 bp, rice(Oryza sativa)
  misc_feature (71): n=a or c
atggaaaaagttcagccagatattataacatagggataaaaacaaaacaccgtccagtgacatggaaacanaatgagttcagcaacaacttatgacagacc

SEQ ID NO: 4515 - DNA, 101 bp, rice(Oryza sativa)
  misc_feature (71): n=a or g
attttcatggaacatataagatacatctactagcgtaatgatatggaagagctagcacaaaagagcagggncaaaagagagtgatgaataaggttccttct

SEQ ID NO: 4516 - DNA, 101 bp, rice(Oryza sativa)
  misc_feature (71): n=a or g
agggcttgtttggtttgcaaccattttgtgtgttgtacaaatttctgtgaagttgttcatttggtttgtanccaatactttttatgtgtacgcgttttaat

SEQ ID NO: 4517 - DNA, 101 bp, rice(Oryza sativa)
  misc_feature (71): n=t or g
ctttagctgctacatggaacagacatattcttgagtgttttttcttttgctgttcatgatctgtctacttntggatataggtcattgatgtagcaacttct

SEQ ID NO: 4518 - DNA, 101 bp, rice(Oryza sativa)
  misc_feature (71): n=a or c
tttccgctggacattccccgttcttgatacaattcaggacctccactacctccttaattggtggcctgctntctctgtccatctgcaagcactgaaaggcc

SEQ ID NO: 4519 - DNA, 101 bp, rice(Oryza sativa)
  misc_feature (71): n=t or c
tcgttatacaggaagatttccatgctactgtggcctaatgtccactagataaactcttattataataatgngcgtgacatctagttttgctatcgaggaaa

SEQ ID NO: 4520 - DNA, 101 bp, rice(Oryza sativa)
  misc_feature (71): n=a or c
cgccaccggcgcatacctcacgcacaccatctacgaggcgtatcgcgttgttgatatcttcaccggaaacnacaccgtccatgtggtggacgagaatctcc

SEQ ID NO: 4521 - DNA, 101 bp, rice(Oryza sativa)
  misc_feature (71): n=t or c
attgctactactctctctgctgctacagcttcttgacgaagtactccgtactattttctccgtttcatcantatagtatttttcacgtttatattgatgtt

SEQ ID NO: 4522 - DNA, 101 bp, rice(Oryza sativa)
  misc_feature (71): n=a or g
taatttgacatatcctaatattatgagaacttgtagatacatttttctgaacctaataatataggacaganggagtactttctgataaaaacgtgttaata

SEQ ID NO: 4523 - DNA, 101 bp, rice(Oryza sativa)
  misc_feature (71): n=t or c
cagcggtggatcatctgtaactctcatttgtttatagttcgtcacgaaaatatggttccgactttctcctnttttttttttttttgattacgagtgttttg

SEQ ID NO: 4524 - DNA, 101 bp, rice(Oryza sativa)
  misc_feature (71): n=t or c
cagctcatcagggttggagaaaggtatggtcattcctgcttataagataccagaataatgctatgaagacngtccttggttgtcagcattcttatacacaa

SEQ ID NO: 4525 - DNA, 101 bp, rice(Oryza sativa)
  misc_feature (71): n=a or g
cgtatggtttgctacctctgagttcatcagcagttgatttgcctgaaattgttgtagctgctccacttcanccacctactttgtcatggagcctatacttg

SEQ ID NO: 4526 - DNA, 101 bp, rice(Oryza sativa)
  misc_feature (71): n=a or c
gcttgttgaactccttagagcagcggaagattacgattctggcatgcgggtatatcatacatctctctggntgttgtttcagtgctatcaatcaagatgac

SEQ ID NO: 4527 - DNA, 101 bp, rice(Oryza sativa)
  misc_feature (71): n=t or c
ggtactgtatctctaagcatgtttagtatcttctgtgataaaatctttctccagtgtgttaacttttgcantctttttcttgcatgcttgcagctaattca

SEQ ID NO: 4528 - DNA, 101 bp, rice(Oryza sativa)
  misc_feature (71): n=a or g
atttcagtgatttctgggggtttatcctctgttcatcgtttgttgcatcatcgactagctgatgaagatcntcgatcgatttcaatcaagccccccctctt

SEQ ID NO: 4529 - DNA, 101 bp, rice(Oryza sativa)
  misc_feature (71): n=t or c
tccgccatgatcttcttccttccgtgcttccttcacctccacacaccctatgcacacaggagacactgaancacctccatttctactcctctttttttttt

SEQ ID NO: 4530 - DNA, 101 bp, rice(Oryza sativa)
  misc_feature (71): n=a or g
tggggttttgaggtagtagcaaaattacccacaaaaaaattaggtgaaaaaaaaaagaggagtagaaatgnaggtgattcagtgtctcctgtgtgcatagg

SEQ ID NO: 4531 - DNA, 101 bp, rice(Oryza sativa)
  misc_feature (71): n=a or c
ttttgtgagcatcaaggatgatggcatggaggaggagaaggtggcggtaagaagaaaatgatggcacgacnaaaaaatccttcattttcttttgtgatttc

SEQ ID NO: 4532 - DNA, 101 bp, rice(Oryza sativa)
  misc_feature (71): n=t or g
cgcgcaccgcttcggcttcgtcctcctcgccttacacatcgcaccactctctcttactcgtccatacgccnagtccacgagatctcgccgtagtccataca

SEQ ID NO: 4533 - DNA, 101 bp, rice(Oryza sativa)
  misc_feature (71): n=t or g
ggcgtcgccgcgagcggataaggatttcgcactccggcgtcctacgcttttttgtggggttgggttccttngttttaggagagggcgtgtgctcaccactt

SEQ ID NO: 4534 - DNA, 101 bp, rice(Oryza sativa)
  misc_feature (71): n=t or c
gttccttctttctggagatcgtgttgtaattgcttcacgcaggtggtactcatagacatgtagctcaatgngtgttgttgttgcatatccatgatattctt

SEQ ID NO: 4535 - DNA, 101 bp, rice(Oryza sativa)
  misc_feature (71): n=a or g
gttaatggtgtacttgatcctccagaacctgctccatccatgttaaatacgtgacctcccttttgttggtnttgcatgacattcatggcttctctggtgca

SEQ ID NO: 4536 - DNA, 101 bp, rice(Oryza sativa)
  misc_feature (71): n=t or g
tagagaagaaacatacctcttcatcaaaccatcggcctcggcgaacccatgcagtaaccaaggcaagcaanatccttggtggtgtcaagtagtttatcgcc

SEQ ID NO: 4537 - DNA, 101 bp, rice(Oryza sativa)
  misc_feature (71): n=t or g
ggtccaacagtctcagtgctattgtttgtactgcatgttaaatatgacatagttaattctcacatgtattnctggatctcacctagtccacatgaaatcca

SEQ ID NO: 4538 - DNA, 101 bp, rice(Oryza sativa)
  misc_feature (71): n=a or g
gaaaaaaagagttaattttatacgaactatgttacaatggggaatgcgatttgtccagaaccaccgccatnactatgatgctaattaatacaaaatactag

SEQ ID NO: 4539 - DNA, 101 bp, rice(Oryza sativa)
  misc_feature (71): n=t or g
gattaactcaatcaatcatagaataattatgtaatctgttgttcttgcgggtgcttttgttcaatccatgnttgtagtgatagggcaaattcaaagcaact

SEQ ID NO: 4540 - DNA, 101 bp, rice(Oryza sativa)
  misc_feature (71): n=a or g
atttaaatattttcaatcttaatgatagtcattttgatagctacagtacagttcatatgtgtcacgacccnaggccatgacgagataaccaccgccggaag

SEQ ID NO: 4541 - DNA, 101 bp, rice(Oryza sativa)
  misc_feature (71): n=a or g
tatgagaaaagctagatttttaggctctgcttcagcctttagtgttaaacaaactgagtggccatgtgctncaactgactcaaagaaatgttaccgtaagt

SEQ ID NO: 4542 - DNA, 101 bp, rice(Oryza sativa)
  misc_feature (71): n=a or g
ataggcccctgctttttagctactcaaagctggggttttgcactctagaaagattttctgtcttttgggtntggggtaattagatattagtatcagatatg

SEQ ID NO: 4543 - DNA, 101 bp, rice(Oryza sativa)
  misc_feature (71): n=a or g
aatttaaaggatatattttagggtcgttttgggacgcgacagttctgcatgtgtgtttttattaaaaaaangatctaattaaccttctgaaataaaataat

SEQ ID NO: 4544 - DNA, 101 bp, rice(Oryza sativa)
  misc_feature (71): n=t or c
ttgttggatttttttaataaaaaaatcccaaacctctccctccctcccacacccgtgtcatgtcaaaatcnattaaatattttacaaacgcctctaagctg

SEQ ID NO: 4545 - DNA, 101 bp, rice(Oryza sativa)
  misc_feature (71): n=t or g
aaacaaacttcctccaggatcatattcggcttcggcacgagaagaaggtatcgtcgtccgccggttagaancttgggtaagaatagggccagagccgagag

SEQ ID NO: 4546 - DNA, 101 bp, rice(Oryza sativa)
  misc_feature (71): n=t or c
aactggttctgattcctctgtatatcttgtactagtaagattcacgaagaaaacgaatggcattattgcgngataatttggaggccatgtggttgtgcgtg

SEQ ID NO: 4547 - DNA, 101 bp, rice(Oryza sativa)
  misc_feature (71): n=t or g
gatccggcacacatcacacttgtttctctttcagaatcatgttaataagctcatcatcctagtagaaaaanatttaaaaaccttttttagtgaaactagca

SEQ ID NO: 4548 - DNA, 101 bp, rice(Oryza sativa)
  misc_feature (71): n=a or g
ggaccaaataaacactgcacaataatgagagcaaagaagagaagagcactagtactagcaagctagcagcngcagcagcagcagcagattgcaggagctga

SEQ ID NO: 4549 - DNA, 101 bp, rice(Oryza sativa)
  misc_feature (71): n=t or c
cgccaaggggaggaaggccagctaccaggacgccgccgtcgagctcggcaaggaactggtcaggattcttnttcttcttcttcttcttcttcttcttcttc

SEQ ID NO: 4550 - DNA, 101 bp, rice(Oryza sativa)
  misc_feature (71): n=a or c
gttatgtcaggtactcaggtgcaaaggaatcttggtgaggtgatggaaaggactctgcttgtcatactttngttgtcaaggagaacagcagatgtgttctc

SEQ ID NO: 4551 - DNA, 101 bp, rice(Oryza sativa)
  misc_feature (71): n=t or g
aacatggttttgaagttgagagtttatcatcatccaatcatgaccaagggaaaatcaattatactccatantttttcagtaacagtgaatgcacacaccta

SEQ ID NO: 4552 - DNA, 101 bp, rice(Oryza sativa)
  misc_feature (71): n=t or c
ttctaatttgtgttttatttttattcaacttggaatcatactttatattgttagcagtattctatttccanatctgctagacttaaatttatactcttagc

SEQ ID NO: 4553 - DNA, 101 bp, rice(Oryza sativa)
  misc_feature (71): n=t or c
aggggaagggatgtctccctaccatgttatgataataagcaaaactaacttacacttacaaaccattaagntgttggttcaataaaatcaataaatgcaaa

SEQ ID NO: 4554 - DNA, 101 bp, rice(Oryza sativa)
  misc_feature (71): n=a or g
acgatgacaaatgaggaggatgaatagaaacggtggtaaatcggcaacaaataaaggggtagcgactagcntgacttctaaaaaatataaaattagaaaca

SEQ ID NO: 4555 - DNA, 101 bp, rice(Oryza sativa)
  misc_feature (71): n=a or c
ctggtgaggagcggttgttggtgtatgattacatgaagtttggcagcttggaggatgtgttgcatgaccgnaaaaagatcggtaaaaagctgaattgggag

SEQ ID NO: 4556 - DNA, 101 bp, rice(Oryza sativa)
  misc_feature (71): n=a or g
agctgggggacatgttctacctcatgatcatgaatcttgggcacaacctactgtcaggtaccatcccatcncggctagcagaggccaagaagcttgcggtg

SEQ ID NO: 4557 - DNA, 101 bp, rice(Oryza sativa)
  misc_feature (71): n=t or g
acaacgggctcacgggtagcatcccgccggagctagccaagtgcaccaagctgaactggatttctttggcnagcaaccggctgtccgggccaatcccttca

SEQ ID NO: 4558 - DNA, 101 bp, rice(Oryza sativa)
  misc_feature (71): n=t or c
ctcaccgacgatgaggttgccggagaggtcaaggtactgaagcccggagcagttggtgaactccgggacancggagatcctgttcagggcaaggtccaacc

SEQ ID NO: 4559 - DNA, 101 bp, rice(Oryza sativa)
  misc_feature (71): n=a or c
cttcttcgcttctctttctctctctctccatctcctcctcatcacttcccactctcccccttctgtctctntactttctctctctaccgccgctctcgcag

SEQ ID NO: 4560 - DNA, 101 bp, rice(Oryza sativa)
  misc_feature (71): n=a or g
acctagaaaatttaatagaactttacaaattgagtgttatagtgagatggcatcggagatgagcaagaacntgaaggtcaccgatgatcaagaggttacat

SEQ ID NO: 4561 - DNA, 101 bp, rice(Oryza sativa)
  misc_feature (71): n=a or g
cggtttatgtcggcagggatcattttccttgccgctaccgctgtgccagaagacggtggaggaggtgtggnctgagatcaaccaagcccctgcacacacct

SEQ ID NO: 4562 - DNA, 101 bp, rice(Oryza sativa)
  misc_feature (71): n=t or c
ggggtaccccatgccatcacccatcaccggatacatggcgtttaccggtcctactgggaacatcataggancgccttggccctgctgcatggggttcaccg

SEQ ID NO: 4563 - DNA, 101 bp, rice(Oryza sativa)
  misc_feature (71): n=t or c
agctccaccgtataagcctgtagcattattcataaaaatttcaatctccatgcaaaatgtcttaacgatanatagaaactaaaaggttcggagcaacatgt

SEQ ID NO: 4564 - DNA, 101 bp, rice(Oryza sativa)
  misc_feature (71): n=a or g
agcgcatatgacatgagaacaaacttacagatacaaactagtatactattgtataattttattcatcgttnttttgtacaaacagcgacatgtaaccatat

SEQ ID NO: 4565 - DNA, 101 bp, rice(Oryza sativa)
  misc_feature (71): n=a or g
gctccggctccgggcatggcgggtagtagttgcaccgcatgattgagctgctgtccgcgaagaactccctntagtagcctcgctccacgcccaggctcagc

SEQ ID NO: 4566 - DNA, 101 bp, rice(Oryza sativa)
  misc_feature (71): n=t or c
aatgccccactcctccatgtgttatgatttatctcacatcttatagttaataggagtaagtaacaagctanttttttcatattatagttcgtttgattttt

SEQ ID NO: 4567 - DNA, 101 bp, rice(Oryza sativa)
  misc_feature (71): n=t or c
agtgtgagttgagttagccaccaccaacttgcacacgagcacatacatttgtgtccattctcgccagtcanttccatctctagtcctaactcctatctagc

SEQ ID NO: 4568 - DNA, 101 bp, rice(Oryza sativa)
  misc_feature (71): n=t or c
agtattatataggaaattaactataacaaacaggtttatatacggatgatgaaattatccgcttacatcgntagataggagttaggactagagatggaagt

SEQ ID NO: 4569 - DNA, 101 bp, rice(Oryza sativa)
  misc_feature (71): n=t or c
aaatacacatccaacgaggaggagaacgcatgcttatctctcatctctcctcttctctactcttccataanccatatcttggcttggcatggcatgaccga

SEQ ID NO: 4570 - DNA, 101 bp, rice(Oryza sativa)
  misc_feature (71): n=a or c
attccctccccgccatgtccgtgttcgaactccgcgaaatcttccaagcatacggtacatacaccaccacngcacgctttcttccgcgaattcctccatgt

SEQ ID NO: 4571 - DNA, 101 bp, rice(Oryza sativa)
  misc_feature (71): n=a or g
ccggcccacgcaggtaaaagaattcaccgtcgtgttaattcccatcgaaaacgcacggtaaaactaatttngctgtggttggcaggcgcgggcacgtgtcg

SEQ ID NO: 4572 - DNA, 101 bp, rice(Oryza sativa)
  misc_feature (71): n=a or g
ttctgcgcaggagctccgggaaaggtagctcgggtagccagtccaagggcggtggcaatgctggccacgancggaagagcaagggcggcaagagcgccgcg

SEQ ID NO: 4573 - DNA, 101 bp, rice(Oryza sativa)
  misc_feature (71): n=t or c
cactaccagcagctagagctcccaactacccattcatctcccagtacatttccaagcccctttcatatacntttgtccttccttcacacggcaatgcaatt

SEQ ID NO: 4574 - DNA, 101 bp, rice(Oryza sativa)
  misc_feature (71): n=a or c
gatccttctcgttttgatgcatcaaatccttttgttgcatgcaatcctctgatcatgagcatctgttcacntgtctacctttcttgcgcacctgcctctag

SEQ ID NO: 4575 - DNA, 101 bp, rice(Oryza sativa)
  misc_feature (71): n=a or g
gtcagatccccacgtcctcccctcgtctccatgtttggtttgttttctgtcctcctcccttccaccacgcnctgagccgagccgctgatcgtgtgcttgcg

SEQ ID NO: 4576 - DNA, 101 bp, rice(Oryza sativa)
  misc_feature (71): n=t or g
ataaaaaaagttactctaaccctcatctcctctttgcatttccgcctcgtcttttccgcctcgtcttttcncttatgcttatatttatcagctaaaatttg

SEQ ID NO: 4577 - DNA, 101 bp, rice(Oryza sativa)
  misc_feature (71): n=a or g
tttgacaaacgtagatttttaaaacttgtctatgcctccaaagcaccaacaatgagacataatggcaatcncaataacagtgacttccttagtagtaggga

SEQ ID NO: 4578 - DNA, 101 bp, rice(Oryza sativa)
  misc_feature (71): n=t or c
gtattggcccagtaagctcgttattgctcaagtctaggtactggagattctgcaaatttcccaaagcttcnggaagctctccggaaaacccacatccactg

SEQ ID NO: 4579 - DNA, 101 bp, rice(Oryza sativa)
  misc_feature (71): n=t or c
aagggggtggaaacctcgtcggctgggtgcggtggatgatcgcccgcggtaagcagaacgagctgttcganccatgcttgccggtttcaagcgtgtggcgg

SEQ ID NO: 4580 - DNA, 101 bp, rice(Oryza sativa)
  misc_feature (71): n=a or g
tatacacatactgtaatataaatgggtctgctcagctgctatatacaactgttgtgctgccgcggctacanatacaagacactactcactctcattcataa

SEQ ID NO: 4581 - DNA, 101 bp, rice(Oryza sativa)
  misc_feature (71): n=a or c
tttagattggataatgacgttctccgtattatatattttttggaaagctaggatattatatttattcatcntttgtaaatacgtctactataagtagagcc

SEQ ID NO: 4582 - DNA, 101 bp, rice(Oryza sativa)
  misc_feature (71): n=t or c
tggagaggggaaggggaagaagaggcagatgtgtgggtcccacgtaaatcccatgccgagtcagttgccangtcggacaaaaccggagtcaaaaccgccga

SEQ ID NO: 4583 - DNA, 101 bp, rice(Oryza sativa)
  misc_feature (71): n=t or c
tcgaggccgttgagtcagagcagcaactgcatgaacgcctcgccgacggtgctccccctcacgactctgcntcgacctctaccttcctcgccgtcgcctgc

SEQ ID NO: 4584 - DNA, 101 bp, rice(Oryza sativa)
  misc_feature (71): n=a or g
gcaaaacaaaaattgtattccaagaaataaatttaatgccttaatagttaccaatatccagagagtagtanttatatcctaacttggcacctcgcccttaa

SEQ ID NO: 4585 - DNA, 101 bp, rice(Oryza sativa)
  misc_feature (71): n=a or g
cggaaaaaaaatgattacacgtacaaaatgtacacgtgtcactctatggggcgatgagttccaggtagatnggtgcaggtgccgaacgattggacaggaac

SEQ ID NO: 4586 - DNA, 101 bp, rice(Oryza sativa)
  misc_feature (71): n=a or g
tcgtctaattcctaactagcttggtatatacgtacgtacaggtagacgatggatggatcgatcggtttgcnccattttcactcacagcgcgatcgccggtt

SEQ ID NO: 4587 - DNA, 101 bp, rice(Oryza sativa)
  misc_feature (71): n=a or g
gtacagatttctgtatcacagattagtaggagtacatataggaaaacctgatcatttagctagctagaatnccctgtcatttggtcaatgacggcaagaca

SEQ ID NO: 4588 - DNA, 101 bp, rice(Oryza sativa)
  misc_feature (71): n=a or g
atattatatacacacggaaagtatggaaccgtgtacttctgaaattctttcagtaagaagcctgcacttcngatctttctctactcccgtgtctttaatca

SEQ ID NO: 4589 - DNA, 101 bp, rice(Oryza sativa)
  misc_feature (71): n=a or g
gcttgcatctgaagtgtaatcaagcttcagaagaagcagtcttcagttcactttttacgtggctatgaaanttagtgctatatatcctttcccttttaaat

SEQ ID NO: 4590 - DNA, 101 bp, rice(Oryza sativa)
  misc_feature (71): n=t or g
tcaaacttcatcatagatgtgagaggccatttaattttcagaacccacagaattttcagaagtttggacangttgtaaattaagtttggccatttttataa

SEQ ID NO: 4591 - DNA, 101 bp, rice(Oryza sativa)
  misc_feature (71): n=a or g
acaccacacatatgatgggccataaatatatggaagataggacaacggggccgagttcccatacgatgggnatgtaaagtggactttttccatggttcggc

SEQ ID NO: 4592 - DNA, 101 bp, rice(Oryza sativa)
  misc_feature (71): n=t or g
ggacgaagttcgatgcatacttggcgtggctccataggaactatcgtcttgtcctacgcccggcctggacnctagccgacatagcggacgaccctgaagat

SEQ ID NO: 4593 - DNA, 101 bp, rice(Oryza sativa)
  misc_feature (71): n=t or g
aagtccttatgtttttttttttttgctgtgttttctgttttcattcattcccattttgttcttgtgttgantcagttaccaccaaaggaactgtctacaac

SEQ ID NO: 4594 - DNA, 101 bp, rice(Oryza sativa)
  misc_feature (71): n=a or g
aggtggaggccgctgacaagcgggtcccacctgatgagtcagcgaatcagttaccacgtcggacgaaaccncctccaaaaccgctacgggagttgatttgc

SEQ ID NO: 4595 - DNA, 101 bp, rice(Oryza sativa)
  misc_feature (71): n=t or c
ggccttttacgtttgcgtcctctcggcggtgcgtgggcctcaaagagtagacgcctaccgagtaatcccgnctccttttcttcctcccctatactactgac

SEQ ID NO: 4596 - DNA, 101 bp, rice(Oryza sativa)
  misc_feature (71): n=a or g
ccctggagttgtaggagcaagcaggacgtcgaaaccctaatataacaagcgaaaatagtagtcaagattangggttggcttcaggagcaattcgagggagt

SEQ ID NO: 4597 - DNA, 101 bp, rice(Oryza sativa)
  misc_feature (71): n=a or g
aaatttttgttgtggctccttaaaaggacgaggttggacttgcatccggagttggtgatggatttgtcacncacgaaggagctggaaaccaaacccacgta

SEQ ID NO: 4598 - DNA, 101 bp, rice(Oryza sativa)
  misc_feature (71): n=t or c
taaatatctatctctatcctaggaaagtaattgatcatttaggcactactccctccgttctatttcatatnatagtcgtctgacttttttcttagtcaaac

SEQ ID NO: 4599 - DNA, 101 bp, rice(Oryza sativa)
  misc_feature (71): n=a or g
tgaaacggtaagcatatacttttttgcatgaggttcatgctcaactgaaatatgttcttcacactaatggnacatctatgtgtaggtgccagaaaaggaag

SEQ ID NO: 4600 - DNA, 101 bp, rice(Oryza sativa)
  misc_feature (71): n=t or c
aaatttgataataaaccgtagcgccaatatcctttcttattactaataatatactcaaaaagatttcagcngccatttgcttagttgtccatggcatgcat

SEQ ID NO: 4601 - DNA, 101 bp, rice(Oryza sativa)
  misc_feature (71): n=a or c
gcagactagcagtgatcgatggaactactccactttttccttcgagctcaggcgttcggggccggggcacnctccgatggcatccagcatccctcaccacc

SEQ ID NO: 4602 - DNA, 101 bp, rice(Oryza sativa)
  misc_feature (71): n=a or g
ttctctaaacatattaaaccctacagagcatgagtttgtactgagcctataaatagcccactagaagcatntaatgggggatcccaacaaattttcataag

SEQ ID NO: 4603 - DNA, 101 bp, rice(Oryza sativa)
  misc_feature (71): n=t or c
gtttcacctcatttggttcagccgaccctgaccatattcacgcgtccagcccctcaagcaaccatggcgcnggtccggccgacagtcgtgctgaaccaacc

SEQ ID NO: 4604 - DNA, 101 bp, rice(Oryza sativa)
  misc_feature (71): n=t or g
tttgctaatgcaaattttaaacaggagatttggtgttatttaaagtttggtaaacatatgttgtttgtttngtaaacataagttcggtattttggtaaata

SEQ ID NO: 4605 - DNA, 101 bp, rice(Oryza sativa)
  misc_feature (71): n=t or c
tattatatgcactaatgttttgccacttttgacaccgtggagcgccagcacctaggatggacagcatgganatggtagttgcaatgaccaatttccccctc

SEQ ID NO: 4606 - DNA, 101 bp, rice(Oryza sativa)
  misc_feature (71): n=a or c
ttactggtttgtagctgttatgtaacaaggacgggattcttggcttgtcgaattattgtgacaatgcaagngaggaaagaaaaaagtatcatttatctcct

SEQ ID NO: 4607 - DNA, 101 bp, rice(Oryza sativa)
  misc_feature (71): n=t or g
acattccttcaccattactccagtccttattaaggtagcaataatccaattataaccgcaagtctgcaatnataactgctgtgcatgtatcttatttgttt

SEQ ID NO: 4608 - DNA, 101 bp, rice(Oryza sativa)
  misc_feature (71): n=a or g
acaattcaaaacccaaaggctcaactgatctgctacagctacagtatcaaagtactagtgctacagtacanaactgatctcagctaaagatgttgcattgt

SEQ ID NO: 4609 - DNA, 101 bp, rice(Oryza sativa)
  misc_feature (71): n=a or g
aaaagcaagcatttctatctgtaaatattcttttaccaactctctctagaaatatagctatctttcatagngatgagaataaaacaactcagactgtggca

SEQ ID NO: 4610 - DNA, 101 bp, rice(Oryza sativa)
  misc_feature (71): n=t or g
agcagccaattgaccaaatgaactaactatatccctgagctgaaagaggaaaatgcagtaacttgtcaggnataagagctttaataacaacatgcagagcg

SEQ ID NO: 4611 - DNA, 101 bp, rice(Oryza sativa)
  misc_feature (71): n=t or c
gtgatcagtaaccattttatctgaagtcacagcatttttctctttgttttttttccgtcgttcgaatcttntcttatcctatatacctatataattcatcc

SEQ ID NO: 4612 - DNA, 101 bp, rice(Oryza sativa)
  misc_feature (71): n=t or c
ttataacccgtgcttattgtttaatgggttttaaatttataatgttggtgaagtttttgatcaaaccaatncattggcacaaacggttcatgggcgaaaag

SEQ ID NO: 4613 - DNA, 101 bp, rice(Oryza sativa)
  misc_feature (71): n=a or g
tcgtttagtttgagttcgggctgggcatcccttcttctataggtgaaagtggtggtggtggtgctactgcnagggatggcgaaagagaaggatggcggctc

SEQ ID NO: 4614 - DNA, 101 bp, rice(Oryza sativa)
  misc_feature (71): n=t or g
tgactgactgcacctgaaccgaatcctatttcatcgacggcaccttcaccaccctgaaccaaatcctattncatcgacggcaccttcacacggagtggtgg

SEQ ID NO: 4615 - DNA, 101 bp, rice(Oryza sativa)
  misc_feature (71): n=t or c
ctcccccctgactttgattttccgtgtcatttcctccttgtttaggaacactgcttgatctcaatgatggngatgccggtgcccgcgctgacattctcagg

SEQ ID NO: 4616 - DNA, 101 bp, rice(Oryza sativa)
  misc_feature (71): n=a or g
ggacctgaagcaggaattacagagtctgatacaaaagactgaaaaggaagaaaaaaaacatctgagtttcntaacagcttgccacccacaacctcctacca

SEQ ID NO: 4617 - DNA, 101 bp, rice(Oryza sativa)
  misc_feature (71): n=a or g
ccttgtttccggactctgtgtagtccaggagtaccacagcgttgccatgcttgaaatcactcaaaaactcntagctttcgagtctcatgtttgttcctttt

SEQ ID NO: 4618 - DNA, 101 bp, rice(Oryza sativa)
  misc_feature (71): n=t or c
acttggatcaggcaatcagaacacaagtgtcaggttactgaagtaactgactgattgttacttctgaaganaacggaaaagggggaaaaaagtttcagtac

SEQ ID NO: 4619 - DNA, 101 bp, rice(Oryza sativa)
  misc_feature (71): n=t or c
taacatatgtggaataaatactttttaaatcccagcaagtataataacatattataagtagctataagcanatatggaggagataaaagatgagagagaag

SEQ ID NO: 4620 - DNA, 101 bp, rice(Oryza sativa)
  misc_feature (71): n=t or g
gcgacattcccagcaggatcttcagtcgaaattcccagcgttgacttggcggaaaactgccccctgctagnctgctacctgcttgcgctgacctagtttgc

SEQ ID NO: 4621 - DNA, 101 bp, rice(Oryza sativa)
  misc_feature (71): n=a or c
cgaaatatggtggtacctcaaatgatacctctttgaatgcacctttttcatgcaacatttcagcttccttnagtttcttcgcagcctgcatgccaatttcg

SEQ ID NO: 4622 - DNA, 101 bp, rice(Oryza sativa)
  misc_feature (71): n=a or g
tcagaacgtgttgccagaactactttctgcttatttaggccattaggatatggaatgccagcttcagctanatcaaaataaccccataaatcatctatcag

SEQ ID NO: 4623 - DNA, 101 bp, rice(Oryza sativa)
  misc_feature (71): n=t or c
agaagtcccgcattcatgagatcccaaatatgggaaatactagtcacatatacactaggctaaaattaagntatgattatctgcaggataaacagatcaaa

SEQ ID NO: 4624 - DNA, 101 bp, rice(Oryza sativa)
  misc_feature (71): n=t or c
atattgagaaatggaggtcagccagaaagatatcgctcatgtgcaattatatcagtgaacttcctcatgcnatcagctgttacaatctccaatatctgtca

SEQ ID NO: 4625 - DNA, 101 bp, rice(Oryza sativa)
  misc_feature (71): n=t or c
tatcttgcttaactagagaactaaaagctctgggaataacaatcaagaaagtgagtaccttgaagaagctncttgatattcatggaagtcacatgagattg

SEQ ID NO: 4626 - DNA, 101 bp, rice(Oryza sativa)
  misc_feature (71): n=a or g
attcagagggtcgtaactgtttactggctggcatagcacgagctctaaccaataaccactctgaccgttcncaacggtcaagaacacaagtaatctgtgtc

SEQ ID NO: 4627 - DNA, 101 bp, rice(Oryza sativa)
  misc_feature (71): n=a or c
gggtaggtggttggtggttccgctccgatagacctgcgtacgtctcgcgtgcacgcgacaagtccccatgntcgtcaagcgcagcagattttgcggtcacg

SEQ ID NO: 4628 - DNA, 101 bp, rice(Oryza sativa)
  misc_feature (71): n=t or g
cccatctccgatcgcaacgcattttccgcagtctccggtctcccgtgcgcgagcgcgatcgtacatgtgtnttgggctcgcgcgatcggctgactttgctg

SEQ ID NO: 4629 - DNA, 101 bp, rice(Oryza sativa)
  misc_feature (71): n=t or c
agtaagaaacacaccatcgcttcctggtggttgagagtatcgtaagcaacggaaacaatgcagcagtcagngtcatctatatgccatgtttacttcccaca

SEQ ID NO: 4630 - DNA, 101 bp, rice(Oryza sativa)
  misc_feature (71): n=t or c
ctgacaaattctatgtgtgttcttttttttgcaaaaaatatgtattgcattcatgatccattgatgcacanttctccatgaaatttaacaagattaccacc

SEQ ID NO: 4631 - DNA, 101 bp, rice(Oryza sativa)
  misc_feature (71): n=t or c
ggtcgagacaagagaattctaaagcttcagatccgatgcaaatctaacataagccaacgaaatatacttantacgcagctatgtaaaaatgttgtctctca

SEQ ID NO: 4632 - DNA, 101 bp, rice(Oryza sativa)
  misc_feature (71): n=t or c
cctttaggaatttccatatttgaaattggacgattttggagagtaccattatgtagtcttgtaatccctcngtttcatatcataaggtgctttgatttttt

SEQ ID NO: 4633 - DNA, 101 bp, rice(Oryza sativa)
  misc_feature (71): n=a or g
gtaaatatgaattagagatggcacacaaacagcagagaaaaatcaaaggttagttttgtatacattcgtanttgctattccaggagctatctccaaaaatc

SEQ ID NO: 4634 - DNA, 101 bp, rice(Oryza sativa)
  misc_feature (71): n=a or g
tccagctactggagtgaaataattagaataatattcttgactgttccagcacaggaggactaacctgcttnttgctgcgctctgctgttgttatatctccc

SEQ ID NO: 4635 - DNA, 101 bp, rice(Oryza sativa)
  misc_feature (71): n=a or c
cacatctcaataaagatttcggtaaaaatccccttctactgcttgaatttgtgatgtttattacctctgtntggaattttctgaaatattccaatcacatc

SEQ ID NO: 4636 - DNA, 101 bp, rice(Oryza sativa)
  misc_feature (71): n=t or g
cagcagagcaatgtacaaaaactagtaactagtacaaattgagaagcaattatagtttcaaatgcaggaanaatcagtcgcctaaatatggaagaacaaag

SEQ ID NO: 4637 - DNA, 101 bp, rice(Oryza sativa)
  misc_feature (71): n=t or c
catgcagctccaagtcatgggcatctcgtcaaccacaggctaagctaatgtgacaactatggcagtatggnacaaacaaattaactcccagatggaaccgt

SEQ ID NO: 4638 - DNA, 101 bp, rice(Oryza sativa)
  misc_feature (71): n=t or c
ggtagggcaagttttggttatttggtatcaaacagaaacagccccaagcaacaaatgatttgaggaccgtnttaaattcagaaatttcaaacgatttttgc

SEQ ID NO: 4639 - DNA, 101 bp, rice(Oryza sativa)
  misc_feature (71): n=a or g
ctgtttatctgcacaaggattgttcatgtataatctctacaacggtttgcctgtttgaagagagaaacagntaaaacaatttcaacggtggggtaagtcct

SEQ ID NO: 4640 - DNA, 101 bp, rice(Oryza sativa)
  misc_feature (71): n=t or c
gcagatagaccataacaggtcacgtctacgaaaatcgtcatccattttgtgtgcggctctttaatagaacngcacggaaaaatcgatttttgcgtgcaatc

SEQ ID NO: 4641 - DNA, 101 bp, rice(Oryza sativa)
  misc_feature (71): n=a or g
tgcaacgaagcgggtgcatcagaagctccatcaaatcacggatacgataatccaaggacatgaaatcatcnaggacggcagcgttggtgatgacaccatac

SEQ ID NO: 4642 - DNA, 101 bp, rice(Oryza sativa)
  misc_feature (71): n=t or c
gtctaggttcaggacctggctctggaatcacactcgcctattacactagacctcgtcgaacaactggttgncctgtgggaagcggtccggaatgttcactt

SEQ ID NO: 4643 - DNA, 101 bp, rice(Oryza sativa)
  misc_feature (71): n=t or c
aagattatttaatttctccttaattttggtgacaaaagtaagatatggagagagtacttgggatgatgagnccaatccttgattctctagtactgaacgat

SEQ ID NO: 4644 - DNA, 101 bp, rice(Oryza sativa)
  misc_feature (71): n=a or g
atggcgcgccagcgttgaaggggtttataccttgccgagctaccctagagaatagatatatcggagaatcnggaggatgcatggtggaaaagttaggaagt

SEQ ID NO: 4645 - DNA, 101 bp, rice(Oryza sativa)
  misc_feature (71): n=t or g
gcgccatccaaaaattttaattttccccagcaacacttcaatctccacaaattcttccacagctaattccntgaagcagtactagcttgcacttgggccct

SEQ ID NO: 4646 - DNA, 101 bp, rice(Oryza sativa)
  misc_feature (71): n=t or g
agtactttaattcagatggcgtgtccgtctcaacaaacaacagtgcatgcgttactagtttcactgtatcnatcaaaggacgttcggtctgcggtctgcct

SEQ ID NO: 4647 - DNA, 101 bp, rice(Oryza sativa)
  misc_feature (71): n=a or c
gactatataaaattatagacccttaattatgtttttaaggtaagacgtcaccactactaatactctctctncccctaaatatttgacgctgttgaagtata

SEQ ID NO: 4648 - DNA, 101 bp, rice(Oryza sativa)
  misc_feature (71): n=t or c
agaggtgatgtgataatgcacatcaccactactaatagtccccgcgtctttgaatatttgacgccgttganttttttaaacatgtttgaccgtttatctta

SEQ ID NO: 4649 - DNA, 101 bp, rice(Oryza sativa)
  misc_feature (71): n=t or c
aacctaaaatccgtaccactaaaatcaacaatatcatctttaaatcgttcaggcctaaactcatttacatntttccaaatcttctcatctcttccaatagc

SEQ ID NO: 4650 - DNA, 101 bp, rice(Oryza sativa)
  misc_feature (71): n=t or c
taaagatgatattgttgattttagtggtacggattttaggtttattcctggtggttctggtcgaaggatgngcccaggtttaacatttggagtatccaata

SEQ ID NO: 4651 - DNA, 101 bp, rice(Oryza sativa)
  misc_feature (71): n=t or g
tgtcctgctgcgtcttcagagatgggagcatagagacaacccatactacggaggttatctgcacgaccttnttcgtacgtgtcactctcttgtacccccat

SEQ ID NO: 4652 - DNA, 101 bp, rice(Oryza sativa)
  misc_feature (71): n=t or c
ttatctgcacgacctttttcgtacgtgtcactctcttgtacccccatctatatctatatcgtcctccctcngtcccatgaaaaaccgatattctaataaat

SEQ ID NO: 4653 - DNA, 101 bp, rice(Oryza sativa)
  misc_feature (71): n=t or c
cttttaaaacttatgaaccatggcgttgcggttggatatcctaacttatatgtagaaaagacatataatangacgtgtgttttattgcttaaatatgtgaa

SEQ ID NO: 4654 - DNA, 101 bp, rice(Oryza sativa)
  misc_feature (71): n=t or g
tttgcttggtaggttcgaaggtgtgcacaggagagtgtggagaagctatttgcgcacttgaaacaatgtgnttgtgggaagaaagttagtaatgctgcaat

SEQ ID NO: 4655 - DNA, 101 bp, rice(Oryza sativa)
  misc_feature (71): n=a or g
ccataggttcaacgtgccccatcaatgataaccataataactcaaacacaagtatgtcaactgaaaactcntaaaagaagcattatcatattgaaatgttg

SEQ ID NO: 4656 - DNA, 101 bp, rice(Oryza sativa)
  misc_feature (71): n=a or c
tgcattcagcttgtagaaaaactctctcagactccaatgtacaaaggattaacaattcgcagctgccaagnttttgagtgtatatctaattagttatatct

SEQ ID NO: 4657 - DNA, 101 bp, rice(Oryza sativa)
  misc_feature (71): n=t or g
cttgtagaaaaactctctcagactccaatgtacaaaggattaacaattcgcagctgccaagcttttgagtntatatctaattagttatatctgagagagcc

SEQ ID NO: 4658 - DNA, 101 bp, rice(Oryza sativa)
  misc_feature (71): n=t or c
tgcagggccgcaagggaaatcataatccagcagatggcgcagagtctgaggcacaacaacctacgcaacangctgctaagaggttagcctgcagcacttag

SEQ ID NO: 4659 - DNA, 101 bp, rice(Oryza sativa)
  misc_feature (71): n=t or c
aaagcctacacactttttcttactaaattattactaactctttcttaccagtaaattcttggggtaattgnaaatttactactactttgaatcgttattgc

SEQ ID NO: 4660 - DNA, 101 bp, rice(Oryza sativa)
  misc_feature (71): n=t or c
caactggttaatgcagcatacctgtgatggatccaaagttaacatcttctctaaaagatccagcgcgtgcngatcaaagctgcaaatatgtaaaacagtga

SEQ ID NO: 4661 - DNA, 101 bp, rice(Oryza sativa)
  misc_feature (71): n=a or c
atccaaccacggtgcacgcaatccaaagctataaaaaaacgttccgactcgcctccaccacgacaactcgnaccacacaccaccaccatcaaactccttgc

SEQ ID NO: 4662 - DNA, 101 bp, rice(Oryza sativa)
  misc_feature (71): n=t or g
accgacgttgctttatggaccacaattagctaagaacataagatgtgtcttattggccacaaaatgcagancaatcctgctgttggagttgagtactaaca

SEQ ID NO: 4663 - DNA, 101 bp, rice(Oryza sativa)
  misc_feature (71): n=t or c
gctaacatgtcggcccacgagctataagacccatgtgtcagtgcagcgtgggtgctgggggacttgagtcncctctactccgctggatcataattgataga

SEQ ID NO: 4664 - DNA, 101 bp, rice(Oryza sativa)
  misc_feature (71): n=a or g
gacagccgttacagaccatgaaggtccaagtaaccttctcatgatgcccctagttactgaagcttggagtnatccgataaaagaaacaaatgagctaaccc

SEQ ID NO: 4665 - DNA, 101 bp, rice(Oryza sativa)
  misc_feature (71): n=a or g
ttagacccaatttttctaggtacatattgcaatatgtgtatgtacatagaggattagaggtatttattctnttgcgtatgcgtcaaacagtataggcgtag

SEQ ID NO: 4666 - DNA, 101 bp, rice(Oryza sativa)
  misc_feature (71): n=t or c
aagaaatcgagacattgctcaccgcattggtgatctacgccttctaggtggtggagagggagaacgccttntcactggagatcctggtctccgacgaggag

SEQ ID NO: 4667 - DNA, 101 bp, rice(Oryza sativa)
  misc_feature (71): n=t or c
atccaagaggatcgaagcttacgaggaaggtgcataaaaaaacatactagtactaatattgcattagcttnttttttttttatctctattgcctggactct

SEQ ID NO: 4668 - DNA, 101 bp, rice(Oryza sativa)
  misc_feature (71): n=a or g
ctgacaatgagaacataatatgtattctcttatttattttgtacatacaaactatactacaagaacgaganctatgcactcagcgatgacaaactaacgaa

SEQ ID NO: 4669 - DNA, 101 bp, rice(Oryza sativa)
  misc_feature (71): n=t or c
acactgtgaagaatatggaaggaagtgaagcagggggcgagccggaagcataaagttcgaggaggaagaantaaggtggcctaccatgactccagcacaaa

SEQ ID NO: 4670 - DNA, 101 bp, rice(Oryza sativa)
  misc_feature (71): n=t or c
ctgatctaccttaaagaaaacaaaatatctccattaaatactctctagagttttctaagccaacacatgtnaactggtgaacccattattttcaaccatta

SEQ ID NO: 4671 - DNA, 101 bp, rice(Oryza sativa)
  misc_feature (71): n=a or g
gagatcgagattaaagaaacacacagcggagggaggagggaggagagagatggaaaacttgcatggtctcnttggcttttatagtgacgacagcctctctc

SEQ ID NO: 4672 - DNA, 101 bp, rice(Oryza sativa)
  misc_feature (71): n=t or c
acgtatgacacttattacaaatgaccgacggccgaggatactagaggacgatgaaattattacatcatctnacaccatgctaacttgttgagggtttgtat

SEQ ID NO: 4673 - DNA, 101 bp, rice(Oryza sativa)
  misc_feature (71): n=t or c
ggagttgttctattagagaatatgaaatggttaacagtacagtacaatagagtacaaactaattaatgttntgtacacttactacaagcgagaacaagaat

SEQ ID NO: 4674 - DNA, 101 bp, rice(Oryza sativa)
  misc_feature (71): n=t or c
gtctagcaaagccgctactaaagttcccaaattagaaaggcacccgaatcccttcctcgagccctcagtcntggggactcagccccatttattttttttat

SEQ ID NO: 4675 - DNA, 101 bp, rice(Oryza sativa)
  misc_feature (71): n=t or g
acaagggcttctcagttctcactgaattagctagggctgcctcgtctcttattctttgcaagactccagancttcgatgtattgaatattgcaaccactta

SEQ ID NO: 4676 - DNA, 101 bp, rice(Oryza sativa)
  misc_feature (71): n=a or g
caaggcttattaggtcatgctccctggctccctgcaacttcctccgttcaaaaaaaaacacacgaatctanacatagagtatgtccagattcattctagtc

SEQ ID NO: 4677 - DNA, 101 bp, rice(Oryza sativa)
  misc_feature (71): n=a or g
gggagtgcgcttattgacttgtacttcaactctggctgtatggaagatgggtttaggtgcttcagatccanccccaagcatgatattgttacctggacagc

SEQ ID NO: 4678 - DNA, 101 bp, rice(Oryza sativa)
  misc_feature (71): n=a or g
cctgacttgattgtagttgtcctaacatgccgaccgtcagtttgcaaatgttgtacgaattgaaaacaganttcgttctataaactttatacgcacttaat

SEQ ID NO: 4679 - DNA, 101 bp, rice(Oryza sativa)
  misc_feature (71): n=a or c
ttcatctttattttcattagaaataaaaagccacataatagtattacgcaagttcccaagagcttccaccnggcttccgccggaagagatgattggcaggg

SEQ ID NO: 4680 - DNA, 101 bp, rice(Oryza sativa)
  misc_feature (71): n=a or g
tccttcgccttcgtcgtcgtcttcccctcctcctccttgctgctcccctgctgcttcaccttcttctgctnctcctgcttgctgcaatcgtcgtcgtcgtc

SEQ ID NO: 4681 - DNA, 101 bp, rice(Oryza sativa)
  misc_feature (71): n=a or c
tattttctcccagtttggatatttcgcttttggagggagcacagtaatatgcgtctttgagaaggtttctntttctcgcttctgctgactaaaacatctag

SEQ ID NO: 4682 - DNA, 101 bp, rice(Oryza sativa)
  misc_feature (71): n=a or g
agtgtcttatatgattgactattgtttcctggcaaattatgttatgttcagtgtgctgtaacttgtaagcnccatttcagacgtggcattcttccaaatgg

SEQ ID NO: 4683 - DNA, 101 bp, rice(Oryza sativa)
  misc_feature (71): n=a or c
tgttggaataagaagcagagcagtttgtcccatattttcccattagccatttatatacctagaatgccaanaaacattacattgttcattcaaatgttctg

SEQ ID NO: 4684 - DNA, 101 bp, rice(Oryza sativa)
  misc_feature (71): n=t or c
gcagttgcaaaggtatgacatatttcccattcttttttaatattttgttcgttgtagttgtaatcaggtcnatccgcagttctccctagtatatcatatta

SEQ ID NO: 4685 - DNA, 101 bp, rice(Oryza sativa)
  misc_feature (71): n=t or c
cgcccgtatggaactctgtgagtaagctgttacctttttggtccccatgaagctgtattgtgttgtatcanactgctgctccaccaatgtaaacattagtt

SEQ ID NO: 4686 - DNA, 101 bp, rice(Oryza sativa)
  misc_feature (71): n=a or g
tcgccggcatcgcgcgcatccggatagtgaaggtacggggccgggttgggtgtgtgtgcttgcggctgcgnagcggaggggggtggaattggggatcggtg

SEQ ID NO: 4687 - DNA, 101 bp, rice(Oryza sativa)
  misc_feature (71): n=a or g
tgtttggacagatcgcttgggttggaatcccaactccaccggcatggctgccaacttacatgctcatcaangtaattacagtatctctaagtccatcacac

SEQ ID NO: 4688 - DNA, 101 bp, rice(Oryza sativa)
  misc_feature (71): n=a or g
caaaatcaaaatgatcgatagtgttgttttatgaaactttatagctataatactgagggttaagtggcacntgctaaaatctatatgatttgtgcaattta

SEQ ID NO: 4689 - DNA, 101 bp, rice(Oryza sativa)
  misc_feature (71): n=t or c
ggctgctggtccccgtcgccggcggcctcgtcgagctcttcgcgtcgagatatgtgagtggtcggtcgttngattggttagaggagtagtagttagagagg

SEQ ID NO: 4690 - DNA, 101 bp, rice(Oryza sativa)
  misc_feature (71): n=a or g
aagaaaaagcaggccttgtgaatgctgcaactgacacttgcatccattcttcttgctttcatgtgtcactnctagggcaagggtgatcaccacatgggaag

SEQ ID NO: 4691 - DNA, 101 bp, rice(Oryza sativa)
  misc_feature (71): n=t or g
ttcagtaacttaaagagacagagatcaaagctgcattcttctggctcatcaggattgtatgtgaaatcttntctagtgaatttttggaattaagcagagaa

SEQ ID NO: 4692 - DNA, 101 bp, rice(Oryza sativa)
  misc_feature (71): n=t or g
ctcttccatctgttgatcactgccacagttcgtcagttagtttgaagcgatctcaggaagacagaaggtanctttctttctctgcttaattccaaaaattc

SEQ ID NO: 4693 - DNA, 101 bp, rice(Oryza sativa)
  misc_feature (71): n=a or c
tccccctccctccatttctttactcatttcccttcccctccgcttcctaatcctgcgtgaccccagacgangacgacgacgagtacacatgcgtttgagcg

SEQ ID NO: 4694 - DNA, 101 bp, rice(Oryza sativa)
  misc_feature (71): n=a or g
tgagctgatttggggttttttttgttgtgaaggttgcggcgctggaggcggagctgaagcggatgggcgcngagaaccggcagctgagcgagatgctggcg

SEQ ID NO: 4695 - DNA, 101 bp, rice(Oryza sativa)
  misc_feature (71): n=a or c
gactctgacgacttgtccatgtaacgtccgtgtgcctttccggtataaattcggcctcgcaatatatggancattttgcatttccgatcaaaatcatgctt

SEQ ID NO: 4696 - DNA, 101 bp, rice(Oryza sativa)
  misc_feature (71): n=a or g
tacctaactttggtgacttctcactttacactcaacacagtaccgacttctcgacatctctttcagtctcngatgacattttctccacaaaattttctaac

SEQ ID NO: 4697 - DNA, 101 bp, rice(Oryza sativa)
  misc_feature (71): n=t or g
gccatactgacatccaccaggccaagaaccaccttggtgcttccaagtaccccatggtccctgggtaagantattcacagttatctagatggatcatggct

SEQ ID NO: 4698 - DNA, 101 bp, rice(Oryza sativa)
  misc_feature (71): n=t or c
ccgccgcctcgtgcgtcgcgtgttcgtgtccagagacgatgggcagcctcgccgccgagaagaccgtcacngggtgggccgccagggacgcctccggccac

SEQ ID NO: 4699 - DNA, 101 bp, rice(Oryza sativa)
  misc_feature (71): n=a or g
ctttaattatatatactcgctgcgggacgcaccaccccctctccagaattcagcgagagagagcgaatcanccactgcacttcttgttcttgttctcttcc

SEQ ID NO: 4700 - DNA, 101 bp, rice(Oryza sativa)
  misc_feature (71): n=t or c
tgaaagctaacaatttttacatcaagtgaatgatgtatctctgtatggttctacatgtgggacacattttntataaattatttattttgggtttgttctat

SEQ ID NO: 4701 - DNA, 101 bp, rice(Oryza sativa)
  misc_feature (71): n=a or c
aaaagtaaatcaactccataaacttcatttctgtttcaccacacattttcctctgtgaacttatcttaaanaaagataaaatttgttttggcaccacaaat

SEQ ID NO: 4702 - DNA, 101 bp, rice(Oryza sativa)
  misc_feature (71): n=t or c
gttaattacagtctttgtgttacagtttcagataggtttgttacagttaacttttcagatagattgttaangcagtctgtgagatagacagtttgagatag

SEQ ID NO: 4703 - DNA, 101 bp, rice(Oryza sativa)
  misc_feature (71): n=a or g
ttcatattttgaattgccctatagtttcacgtattatataggatgacttattagtttgtgaagaagtacangtataatttagttgggctccacaatatttt

SEQ ID NO: 4704 - DNA, 101 bp, rice(Oryza sativa)
  misc_feature (71): n=a or c
taacttccaaaaactgaatttcggagacaaactgccgttcagttttcgtccaatttgatttatcactattnctagaaaaaagtctgtgcattgcaacgggt

SEQ ID NO: 4705 - DNA, 101 bp, rice(Oryza sativa)
  misc_feature (71): n=a or g
accaggcggcgtggaggacgcatcgctcctggacgttggcgcagaagccgagggtgatcttgttgaggtcnccgcgcagcacggcgccgctccacacggag

SEQ ID NO: 4706 - DNA, 101 bp, rice(Oryza sativa)
  misc_feature (71): n=t or g
tactactagtatacagtagaagcgaaccaaacggtcggcgtgacgcgacgagctatgggccgtgtggctgncgcgcggggccagtcgaagcactcttggcc

SEQ ID NO: 4707 - DNA, 101 bp, rice(Oryza sativa)
  misc_feature (71): n=t or c
gtgcattggttctttctttagctagctaatctgcttttctatgtgttctgatgtggcaaaaataaaggtanctagcagggccaagaatggatgatatgtta

SEQ ID NO: 4708 - DNA, 101 bp, rice(Oryza sativa)
  misc_feature (71): n=a or g
cgacaccatttacaggctgtgtgattctacaggagggtctatatatagttgatcaaggttacatgctagantatctccagttcatatatatatatatatat

SEQ ID NO: 4709 - DNA, 101 bp, rice(Oryza sativa)
  misc_feature (71): n=t or c
caccctcatcttcttcgccgccttcgccatcctcaccctcgccctccacctccacatctacaccggctagncacctagtactcttctccaatttccatcca

SEQ ID NO: 4710 - DNA, 101 bp, rice(Oryza sativa)
  misc_feature (71): n=a or c
cagcagatcagtatacctactacgtataaaccacggttgcttcaacatattgaagttcattgcagaatttnggtcgccttttctggattctgaacatgttg

SEQ ID NO: 4711 - DNA, 101 bp, rice(Oryza sativa)
  misc_feature (71): n=a or g
aatagaatctaatcctagtagcaaatctgaacacatgcatgtccatattcgttgttaggattaggtttacnggggatggagggggtaggtccttgaactct

SEQ ID NO: 4712 - DNA, 101 bp, rice(Oryza sativa)
  misc_feature (71): n=a or g
atttttaaatgaccatcatattaatattcaattcactaggactatttgttatttatgcatgagatagcatncatacatccacgcacacaacatttacaacg

SEQ ID NO: 4713 - DNA, 101 bp, rice(Oryza sativa)
  misc_feature (71): n=t or c
gatgaaatgaccctaaaaagaaatataccctctagatctaggttagctttatcccttaaaaattggcatantgtcgatgggatacctgtgaactgtattct

SEQ ID NO: 4714 - DNA, 101 bp, rice(Oryza sativa)
  misc_feature (71): n=a or c
aaacttcaaagggcccctttaatctgaaggatacacgtaagtactttggaggatttcaaggagaaaaatcntatgaatatctttaaaacaaaggattgaaa

SEQ ID NO: 4715 - DNA, 101 bp, rice(Oryza sativa)
  misc_feature (71): n=t or c
gctgaggagaggaggaggaaggttgagctggtgcaggaagccatccgtgagctcctggaggagaagaggangggggagcggcggcggcggcagggtggaga

SEQ ID NO: 4716 - DNA, 101 bp, rice(Oryza sativa)
  misc_feature (71): n=t or c
acaattgttcatgcaatcatgctgaaataacttacattcagaagttgtagaatagacagagacaggcaacngaatgtcaggatggtgtttccttagctcct

SEQ ID NO: 4717 - DNA, 101 bp, rice(Oryza sativa)
  misc_feature (71): n=t or c
acgtagcgaaagacctgaacaaaatcaagaggcagaacatgatcacccacatcctactcggcacggtcatngtcatgactgccgtctggcaattcaacgag

SEQ ID NO: 4718 - DNA, 101 bp, rice(Oryza sativa)
  misc_feature (71): n=a or g
tccggctcccccgcaccggttgtccgacttcaagcattttcgatgtttaatcggtgtattaccacgcatcnactgtatgctccttcctgaatcccagtaga

SEQ ID NO: 4719 - DNA, 101 bp, rice(Oryza sativa)
  misc_feature (71): n=t or g
cgaggctggtaaaatgggagcacaatctatgatcaatcaaacaagagttgaatcctgcagactcgcagatnttctgaacaactctttgcatcgcactagct

SEQ ID NO: 4720 - DNA, 101 bp, rice(Oryza sativa)
  misc_feature (71): n=a or g
caatgcaaagtttacttaatactaaatctgtcagactggagttcgtttagtttggtgtcatcacagtccantttaagaaaatgtatcatattcatacttct

SEQ ID NO: 4721 - DNA, 101 bp, rice(Oryza sativa)
  misc_feature (71): n=t or c
gttccaggtttccagccacaagtgctctttcttgagcaacttgctaacaccattgcagcttagcagttagnagcttatcagcatgtttctgatcaaacata

SEQ ID NO: 4722 - DNA, 101 bp, rice(Oryza sativa)
  misc_feature (71): n=a or g
agagagacatttcctgtactatgatgtgaaaacctaaatttgcccctggggttcggttaagccaaccacancagcgggttacccactgagacgaggtttac

SEQ ID NO: 4723 - DNA, 101 bp, rice(Oryza sativa)
  misc_feature (71): n=t or c
aagtttgggcagacatgaaaattaatttttggcatcaaatgaggggggcatcgaaacaggttggaattttntttaatacacaacacatggtctagtttttt

SEQ ID NO: 4724 - DNA, 101 bp, rice(Oryza sativa)
  misc_feature (71): n=a or g
cctctgctgctgcagcagcagctgcagctgctgcggccgcagaagccgcagcattctttctagcccgcttntgagctttcttatcataagtatacaaacca

SEQ ID NO: 4725 - DNA, 101 bp, rice(Oryza sativa)
  misc_feature (71): n=a or g
atcagcaagcacagttgttcctgcagttgcagccacagtttccttgttatctccattacaatcaacagaancatatccattattaatattctgcctccttt

SEQ ID NO: 4726 - DNA, 101 bp, rice(Oryza sativa)
  misc_feature (71): n=t or c
ttgaaaatccagcaactgatgagaataatctggaacagaagcgtgtgcctgtgtcaattgatgtcccaganccagacttttatgattttgataaagatcgc

SEQ ID NO: 4727 - DNA, 101 bp, rice(Oryza sativa)
  misc_feature (71): n=a or g
aaaattaatggtcaggagttttcaacattagctgtttaccctggtaacatagtccaagtcatcagctagangttagatcacatgatagagctaagagccaa

SEQ ID NO: 4728 - DNA, 101 bp, rice(Oryza sativa)
  misc_feature (71): n=t or c
gtaccacagtccacaactacatatgggattaacattcagaatcactccccagtgttcaacaatcactgaanttgaaaaggtatagctaagaatactatgga

SEQ ID NO: 4729 - DNA, 101 bp, rice(Oryza sativa)
  misc_feature (71): n=a or g
tttactgtgtagtgtcattccagatgaatttgtttggatgtataatttgcgttatcttattttcagaattnagattccgaaggatccaagtgatttgttat

SEQ ID NO: 4730 - DNA, 101 bp, rice(Oryza sativa)
  misc_feature (71): n=a or c
aatatgtcaatggtcagctgaagaacaagtacggtgacgctttcatacgaggaaacaatggtatgcgtacnatgcaaaatcttatacgacaaatattctga

SEQ ID NO: 4731 - DNA, 101 bp, rice(Oryza sativa)
  misc_feature (71): n=t or c
catgtaaccatcaagacaagccaaaatacctggttcataccaatgaaagacatttgaaatcagctttttangtaagcataatggaataatcaaatttcact

SEQ ID NO: 4732 - DNA, 101 bp, rice(Oryza sativa)
  misc_feature (71): n=t or c
ttaatactcctttgcttgtctatgaacgttataatctttttaagctttcactagttaggtttttaatgtgnatggactttgaattttcctgtatctttttt

SEQ ID NO: 4733 - DNA, 101 bp, rice(Oryza sativa)
  misc_feature (71): n=a or g
gtccatgcacattaaaaacctaactagtgaaagcttaaaaagattataacgttcatagacaagcaaaggantattaaggtaggtttgcaatgtagactcta

SEQ ID NO: 4734 - DNA, 101 bp, rice(Oryza sativa)
  misc_feature (71): n=a or c
agttatttatcaaaagtcaatgaagtgagttagtttctggttttgcatccatgaagtttagcgattaagcnccaccttatatataaactagcaacactata

SEQ ID NO: 4735 - DNA, 101 bp, rice(Oryza sativa)
  misc_feature (71): n=t or c
tatataaggtggtgcttaatcgctaaacttcatggatgcaaaaccagaaactaactcacttcattgacttntgataaataacttcatatcttcctctctac

SEQ ID NO: 4736 - DNA, 101 bp, rice(Oryza sativa)
  misc_feature (71): n=t or g
actatgatgatggctttaagcaaattcctagagcgaactgtggtttaaacaaattcctaagatcgaagtgntaggccttgtttgtgaatcctgatcccaga

SEQ ID NO: 4737 - DNA, 101 bp, rice(Oryza sativa)
  misc_feature (71): n=a or g
tataagaatcatcaatgctgatatgattggtgatttcataattcatacttcaccgatcacaagcaacattnactgcacaattgcacatatactcctgacat

SEQ ID NO: 4738 - DNA, 101 bp, rice(Oryza sativa)
  misc_feature (71): n=t or c
aatcatatcagcattgatgattcttatataaccttgcaatatgtgctcagagtttcaacttgcttgttttntttaccaaactgtagacctgagcatatcat

SEQ ID NO: 4739 - DNA, 101 bp, rice(Oryza sativa)
  misc_feature (71): n=t or c
ggtgtggttttcctttttacttctcttttctgtttttgagccaaggttaaaaggctggttgtagactaatnccatgtatgtagaactcatccatcctggct

SEQ ID NO: 4740 - DNA, 101 bp, rice(Oryza sativa)
  misc_feature (71): n=a or c
catgggattagtctacaaccagccttttaaccttggctcaaaaacagaaaagagaagtaaaaaggaaaacnacaccaggcatagaactcactaactcagca

SEQ ID NO: 4741 - DNA, 101 bp, rice(Oryza sativa)
  misc_feature (71): n=a or g
attggtcttacaattttgtgccactgctacatctcttttaacaaattgttagcttttggcccatatttccntggaatttcatttgtggaatgataatatac

SEQ ID NO: 4742 - DNA, 101 bp, rice(Oryza sativa)
  misc_feature (71): n=t or c
ttgttaaaagagatgtagcagtggcacaaaattgtaagaccaatgtcaccaatcacatactaaatggttgngtcaagataagtggctgaataagtctacat

SEQ ID NO: 4743 - DNA, 101 bp, rice(Oryza sativa)
  misc_feature (71): n=t or c
actatcaccaatttcatggaatcttacttattggaaatttgtaacaaatctattttatcccctgagttacngtgttggtctaaaatcaactcgcatgtgag

SEQ ID NO: 4744 - DNA, 101 bp, rice(Oryza sativa)
  misc_feature (71): n=a or c
tttagaccaacacggtaactcaggggataaaatagatttgttacaaatttccaataagtaagattccatgnaattggtgatagtatataatgattttattg

SEQ ID NO: 4745 - DNA, 101 bp, rice(Oryza sativa)
  misc_feature (71): n=t or c
ttcacattggcggtacacccatgatatatttaattgttacccagaaccatataatagcctaataagagcanatggtattccattgattggggccttcggaa

SEQ ID NO: 4746 - DNA, 101 bp, rice(Oryza sativa)
  misc_feature (71): n=a or g
tggttctgggtaacaattaaatatatcatgggtgtaccgccaatgtgaaattgagaactgcatacacatanccacattataaaatataaatgcactatgct

SEQ ID NO: 4747 - DNA, 101 bp, rice(Oryza sativa)
  misc_feature (71): n=t or c
ttgcaatgcaaaccttaagcacagatgtcctccctcttaaatattaatcataatcctcagtaaatggacanacagcataaagtactttaaattaccatagg

SEQ ID NO: 4748 - DNA, 101 bp, rice(Oryza sativa)
  misc_feature (71): n=a or c
tcaaagtcggatgcggatgcaaccgcgagacctagcagtctagcacccgcacccgcacccgcacaaacgcngcgcaagatgagcagtggcggcgagaagtc

SEQ ID NO: 4749 - DNA, 101 bp, rice(Oryza sativa)
  misc_feature (71): n=t or g
ggttgcatccgcatccgactttgagatcgattttttatcgggttctgtaccctccacccgttattgggacngacccacctgtcatcctcatccaatcgact

SEQ ID NO: 4750 - DNA, 101 bp, rice(Oryza sativa)
  misc_feature (71): n=t or c
gggccccatatgtcggtgggataggatgacacacagccacgtcggggtcgatctgggcccgcgtgtcagtngattggatgaggatgacaggtgggtcagtc

SEQ ID NO: 4751 - DNA, 101 bp, rice(Oryza sativa)
  misc_feature (71): n=a or c
atccaatcgactgacacgcgggcccagatcgaccccgacgtggctgtgtgtcatcctatcccaccgacatntggggcccactgtgacgtggccccacacga

SEQ ID NO: 4752 - DNA, 101 bp, rice(Oryza sativa)
  misc_feature (71): n=t or c
acatcgcctcacgctgcgtcaccgcgcgcggacaaaacacccacacccccacactctccacccctctctcnctctcgcccaaacccagaaaccctcgccgc

SEQ ID NO: 4753 - DNA, 101 bp, rice(Oryza sativa)
  misc_feature (71): n=a or g
gccgtgactcgccaaccagacgcaagacctgctcaagcaattctgtcgcgggtggcttgggcaggcgtgcnatgtaccctggtagattcatcgaggtgtcc

SEQ ID NO: 4754 - DNA, 101 bp, rice(Oryza sativa)
  misc_feature (71): n=t or c
tcttgcgtctggttggcgagtcacggcgcccgattctctatgtcggtggtggctgctctgcatctggtgangaattgcgctggtttgttgagctgactggt

SEQ ID NO: 4755 - DNA, 101 bp, rice(Oryza sativa)
  misc_feature (71): n=a or g
caatgtgcacaatcttggccctgcttgcaaaagcctcaattttccctgtcacacgatcatcaaaccgcacnccaaacgcaagcaacaggtcagccttatcc

SEQ ID NO: 4756 - DNA, 101 bp, rice(Oryza sativa)
  misc_feature (71): n=t or c
tcaagccctgtaaagcaagcttaacatctgcgcaaattgacacatgtggttgcttgttctttccaatctcngctggatcaatgtcaatgtgcacaatcttg

SEQ ID NO: 4757 - DNA, 101 bp, rice(Oryza sativa)
  misc_feature (71): n=t or c
gaccagccgaagacagccactgccgtggccgcttgtaggtgtaatattgtgccgcccacatctggtgctgnccaacaccagtagcgatgattgcctcacct

SEQ ID NO: 4758 - DNA, 101 bp, rice(Oryza sativa)
  misc_feature (71): n=t or c
tgtggctaacccaggtgtcacagttgttgatattgatggggatggtagcttcctcatgaacattcaggagntggcattgatccgcattgagaacctccctg

SEQ ID NO: 4759 - DNA, 101 bp, rice(Oryza sativa)
  misc_feature (71): n=t or c
cgagcatcttcttgatggcggcacggacttcactcttctttgttacacggactgcaggaatattgaacccnttagcaatagtcacaaaatctggatatatc

SEQ ID NO: 4760 - DNA, 101 bp, rice(Oryza sativa)
  misc_feature (71): n=t or g
ggttcaatattcctgcagtccgtgtaacaaagaagagtgaagtccgtgccgccatcaagaagatgctcganactccagggccatacttgttggatatcatc

SEQ ID NO: 4761 - DNA, 101 bp, rice(Oryza sativa)
  misc_feature (71): n=t or c
catcaccatccaggatcatgtccttgaatgcgcccccacttgggatcataggcagcacatgctcctggtgngggacgatgatatccaacaagtatggccct

SEQ ID NO: 4762 - DNA, 101 bp, rice(Oryza sativa)
  misc_feature (71): n=a or g
tactttattctcttattattgatatgtaggacaagaaacttacatgatatcttgtgatgcatatgcctacngaaaacaacacactacaaacctagacagca

SEQ ID NO: 4763 - DNA, 101 bp, rice(Oryza sativa)
  misc_feature (71): n=t or c
taagttcagaagttcagaaattgttgaaacacttaactcagagctattgcatagaagtactttattctctnattattgatatgtaggacaagaaacttaca

SEQ ID NO: 4764 - DNA, 101 bp, rice(Oryza sativa)
  misc_feature (71): n=a or c
tataatatgggacggagggagtatataagaatacattatgccaaaaataatccttagcagtcaggaatagnttgatttttcatctattttgcatggatgct

SEQ ID NO: 4765 - DNA, 101 bp, rice(Oryza sativa)
  misc_feature (71): n=a or c
gacaagtagacacgtatccacacctcaagccataaaattataaattatactaccgtttatcatttttcctncatgtattagtgcctcaaataaccgtaaaa

SEQ ID NO: 4766 - DNA, 101 bp, rice(Oryza sativa)
  misc_feature (71): n=a or c
aaaactctaccgagaacaacagcatttttaacaatacaaaggtctacgtatcattagaagcctcgttgaangacaagtcaaggtactctgccaagctcaat

SEQ ID NO: 4767 - DNA, 101 bp, rice(Oryza sativa)
  misc_feature (71): n=a or g
atagttcattcggccgcctccttggccaggattatagtttctgggtccatagctaggtggatgtggataanggccttgagatggaggagcagaatgtggat

SEQ ID NO: 4768 - DNA, 101 bp, rice(Oryza sativa)
  misc_feature (71): n=t or c
gtcaggataccgaggacctcctcctggcgctccaccaccatggagcccacattctggcgttccaccaccanggaatccacattctgctcctccatctcaag

SEQ ID NO: 4769 - DNA, 101 bp, rice(Oryza sativa)
  misc_feature (71): n=t or c
caggaggaggtcctcggtatcctgacatcggagcctggaactgcataggacttcgccaaggactgcccccnggtgaatcatgggacaatcgggatggagtg

SEQ ID NO: 4770 - DNA, 101 bp, rice(Oryza sativa)
  misc_feature (71): n=a or g
tgatcctgataaacaagcaaagttaggaattagatgagactgtgcattgtaataattatgagatcatatcnaattgcaattatctagcagaggcacttcta

SEQ ID NO: 4771 - DNA, 101 bp, rice(Oryza sativa)
  misc_feature (71): n=t or c
aatctagcatcctatttttttactcactatcctgacactccagttctcctaaaagtaatttaaagatcaanacaaacagtaaccaaaggataaaatatatt

SEQ ID NO: 4772 - DNA, 101 bp, rice(Oryza sativa)
  misc_feature (71): n=a or g
tagccacactgcactgcatctgtatactgttgtcgacttctggtaacatgtttgggttaccatcaaattgnttatcaacttagagcacagcagaacataat

SEQ ID NO: 4773 - DNA, 101 bp, rice(Oryza sativa)
  misc_feature (71): n=t or c
aacccaaacatgttaccagaagtcgacaacagtatacagatgcagtgcagtgtggctaaattaaaacctangcataatacagccgagaaattgtacaagcc

SEQ ID NO: 4774 - DNA, 101 bp, rice(Oryza sativa)
  misc_feature (71): n=a or g
atcacctttatgttcccaggtagctgaattccagcaagttcttagatcaaatcataacaataaatttacantgttattaagaaacccacatctaaacccgg

SEQ ID NO: 4775 - DNA, 101 bp, rice(Oryza sativa)
  misc_feature (71): n=t or g
ccaaaccattcccagtgccaattttcctgacataaataatgtttccttggcatgctgagatttgagttgtntttagcatgagtaaaaatagcgcatgaact

SEQ ID NO: 4776 - DNA, 101 bp, rice(Oryza sativa)
  misc_feature (71): n=t or c
taatcgaactggaatcagtgaccactatgctatccctgatggaagtggaaaccctaagaagcaaatcacancatgtaatttatcctaagctaccttgggcg

SEQ ID NO: 4777 - DNA, 101 bp, rice(Oryza sativa)
  misc_feature (71): n=t or c
gagcccccgcctccgggtagcctacacacttgttcctctcttaggcttactaattgctcttcttccaacgnttactgcgaacgcccaaggtagcttaggat

SEQ ID NO: 4778 - DNA, 101 bp, rice(Oryza sativa)
  misc_feature (71): n=a or g
ggcctagctggggcactcggcccacagtatcaagcccgtagtcaactattcttctcagctctttagcccgncctcccgaagtcccccgtctcgagccgacg

SEQ ID NO: 4779 - DNA, 101 bp, rice(Oryza sativa)
  misc_feature (71): n=t or c
cgggcttgatactgtgggccgagtgccccagctaggcccacagctgaagcattcgtagttcgaaaaagtcnactatgagtcccttaaattagtggcctgat

SEQ ID NO: 4780 - DNA, 101 bp, rice(Oryza sativa)
  misc_feature (71): n=t or c
gacagcccagtcatcatcaaataacttttataaaaaataaagttaccatcccccatctctactaacctctntctccccttttcccaaatttgcatagccta

SEQ ID NO: 4781 - DNA, 101 bp, rice(Oryza sativa)
  misc_feature (71): n=t or c
tattcttgaaacatgcatgatctaatatgatcacctaatttatcttatttatgcgaaattaatacgggtantcagtactcacccgcgcttgatgaagccat

SEQ ID NO: 4782 - DNA, 101 bp, rice(Oryza sativa)
  misc_feature (71): n=a or c
gttctgctacgactacatctacaactcaaaagcgatcgagttctaccgcggcactcatggcttcatcaagngcgggtgagtactgagtacccgtattaatt

SEQ ID NO: 4783 - DNA, 101 bp, rice(Oryza sativa)
  misc_feature (71): n=a or g
gtaggagtcccagaccgatctagtctggtatatgatgcctgcgtgcacttaaataggcctaagggcgatcntgtactatcatagactagtaatatgcccgt

SEQ ID NO: 4784 - DNA, 101 bp, rice(Oryza sativa)
  misc_feature (71): n=t or c
atcgcccttaggcctatttaagtgcacgcaggcatcatataccagactagatcggtctgggactcctaccngaactcggaactcatacatgcaccaacaca

SEQ ID NO: 4785 - DNA, 101 bp, rice(Oryza sativa)
  misc_feature (71): n=a or g
ctgatttattggcggcatcatcactattatcttaattaggattataccttaattagcctttgcgtttttantttgtgttggtgcatgtatgagttccgagt

SEQ ID NO: 4786 - DNA, 101 bp, rice(Oryza sativa)
  misc_feature (71): n=t or c
acgtgacgctgcacatgaacagaggatgttgttcgatcattacggcacaaatttgcataagattttggagnatgcattgttgcgcatttaaaatgttcaag

SEQ ID NO: 4787 - DNA, 101 bp, rice(Oryza sativa)
  misc_feature (71): n=a or g
aaaatcttatgcaaatttgtgccgtaatgatcgaacaacatcctctgttcatgtgcagcgtcacgttactntactgtacatcagtacatgcctgccgatta

SEQ ID NO: 4788 - DNA, 101 bp, rice(Oryza sativa)
  misc_feature (71): n=t or g
cagtctaaccactgattagccccatgcatgcatgatcacaaaaagattagggcaaataatcggcaggcatntactgatgtacagtacagtaacgtgacgct

SEQ ID NO: 4789 - DNA, 101 bp, rice(Oryza sativa)
  misc_feature (71): n=t or c
actgatcggtagcgattaaactaatcaaatcccaacatcctcagtgtcagaagctaatagcctcgaaatcntacacactactccaccattgatttaattta

SEQ ID NO: 4790 - DNA, 101 bp, rice(Oryza sativa)
  misc_feature (71): n=t or c
aggcagaacttttgctatagccaagctaaaatggcactaacccgaccaggagtatcacatgaatgttaatnacacattttcgttgtacgcatatataacgg

SEQ ID NO: 4791 - DNA, 101 bp, rice(Oryza sativa)
  misc_feature (71): n=t or c
aacattcatgtgatactcctggtcgggttagtgccattttagcttggctatagcaaaagttctgcctaaanactacttcgtactccacgtagtatacgata

SEQ ID NO: 4792 - DNA, 101 bp, rice(Oryza sativa)
  misc_feature (71): n=t or c
ggataatgtgcatacagtacttgaactaatataatactacggcgtaatggatatatgtacttctcattatncgggaaaattttcaatattattgccaagta

SEQ ID NO: 4793 - DNA, 101 bp, rice(Oryza sativa)
  misc_feature (71): n=a or c
ttttcttttacagaaaccggttcaggaacctctaggatgaaaacaaacactaaaattttcttatggagctnttacattcaaagaactctgtttgatttatt

SEQ ID NO: 4794 - DNA, 101 bp, rice(Oryza sativa)
  misc_feature (71): n=t or c
ttacggtagtagatgtttctgttctgaaccggtttctgaaaaagaaaagctgaaccttcaacacacgcaangcatcagaagttgcagcgagaaaatttggc

SEQ ID NO: 4795 - DNA, 101 bp, rice(Oryza sativa)
  misc_feature (71): n=a or g
aaggtcaccgtccactgtttcttttgttgggatgccgtgtgttttgccactgcagaggagctctgctgtcnttgccataccagtgcactcctacatgatac

SEQ ID NO: 4796 - DNA, 101 bp, rice(Oryza sativa)
  misc_feature (71): n=t or c
cctctgcagtggcaaaacacacggcatcccaacaaaagaaacagtggacggtgacctttatacggagtacnatcgagactgtaacaaaaggagtagtaaat

SEQ ID NO: 4797 - DNA, 101 bp, rice(Oryza sativa)
  misc_feature (71): n=t or c
ttgtctgagcgaacagttaatgtgtgacggcaaggtcggctgagcctcaccaaagacgacgccgttgcgtncttcgaggagttaatgtgtgatttactact

SEQ ID NO: 4798 - DNA, 101 bp, rice(Oryza sativa)
  misc_feature (71): n=a or g
ggacgcaacggcgtcgtctttggtgaggctcagccgaccttgccgtcacacattaactgttcgctcagacnagcgagtagtagtagtataatctgtttttt

SEQ ID NO: 4799 - DNA, 101 bp, rice(Oryza sativa)
  misc_feature (71): n=a or g
taaactttacacaaatcgactcgtccgagcgtgaagcggatagagatgtacggggagaaagcccagaaagntcaggaaaaaccgtgaaaagggcaaaaaag

SEQ ID NO: 4800 - DNA, 101 bp, rice(Oryza sativa)
  misc_feature (71): n=a or g
tttcagattttggcgacaacatttttgtggggaggacatgtcaggaaaatattttttttctttctgacaancgttgcagtatcttgattttttatactaca

SEQ ID NO: 4801 - DNA, 101 bp, rice(Oryza sativa)
  misc_feature (71): n=t or c
aagatactgcaacgtttgtcagaaagaaaaaaaatattttcctgacatgtcctccccacaaaaatgttgtngccaaaatctgaaatgagagggggaaaaaa

SEQ ID NO: 4802 - DNA, 101 bp, rice(Oryza sativa)
  misc_feature (71): n=a or g
agaggacggagacggagacggacggtgcgggtttatctctcagaaaatgccttggaatttggaactaatcncgcttgtctccatcatctcctatatctgtt

SEQ ID NO: 4803 - DNA, 101 bp, rice(Oryza sativa)
  misc_feature (71): n=a or g
tggagacaagcgtgattagttccaaattccaaggcattttctgagagataaacccgcaccgtccgtctccntctccgtcctctctcgcttccgtactactc

SEQ ID NO: 4804 - DNA, 101 bp, rice(Oryza sativa)
  misc_feature (71): n=t or g
gccagagtgagccaccaccagaggcgtgaccgaatcggctagcgagtgagagaggaggagcagttcacagntgcagttccacgctcgcagtagtgtccaga

SEQ ID NO: 4805 - DNA, 101 bp, rice(Oryza sativa)
  misc_feature (71): n=t or c
agcaggaggagaggcaggcagccatgggcgaggtatggtctctctttccgttcttggtaatgtgcgggggngcgtgcgcgcggctccctgtggccgaggaa

SEQ ID NO: 4806 - DNA, 101 bp, rice(Oryza sativa)
  misc_feature (71): n=t or c
ggtgcgctcgcaaggtcaagaagatactcaggggatttgatggtaatggagaaagcctcttctcttcttcnttttctgtttatctctagctttcttcttgt

SEQ ID NO: 4807 - DNA, 101 bp, rice(Oryza sativa)
  misc_feature (71): n=a or g
ctcttctcttcttctttttctgtttatctctagctttcttcttgttttctggccttgttcttcacttcttntgctactgtgtaatgtttttccctttggtt

SEQ ID NO: 4808 - DNA, 101 bp, rice(Oryza sativa)
  misc_feature (71): n=a or c
atcacttaaccctaaagtttaacgaggtaaaagaacatgtcgagaacgaagcaatgaagtactcttcctcnacaaaatacaaacaagatgggaaccagaag

SEQ ID NO: 4809 - DNA, 101 bp, rice(Oryza sativa)
  misc_feature (71): n=t or c
attcaacattcaaagataatctaaacttttttgaagagcatcaacatatagcagttgcgattcatctttanggcactcgagctatcctattatcttccgag

SEQ ID NO: 4810 - DNA, 101 bp, rice(Oryza sativa)
  misc_feature (71): n=a or c
gaatgttgaatgaaaagacatacataacacatttaaaacttccaagttctgtactagcactcagtgactcngatcacaaggcacacacttattttgcagag

SEQ ID NO: 4811 - DNA, 101 bp, rice(Oryza sativa)
  misc_feature (71): n=a or g
tactaagaaagtagtatattgttctttgaaagtttatgttcttaaactaaataaggttagttaaagtagtntgcctagagtaacaattcataataattgtc

SEQ ID NO: 4812 - DNA, 101 bp, rice(Oryza sativa)
  misc_feature (71): n=a or g
ccgccttcttgtcatcctttgcatttgcatcgccagcattctcagggggaggggctggttcagattttacnacggcggcattcttaccaatgcgtttatgc

SEQ ID NO: 4813 - DNA, 101 bp, rice(Oryza sativa)
  misc_feature (71): n=a or g
atatgcattacccaagattcagcaaccctggtggatatggtgttcctggctacgcatacccgtatgcgccncagctcttcagtgacgagaatccaaacgcc

SEQ ID NO: 4814 - DNA, 101 bp, rice(Oryza sativa)
  misc_feature (71): n=a or g
gtggcccattggagtttgattgccgagaaatttctggaggcccggtgcatgcacgcacgcacgcaagagtntttcatcgatccctgcacgcgcggacgcaa

SEQ ID NO: 4815 - DNA, 101 bp, rice(Oryza sativa)
  misc_feature (71): n=a or g
cgtgcgaattgtgccgtgtgatggcacaagaacatgctgggtgacgattctagagagaaccggcgccattntgtggatgagacgagatactatgcatacat

SEQ ID NO: 4816 - DNA, 101 bp, rice(Oryza sativa)
  misc_feature (71): n=a or c
gagtaactgcgcgtgcacgcgcgcgcgtgatggatgcactagtgacttgactctgcttgccgtgcaaaacnatgcgactctcgtgattcccattgctctac

SEQ ID NO: 4817 - DNA, 101 bp, rice(Oryza sativa)
  misc_feature (71): n=t or g
agggcaaagccgatatttaaagctcatacatattttaaaatgagacccataaatagttagattttgttgtnatttgctacacaatgtttatggctttagta

SEQ ID NO: 4818 - DNA, 101 bp, rice(Oryza sativa)
  misc_feature (71): n=a or g
acagcggacaggcggacagtaggtagcagtgggctgcgcttcgcctttggaacgtactaaagacgaggacnacggatcagagggcgctcgtattcagattt

SEQ ID NO: 4819 - DNA, 101 bp, rice(Oryza sativa)
  misc_feature (71): n=t or c
tgagagttgactttccccgctgccaaactcctttatagtatctcacgttgttttaagggctcagtgtcaangtgtctttgatgcaacaactaagttatcca

SEQ ID NO: 4820 - DNA, 101 bp, rice(Oryza sativa)
  misc_feature (71): n=t or c
ttttttttttttgaacccacacctatccatcggtggtcgtctcggcctctcaagcgttcgcgcgcgtgtancacctgttcgatcgacttgactcgggttca

SEQ ID NO: 4821 - DNA, 101 bp, rice(Oryza sativa)
  misc_feature (71): n=t or c
agtaacgaggcccatgtaaaaactgaaaataatccccccttgagagacctccacaaatctggtgtgtttcntcctctcggcagacggaccactaccagtac

SEQ ID NO: 4822 - DNA, 101 bp, rice(Oryza sativa)
  misc_feature (71): n=t or c
aggaagtgagctctgttattatccttgctctgataggaatagtttttttttctagaaaataataaagtttnaaataatttgtggtagagactagacacaat

SEQ ID NO: 4823 - DNA, 101 bp, rice(Oryza sativa)
  misc_feature (71): n=t or c
ctccctcgacagtattggacagtggtttcgctggcgtggcttgttgacctgatcctatcggctgagtcacnatgcgggacccatgtgtcaacgaccactct

SEQ ID NO: 4824 - DNA, 101 bp, rice(Oryza sativa)
  misc_feature (71): n=t or c
accaggttaacgagccacgtcagcgaaaagaactttccaatactgctaagggagttagattataccagttntgaaagttcgggatcaggatatctgatatt

SEQ ID NO: 4825 - DNA, 101 bp, rice(Oryza sativa)
  misc_feature (71): n=a or c
aagatacattgtggcagatggcaatagttataactgggtagtatacttactaccggcaataagccattaanatatatttttttgttagtgtgtgtatgaca

SEQ ID NO: 4826 - DNA, 101 bp, rice(Oryza sativa)
  misc_feature (71): n=t or g
gctaccgccggctgctacccccgttggttcgtatacataagccacatacgagcacaaatctctccatatcnatctctctctcacccacgcaagctatatat

SEQ ID NO: 4827 - DNA, 101 bp, rice(Oryza sativa)
  misc_feature (71): n=a or g
aactatagccactatttatatacccttatctagctagcacgctgtacatttcaatcccgcgaggacgtacnattaacaattaactatactcacttacctcg

SEQ ID NO: 4828 - DNA, 101 bp, rice(Oryza sativa)
  misc_feature (71): n=a or g
gatgaaggaggcttgcatccttgtggttgcctcgctagagataaaccaaatggacggtgcaaccttttgtnaagcaaacttgttttacttccagtttgagg

SEQ ID NO: 4829 - DNA, 101 bp, rice(Oryza sativa)
  misc_feature (71): n=t or c
ggtgattcctccaggtggaaaaaaatgtcattcttcctcctccatccagttcctttcctccatcgggggtngggggggggggggtttccagatagtcgggt

SEQ ID NO: 4830 - DNA, 101 bp, rice(Oryza sativa)
  misc_feature (71): n=a or g
caagaggttatgctagaagtcctccaaaattccaatcaaacatgccattcaacgattcaacaagaatgtcnaaaggaattctagaagcccaatcctttatg

SEQ ID NO: 4831 - DNA, 101 bp, rice(Oryza sativa)
  misc_feature (71): n=a or g
ccctttgctagcatattggtaggcaagttcctgcatgtgtgcacaaatccacaaacgatatgttacatatntatgtatactgtgttagcaaagcaacaata

SEQ ID NO: 4832 - DNA, 101 bp, rice(Oryza sativa)
  misc_feature (71): n=t or c
ctagaacgcattgttaattattccagccatcgatctccactgtaaataaaaaatgctaagattgttttggncggtcgatggaatattgcaggtgcagatcg

SEQ ID NO: 4833 - DNA, 101 bp, rice(Oryza sativa)
  misc_feature (71): n=a or g
caacccggtcgtcatcaagacggacgaggagtgcgacggcgacgaaggcgtcgccgcatgtaattaacttncgggccgtcgcacgtacacacacatacatg

SEQ ID NO: 4834 - DNA, 101 bp, rice(Oryza sativa)
  misc_feature (71): n=a or g
attgacttttaaacacatgtttggccacactagctctactatcatattcttttgataatatgacaaacttnatcaaatttaaagaaatttgactaaaaaat

SEQ ID NO: 4835 - DNA, 101 bp, rice(Oryza sativa)
  misc_feature (71): n=a or g
agtagtaaactgctaactagttgccatgttgccctaattaagcggcaaaggttgttacgcgtacagatagnagatttggacttaattaagttctgacagag

SEQ ID NO: 4836 - DNA, 101 bp, rice(Oryza sativa)
  misc_feature (71): n=a or g
gcgctccgaccatcggcggcggggtggtattgaaatctagagagctgaaaaatccgcggaagacgaggatngccggcggcgggccaaggaagaaggcggag

SEQ ID NO: 4837 - DNA, 101 bp, rice(Oryza sativa)
  misc_feature (71): n=a or g
gcattggcacactaggagatggttaggtgagcaaggagttggcagcagctataggtgagatgaagatgagnattgagtaccatgtttaagtgctgtaagaa

SEQ ID NO: 4838 - DNA, 101 bp, rice(Oryza sativa)
  misc_feature (71): n=t or g
aaaaaacggaggtagtagttaatttttccaccgtatctggttagggacaactttgttccgtcatggtttanggttcccctgaaacagagaactttcaaagg

SEQ ID NO: 4839 - DNA, 101 bp, rice(Oryza sativa)
  misc_feature (71): n=t or c
ccgggaggaggaacctggccgagatttcattagaaagaaagaaagaaaagtaaattgcatcgtcggtacangaacttgtcaggtgggtataatctagtgca

SEQ ID NO: 4840 - DNA, 101 bp, rice(Oryza sativa)
  misc_feature (71): n=t or g
ttgatttttcagacggagctcgattagtagcatttccacgtaacttgccgacaatactacggaaagatgtnaaattatgtttttcagggaattaaggaaag

SEQ ID NO: 4841 - DNA, 101 bp, rice(Oryza sativa)
  misc_feature (71): n=a or c
agtaatatattatgggtattatttagtatgttgggtccggcgtccctccttttttttttgactcacatganataaacccaaattaataatttcaactcata

SEQ ID NO: 4842 - DNA, 101 bp, rice(Oryza sativa)
  misc_feature (71): n=a or g
tattataagtttgtagtaggggaaaaatcaattttcatatagactttaactcttcttatgcctaagaaacnagagagctttactacccggccaaaagcttg

SEQ ID NO: 4843 - DNA, 101 bp, rice(Oryza sativa)
  misc_feature (71): n=t or c
tttctttcttagagcactttagtatgaaattcatgatgtcgatatttattcaacgaaataggcgtaaccangtttcttaaatgcaagactgtcaaaaacat

SEQ ID NO: 4844 - DNA, 101 bp, rice(Oryza sativa)
  misc_feature (71): n=a or g
tttggtatataaatttatacatgcaaaataattggtatacaacttcatatagagatataataaaaataggnaaaaaaagcatgaatgcgtattttgggccg

SEQ ID NO: 4845 - DNA, 101 bp, rice(Oryza sativa)
  misc_feature (71): n=t or g
tcttcctccgcgccaccagcgccaggcacgcaccttgcgctgcgtactggtaggccagttcctgcacaatnacaagagcagctagccacgttaagcaccac

SEQ ID NO: 4846 - DNA, 101 bp, rice(Oryza sativa)
  misc_feature (71): n=a or g
atcaatcaattttattacaggattgaatccgaaaggctaaaaatgcaacgtatgtacgtatgtgcggctcncaaacccttcctgcattgcagtaggtacgc

SEQ ID NO: 4847 - DNA, 101 bp, rice(Oryza sativa)
  misc_feature (71): n=a or g
ttggttgtttaagctggacatacaagttacgattgctgagtgctgacaaactttatagtgtttttcacgtnctctgtcccataaaaaacaaatctagtata

SEQ ID NO: 4848 - DNA, 101 bp, rice(Oryza sativa)
  misc_feature (71): n=t or c
gaagcagaagatgtttttatggatgaagatgatgacatgatcatgtcagacactgtggcaaaagatgacangagtgggctggccgtggtcaaagaggaaac

SEQ ID NO: 4849 - DNA, 101 bp, rice(Oryza sativa)
  misc_feature (71): n=t or c
taaagacaggcagaaaaatgaacattatatcacatcaatccaataaacacagcatgttagcagtaacacanatatgtatggtgaacttacttgtcatcata

SEQ ID NO: 4850 - DNA, 101 bp, rice(Oryza sativa)
  misc_feature (71): n=t or g
atttcttgtttatgtaatggaagcataggtttggtttgtacagaacacgatcaaatatactgaaataaatnccatcttgttacacctttgatctttgttca

SEQ ID NO: 4851 - DNA, 101 bp, rice(Oryza sativa)
  misc_feature (71): n=a or c
tcttgtccctcccgcggctcttctccttgtccctgtccttccgctccctctccttgtcccgctctgcctcncccctatcccggtccttgcctcgatcacgg

SEQ ID NO: 4852 - DNA, 101 bp, rice(Oryza sativa)
  misc_feature (71): n=t or c
gaggaaccacaagtgaacttagtccttaaggaaaaggcctggacatatcacggcccgaaaagagagctggncggcatatcgattcgtttttgcttgggccg

SEQ ID NO: 4853 - DNA, 101 bp, rice(Oryza sativa)
  misc_feature (71): n=a or c
aaggggacagtgacaagaaaaacgcacatgttgatggcgaaaaaaggtcctagaaaaaccaggcctgtagncgagaaaggaggcaccaggggcgaagctat

SEQ ID NO: 4854 - DNA, 101 bp, rice(Oryza sativa)
  misc_feature (71): n=t or c
cttgcaggtgtcagctagcaacgggcggcgcggtttattatgctactactagtaagtgtaaagctcaaacntggtagctataaacttgaattgagacgata

SEQ ID NO: 4855 - DNA, 101 bp, rice(Oryza sativa)
  misc_feature (71): n=t or c
ctacccactccctatggcggcgtgtttccgggtgctaccgtgggttgcacatcacatgcttaatgtgtggnggcgttattctacttcaacaacttgactat

SEQ ID NO: 4856 - DNA, 101 bp, rice(Oryza sativa)
  misc_feature (71): n=a or g
tgtaaattgactccttcggtggttttaaaagcggtttctattgacgtggcaagcagggccccacatgtcangcacctctcttccatcaaccaaaccaccac

SEQ ID NO: 4857 - DNA, 101 bp, rice(Oryza sativa)
  misc_feature (71): n=t or c
gtgcatgcatttaatatgaaccaccagttggcatgtaggtcttctgtttttagcatttttcagtgcgattntaccgtgtgtttggttctgggactagatgg

SEQ ID NO: 4858 - DNA, 101 bp, rice(Oryza sativa)
  misc_feature (71): n=a or g
aaatagagggggtatgaatacttttatagggggcaaaaatagatggattaggtgggacctactgggactcngattgggagagggggagagaggcggttcgg

SEQ ID NO: 4859 - DNA, 101 bp, rice(Oryza sativa)
  misc_feature (71): n=t or c
acgacggatccggagatcccctgcgtcggatccaatgtagcaacggggctcacgctgtgcgcccatcccangtgggacaagttcgtccgctcgaatttgtc

SEQ ID NO: 4860 - DNA, 101 bp, rice(Oryza sativa)
  misc_feature (71): n=a or g
aaaagtaaaggaggtaaattacgtgtcaatgacaatgagagtttacagaggtattgtaggatcgtaaatgncatttcccaccccaaaaactagctattgat

SEQ ID NO: 4861 - DNA, 101 bp, rice(Oryza sativa)
  misc_feature (71): n=a or c
tctcaagttaaatttgggaattactgatatgatcagtgtactgtttggtttctactttagacaagttagantgtgcttctccaagctgctatttgttttgg

SEQ ID NO: 4862 - DNA, 101 bp, rice(Oryza sativa)
  misc_feature (71): n=a or c
attcagattaaaaaatattgaatgtggactaaaaaaatttcatgttatgtacgtctccaattgtactgtanctaatatttctccctgggtctctgggatat

SEQ ID NO: 4863 - DNA, 101 bp, rice(Oryza sativa)
  misc_feature (71): n=t or c
atgctcatcgtatctcacttttttgtcagctgtttagcttttatttagaaactgggaaagattgttatttngtatcctttaattgaaagatgtggtgccag

SEQ ID NO: 4864 - DNA, 101 bp, rice(Oryza sativa)
  misc_feature (71): n=a or g
accatcaatgttatacgagtatgttagtaaagaattatacaaatgtattgttatgaaaaaaattcgtgacnaatataatggcaccatttgcatgtgaataa

SEQ ID NO: 4865 - DNA, 101 bp, rice(Oryza sativa)
  misc_feature (71): n=a or g
taagagttttcacaatttaaattggctagcattcgagtttatcttaggatgggaagaaaatgaattaaacngtttcattcatattttctattcaattattg

SEQ ID NO: 4866 - DNA, 101 bp, rice(Oryza sativa)
  misc_feature (71): n=t or c
acacaacattaatgtactaccactacagtagcatcaaaaccgataactaacagttaactcatggcaacagncaataacatataagagtgtgcatgatatat

SEQ ID NO: 4867 - DNA, 101 bp, rice(Oryza sativa)
  misc_feature (71): n=a or g
caaaacaatatttatttgtcttatctaggttatagctttctctgatctctctataattaattttgtgtgtnatcaatggtgatgcagggagggaggtggtg

SEQ ID NO: 4868 - DNA, 101 bp, rice(Oryza sativa)
  misc_feature (71): n=t or c
atcagggtcagtcatcacctgaattaagcacacaagtacaaaggatcaattagcacataatggacacatanatattacagtatagatgtgcgatagtctga

SEQ ID NO: 4869 - DNA, 101 bp, rice(Oryza sativa)
  misc_feature (71): n=t or c
gataatcttgagatagatatacggccatgtcgagggtgctggagcctctcattgtggggaaggtgatcggngaggtgctggacaacttcaaccccacggtg

SEQ ID NO: 4870 - DNA, 101 bp, rice(Oryza sativa)
  misc_feature (71): n=a or g
tcaagttcgagctggagagcatgaaggccaagtacctggagctccagcacgagatggacgcgctccagaancaggtggacggccgcggcggcggcgcgccg

SEQ ID NO: 4871 - DNA, 101 bp, rice(Oryza sativa)
  misc_feature (71): n=a or g
ttttcaaaataattaactgtagccattatagttttatcgtggatacaccatattttcaaactaatggtctntttacttcatagccacacttttgacagcca

SEQ ID NO: 4872 - DNA, 101 bp, rice(Oryza sativa)
  misc_feature (71): n=t or g
aaaattaatcctgatgcaatttatccctaccaaaataaattggattaattaggattcgacaagcatccttncaagcacaggccccatgaaagctcaggata

SEQ ID NO: 4873 - DNA, 101 bp, rice(Oryza sativa)
  misc_feature (71): n=a or g
gagatagcaaaaagagaagccattgctataaggagacggtaccgcggtatcatatcttatccgtcgatccntcgattacacatgatttatcaactaaaaag

SEQ ID NO: 4874 - DNA, 101 bp, rice(Oryza sativa)
  misc_feature (71): n=t or c
tgtcaacagtgacatccccagcgatctgctcgtcaaagtgggagacgtgaacttctaccttcacaaggtanacaagttgggtcgcaaataaaatcctgaga

SEQ ID NO: 4875 - DNA, 101 bp, rice(Oryza sativa)
  misc_feature (71): n=t or c
gatcgatctggaatcccgtgtgctcgcaagatgcaagatcgatcaccggctcaccaccacactgtctcggngtagtagctcggactgccgctgcgctgctc

SEQ ID NO: 4876 - DNA, 101 bp, rice(Oryza sativa)
  misc_feature (71): n=t or g
attttcaattgtgaaatttaggagtatctagctagctctcggtacatccactactaaaacatacaaaaatntagtttaaaagttttggtacctcttggtat

SEQ ID NO: 4877 - DNA, 101 bp, rice(Oryza sativa)
  misc_feature (71): n=a or g
caatcgaagtaataataatagattattgtcaacttaactgtactagatcgagctttgtgattactactacnaaaatagattgctatatatgggcatgttca

SEQ ID NO: 4878 - DNA, 101 bp, rice(Oryza sativa)
  misc_feature (71): n=a or g
cccggttgggctcgaagatgttcgccgcggctaagaagtaggctctcagcacgctctgttcggtcacgccntgcgcttgcagattgttcctgatgtaccac

SEQ ID NO: 4879 - DNA, 101 bp, rice(Oryza sativa)
  misc_feature (71): n=t or c
actgcagtggaagcagtggctcatgtcatggacaaacgagagccaaggatcaactggtggggataccgcantgctgctagttcgcacaatcgagatctgct

SEQ ID NO: 4880 - DNA, 101 bp, rice(Oryza sativa)
  misc_feature (71): n=t or g
caggaatcgtgggggggcgggttaatagatggcgatggacgaaggaagcggaaaatgtgggaaacggacgngaggcaacggatagataggggtagggcggt

SEQ ID NO: 4881 - DNA, 101 bp, rice(Oryza sativa)
  misc_feature (71): n=t or c
ttccaaaaggcttcgtttccccagacggaaaagctttgtttgcaggtcttacaggatgtgaacagaatcangggcggctgccctgagtcctaatgttacaa

SEQ ID NO: 4882 - DNA, 101 bp, rice(Oryza sativa)
  misc_feature (71): n=t or c
ccttatgggtttaggccgcaaagcaagccaggtttgtcccattcatctgcagttgctggtagatataattnattatttttctgcgctttggatgttgttgg

SEQ ID NO: 4883 - DNA, 101 bp, rice(Oryza sativa)
  misc_feature (71): n=t or c
aacgcaaactaatatgtatttaagaggtgcaaaatgtggcaacactgaaaagttatgaacaagtgtagctnctttgaaacaaataaagtttagcttgcaac

SEQ ID NO: 4884 - DNA, 101 bp, rice(Oryza sativa)
  misc_feature (71): n=a or g
gagccttccttgatgtgctcccattacgagatgatgatgtgggccttcttttatctaaatcaacagcctancacgcatggtaaaattgacataagccttcc

SEQ ID NO: 4885 - DNA, 101 bp, rice(Oryza sativa)
  misc_feature (71): n=t or c
tttttctttttctcaaattttgtgcaagtcttacaaaacctcaccacatttcacaaacaatcttttttttnccttttttctggtgctgcgcaatcatccaa

SEQ ID NO: 4886 - DNA, 101 bp, rice(Oryza sativa)
  misc_feature (71): n=a or g
acggacgccgattctgacaagagatcgaccttgttttgttcgtgtcgtggtattgctgactactactttgnaatgattaatctcctactactaattactcc

SEQ ID NO: 4887 - DNA, 101 bp, rice(Oryza sativa)
  misc_feature (71): n=t or c
agtcgtcgcggaacccgacgccgaggggttcaagcttcaaccacaccgacttctactccatggtgggccgnagctccaacttcggcgcggccgacgcgttc

SEQ ID NO: 4888 - DNA, 101 bp, rice(Oryza sativa)
  misc_feature (71): n=t or c
tgaggttgctcggccgcggcgtggtgctggagaagcccatggagcggcgggagtagatgtccgagcgagangcgttggagcggcgcacggtgacgtgtatc

SEQ ID NO: 4889 - DNA, 101 bp, rice(Oryza sativa)
  misc_feature (71): n=a or g
gaggaggcggcggaggaggagcatttgattgggtgtgtgcgcgtgcgagtaggatcggtcgatgggtagcncggttttatttaggcgagatggcagcgcgg

SEQ ID NO: 4890 - DNA, 101 bp, rice(Oryza sativa)
  misc_feature (71): n=t or c
ataaaggcaagcaaacaagggatggtccaaaccgagctcgggccgcgctgccatctcgcctaaataaaacngcgctacccatcgaccgatcctactcgcac

SEQ ID NO: 4891 - DNA, 101 bp, rice(Oryza sativa)
  misc_feature (71): n=t or c
agcgtgcacgcattagctcccccccagctcaatcgatctcgaatcaatcaagcaaccagagaaagacaganaaagctctgaaagtctgaagaattaatcat

SEQ ID NO: 4892 - DNA, 101 bp, rice(Oryza sativa)
  misc_feature (71): n=a or g
tttttgattgatgtgagcttaattaatctggtgatcgatcgatcacatgctactgcccaacgtgttgtctngctgtactattgtttgtgtgttgctgatat

SEQ ID NO: 4893 - DNA, 101 bp, rice(Oryza sativa)
  misc_feature (71): n=t or g
gtatcgctacggacacttgtccctgctagctttacgtgcagtggcaacaaaaaagcctcgaccacgatcanactcttgtcttctactagcagcagcagcag

SEQ ID NO: 4894 - DNA, 101 bp, rice(Oryza sativa)
  misc_feature (71): n=a or c
gcactatagcagatagcggcaactagcttagccccggattcggtgccgatcgatcggacgacggcgccacnggcgatcgatttccggcggatccctatcga

SEQ ID NO: 4895 - DNA, 101 bp, rice(Oryza sativa)
  misc_feature (71): n=t or g
tccctacatttattaatttggttactgatcgatcaaagataatgttgattagccaggttagtttgactttncccccccccccctctcacttgtcaggagtc

SEQ ID NO: 4896 - DNA, 101 bp, rice(Oryza sativa)
  misc_feature (71): n=a or c
ttttttttttttgaccgaatcaacgcacccgttccatgtgttcctccaaatatcaacaatcccgatcgacnaaatcggacacacacaaaaaaagggcccaa

SEQ ID NO: 4897 - DNA, 101 bp, rice(Oryza sativa)
  misc_feature (71): n=a or g
aacaactaatcgcttcattgaggacaaatccctcaagacactactctgtaatgcataaaagagagccacanagaaaataatcagtctcagattttccttct

SEQ ID NO: 4898 - DNA, 101 bp, rice(Oryza sativa)
  misc_feature (71): n=a or g
tacttaaaagtaatgtgtcgcacataacctagcacatattctctaaatgggaaagcgcggatttgcgaaanacttgtgaagttataccttcaagagaaacc

SEQ ID NO: 4899 - DNA, 101 bp, rice(Oryza sativa)
  misc_feature (71): n=t or c
atttcagtttgttatcatgagtaacaaattaaagggcgagtatatcataaacaaactcatattgtacagcngcaaacaagactgaacagcacgatgtaaat

SEQ ID NO: 4900 - DNA, 101 bp, rice(Oryza sativa)
  misc_feature (71): n=t or c
gaactaaacaaattcatatgtagaagagtaaaggaagtatcaggttatcttatctgagataatctacattnatcgaagaaatgaaaaatgatgtacttaaa

SEQ ID NO: 4901 - DNA, 101 bp, rice(Oryza sativa)
  misc_feature (71): n=a or g
aaaagaaaacagtaagaaaatcagatattatggcatccaaatgtagaagaaaggatcaatacattgtccanctgtagaacaaataatcaagacaaatgtta

SEQ ID NO: 4902 - DNA, 101 bp, rice(Oryza sativa)
  misc_feature (71): n=a or g
tcaatccctcaagctcctcacctctcatttgtctacaatttgttcatgtaccaatgatatacatttgagantaaatgcctcaagaataaaggatctgagaa

SEQ ID NO: 4903 - DNA, 101 bp, rice(Oryza sativa)
  misc_feature (71): n=a or g
ttgtatacatggatacaaattgtgtgtcgtgtttttctgggtattgtttgagaccgagctatggccttttnctaattcttattttcttataaatccagata

SEQ ID NO: 4904 - DNA, 101 bp, rice(Oryza sativa)
  misc_feature (71): n=t or g
ctgtcatggcgagtgattgcgtaatagagtagagtttcaatcatctagaatttacttacagtttgcgtttnattacccttctactgctactgctagtattt

SEQ ID NO: 4905 - DNA, 101 bp, rice(Oryza sativa)
  misc_feature (71): n=a or g
tgaaactggtacttggtaactctggtccttcagccaagaccaaaaagaagttagagaaagatactggaagncttatggctaaaattacttgagtcatgaat

SEQ ID NO: 4906 - DNA, 101 bp, rice(Oryza sativa)
  misc_feature (71): n=a or g
tgttttgcctgtttgcgcagggggttgttagagctatcaggtctgtcaatagtaggcctgctgcaatgcanatgatggcagtatgtaaattcatgactcaa

SEQ ID NO: 4907 - DNA, 101 bp, rice(Oryza sativa)
  misc_feature (71): n=t or c
tagaaagttcaattgaaatcattctttatctggactccaaatcactaagttgttgtactgccatagtattntctcatcagtataactgacagatgggtata

SEQ ID NO: 4908 - DNA, 101 bp, rice(Oryza sativa)
  misc_feature (71): n=t or c
gcggagaacagggacccaccagaaagcaagcagagcaggaagaaattcaaatttgcgaatattctctctcnctccccggcgaaggcgacggcgaaggagaa

SEQ ID NO: 4909 - DNA, 101 bp, rice(Oryza sativa)
  misc_feature (71): n=t or c
gtatatatgacaaattgacaagcgatcactgatcagcccgtgcgattttgtgtttttggttgtggtgcacnggacgcagcttcgtgcatggattttataga

SEQ ID NO: 4910 - DNA, 101 bp, rice(Oryza sativa)
  misc_feature (71): n=t or c
taaacaacatgtgcaccctactattatgagcacatccgagagattgtgccgacacgtaccatgagatcaangagattattaccacatgcacttagttatgg

SEQ ID NO: 4911 - DNA, 101 bp, rice(Oryza sativa)
  misc_feature (71): n=t or g
acgtactgcgtgtgttctatgcatgcatatactttattttaaaataaatcaaattatatactccctccagnttaataatacttgtcgttttgaacaagtgc

SEQ ID NO: 4912 - DNA, 101 bp, rice(Oryza sativa)
  misc_feature (71): n=a or g
actatagttgtcagtaatagtaaggggctgaacgtccttcggaaaaaaaaaaggcctgatagcccatttcnaatacagctcaatcgaacttaaatgggttc

SEQ ID NO: 4913 - DNA, 101 bp, rice(Oryza sativa)
  misc_feature (71): n=t or g
tattactttttctgaccctacgtatagtcatcgggcaataagctaaccccaaaaaattctatatttaaaanacatatcttatctactactactttaaaata

SEQ ID NO: 4914 - DNA, 101 bp, rice(Oryza sativa)
  misc_feature (71): n=a or c
accgcacgacccactcgtccgactccaccttcgctctcgagctccgaaatctagatcccccaccccgaggnggatccgccatcacctgcccaccgccgcca

SEQ ID NO: 4915 - DNA, 101 bp, rice(Oryza sativa)
  misc_feature (71): n=a or g
tttagtggctctagctggattgcgactttctataggtgaaatatccacgcaaagagaaatatttaatagcntcattgttagtttttttcaatttcagtctg

SEQ ID NO: 4916 - DNA, 101 bp, rice(Oryza sativa)
  misc_feature (71): n=a or c
gcttgctactggtcttttactagccacactagaggcttggatcccattcatcttgagctgttccggtgcantgatggccgtgttttcacgtgaaaattaga

SEQ ID NO: 4917 - DNA, 101 bp, rice(Oryza sativa)
  misc_feature (71): n=t or g
aaatattatcgttcaagtttccataaaaaactaaaagctaaaagttgagaaatcaaacttttgtagattcntaaaagccggctaccaaccaattgcttctt

SEQ ID NO: 4918 - DNA, 101 bp, rice(Oryza sativa)
  misc_feature (71): n=t or c
tgatctgttccagcttttctttctggttgtttttgtacttttgaatcatgaatttgtgatgctcgcctcangagtgacggttccatgaaattcagcgatgt

SEQ ID NO: 4919 - DNA, 101 bp, rice(Oryza sativa)
  misc_feature (71): n=t or g
ttctattgcatctaccttcattgttgccatgaaaaagaagcgagaatattgagaaaacaagggtttcgganaattgaaatccgacctccacctccacgaat

SEQ ID NO: 4920 - DNA, 101 bp, rice(Oryza sativa)
  misc_feature (71): n=a or g
gctacagttgagcccatcagaagacgaagaggacgagtgtctcaggtccaggagtggccgctcccagctcnagccaaccgagccaggaaagcctgagaagg

SEQ ID NO: 4921 - DNA, 101 bp, rice(Oryza sativa)
  misc_feature (71): n=t or c
tctcatacccgccagatgactacctgcctacggaagaggacacagaccagatgtttgttcggtctctcagntctgacaatctcagcaccattgagaccttt

SEQ ID NO: 4922 - DNA, 101 bp, rice(Oryza sativa)
  misc_feature (71): n=a or g
ataccaagcaaaagcacgatacctagtggaaccagaatttcagtttcgatgttactgtcagaatttgatgntgccgtggctgttgtgtttggccagatgta

SEQ ID NO: 4923 - DNA, 101 bp, rice(Oryza sativa)
  misc_feature (71): n=t or c
aaagctaaagaaacaaggtaccatttgccaagttgcttaggataagccctaaactaaagcgcccagtctangctaatcaagtgatcaaactttcataaaaa

SEQ ID NO: 4924 - DNA, 101 bp, rice(Oryza sativa)
  misc_feature (71): n=a or g
caaggtagcatggctagctgtgcacgtacactaatgaaatatcataaagattataattatattagtaggantttaattggaattaatagcttgccagtgga

SEQ ID NO: 4925 - DNA, 101 bp, rice(Oryza sativa)
  misc_feature (71): n=a or g
gttaagttgctgatatgcttgtatatttcagggaatgtggtccttgatgagaacatggtgagtacagatcngagcagatttctgaagaaccccatgtggat

SEQ ID NO: 4926 - DNA, 101 bp, rice(Oryza sativa)
  misc_feature (71): n=t or c
ctctgaagaacagcactaaacaagaccacaagttaaaaagatgaccagctctgagctgactccgagagagngacaaacaagttgcctgaaactgaaccctt

SEQ ID NO: 4927 - DNA, 101 bp, rice(Oryza sativa)
  misc_feature (71): n=t or c
gctgagtagtatagtacatcgttttccccgatatatcactccttttgacttgctgagagaataatctgtgngtacctctttaaaaagatactacttttatc

SEQ ID NO: 4928 - DNA, 101 bp, rice(Oryza sativa)
  misc_feature (71): n=t or c
caaggttcagaaagtggatactacacaaaagtactaattgtgtgtgaaatacacaaacccatacttagtcnagacattcaaaaacaaataaaacaaaaatg

SEQ ID NO: 4929 - DNA, 101 bp, rice(Oryza sativa)
  misc_feature (71): n=t or c
tttacccctatgatgtatttgtcaaattattattttttaccatattcctcttcttcctttctcctctcctntcttcccgttggtggagcggtgggtggtgt

SEQ ID NO: 4930 - DNA, 101 bp, rice(Oryza sativa)
  misc_feature (71): n=a or g
atatggttctaattaaccctatagttctattgtcaatgaattttacagtactctataagtacatgaaattntgtacaactatcaatgaatatcttgtagat

SEQ ID NO: 4931 - DNA, 101 bp, rice(Oryza sativa)
  misc_feature (71): n=t or c
ttctctgaaatggatcgaacaatgatcgcaagtagaacctcgttgtgcaatcttttcagtgctgcgtcacngtccttcgccttgatcagcacgtagatctt

SEQ ID NO: 4932 - DNA, 101 bp, rice(Oryza sativa)
  misc_feature (71): n=t or c
atattcacggacaattccatgatcttgtagaactttttcggatcggtgggaaggtactatttgcatttacntttgctaccatactttgaaatcttcctttc

SEQ ID NO: 4933 - DNA, 101 bp, rice(Oryza sativa)
  misc_feature (71): n=t or c
acatgccacagcagcccacgtactccgtttcctctccagtccgtccatccatccacaaacggctgacatgngggccccacccccacccccttgttgtccag

SEQ ID NO: 4934 - DNA, 101 bp, rice(Oryza sativa)
  misc_feature (71): n=t or c
ctgcactacagcaagggctaccaccctgaatgactggcttcttctgttgaagcttggaaaattgttttgcnctgatataagtgattttaatattttattgg

SEQ ID NO: 4935 - DNA, 101 bp, rice(Oryza sativa)
  misc_feature (71): n=t or g
tatctttctgtccaggcactagcaaaatagtgtgacgattgcattgcatgatgtttatctttcttatatanctagcaaaatacccatgcgttagcaacaga

SEQ ID NO: 4936 - DNA, 101 bp, rice(Oryza sativa)
  misc_feature (71): n=t or c
atgagatttttccggtaccggagagattgagtaggaacgagatcgctagatgttcattcaggcaacagacnatctctttgctggagttctggcacccattt

SEQ ID NO: 4937 - DNA, 101 bp, rice(Oryza sativa)
  misc_feature (71): n=t or c
attgacgtcatctcctgaaaatgatcttcaaacggccaatcgatttctccataatttgccatgtgctggangtgatgatattatctgtactatctttcctg

SEQ ID NO: 4938 - DNA, 101 bp, rice(Oryza sativa)
  misc_feature (71): n=a or g
tattcgaactaattcatccacaatcttaaggccacgttcatggcgtcctttattatggttagagaacccancaaaggaatagcatttctccatgcgaggat

SEQ ID NO: 4939 - DNA, 101 bp, rice(Oryza sativa)
  misc_feature (71): n=a or c
caaaattgaaaagtggaattgggtgatttttgcgtccttttcgttagtttcctattcttttacggcaaacnaatcgcgctttcagacttcagaccgcatac

SEQ ID NO: 4940 - DNA, 101 bp, rice(Oryza sativa)
  misc_feature (71): n=a or g
tcttgttgttctttaccatgacgagggcgtttgcagctccgatgaccatagcgagagggtacataaggttntgcatctgactcgggaggacgaagacggcg

SEQ ID NO: 4941 - DNA, 101 bp, rice(Oryza sativa)
  misc_feature (71): n=t or g
gtttgaaacaagttactgtgtttttcccactgaaacttcactcaaaactgaatcttttgctgttttccacngaaacctcactcgaaactgaatctttgata

SEQ ID NO: 4942 - DNA, 101 bp, rice(Oryza sativa)
  misc_feature (71): n=t or c
ccgcgacacgcaacgtcaaaggggtcgagccgaaacgcctagaaccctcttcatcatccaaattccaagtngcccaacccaaaaaagcttctactcgcgct

SEQ ID NO: 4943 - DNA, 101 bp, rice(Oryza sativa)
  misc_feature (71): n=t or g
gtaaaaactaaaacccctaaatcgatcgaagattttttttcttttactccttaataatcgatcaagaacgnatacgatccacgaaaagagggtgaggatcc

SEQ ID NO: 4944 - DNA, 101 bp, rice(Oryza sativa)
  misc_feature (71): n=a or g
aacgagtgtaacccggtacataagtactactactatgatcaattgccaaccacaaattggtactatgaagncccatgtccaccaaatttcttaccgatgat

SEQ ID NO: 4945 - DNA, 101 bp, rice(Oryza sativa)
  misc_feature (71): n=t or c
atggcagtcactacaccaaattgtttggagctcatctgatcatcagcaattcagcatgatggcaacataantgtattgttcatcaagcctcaagaaaagat

SEQ ID NO: 4946 - DNA, 101 bp, rice(Oryza sativa)
  misc_feature (71): n=t or c
cttctcctacagattcaacactgacatccccatgaccgagactccaggggtaggtttcttgcctgatgcangtagcatgtaagatttgggagatgatcagt

SEQ ID NO: 4947 - DNA, 101 bp, rice(Oryza sativa)
  misc_feature (71): n=t or c
gagctagtcggaagattcctttatgtttctagaggtttatttgatgatctgcatagaatgggcacaaagantgcatctatggtttaggagatctgaagtaa

SEQ ID NO: 4948 - DNA, 101 bp, rice(Oryza sativa)
  misc_feature (71): n=a or g
aaatttaagtaatgaagaatccaggattggttgacgatttactcaaagtttagagcaagttcaatagtatngcccactgctagctccaatttatctatagc

SEQ ID NO: 4949 - DNA, 101 bp, rice(Oryza sativa)
  misc_feature (71): n=t or c
gaactggaaacagagatgctctctttcttcttcccagtgtagcagatttcacctttcaacaagctccttgngttggaattcagctctgaagcaccattagc

SEQ ID NO: 4950 - DNA, 101 bp, rice(Oryza sativa)
  misc_feature (71): n=a or g
atgtcgcttggttttaggttcgcaaattgcatctcagcaagaaaatcaagtgcctgatcgaattctttcancatacatagcctgtacacaacagagtcgta

SEQ ID NO: 4951 - DNA, 101 bp, rice(Oryza sativa)
  misc_feature (71): n=a or c
agaacccagcttgctgcatgtcatgcagaagtgttgcagccttctgtagattgttactcctgcaacagttntcaaaaacaactctatacatgtgataggat

SEQ ID NO: 4952 - DNA, 101 bp, rice(Oryza sativa)
  misc_feature (71): n=t or g
tctcatggagttctgtcagttccactggtgtctacagttcaacttgacaatcgtcagttcaccactttctngaaaaccagacatcagcattgcttatatct

SEQ ID NO: 4953 - DNA, 101 bp, rice(Oryza sativa)
  misc_feature (71): n=a or g
catggatggaggtgtgggtgctgtcgtgcccaacaatgaataggcatcaattttatgatgcaaattgcacnatttggtgctttataatttggatgtatgtt

SEQ ID NO: 4954 - DNA, 101 bp, rice(Oryza sativa)
  misc_feature (71): n=a or c
ccccaatgaagactaaatggtgggaaaagaacatgaaatcctgcaacatgaaaaacattgaatcacaagangattttgacaagcagctcctgttggccagc

SEQ ID NO: 4955 - DNA, 101 bp, rice(Oryza sativa)
  misc_feature (71): n=t or c
tttaagcattactaaacatggttagcgaagcaaccaaatctcttaatattaaatgcacttgataaaacagngatcctgtttcaagaatagttgggctttga

SEQ ID NO: 4956 - DNA, 101 bp, rice(Oryza sativa)
  misc_feature (71): n=a or g
gtatttgctccaggtaccattttctggcctaataatgactaaatcaaagcccaactattcttgaaacaggntcgctgttttatcaagtgcatttaatatta

SEQ ID NO: 4957 - DNA, 101 bp, rice(Oryza sativa)
  misc_feature (71): n=a or c
aaaggatgcttcaactggttggcagatcaccaaagctgcaacagaaaattccaccaatgtaatttcttacnacattgcaattgagcatgcatatgaaactt

SEQ ID NO: 4958 - DNA, 101 bp, rice(Oryza sativa)
  misc_feature (71): n=a or g
cagcatacttcttttttcccacagaaaccagggactggtttcccatcaaccttccaaggttgacattgctncagaggttacaactaggacatcttttgagt

SEQ ID NO: 4959 - DNA, 101 bp, rice(Oryza sativa)
  misc_feature (71): n=a or g
gggtagtcaacttatggtgtaagtggaagatctataagtggaagggtggaaaaactcaaaagatgtcctanttgtaacctctgtagcaatgtcaaccttgg

SEQ ID NO: 4960 - DNA, 101 bp, rice(Oryza sativa)
  misc_feature (71): n=t or c
ttcttgggtaagaacaaaagcagtttgctttgttacaatttctgtgtattctgaagccaatactggcctgngcaatatgcctgcagaatattaattgtttt

SEQ ID NO: 4961 - DNA, 101 bp, rice(Oryza sativa)
  misc_feature (71): n=a or c
cttgcacaaacacagtgccatactcccattgtacaaatgatgtgcaaactgatgtttggatggattgaagntgtttcacatatttatagccacgatccacg

SEQ ID NO: 4962 - DNA, 101 bp, rice(Oryza sativa)
  misc_feature (71): n=a or g
cttctgatatcctttttagtacagatgcaaccctttcctgaactcaattatataaacaaggtaatgagtcntggatcgtggctataaatatgtgaaacatc

SEQ ID NO: 4963 - DNA, 101 bp, rice(Oryza sativa)
  misc_feature (71): n=t or g
aagaagcatttgagttcattgatacgatgaaatgtgagcctaattctgtcatttggagaacactactttcngcttgtagggttcatggtgagatcgaactg

SEQ ID NO: 4964 - DNA, 101 bp, rice(Oryza sativa)
  misc_feature (71): n=a or c
gctcacatttcatcgtatcaatgaactcaaatgcttcttttagtagcccagcacgacccagcatgtccacnatgcaaccgtagtgcttgatattgggttca

SEQ ID NO: 4965 - DNA, 101 bp, rice(Oryza sativa)
  misc_feature (71): n=t or c
tctgagccaagcatgcaaggccggcagagttgtagacatgcaggtaaccaactgaattccttgcctaatanctaaacatttcttgagaaaccaaattgttc

SEQ ID NO: 4966 - DNA, 101 bp, rice(Oryza sativa)
  misc_feature (71): n=t or g
gacaccatatgaatgagacaatcttaattcttggtcacacaaagattgtctcaaggttggtagcatcagtncccaatatatcacctaactatgccatccaa

SEQ ID NO: 4967 - DNA, 101 bp, rice(Oryza sativa)
  misc_feature (71): n=t or c
tttctcaaatctttgatagatggcttatttgtattgactggaaaagaaattagttgtcaataactagaagntttagagatgcaaagtattggatatatctt

SEQ ID NO: 4968 - DNA, 101 bp, rice(Oryza sativa)
  misc_feature (71): n=a or g
agttttgtgagttcttgcccaacaatggcgtcgctggcttcgaacctgcaccgatcgcattggcattcgangccccacgctctcgctgcctccctgcgctt

SEQ ID NO: 4969 - DNA, 101 bp, rice(Oryza sativa)
  misc_feature (71): n=t or c
ccgcgagctttcgaaaccgagccaaacaaacacctccgacattgccgccccgcggcgcaccaccaccactncccagccaaatctcacgccgccgcccagcc

SEQ ID NO: 4970 - DNA, 101 bp, rice(Oryza sativa)
  misc_feature (71): n=a or g
acctacatacggagtatttgttttttacaagatgaccattatgacgtctatattacggagtactactgtgngtgtgtgacagctcatagccgttgctactg

SEQ ID NO: 4971 - DNA, 101 bp, rice(Oryza sativa)
  misc_feature (71): n=a or c
actgcattttgccaaatcttactttgaatttgcaggaacctaggcactcacagttcagagagtttctgagntttggctttgtgttaatgaattgctgtttt

SEQ ID NO: 4972 - DNA, 101 bp, rice(Oryza sativa)
  misc_feature (71): n=a or g
acctgtgaggtatcaagtgatacttgagtatggtcatgttaaacctaggaggtatcatgtcccccttagtntcatgttcagtctcaccaggtttcataagt

SEQ ID NO: 4973 - DNA, 101 bp, rice(Oryza sativa)
  misc_feature (71): n=a or g
tcctatactacctactccccctccagcccctctcacagaggcccaatcgttcgtgctcccgggcataggcnccgccgtcgccggcggcatggacctcatgg

SEQ ID NO: 4974 - DNA, 101 bp, rice(Oryza sativa)
  misc_feature (71): n=t or c
tacaaacaaaagtgaaaacttaccactagtcttggcaacatctttcagtatacactctacaattaaagagntttttagacattgaaagaacaaactcagcc

SEQ ID NO: 4975 - DNA, 101 bp, rice(Oryza sativa)
  misc_feature (71): n=a or g
cataaatcgcagcgtgggggccagcgaatttcgtcgcgtttttgggttggggaggagtttttggttggttngttggtggcggctctgaggcgagccagcca

SEQ ID NO: 4976 - DNA, 101 bp, rice(Oryza sativa)
  misc_feature (71): n=a or c
gagccgccaccaactaaccaaccaaaaactcctccccaacccaaaaacgcgacgaaattcgctggcccccncgctgcgatttatgtggaccggctgcggct

SEQ ID NO: 4977 - DNA, 101 bp, rice(Oryza sativa)
  misc_feature (71): n=t or g
agagggaaatctggctccgcttcgcctcgttatctgctcgctgctgcacccaagccgcagccggtccacanaaatcgcagcgtgggggccagcgaatttcg

SEQ ID NO: 4978 - DNA, 101 bp, rice(Oryza sativa)
  misc_feature (71): n=a or g
gatggattgatgtccaaattctacttggtagtcgtatgaattttgttattattttcaatgtatcaatcctnatattagttgttaagtgtgatgggttgatg

SEQ ID NO: 4979 - DNA, 101 bp, rice(Oryza sativa)
  misc_feature (71): n=t or c
actactttttgccccagtaacaaacatatgctccgcactggagtattgggtaatgtgacagttgaaaatanagtactaccaaaatggtcagggggcaaaaa

SEQ ID NO: 4980 - DNA, 101 bp, rice(Oryza sativa)
  misc_feature (71): n=a or g
tgcatataagaggaaataccacactccattgctccctccgttttttcttatgtcgtttgttgtagtaggangcaaacaccatccccctattcaaccaaaac

SEQ ID NO: 4981 - DNA, 101 bp, rice(Oryza sativa)
  misc_feature (71): n=a or g
aacaaataaacatgctggaccctaaagatgtctggaatgtctcatgtgtggattcctcctgaccaccactngactaatcgccgccgctcgtacgaaagaca

SEQ ID NO: 4982 - DNA, 101 bp, rice(Oryza sativa)
  misc_feature (71): n=a or g
ccatgctactacattaccttatagtactattcacttaaacagtactcctttgggacaaagttttttgaagnaaatttgaaggaactcaattcagtggaaaa

SEQ ID NO: 4983 - DNA, 101 bp, rice(Oryza sativa)
  misc_feature (71): n=t or g
agccccacagaactttgcaatatccctcttgacattatcccagtgtgtcttcatttgcttgactgtccttntatgtgcatttctaggcatattgctgttga

SEQ ID NO: 4984 - DNA, 101 bp, rice(Oryza sativa)
  misc_feature (71): n=t or g
tgaacaatcgctgaaaaattccacacaaatggttaagttaggcggttagcatcacacattcagaatttcangctgaaactttataaaccaaaactgcaaag

SEQ ID NO: 4985 - DNA, 101 bp, rice(Oryza sativa)
  misc_feature (71): n=a or g
gcgatgcatatgccgagataaatgtattccaagatgccaagctcctcacggtcatgccatcaaacaaattncgtgcttcagtgaggctcccacacttggca

SEQ ID NO: 4986 - DNA, 101 bp, rice(Oryza sativa)
  misc_feature (71): n=a or c
tatgaagagtctgccaagacacaaaagcagctcaacaagaatatactcaatatagtgatcaattgataatntgcaatatggagtcccaattaacactcaga

SEQ ID NO: 4987 - DNA, 101 bp, rice(Oryza sativa)
  misc_feature (71): n=t or g
cggtagcatctagcgggcacgctatgtcgctatattgataaaacaaaaccccacatgtaactaagtcctantgatctgagcacagacagggtcccacgagc

SEQ ID NO: 4988 - DNA, 101 bp, rice(Oryza sativa)
  misc_feature (71): n=t or c
ttcatgccagagagaaaaaatctaactccagttgttggtctatatacgcttggattggatttctctattcnttttcttttcttttctttttgcggtttcga

SEQ ID NO: 4989 - DNA, 101 bp, rice(Oryza sativa)
  misc_feature (71): n=t or c
ttcctgtgttcaaacttaaaaaatgctgctgcttggaaggaaggtcagttaatttcattagtagttcatgntggtcattggctagaaaattttggtcgtaa

SEQ ID NO: 4990 - DNA, 101 bp, rice(Oryza sativa)
  misc_feature (71): n=a or g
aaccaaatttggttagaaaattcaaatacttttggattgaaatttccgtatctcggcaccccccgatacanaatgctgaaaacgaaatattaaaccctcca

SEQ ID NO: 4991 - DNA, 101 bp, rice(Oryza sativa)
  misc_feature (71): n=t or c
ccccatagtgttcttttagagcctataaatttcccatgcttcaagccgaaaagaaaatagctgtagcttcnctggaaagaaaaataaacctaaactctctc

SEQ ID NO: 4992 - DNA, 101 bp, rice(Oryza sativa)
  misc_feature (71): n=a or g
gaatgaaaagatttcaagaaatccaaccaaaaatctcgcgctctcctctcctcctcctccgcatgagctcntcggcgttggcgttggcctgtcgtctccgg

SEQ ID NO: 4993 - DNA, 101 bp, rice(Oryza sativa)
  misc_feature (71): n=a or g
tgaagaaacttgatgagtttttgggtgttaaatttgcaattttgttcagttggaaactataagcccacatngacagttttgtgttcaggttattgtaccag

SEQ ID NO: 4994 - DNA, 101 bp, rice(Oryza sativa)
  misc_feature (71): n=t or c
ctgacctttattcctatttgagcagccttctaatggtgtgagggcatgttaagtatgcaactatgcatgtngagaaatatctcatatatgatagaacgtga

SEQ ID NO: 4995 - DNA, 101 bp, rice(Oryza sativa)
  misc_feature (71): n=t or g
taacatatcaaacaattcaatattcagctgtaaaaaggtgtgacttacatattacttagtcaccttgtctngtttaaaggtggctagtacccaaaccgtta

SEQ ID NO: 4996 - DNA, 101 bp, rice(Oryza sativa)
  misc_feature (71): n=t or c
tttctttttttccctctcctatttggatttcatgtgagacttacaggtggggcccaccggataggatcgcngtggaggcatttcgtcgagcaggttgcatg

SEQ ID NO: 4997 - DNA, 101 bp, rice(Oryza sativa)
  misc_feature (71): n=t or c
aactaagtaaagtctgccacaggttggtggtgtcttagaaaaaatatgtatttgattatgctattgcttgnggaactggagaaattaattgtcaataagtg

SEQ ID NO: 4998 - DNA, 101 bp, rice(Oryza sativa)
  misc_feature (71): n=t or g
aatcctcattgaccgttagatgacatgacagtaaagtcgtgacttaattccaagaataataaaaaaaaganaatcaaatcaaaaccgggtaggctatcagg

SEQ ID NO: 4999 - DNA, 101 bp, rice(Oryza sativa)
  misc_feature (71): n=t or c
atgattatacaagttcggttctctagctgcataatatccccactcgtgtgattcattagagagactaactntcaagcatacggtaaattagggttggctcc

SEQ ID NO: 5000 - DNA, 101 bp, rice(Oryza sativa)
  misc_feature (71): n=a or g
caagccagcaatgaagctatcgctgttttaggcaaaggagcatggctgccgatcgccatcgccataaactntttttacgaggagaaatcatctaaagaacg

SEQ ID NO: 5001 - DNA, 101 bp, rice(Oryza sativa)
  misc_feature (71): n=t or c
tatataatgatgattatatcttctttacaaagacgatattggcaatggaaatagcgaattataaagcattngtagtttgattgaattgctgtccggttctt

SEQ ID NO: 5002 - DNA, 101 bp, rice(Oryza sativa)
  misc_feature (71): n=a or g
ccgtggtgaaactctcgggccgagtcatgtaatgttacggactcgtgagatttgcagggagcagaagaagnaggaggctcaagtgaccgggtccaccacga

SEQ ID NO: 5003 - DNA, 101 bp, rice(Oryza sativa)
  misc_feature (71): n=t or c
cggggtcgcgcgcatgtggacgtacatgttgatggagagttggagatgggggagccaaccaagtaaccaanagacgcggccacgcagcagggatgtaagcc

SEQ ID NO: 5004 - DNA, 101 bp, rice(Oryza sativa)
  misc_feature (71): n=t or g
attagaatattagatatatgaaaactgaaattggaattatgcaaaaaaaaaagtgagagatatgtacatgnagatttggacacggccgagttgttggcttg

SEQ ID NO: 5005 - DNA, 101 bp, rice(Oryza sativa)
  misc_feature (71): n=a or c
atactccttcaaaataagtatattttaacctatcacacacatacaaataaaaagtaaaaatactaggatancccactttattaaatcttaatacaaatatt

SEQ ID NO: 5006 - DNA, 101 bp, rice(Oryza sativa)
  misc_feature (71): n=a or c
atcgaatatctccaggccatcgataaaaagaggattgatgcgagcagtagctgcaatgccaaagagataanaaactgtcgatttcagaattccaagaaaat

SEQ ID NO: 5007 - DNA, 101 bp, rice(Oryza sativa)
  misc_feature (71): n=t or c
atcaactgctgagaaaacctgggaaaaatatccaattcacagtttgtcacctttcatagtgagataatccntttgactgagatcaataaagcttccattat

SEQ ID NO: 5008 - DNA, 101 bp, rice(Oryza sativa)
  misc_feature (71): n=t or c
atttcttgttgagatagcagacccatcaaaagtgaccagcaaaacaagtttatcatctgtcccttccacgnttaagagcaattcaagtcgctcgactttga

SEQ ID NO: 5009 - DNA, 101 bp, rice(Oryza sativa)
  misc_feature (71): n=t or c
atggtttttatgggagagaaaatgtttctatggaagtggagaacgagatagaaatagttagtttttagggntgtgtttagttcacgttaaaattgtaagtt

SEQ ID NO: 5010 - DNA, 101 bp, rice(Oryza sativa)
  misc_feature (71): n=t or g
agtactaaaacacaagaaagagatgagcaatgaccaaacaatcacgctgaaacctatgttagctggttaancaagagaaataagaagttgctccagtgagc

SEQ ID NO: 5011 - DNA, 101 bp, rice(Oryza sativa)
  misc_feature (71): n=a or g
gagttaaacaacaagaagccaactgtttatcggcaattgctgcaagaaagagagatgacaagcttaagaangttcttgcaagcagaattctgcaacctcca

SEQ ID NO: 5012 - DNA, 101 bp, rice(Oryza sativa)
  misc_feature (71): n=t or c
tcagattcgtcaagattgggaaaaaaatcaaaatatattcgacttttttcacagttcttcaataattagantcatcacgattaaaaaaaagaagaagaaga

SEQ ID NO: 5013 - DNA, 101 bp, rice(Oryza sativa)
  misc_feature (71): n=a or g
aggtgtggcgcacatgcgcgtgcagggcgatgtcgcctcacaattgtaagctgtgatgcgtctgagtcgcngatactacctggctgcagttggggcagggt

SEQ ID NO: 5014 - DNA, 101 bp, rice(Oryza sativa)
  misc_feature (71): n=t or c
aaccgtaactcaaacaaatggacttaccatgtgttgttgacatgatttcagtggtctcatccaaggttgtnaatatcccggttcgtatcctagtatcttac

SEQ ID NO: 5015 - DNA, 101 bp, rice(Oryza sativa)
  misc_feature (71): n=t or c
cttttgtgaaaatttaaaatatcagtattattgttcttctccaataagtaaaatttagtgtttttagattntaagggtggaaccagctaaaaaaatatgaa

SEQ ID NO: 5016 - DNA, 101 bp, rice(Oryza sativa)
  misc_feature (71): n=a or g
tcaagtacatcctcacaatctttacgtgtacatgcattgatccttttgcattatagcctcctctctcgttnattttatttaatcacgatacaaacacagac

SEQ ID NO: 5017 - DNA, 101 bp, rice(Oryza sativa)
  misc_feature (71): n=t or g
gtgaacaaaaatattgaaataaggactccatatgcagcgtaaatcttaagcgtttatttttatcctacganatatatatatatatatatattttacttttt

SEQ ID NO: 5018 - DNA, 101 bp, rice(Oryza sativa)
  misc_feature (71): n=t or c
accctacaatgcaatcaaggccatttagaaagaacagaaaagcatggacaccagcaatatttaaatttggnagctctgtctacatatcttgttggccccct

SEQ ID NO: 5019 - DNA, 101 bp, rice(Oryza sativa)
  misc_feature (71): n=a or g
tgccaggtgcaattatggtttacatgcatatgagatgagatgagaagaagtttggagcagcagcaagtatntgtaatagaaagccaagtacaatatatccc

SEQ ID NO: 5020 - DNA, 101 bp, rice(Oryza sativa)
  misc_feature (71): n=t or c
acaaggccatgtgccgggctggcctcccaacacaaaggccaactagtccccagggccaccatggttagcantagcagggggcaggggaaatggtgggcccc

SEQ ID NO: 5021 - DNA, 101 bp, rice(Oryza sativa)
  misc_feature (71): n=a or g
gatgtagtaataaatacaaacatcagagggagtacgaaagaagatgatgaatgtacacagttggcttgttnccttgttggtacggatccaattgttttgtt

SEQ ID NO: 5022 - DNA, 101 bp, rice(Oryza sativa)
  misc_feature (71): n=a or g
ctgttttctctgttattcctaagagtaatattacctctaatttcatgcataccatgtaatagtaaattaanaggtagcatgtattacaggttgtctctaac

SEQ ID NO: 5023 - DNA, 101 bp, rice(Oryza sativa)
  misc_feature (71): n=t or c
agtactgctcaacatctccaaatttggatagaagaatttatagctgaaattaactagaactccctccgtcncaaaaaaaggcaagccctgatttccgtgct

SEQ ID NO: 5024 - DNA, 101 bp, rice(Oryza sativa)
  misc_feature (71): n=a or g
gttttcgtggaacttctagattgctttatctttattacttttagatggtttatattcgtatatggatcagnactagacttgcgagaagttaaggtctataa

SEQ ID NO: 5025 - DNA, 101 bp, rice(Oryza sativa)
  misc_feature (71): n=a or c
gcggcggcggccggagcagcgccgccggaagtggtgagctttgtagttctcgtttgcaatggatcaaaggngccccctctttttttttacatagggtaatt

SEQ ID NO: 5026 - DNA, 101 bp, rice(Oryza sativa)
  misc_feature (71): n=a or c
atcagagtttgaagctgcattttctgtagcttctgatatgtgtaatgtagatcatactgtcataattcatnagctttcataaaaaatgtttgtgtacaagt

SEQ ID NO: 5027 - DNA, 101 bp, rice(Oryza sativa)
  misc_feature (71): n=t or g
tgattccgttttatctcagatatgacactcctttttttaaaattccattttacctcagatgctgtacagtnccataaaaaaatatacatctgctccaactc

SEQ ID NO: 5028 - DNA, 101 bp, rice(Oryza sativa)
  misc_feature (71): n=a or c
gcgtgtcgctaatccgatactaactccattaattccattttcatttcaataattgttgaagttattactgnactggaaataataaaggcaggggggtgtaa

SEQ ID NO: 5029 - DNA, 101 bp, rice(Oryza sativa)
  misc_feature (71): n=t or c
caccgactccggctccggcgacgacaccgacgcgctgttcgacgcgctgctgttcgccgaccagtacaacnacttcaacggcggcgcctacgagtccctgg

SEQ ID NO: 5030 - DNA, 101 bp, rice(Oryza sativa)
  misc_feature (71): n=a or g
gcccccctcccccctatttaacaccgcctcgtcgctctctccttcctcatcacaagctcacaagttcacancccaacacccaaaagcaaaagaaaagcagc

SEQ ID NO: 5031 - DNA, 101 bp, rice(Oryza sativa)
  misc_feature (71): n=a or g
ggagttggaactgaaagtatgggagaactcacccgagcctgagagatgtatcagagctgtagtcgttgtcnggtggaggtcgcgggtaagaagcattggtg

SEQ ID NO: 5032 - DNA, 101 bp, rice(Oryza sativa)
  misc_feature (71): n=a or g
accttagctagctctacaaacatccaactctgtctaactttgttttctatatatacattgatgaagcatgnaacagattattgaccggtacaactcgcatt

SEQ ID NO: 5033 - DNA, 101 bp, rice(Oryza sativa)
  misc_feature (71): n=t or c
cactcatcaccaaatgcaacataacactgttaaaagacaacacttgagtcttataagcacgatcttgagtnttattatacttgctcttatgtacgtactcc

SEQ ID NO: 5034 - DNA, 101 bp, rice(Oryza sativa)
  misc_feature (71): n=t or c
attacaaatctaatggtataactttgatgctaaatactaactagatttcttaaaaatattgttggtcaaanatagctaggcaactcaatgaaaactaacaa

SEQ ID NO: 5035 - DNA, 101 bp, rice(Oryza sativa)
  misc_feature (71): n=t or g
ttcttggaatatcgtactattgttagggctctttgtcgatcgatcagggtttcttttttcttctgaaattnccctaattgatttgccggtaagttacgttc

SEQ ID NO: 5036 - DNA, 101 bp, rice(Oryza sativa)
  misc_feature (71): n=t or c
ttaatttcatctctttgttgcatggcactgtccttaaggagaaaaagtagaggagaacagcatatctgtgnggaaggaatctagatggagcaagcaaataa

SEQ ID NO: 5037 - DNA, 101 bp, rice(Oryza sativa)
  misc_feature (71): n=a or g
aacatatacatatatgtagagagagatagagatatgataaaatcaatgcaaattggcaataactaggaccncattataattatatgcagagatctcagcta

SEQ ID NO: 5038 - DNA, 101 bp, rice(Oryza sativa)
  misc_feature (71): n=t or c
taatttggtggcaatagctcaattatcttgtaatgccggagggagtagcatttatacttagtgtttatatngaagaaattaaacataattgtatccaattg

SEQ ID NO: 5039 - DNA, 101 bp, rice(Oryza sativa)
  misc_feature (71): n=t or c
atattttattccctttggttaattacttcatcgatgatatatcgaagtacgggtctgtaaaaagattaatngatactctctccatctcaaaatataataat

SEQ ID NO: 5040 - DNA, 101 bp, rice(Oryza sativa)
  misc_feature (71): n=a or g
cttgcttacacatcaattactagtacaataatattaattacttgcaccgatggagatgcaagtgtctgatnatcagctctgcatttatgcagtgggcgaag

SEQ ID NO: 5041 - DNA, 101 bp, rice(Oryza sativa)
  misc_feature (71): n=t or c
ggcctggtgatggtgagcatgagggtgatgataccttcaccaaggaaaaattaaattaaagctatgaaaangatggagtatatatacataaattttaaatt

SEQ ID NO: 5042 - DNA, 101 bp, rice(Oryza sativa)
  misc_feature (71): n=t or c
tacctgaagctgaaaacaagagttgaatttcttcaaaccacacagaggtagtcttcagagatgaatgtggncaatcatttcagcttcttatctactacaga

SEQ ID NO: 5043 - DNA, 101 bp, rice(Oryza sativa)
  misc_feature (71): n=a or c
gttccactaatcaatttatatataataatgtgctaaactatacagcgtccatgcatttttattcttcatgnctaattaatttgattcaccattaattaatt

SEQ ID NO: 5044 - DNA, 101 bp, rice(Oryza sativa)
  misc_feature (71): n=t or c
actcaaaggtagctttgaaattaagatgcatgtcattaatgcataatagagaaatcaggttaccaaattanattaagcccatatattaactcaaaggtcat

SEQ ID NO: 5045 - DNA, 101 bp, rice(Oryza sativa)
  misc_feature (71): n=t or c
ttatcaaaaagaaacacacatgttctagcttcagatcccaaaataatcaaacaggaaaatatatataatangcaattagttcagatcccgaggtagatttc

SEQ ID NO: 5046 - DNA, 101 bp, rice(Oryza sativa)
  misc_feature (71): n=t or c
tcagcctattattaccgatcgatcgatatcctagctactagctaagcttgcttcacggcgaggcgagcagngcgcgtgcttatatagctgtgtgcgtgtac

SEQ ID NO: 5047 - DNA, 101 bp, rice(Oryza sativa)
  misc_feature (71): n=t or g
gtcaacagggacctgcacatgatcgtcgttgcaagttgtttgctttagctaagctgggtatagtagtatangcctatatgcagctgcttatagtatgcata

SEQ ID NO: 5048 - DNA, 101 bp, rice(Oryza sativa)
  misc_feature (71): n=a or g
cttaacgaaattaatgtggttcgggtgtgtggcaaagagtttggtcagcggttgaatcatgataaatgatngattccccagcatataatcatgccaaatta

SEQ ID NO: 5049 - DNA, 101 bp, rice(Oryza sativa)
  misc_feature (71): n=t or c
ccagctcaatttgcactcccctcttagcctttgtctccttgcaatcccaagatgctcctcctgcatgtcangcgtcagtgtgagtgtaactaatcgattcc

SEQ ID NO: 5050 - DNA, 101 bp, rice(Oryza sativa)
  misc_feature (71): n=a or g
acacagatccattgttcgatcgatcgatcgagcatacatacacacatgcgtcgttcacccctcaacaactnatgtccgtgagtcgcagcggataagaatgg

SEQ ID NO: 5051 - DNA, 101 bp, rice(Oryza sativa)
  misc_feature (71): n=t or c
acacgagctgatcagctaatgttgcacgagcacttgagctgtcagtggaaaacggcaagcttgtggaatgnttgagctgcttgatgagctttgaaatggga

SEQ ID NO: 5052 - DNA, 101 bp, rice(Oryza sativa)
  misc_feature (71): n=a or c
ccttttacattattatttcagacggtgacaaacacctcttgctttctcagcaccttactcgtcgttgtccnctagagttgcaccgaaacacggaatgcatt

SEQ ID NO: 5053 - DNA, 101 bp, rice(Oryza sativa)
  misc_feature (71): n=t or c
ttcaagacccataatttttgtaaataaattttacaaaactatcaaactattcaaagctagagatttaaggnggtacatcatgaaactatttaacatcaaat

SEQ ID NO: 5054 - DNA, 101 bp, rice(Oryza sativa)
  misc_feature (71): n=a or c
gaggaccctgtaagccagtgtaaacgaggaacatgccatctgtgtatgacagtgagaaattatataagaanaacattttgtgacaaaagtaatcagggcta

SEQ ID NO: 5055 - DNA, 101 bp, rice(Oryza sativa)
  misc_feature (71): n=a or g
gctgcatttgcgaagctaaggtatactatgcaagccatatgtttgtgttcgtacgtgttgtttgggacgtncagttgtgttgttgtacgtcgtgaagtact

SEQ ID NO: 5056 - DNA, 101 bp, rice(Oryza sativa)
  misc_feature (71): n=t or c
ctgcaaggtggaggcgagcgcggttgagaaggcagaagagtttgccgccaacaaggagctgtccgtctaanagccggacgatcgaaaggcgcactatatta

SEQ ID NO: 5057 - DNA, 101 bp, rice(Oryza sativa)
  misc_feature (71): n=t or c
gttcagtttgagctcgatctgccctgtacttactccatcccatcatttttagctcattcaatctatctcgnttaaagtaatcattgtaccagagtgtatga

SEQ ID NO: 5058 - DNA, 101 bp, rice(Oryza sativa)
  misc_feature (71): n=a or g
aaaaaaactatcaggattcgttggggagttataggtgctagctcgtaggtgcaaggatcaaatgatatgtnaaggagaaaagaaggaaaggattggtggct

SEQ ID NO: 5059 - DNA, 101 bp, rice(Oryza sativa)
  misc_feature (71): n=t or c
attttttgtatatataaatgcaaatgctgctgcatctgcatatgattccgacatgtacgcgtagcaagcangcctaagttgcctatagttagtcatgtggc

SEQ ID NO: 5060 - DNA, 101 bp, rice(Oryza sativa)
  misc_feature (71): n=t or c
cacccacttctcccctaaatatcccacctaaccatggtcactgcttccactctcactcgaaaccactcccncactcgcacagtggtgatgactctgagggc

SEQ ID NO: 5061 - DNA, 101 bp, rice(Oryza sativa)
  misc_feature (71): n=a or g
aaatgggtgaagtgggtggatcaagcacgaagggggctaattgcaagatgtagtcatgctggatagccacntaggcaggtcaacctgatcagacgtgcttt

SEQ ID NO: 5062 - DNA, 101 bp, rice(Oryza sativa)
  misc_feature (71): n=t or c
aatgcagagaaagaaaaacacgggtaggacttgttatgcatgttcatgggcatcagtacgttttccacaangttgaattgggaaggacatccagctggagc

SEQ ID NO: 5063 - DNA, 101 bp, rice(Oryza sativa)
  misc_feature (71): n=a or c
gcaaaggctctataaaatgctctagaaaacaatgtactccctccatttcgtatctcgtcgttttgattttnttttctaatccaatattacaagtcgtttga

SEQ ID NO: 5064 - DNA, 101 bp, rice(Oryza sativa)
  misc_feature (71): n=t or g
ctggccttacaatggtgaactgggtcaccatctgttcatggcgatggttaggatgatggcagtggaaggangaagaatggcactgcgctgcttgcctgctt

SEQ ID NO: 5065 - DNA, 101 bp, rice(Oryza sativa)
  misc_feature (71): n=t or c
taatcattccttaatacattgatgtatctgtattcgtatatagctttttatagtatgtgtaaattgaacanttactaattacgatggcacttgtaataccg

SEQ ID NO: 5066 - DNA, 101 bp, rice(Oryza sativa)
  misc_feature (71): n=a or g
tctcggcacctctttcgtatggtcggaggaaggctggtctcggacagcttgtacgtagcattagcagaccnatgagaagtgcgctgtcaagaacatttagt

SEQ ID NO: 5067 - DNA, 101 bp, rice(Oryza sativa)
  misc_feature (71): n=a or g
cttctgattacttgaagcctgcaacactaaatctctctgaccactggtgttcaaatccatctgaacttgcnaagcacccccatcacttatcttcacattgg

SEQ ID NO: 5068 - DNA, 101 bp, rice(Oryza sativa)
  misc_feature (71): n=t or c
cctcagatatcctatcaagttcaacacgaacaagtgactcccttgacctgttacgatgtcttaaatcaccntttaagaagcttgagttattgtattgctca

SEQ ID NO: 5069 - DNA, 101 bp, rice(Oryza sativa)
  misc_feature (71): n=t or c
aaaatatgataattattttgtatgctatctttgttctggtcaacaaaatgaagcttatgagctatctggangttcttcattattacttgactttctctcaa

SEQ ID NO: 5070 - DNA, 101 bp, rice(Oryza sativa)
  misc_feature (71): n=t or c
ttatggtacacaggaaaatcttgacctctgacaagcttcagctcaggggatgggacaacagccccatctgntccctatgcggcatcgagccagagacagcc

SEQ ID NO: 5071 - DNA, 101 bp, rice(Oryza sativa)
  misc_feature (71): n=t or c
acgctcttgtaaccttcaactgtcctttcaccctgtcattaaatacagattgagggtcgtcaggatgttcngccctaatcctcgagacttcctgcagagaa

SEQ ID NO: 5072 - DNA, 101 bp, rice(Oryza sativa)
  misc_feature (71): n=t or c
tacaatgtaatattctattatgcaaacggttaaaatatcttctttgcctgttgcagccaaaatttaatganatactacttgagatgtttcgcatcgactat

SEQ ID NO: 5073 - DNA, 101 bp, rice(Oryza sativa)
  misc_feature (71): n=a or g
ttcatggtcttgctactacctttaccaatcaagactccggtcataccttggttgtcttgaaattgttgaancaattcacggtcctattaggactctggaaa

SEQ ID NO: 5074 - DNA, 101 bp, rice(Oryza sativa)
  misc_feature (71): n=t or c
acttatacatgtttcttgtttcttattagtaaaaaggttcatttttgtggggatttttattccctgtgccntctattagcttactttaagtgtattgtgta

SEQ ID NO: 5075 - DNA, 101 bp, rice(Oryza sativa)
  misc_feature (71): n=t or c
atatgcaccaatcatctgtagtaaaaaaagaaaagaaaaggaagttttccatttccagttttccatcctanagagaagcggataacaaaacatactaacca

SEQ ID NO: 5076 - DNA, 101 bp, rice(Oryza sativa)
  misc_feature (71): n=a or c
tttgatgaagtggggtctgagatgccagatttatgaaaaaaaaaacggagtcaaaacgttgtgaattgganggtgtttagaagtagcataaggctattccc

SEQ ID NO: 5077 - DNA, 101 bp, rice(Oryza sativa)
  misc_feature (71): n=t or c
ggggaaatgtctacgtacctaccaatggtatgggtgtttttcttcagtgttgatttttttaattaattatnatgtacttgcatgcatgacactaaacaccc

SEQ ID NO: 5078 - DNA, 101 bp, rice(Oryza sativa)
  misc_feature (71): n=a or c
gatgtcgatccatactgattcaattatggcgagatacacgcaacctccctttcttagcatcaaagctcctnaccctctcacctcacctgctccacttcgtc

SEQ ID NO: 5079 - DNA, 101 bp, rice(Oryza sativa)
  misc_feature (71): n=t or c
ctcttgcctttttctaatcttctcctgcaatctgtccctagtaatgcacaggataatatataacctttaantgattactcgttaagtttcataatattatc

SEQ ID NO: 5080 - DNA, 101 bp, rice(Oryza sativa)
  misc_feature (71): n=t or c
agggagagggatgaggagtcgaaggcgtcgtcgtcgccgaagccggggacggtgtagtcgttgctgtcgangcggacgaagacgcggtcgttggggtcggc

SEQ ID NO: 5081 - DNA, 101 bp, rice(Oryza sativa)
  misc_feature (71): n=t or c
ggcttgggctcaccctcatcatcctcaaactcctcttcctcttcaacatcacttaagaacacaccatccancacttcctcctcttcatcatcatcatcttc

SEQ ID NO: 5082 - DNA, 101 bp, rice(Oryza sativa)
  misc_feature (71): n=a or g
acttgcaattggatcatattctgcagtagatagtactacccaggatgggtatatctacatttcacttgacntaacactaccgctgaattctttatctaagg

SEQ ID NO: 5083 - DNA, 101 bp, rice(Oryza sativa)
  misc_feature (71): n=a or g
catttctttttaaaatatagggtgtttttttattaagtttaactgattccccgatggatttggatacaccntcgtgctcttcaactcgttctgccgtgccg

SEQ ID NO: 5084 - DNA, 101 bp, rice(Oryza sativa)
  misc_feature (71): n=t or g
atccacaaatttcgtcgaatattcaaattcaagttcggttcaacaattcacctccaaaccctaaactctcncctgggtctcctgaaatccatactcgaatt

SEQ ID NO: 5085 - DNA, 101 bp, rice(Oryza sativa)
  misc_feature (71): n=a or g
ggcaggcgagctcgctcgagctcggctcgttgacagccctagtcccatcttcaatcgggaaaccaccctcnaattggatgcgtacaatcgtgagtttttgt

SEQ ID NO: 5086 - DNA, 101 bp, rice(Oryza sativa)
  misc_feature (71): n=t or c
gtgacctccaatagaatcggccaaaccaaaaaattaaaccatgatcaggagtcctaaacttgtgggaggantattagtcctttcatcgaaagaaattaaaa

SEQ ID NO: 5087 - DNA, 101 bp, rice(Oryza sativa)
  misc_feature (71): n=t or g
tactgtagtccttttctgctttacttacgtaggctatttctcatgtattttcagaaagttttgatccatgntttagaagaagctggctatacaaaagattc

SEQ ID NO: 5088 - DNA, 101 bp, rice(Oryza sativa)
  misc_feature (71): n=a or g
gacggcggcgcctggcgcgaggttcccctcctggaacagcaggaagaagaagacggccacgacgacgcaancatgcaaaattgcagcggagaaggagaacc

SEQ ID NO: 5089 - DNA, 101 bp, rice(Oryza sativa)
  misc_feature (71): n=a or g
ttaattgcacaattatcaatatgcacctgttggataatgcagcagggatagttgagatagaacatcttggngcgcttgttcttttgtgtcatgtttggaga

SEQ ID NO: 5090 - DNA, 101 bp, rice(Oryza sativa)
  misc_feature (71): n=t or c
agattttacaacgttcgagtggacgccaataaaaaaagtagagtgcagacagatagtacatatggattaancaatcgatactgggtatgctatttgttaga

SEQ ID NO: 5091 - DNA, 101 bp, rice(Oryza sativa)
  misc_feature (71): n=t or c
aaattttgaattctaacaaattctagggcccgcttaccggagcatctttcctccggcttcgactcttagtncttctggtctcttggcaactgtggaaggag

SEQ ID NO: 5092 - DNA, 101 bp, rice(Oryza sativa)
  misc_feature (71): n=a or g
atataactaccaaattcatcttaatgtttgattatgatcagcatcttattgtttgccgaatccaggctaanaacatgcaagagaatgtgcattttttagag

SEQ ID NO: 5093 - DNA, 101 bp, rice(Oryza sativa)
  misc_feature (71): n=t or g
aaagcctcctggtttatggtacatactgaattcaaaataacaaatcggtgtaaattggatttcattatagnagtccaggaaaatgtttgattatacacata

SEQ ID NO: 5094 - DNA, 101 bp, rice(Oryza sativa)
  misc_feature (71): n=a or g
atgccaaacaccgttagatcttattctcggctggacacagaaatcaggcccaagttggttagcaggccctntcaagcccgtccgaactcctgcaaacctct

SEQ ID NO: 5095 - DNA, 101 bp, rice(Oryza sativa)
  misc_feature (71): n=a or g
tcatggcaacaaggttaagccatgtttgcaacaaccaccaagggccaccagcaccgactactgatccactngttatcttaaccgatgcattgtttaacatc

SEQ ID NO: 5096 - DNA, 101 bp, rice(Oryza sativa)
  misc_feature (71): n=a or g
tacttttttttttccatgatcacattgttagtcttgctggctggagtaattgttggaatcaatagagattnatttctacctgcgagtcttttttttttcat

SEQ ID NO: 5097 - DNA, 101 bp, rice(Oryza sativa)
  misc_feature (71): n=t or c
ataaaaaggaaacgtatatttggttataggcttatagccatcctgccctattttattccgctaactcctcnggtccaggactgctatacgaaagatatttt

SEQ ID NO: 5098 - DNA, 101 bp, rice(Oryza sativa)
  misc_feature (71): n=t or c
aactgtgacaaacccacattctcttaacctaacatatgtactaacagcttgcacactacaagcattacgcnatccaatccagttatagatgcaaaatagcc

SEQ ID NO: 5099 - DNA, 101 bp, rice(Oryza sativa)
  misc_feature (71): n=t or c
gggcctgctgccagcttttgaccagttgcagagcaacacttcaatcacaacaacttatttccagttttagnataccgaatataactttattcttaagatat

SEQ ID NO: 5100 - DNA, 101 bp, rice(Oryza sativa)
  misc_feature (71): n=t or c
atattaacgaggaacaggaaccttttaggttatattgaacccacaatgctgacagtacaatgttgagttgntgacccttcagagaccttcgaaatcaggaa

SEQ ID NO: 5101 - DNA, 101 bp, rice(Oryza sativa)
  misc_feature (71): n=a or g
agcaaaaaattgattggcaccatcattacaatgcacacatatcaaaaccatgaaatatcctttcaggagtncatcgaagctctgttcggctaccaaccttg

SEQ ID NO: 5102 - DNA, 101 bp, rice(Oryza sativa)
  misc_feature (71): n=t or c
ggcgagtttgcagatggtggcgagatggggattttggataggtttggttcgaattttttattttttttttncccaaatcggaacgaattcgccgccgccgc

SEQ ID NO: 5103 - DNA, 101 bp, rice(Oryza sativa)
  misc_feature (71): n=a or g
gtaaagtcaagcacgccctcaccgcctcacatccatcgcgctgcctccaaaccaatccccaccctagcgcnccgtcacgcctccacctcgcgtttcctccg

SEQ ID NO: 5104 - DNA, 101 bp, rice(Oryza sativa)
  misc_feature (71): n=a or g
caccttggatgcatcgtcggctccaactaaacccaaactccttttttctcctactaagaaaatcgccaacncaccaccaaacttcccctttttttcgaagg

SEQ ID NO: 5105 - DNA, 101 bp, rice(Oryza sativa)
  misc_feature (71): n=a or c
acctccactaatgcatggtagtggaggtttcataagcagaaacctctgccgacaaaccataaaaagaactnaagtcaagatttcagtacttggtcaaccta

SEQ ID NO: 5106 - DNA, 101 bp, rice(Oryza sativa)
  misc_feature (71): n=a or c
attgaaaattttgtaaacttgaaattaaattgcattgtgacagccgtgcatccattaaccatacattcatntagcattccaactggtgtgcataaactagg

SEQ ID NO: 5107 - DNA, 101 bp, rice(Oryza sativa)
  misc_feature (71): n=t or c
gaacctacaacaaacagatcttccaacataagtccaaacaattttctggaaaatgaatatgattaaaatgntactcctatctggcacaacatggtacaaaa

SEQ ID NO: 5108 - DNA, 101 bp, rice(Oryza sativa)
  misc_feature (71): n=a or g
aatcaagaaaccccaaccatagccaaagatcattccagctagccacatggaaggtccagaagggactaaantaactgggaagagggctaaagatgcaacga

SEQ ID NO: 5109 - DNA, 101 bp, rice(Oryza sativa)
  misc_feature (71): n=a or c
aagttttattagagctatctgctgaggccatctttttaaccatgcctgcattaaaaaatgtagagggaagnagagagcagaaaattagggcaaagctcctt

SEQ ID NO: 5110 - DNA, 101 bp, rice(Oryza sativa)
  misc_feature (71): n=t or c
aattggatgtctgcagattggagaggtatgtaaccaacctataaatatagatgaacgcctcgggtatcatnccagcaattgaaccacatagataagggttg

SEQ ID NO: 5111 - DNA, 101 bp, rice(Oryza sativa)
  misc_feature (71): n=a or g
aaataccttccgactcttttatgtcattcagagctctcttggcgtacaccgtgaaggcgaccgtgaggacnacagcgatgacgaacgagatggcgttgtat

SEQ ID NO: 5112 - DNA, 101 bp, rice(Oryza sativa)
  misc_feature (71): n=a or g
tcgtcatcgctgttgtcctcacggtcgccttcacggtgtacgccaagagagctctgaatgacataaaagantcggaaggtattttaacagaagagtatggc

SEQ ID NO: 5113 - DNA, 101 bp, rice(Oryza sativa)
  misc_feature (71): n=t or c
aagaatccccatcaagagcgctccccatcacggcctgtaccattggatgatgttgtatgacggcgttgttntacagggacaaagtacatacggctgcttca

SEQ ID NO: 5114 - DNA, 101 bp, rice(Oryza sativa)
  misc_feature (71): n=a or g
ttagacaggtgcattcaccttatgcaattagcctacctacactacacctcttcttccgctggagaaaagcngacgagagatgaatatcctactttctcagt

SEQ ID NO: 5115 - DNA, 101 bp, rice(Oryza sativa)
  misc_feature (71): n=a or g
attcatctctcgtctgcttttctccagcggaagaagaggtgtagtgtaggtaggctaattgcataaggtgnatgcacctgtctaactcaaatacacgccct

SEQ ID NO: 5116 - DNA, 101 bp, rice(Oryza sativa)
  misc_feature (71): n=t or c
aagtttttttcattcttggaagaagttgaccacaagtgcacgaattgatatgatatatgttccaaaaatangaatgtatttacatgcccatatgttaatta

SEQ ID NO: 5117 - DNA, 101 bp, rice(Oryza sativa)
  misc_feature (71): n=a or g
tggaacatatatcatatcaattcgtgcacttgtggtcaacttcttccaagaatgaaaaaaacttgtatatntacactatgtcaaacaactttgctagtact

SEQ ID NO: 5118 - DNA, 101 bp, rice(Oryza sativa)
  misc_feature (71): n=t or c
ttagtatgcaattatacaaattactcggcaaaagtttcatcttttttttcttcttccacggcgaaggccgnccatgatcagtcagccgcagcgacggtggc

SEQ ID NO: 5119 - DNA, 101 bp, rice(Oryza sativa)
  misc_feature (71): n=t or c
gctcgccgccgccttcttgatcctcctcctcggcttcagtgttctcagcagcagcagcaacagctgacgangaatctaccctcctcgtcgccgccggttcg

SEQ ID NO: 5120 - DNA, 101 bp, rice(Oryza sativa)
  misc_feature (71): n=a or g
ttgtctgacaggctatttggccacatagtggacactaccgcccaactgaggagaacttcgaggagttcaanagcttcctgaacgacaactctgtcgatctc

SEQ ID NO: 5121 - DNA, 101 bp, rice(Oryza sativa)
  misc_feature (71): n=a or g
tttatagtcagtccattgaacaacttgttcatcctttacaaagaactgggtcatgtgttgagttctagttncagacaaaatgctgacacaatcatgtttcc

SEQ ID NO: 5122 - DNA, 101 bp, rice(Oryza sativa)
  misc_feature (71): n=a or c
atcatgatcctgatttgattatgtaatgcaggcttgatgtgggagaagggaaagagatcaatcttgagggnaagtgctccaggtcgaagcttttgagccaa

SEQ ID NO: 5123 - DNA, 101 bp, rice(Oryza sativa)
  misc_feature (71): n=a or c
tgaaggttgtgaccataccggtggcgcgggtcaatctgaacatttgcaacattagctcattgaacgataanacagcggtaaaaaaaaaaaaactgaataat

SEQ ID NO: 5124 - DNA, 101 bp, rice(Oryza sativa)
  misc_feature (71): n=t or c
gagaagcaggagacggccgtctccagatggtccagagcaagaacccgagctgccaaggtaacaacactgcnttttctttttctttttctttttcttttttt

SEQ ID NO: 5125 - DNA, 101 bp, rice(Oryza sativa)
  misc_feature (71): n=t or c
gcttcaagcgtgaccagcagatgagccccacctccctcctccaggtggagaccgagatctccatcaagccngccgccgccgacattgccgccgcgccaagg

SEQ ID NO: 5126 - DNA, 101 bp, rice(Oryza sativa)
  misc_feature (71): n=t or g
gcttgaagctgagcgacccttcgatgagcagcttcccggatcccaacgccttcaggatcgccgccggcttnccgccgccggagttcgactccgacgacgcc

SEQ ID NO: 5127 - DNA, 101 bp, rice(Oryza sativa)
  misc_feature (71): n=a or g
ttttgagtttttgatccaatcttgttagtgaagtcgtgagcttgttgtttgtttggtggtgtttgttgctnttcttgttcttgaaatctgaaggtgttgtg

SEQ ID NO: 5128 - DNA, 101 bp, rice(Oryza sativa)
  misc_feature (71): n=a or g
acgtacgtggaaatcataaacctttttttttattttatttagtttcttctcgccaccgctcgccttcgccnagctccctatatatcgccgtcgtctcgcac

SEQ ID NO: 5129 - DNA, 101 bp, rice(Oryza sativa)
  misc_feature (71): n=t or c
atttgcaaagaatgtgtaagcagtaactgtacagaggcaaatattcagacattccaagcagaggctctttngctgtacaagcaataaccgtataccagatc

SEQ ID NO: 5130 - DNA, 101 bp, rice(Oryza sativa)
  misc_feature (71): n=a or g
gtcattacctttagctaattaagtcccttcataagctttggtaaattatggtgaaaaggtccagcactctnaaaaattccatcaagaacatcagtaaacag

SEQ ID NO: 5131 - DNA, 101 bp, rice(Oryza sativa)
  misc_feature (71): n=a or g
acatgtttgcttggtaagcaatctggattagtaaattcttttacttctagaagggtacgattcagtttgtnttgtgcttcgtccaaagatgacatatttac

SEQ ID NO: 5132 - DNA, 101 bp, rice(Oryza sativa)
  misc_feature (71): n=a or c
taaattttacttctaggctagattggtaggattataaaagaagaatctataaacaccaaccaaatagcctntcataggaactatatatacgaatctctgct

SEQ ID NO: 5133 - DNA, 101 bp, rice(Oryza sativa)
  misc_feature (71): n=t or c
cccatttttgagtctcacacggcatgggcgaaagtaaccgaccgaccagcagcgctcaagtcaatttaagnaaaaacaagacaaactgtagccatcaggcc

SEQ ID NO: 5134 - DNA, 101 bp, rice(Oryza sativa)
  misc_feature (71): n=t or c
ttttgcttggagacctagcaacattgaaggaaaacaaaattgtggcagtgtccaatttctcaactcatggnccatggtgtccacgtagacaaagaaatata

SEQ ID NO: 5135 - DNA, 101 bp, rice(Oryza sativa)
  misc_feature (71): n=t or g
ataagcataagcgaaaagatgaggctgttattgattttccttgcacaagtcatgaatatacatttgatttnattttttttcctggagttatagatgtcgca

SEQ ID NO: 5136 - DNA, 101 bp, rice(Oryza sativa)
  misc_feature (71): n=a or g
aggttgtgtgccgtcgggctggtcagcaattgcgttcagagggcaacgtcttagggctttctttttcgatnaataatttatctaggtattaatataattcc

SEQ ID NO: 5137 - DNA, 101 bp, rice(Oryza sativa)
  misc_feature (71): n=t or c
atcatgttgctggttaaggtatatatcatcatgctcccaacggagagtacggagagatgagcgattagatnaattaaacagggtgctttcggtgtcttctt

SEQ ID NO: 5138 - DNA, 101 bp, rice(Oryza sativa)
  misc_feature (71): n=a or g
tacgctagcagctgggagatcgagagtatagcagtttttgctacgtcatcgatgaccatgcattaggctanctaataatcaagccatgcattggttagctg

SEQ ID NO: 5139 - DNA, 101 bp, rice(Oryza sativa)
  misc_feature (71): n=t or g
cttccattttggacgaattaattagttcaggatactcgattttataatattatataaattgagaagtattntatattatagattagtaataaattaattaa

SEQ ID NO: 5140 - DNA, 101 bp, rice(Oryza sativa)
  misc_feature (71): n=t or g
tgaaaataaattaacaatgggattataggatatttcttagatccttcatgtgtctaaaaccctagtcgtcnccacagcccacaggaaaaacaagctaggcc

SEQ ID NO: 5141 - DNA, 101 bp, rice(Oryza sativa)
  misc_feature (71): n=a or c
atgactttttgacctaaatttgtggtccaatataacacacattatatgaatacaaaaaacagaaataatgntgtttttaaaataaaatgttggcagaaaaa

SEQ ID NO: 5142 - DNA, 101 bp, rice(Oryza sativa)
  misc_feature (71): n=t or g
gtgcatgcatgcatatatgtagatatgtcagtgtcatgacactgaggaagctagaaactctcacttataantccaccacacaccaaaaccatttgtctcat

SEQ ID NO: 5143 - DNA, 101 bp, rice(Oryza sativa)
  misc_feature (71): n=a or c
tctctccctaatccagtctgtcatgtgcttgctacttcttgatacaatcgttcgtaaagtgcaagtttagnagatcctccccacttaaattaattattata

SEQ ID NO: 5144 - DNA, 101 bp, rice(Oryza sativa)
  misc_feature (71): n=t or c
tgttcaaaaggtaacaactttgtatatttgaaaaatagtaaatagctaaaaagaagatactccctctgtcncaaatataagtatttttagatttcgacaca

SEQ ID NO: 5145 - DNA, 101 bp, rice(Oryza sativa)
  misc_feature (71): n=t or c
aggcccaattaatcagccagctgctagcctgcgtgtagctaggacgcactcgtgcgtccgtacgtacgctngtacgggtcacaccgctagggcaaactccc

SEQ ID NO: 5146 - DNA, 101 bp, rice(Oryza sativa)
  misc_feature (71): n=t or c
cataaaaatgttttgaattgattggaccggttacattagtttaatccattaagtagtagatgtggtagttnattttcactcaaaactaatttggctcaatc

SEQ ID NO: 5147 - DNA, 101 bp, rice(Oryza sativa)
  misc_feature (71): n=t or c
accacatctactacttaatggattaaactaatgtaaccggtccaatcaattcaaaacatttttatggatgnttttctagaagttcgtaactgtgtgctgtt

SEQ ID NO: 5148 - DNA, 101 bp, rice(Oryza sativa)
  misc_feature (71): n=a or c
aaggaggtcattctgctcgcaagcaaatgtcccatattttttgacattgtacgctgtacttccccaacagnacacagttacgaacttctagaaaaacatcc

SEQ ID NO: 5149 - DNA, 101 bp, rice(Oryza sativa)
  misc_feature (71): n=t or g
ggacggaaggagtactaggaaaggttaccgttcatgcatttgattcgaaagaatgaggaaaagaaaaatanactccctttatctttaaatataagagattt

SEQ ID NO: 5150 - DNA, 101 bp, rice(Oryza sativa)
  misc_feature (71): n=t or c
agctgctctatataattaagcagcattacacgctcctcctcctcagttaagtggtactactcccttcattncaaattgatatacatatttcatggtatatc

SEQ ID NO: 5151 - DNA, 101 bp, rice(Oryza sativa)
  misc_feature (71): n=t or g
aaaagataatgcacagtgtcagcacagctggaatagttgttggccaagctggattcctgtcaggtccagtntacatcatctctgacaccctttttaatcga

SEQ ID NO: 5152 - DNA, 101 bp, rice(Oryza sativa)
  misc_feature (71): n=a or c
cttgaattaatcacaggcaccgatcgatcaagatgcggacatgtatgcatgtatatatatactccatatanattttattattattattttgaaagaaatac

SEQ ID NO: 5153 - DNA, 101 bp, rice(Oryza sativa)
  misc_feature (71): n=t or c
atccacaaacgaatgatgcacatggattactgcttgctggctgcctactgttctacttcagctgttttgcnggtgacaccgacaagttcatgattctctgc

SEQ ID NO: 5154 - DNA, 101 bp, rice(Oryza sativa)
  misc_feature (71): n=a or g
aggcaacaattaattaagaagaaaaaaccgaattaattgccggacgaggtttccggtcagtttcatcgatntcccaatccaggacaccatgcaatgcaact

SEQ ID NO: 5155 - DNA, 101 bp, rice(Oryza sativa)
  misc_feature (71): n=a or c
cgcggtcatggtcggttccagcttctcaattgacctttcaacatctgtataaatttccttttagcagtggntcattttgcgctcatcacattcatatgttg

SEQ ID NO: 5156 - DNA, 101 bp, rice(Oryza sativa)
  misc_feature (71): n=a or c
tggcaatcttcccttcttttggtgccctttagatctggaatttctttaaggaaccaagatcattgcctcanaaaattagacctcacaaaactctgctattc

SEQ ID NO: 5157 - DNA, 101 bp, rice(Oryza sativa)
  misc_feature (71): n=a or g
ttttcatactcatcatctggaggttattttgttggttaataagaacagttttttttctctgatacaaacantgtacctggagttaaaatcggtatatactc

SEQ ID NO: 5158 - DNA, 101 bp, rice(Oryza sativa)
  misc_feature (71): n=a or c
gatgtgtggtcttctaggatttccttttcattgttggatcctgaagataaaaagtcgaagcatcgaacaanttatcatattctttgacctcgtgcccattt

SEQ ID NO: 5159 - DNA, 101 bp, rice(Oryza sativa)
  misc_feature (71): n=t or c
ccgtcgggagagatctctgtcgcgctcaccagcggacagcagatcacgaagtagaagcctctctgatgacngccgcagcaagtcacctgacagggagaggt

SEQ ID NO: 5160 - DNA, 101 bp, rice(Oryza sativa)
  misc_feature (71): n=t or c
gagaacagaaagaaaccatctgagatgagggctagggaaagagtcgggtattgcactgctctctttcatcntttttctctaatgttttttgttttgttaaa

SEQ ID NO: 5161 - DNA, 101 bp, rice(Oryza sativa)
  misc_feature (71): n=t or c
tagagccagtgttcattttcaactggaggcctacatgctgtttagggatcaaaccatgagatgtttaggangctgtgatattttttcaatccagtaatatg

SEQ ID NO: 5162 - DNA, 101 bp, rice(Oryza sativa)
  misc_feature (71): n=a or g
atcttgagcttctattgcatacagctcatgagcttggtttgcaatgccaaaattcatttagtcatcacttntaaaccaaagaagcattgctttggcgcaaa

SEQ ID NO: 5163 - DNA, 101 bp, rice(Oryza sativa)
  misc_feature (71): n=a or g
tttttcctgtaagcttagatcactatgggaagaggctatgattatggtccatcaccgccaagagaatacangagaagagcccgcagcccaagtcctcgtgg

SEQ ID NO: 5164 - DNA, 101 bp, rice(Oryza sativa)
  misc_feature (71): n=a or c
tcgttccgctaaaaagaacaatgccaacagcaagtgaccttatcaacaagactcattcttccattcagctntttttagctaaaaaggttcggtagatgctg

SEQ ID NO: 5165 - DNA, 101 bp, rice(Oryza sativa)
  misc_feature (71): n=a or c
tatattgtgatgtctatttttctcgaatgctgaaatgttgtagcttgttttattccctaccagcatctacngaacctttttagctaaaaatagctgaatgg

SEQ ID NO: 5166 - DNA, 101 bp, rice(Oryza sativa)
  misc_feature (71): n=a or c
gcacgccgccaatccacacagctgtcgatcattgccattcaatcccaccagcaaacactccatccttcacnccgccaagaacacccaaaccctagcgaaaa

SEQ ID NO: 5167 - DNA, 101 bp, rice(Oryza sativa)
  misc_feature (71): n=t or c
tttgatgcggtttgatggttgattcgtgcgcgcgcgtgttacatacacgtcgttgtgtgccgcgcgccatnggggaaaccctagctcgctccaccgcgcgg

SEQ ID NO: 5168 - DNA, 101 bp, rice(Oryza sativa)
  misc_feature (71): n=t or g
gacgaacccaggagcggcgaagcgcctccaagccctaggcgggaaaggtaatcatcatccgattcgcgagncgagattcctatccccccgttccccttctc

SEQ ID NO: 5169 - DNA, 101 bp, rice(Oryza sativa)
  misc_feature (71): n=a or g
accgtccaatccccgcccccccggatccaacggtccacgcgacatctctcccctcattaaagccaaaggcngcacgcacgcacccctccccctccgcgctc

SEQ ID NO: 5170 - DNA, 101 bp, rice(Oryza sativa)
  misc_feature (71): n=t or c
taccaaactcgaaagacaaaaaaagagaagagaaaatgaaccagaccgaaatgggaaagcaagaaagtagncgaaactggaaagcgagaaaacataccgtc

SEQ ID NO: 5171 - DNA, 101 bp, rice(Oryza sativa)
  misc_feature (71): n=t or c
gtggtggataagtgtaaagttaaggtttcgttattttcggcctcatcttttcacttaaattttaaattttnaacatttaatttgaagctgatgttgggatt

SEQ ID NO: 5172 - DNA, 101 bp, rice(Oryza sativa)
  misc_feature (71): n=t or c
ttttggctctgacttataagcgataggacaaccaatgagacccttaacttttacgcaggagtataatgtantgggaacgtgcagtgtatcagaataaaaat

SEQ ID NO: 5173 - DNA, 101 bp, rice(Oryza sativa)
  misc_feature (71): n=a or c
tatactgttgttaagaaattgcatctctgaatttatatcagcctagataacttcaaagtacaagccaaagngcaatcagctccatcacgtatatttacaaa

SEQ ID NO: 5174 - DNA, 101 bp, rice(Oryza sativa)
  misc_feature (71): n=t or c
atatcatatctatcctttgatggggatagctaagcacttaatccgctaatcctgattactactgatttttnttagagaagggtattttttacccgggctct

SEQ ID NO: 5175 - DNA, 101 bp, rice(Oryza sativa)
  misc_feature (71): n=t or g
aagaacaatacatgtcaaccagccccatgcattgttttgatgattttctacttagtaatatagcaacctantatcgaataggacatatacttcatagtaca

SEQ ID NO: 5176 - DNA, 101 bp, rice(Oryza sativa)
  misc_feature (71): n=a or g
tacgtcacgtgagcgccgcgccagctaacaccaacctcaatattgccttaaaattatatttacacttgttntaaagatgatagatgtgttgtattcggctt

SEQ ID NO: 5177 - DNA, 101 bp, rice(Oryza sativa)
  misc_feature (71): n=a or g
ataaataaactgatatcttcaagagaaacctaattaaattttataaaaaaaactaaaagtggacccttctnttaaactataaatagaattctcgtgcagaa

SEQ ID NO: 5178 - DNA, 101 bp, rice(Oryza sativa)
  misc_feature (71): n=a or g
tgcatgctacgtccacctcgtcatggtgctttgcgagagcagcaagatcacccctgcagcgtggggagggnaaagatgggcaacggtggggagatggagga

SEQ ID NO: 5179 - DNA, 101 bp, rice(Oryza sativa)
  misc_feature (71): n=a or g
gcactggttcattaaaaaaattgcacacatggcatgagtcccacattgtttggtgttagcaagcgatatcnaaccgaacatgtgagattttatactatttg

SEQ ID NO: 5180 - DNA, 101 bp, rice(Oryza sativa)
  misc_feature (71): n=t or c
gcagcatctgctagaggatgaagcagaagtgcaggagagagactaaacttggggctacatgtcataacagnatgtttagatatatagttaaaagttattat

SEQ ID NO: 5181 - DNA, 101 bp, rice(Oryza sativa)
  misc_feature (71): n=t or g
catggctgaaagtgtaaccttttttggccgctagggccgaggcctcaaaacttttaattacttactttttntataattttcacttctctattcaatgaaaa

SEQ ID NO: 5182 - DNA, 101 bp, rice(Oryza sativa)
  misc_feature (71): n=a or g
atcagcatggatatatatatgctagtctttgcactaccacgaaaggcacgcacaagccagcattatacgtnccggaatagcgaaaaccgacgcctagtatt

SEQ ID NO: 5183 - DNA, 101 bp, rice(Oryza sativa)
  misc_feature (71): n=t or c
aagtagggggaatgtgctcggtgatgatgtattgagcatttttttttcatcccggaaaccttaaaggtacnggcacctttgaggagactcaatggtgccgc

SEQ ID NO: 5184 - DNA, 101 bp, rice(Oryza sativa)
  misc_feature (71): n=a or c
attttgatattgtaatacacatatccttgacccacacacagcacctctgtctgaacaaaatgggttatagnagtgacgaagctgctagtgagttttgagaa

SEQ ID NO: 5185 - DNA, 101 bp, rice(Oryza sativa)
  misc_feature (71): n=t or c
aaatttgttacttgaagtttagaaattcccaaaataagatgtgctacatattaaaaaacaagaagaaacangcgtagtacaaatgatagtttcatatgagc

SEQ ID NO: 5186 - DNA, 101 bp, rice(Oryza sativa)
  misc_feature (71): n=t or g
tacatgttaaaatatgtttagcatgtattactatgggcattgaattgtggatttagttgcgaaatataatnattcaaatagataaaaatcggatataaaac

SEQ ID NO: 5187 - DNA, 101 bp, rice(Oryza sativa)
  misc_feature (71): n=t or c
aaggacgccgggatcccctacaagatccacatctccgccgtttgcccctcgccttccgccgccttgccgtngccgactcgcggcggcggcagatgaggatg

SEQ ID NO: 5188 - DNA, 101 bp, rice(Oryza sativa)
  misc_feature (71): n=t or c
gcattcattttggatattcttggatcattggtttctgacctagtaaaagatatgttttctcccagtaccangaatctgagcaaatgattatccgattcgtt

SEQ ID NO: 5189 - DNA, 101 bp, rice(Oryza sativa)
  misc_feature (71): n=t or c
tccattatgtgtcaagccatcttgatatgtatttatcgggctgaacctactagtcaagtttggttggttcnagagaccaaagggtgggaggtttcgactcc

SEQ ID NO: 5190 - DNA, 101 bp, rice(Oryza sativa)
  misc_feature (71): n=t or c
acccaactccggtgacgcctgccccctgctccgcttcgtgaggagatccacattgacctgctccgcttccnggggcggcgcgaacactacacgagcgtcgg

SEQ ID NO: 5191 - DNA, 101 bp, rice(Oryza sativa)
  misc_feature (71): n=t or c
catctattcggctcttcagcgttccattcaattctcaatcttataaaaaaaagaaaggaaaaacaccactntcgacaagatgggttagagcatcaccaatg

SEQ ID NO: 5192 - DNA, 101 bp, rice(Oryza sativa)
  misc_feature (71): n=a or g
ctgtgacatcatcaatatcgtaatcgcgtcagcgtatatacgtacacacgtactacgtacctgctgcgtcngccaagtagccgttctcccacgcctccggc

SEQ ID NO: 5193 - DNA, 101 bp, rice(Oryza sativa)
  misc_feature (71): n=a or c
tcttatcatgtattattatgagtcggttgtaatgcatagttatttttttggtgataaacactttttttttnaaattgtaaagagtagctatagtagaagaa

SEQ ID NO: 5194 - DNA, 101 bp, rice(Oryza sativa)
  misc_feature (71): n=t or c
gggtccaaattgttttttaagtccccaaccttttgagagtgtgttattccagtcccaaattacaatgaccnatttaggatcctctcgcatggcagataaac

SEQ ID NO: 5195 - DNA, 101 bp, rice(Oryza sativa)
  misc_feature (71): n=a or g
ttgatgaaattttcctcatgtttagtgttctgttaataattaattaggccaagattaaggcttatttaccnctgctcaaggccaattagttcatgtttatg

SEQ ID NO: 5196 - DNA, 101 bp, rice(Oryza sativa)
  misc_feature (71): n=a or c
acgtgtggggggaagaaacgtgttacctctaattttaaatagtgaatttttactctctaaacctgttcatntatgttacccatgtttctaaactcttaaaa

SEQ ID NO: 5197 - DNA, 101 bp, rice(Oryza sativa)
  misc_feature (71): n=t or c
gtaaacttttcatacacatttaaccattcgcaaatatctaagaaataaatcatgtgtaaagtgcttttagngataaaaagctcacaacaaaataaattata

SEQ ID NO: 5198 - DNA, 101 bp, rice(Oryza sativa)
  misc_feature (71): n=a or c
ttgataaaaaaaatgcatatgaattttctttgaagcaattctacagaggactttgaaagcctcatgctagntcaattcctcaagaacattgtggagaaatg

SEQ ID NO: 5199 - DNA, 101 bp, rice(Oryza sativa)
  misc_feature (71): n=t or c
caaccctaactcgacaacaactactgaatatataggttctacggtcgatcaaaaacccctggatgcgtccntgttggactccaacacgatacatggcccaa

SEQ ID NO: 5200 - DNA, 101 bp, rice(Oryza sativa)
  misc_feature (71): n=t or c
aggccaaaataagttgatttgtatattagttaaagtttatctagctcaattggttgtttgtcagatttctngtggtgaaaccagtccaaatagatgcaaga

SEQ ID NO: 5201 - DNA, 101 bp, rice(Oryza sativa)
  misc_feature (71): n=a or g
attcaccgtgcaccacaatacatgttttattgtgcatgtcgcgctgctgacggtagcagcttataagccanttataaacatattttgaggaggtaaaaaag

SEQ ID NO: 5202 - DNA, 101 bp, rice(Oryza sativa)
  misc_feature (71): n=a or g
acataaggtagaaaaaataaattagacgtgattaacgagacaaatagtacgcactcctaatagtgctagangtgtttatatctagtactaattttaaatgt

SEQ ID NO: 5203 - DNA, 101 bp, rice(Oryza sativa)
  misc_feature (71): n=t or c
gtttccagcattataattcaatgtttcatgaatgagtaacaaatgtttcagctggaactcgacaatgttgnatatttttcatgtctttttaacaatggtgt

SEQ ID NO: 5204 - DNA, 101 bp, rice(Oryza sativa)
  misc_feature (71): n=a or g
tccaccaccacctccttttaggcttccggctgccacctcactctctgcgccagctttctccaccaccgtcnctggatttggaggagaaggggggaggcgga

SEQ ID NO: 5205 - DNA, 101 bp, rice(Oryza sativa)
  misc_feature (71): n=a or c
tttttcctttcctagctaatgcctattaagaatcaccgcaccatctggtgttagtcgtcgtaaaaaaaaanaccggtagattctcgttagcgaacttgtac

SEQ ID NO: 5206 - DNA, 101 bp, rice(Oryza sativa)
  misc_feature (71): n=a or c
catacataagctcaaagagaaattctcgacctcactaaaatcctattgaaaacccaccaggatttcaatcntattaaaggaaaatgagcaattctaaggca

SEQ ID NO: 5207 - DNA, 101 bp, rice(Oryza sativa)
  misc_feature (71): n=t or c
ataaaaagaatacaacaaagaatacaacataaatagtagattgtaacgacgcataattaccttatacctcnctctttctcagaatttaaggcctgatcaaa

SEQ ID NO: 5208 - DNA, 101 bp, rice(Oryza sativa)
  misc_feature (71): n=a or c
atacccccgctctcaaaaacaagttgcttgaaatacgaacattcaaaaagagttaattttaaccataaaanccattcaaaatatctttttgggtatatgaa

SEQ ID NO: 5209 - DNA, 101 bp, rice(Oryza sativa)
  misc_feature (71): n=t or c
ctctctctcccaccccctcttctctttttcttcgccaccatcctcgcctttccctctcgctgccgccgctngcctctcccgtcgccggcggccgcgaggat

SEQ ID NO: 5210 - DNA, 101 bp, rice(Oryza sativa)
  misc_feature (71): n=t or c
ccttgtacttcctatggttatatgttttttctttaggcttgaagcatgagtcatttttgcctgctagatgngcccaaagactgattatcatgtcaggttct

SEQ ID NO: 5211 - DNA, 101 bp, rice(Oryza sativa)
  misc_feature (71): n=a or g
cacacatgcatgattgattaatcaacagcaaaagtataatttaattaggaataatgggcaagaagatcgangaagtaattaacctgcaaccgagcatgtca

SEQ ID NO: 5212 - DNA, 101 bp, rice(Oryza sativa)
  misc_feature (71): n=a or c
tcaccgaggtcttcagcttccagtacaagcccctcctcccctacggcaacatcagtaagctctctaccacnacctcttattcctcctctccgacatcgttc

SEQ ID NO: 5213 - DNA, 101 bp, rice(Oryza sativa)
  misc_feature (71): n=t or c
catgccggtgtcgtctgcaatataccatggccgtggtgtcgtccaattagtacaggtatagatatgaaagngagaacgatgtcggagaggaggaataagag

SEQ ID NO: 5214 - DNA, 101 bp, rice(Oryza sativa)
  misc_feature (71): n=t or g
tcgccgttgaagtagatcttgcgcgggaacgcccagccctggctgaaggtgaaggtgttgtagtcctttcncatcagcacctccgactgcacgttgccgaa

SEQ ID NO: 5215 - DNA, 101 bp, rice(Oryza sativa)
  misc_feature (71): n=t or c
tgtacattatggagatctatcaggcaatttcaaagttaacacaatatcacagatttcctctttgactgaanatccagtatgaatagaccaaaatgccccta

SEQ ID NO: 5216 - DNA, 101 bp, rice(Oryza sativa)
  misc_feature (71): n=a or g
cacgcatgatgcagagattgcaggggaaggaatgtatggcgcgtcaggtagcatgtcaaaagaagcagttngttgttgtgttgctttggtttggtgcttgt

SEQ ID NO: 5217 - DNA, 101 bp, rice(Oryza sativa)
  misc_feature (71): n=t or g
aaggtcaaaaaggtaattactgtgtgcttcctactgctgctggctgctagtggtgccacccattctttgtngccaacttgcagcatcagtggaaccacagt

SEQ ID NO: 5218 - DNA, 101 bp, rice(Oryza sativa)
  misc_feature (71): n=t or c
ttcttccttgcctgaaaaaaaaaagagtgccttgttagagtagttcttcagtgcatgagttttaactgaantaccatatcagtacaattctgcagtcagct

SEQ ID NO: 5219 - DNA, 101 bp, rice(Oryza sativa)
  misc_feature (71): n=a or g
cattcatttcaacatcttgggtagttttcctcagcagcccattcacaactgtagctaatcttaatgtctcnaagataacctgcatagtaaaagtgcccatg

SEQ ID NO: 5220 - DNA, 101 bp, rice(Oryza sativa)
  misc_feature (71): n=a or c
catggacatatgttacaagagccaaacggctgttctaatcctgtcatcagggcagcagcatcagaattgcnctcttattttctatctgatttgaattccta

SEQ ID NO: 5221 - DNA, 101 bp, rice(Oryza sativa)
  misc_feature (71): n=a or c
tgaatcatcgatcagacgatagtgctagctatatatgcaatgcacaccatgcgatgaccaaaccaaagttngtcttcaccacagtcaactccggataaacg

SEQ ID NO: 5222 - DNA, 101 bp, rice(Oryza sativa)
  misc_feature (71): n=a or c
tgctctcgacccaggaggagaggtccgaggggttgtagtgcacggtgtccgtggccaggtgcgacacgaanccgtcatccgcggcgccgggggcgctcacg

SEQ ID NO: 5223 - DNA, 101 bp, rice(Oryza sativa)
  misc_feature (71): n=t or g
cagccgtcgccaccaccggtaaggagatcggcctgagggcgtaggtgctactcgacgagtcggcagcggcngggagttcaaagaagccgctaccaccgccg

SEQ ID NO: 5224 - DNA, 101 bp, rice(Oryza sativa)
  misc_feature (71): n=a or g
tcctgcccctacctcaagttcgcccacttcaccgcaaatcaagccatcctcgaggctttcgccggctgccnccgcgtccacgtcgtcgacttcggcatcaa

SEQ ID NO: 5225 - DNA, 101 bp, rice(Oryza sativa)
  misc_feature (71): n=t or c
aatgagaattttgtatacaaggcaccgatctaaaaattgagctatatgttcatgagttacagaatgccccnttgatgctcctgtgaacatgtcgaatgcgt

SEQ ID NO: 5226 - DNA, 101 bp, rice(Oryza sativa)
  misc_feature (71): n=a or g
aggttttcttcgcctgcagattacatggaacaaccaataccccagatcataaaattttgttttttttttcnagcttcatgaccatgtgtttagtgtgaaaa

SEQ ID NO: 5227 - DNA, 101 bp, rice(Oryza sativa)
  misc_feature (71): n=a or g
ccgtttctattgtcgaaaatagttctataacttgatcaacactaataaaaatcacaaagtaccgagaaacncccaggggtattccggctagctccacaagg

SEQ ID NO: 5228 - DNA, 101 bp, rice(Oryza sativa)
  misc_feature (71): n=a or g
tttgtgtgcagcactaactggtgcattgggccatctagaatatgattccaatatgtacataggacagatgngtggtatgaatagggaaactattctaatcc

SEQ ID NO: 5229 - DNA, 101 bp, rice(Oryza sativa)
  misc_feature (71): n=t or c
atgcttacttttatcatcgatatggagcactatagccaatgcagtgactagaagtcatctatgtttaactntttactgcgccttctgacttctgttgcata

SEQ ID NO: 5230 - DNA, 101 bp, rice(Oryza sativa)
  misc_feature (71): n=t or c
aagaggagaggagaggagaggagaggtttggattgggaaggatcaccagctcaccacccgtttctctctcnggcattgcgaggggaaggcggcgacgggag

SEQ ID NO: 5231 - DNA, 101 bp, rice(Oryza sativa)
  misc_feature (71): n=a or c
gcaaataacaaaagccacagggaaatttaaaagacttgcattgtctcaagcagagttaaggccttaaagancacaaaagctcagtcacaatccggctactc

SEQ ID NO: 5232 - DNA, 101 bp, rice(Oryza sativa)
  misc_feature (71): n=t or c
aaaagcaagatcacatgatgtgcattacatacagtagacagacacaatttcaatcttaatgaaatttggtnggctccttcgccgacctggcaaaaacacaa

SEQ ID NO: 5233 - DNA, 101 bp, rice(Oryza sativa)
  misc_feature (71): n=a or g
tgaaatggaagtcaatacaaatacatgatattgtcttcattatctcatcaagaaaaaaatatagccttatnttctacggaaatgttattctaataaaatgt

SEQ ID NO: 5234 - DNA, 101 bp, rice(Oryza sativa)
  misc_feature (71): n=a or g
aacatcacgtaacaagtagtttagatcagagcagttaaccatcactaatacaccaaactactcaatgtgtntttcgtctagacctaaatgagtaattcagc

SEQ ID NO: 5235 - DNA, 101 bp, rice(Oryza sativa)
  misc_feature (71): n=a or c
ccacgtttaaaaactcatgatacatgtggcttttggtttttgtgttttctgctcttttttttggcaaaatntatgaaaattttatcgttgtcttcaggatg

SEQ ID NO: 5236 - DNA, 101 bp, rice(Oryza sativa)
  misc_feature (71): n=a or c
ctagctgctatagatagatcttgtttttctctctcgatcgctcttgcagatgcaatagatattgggatgantgatgagctcctgctgcttgccatcatcgt

SEQ ID NO: 5237 - DNA, 101 bp, rice(Oryza sativa)
  misc_feature (71): n=t or c
aggtatgtgtatatcactagatttccttttctccattgtctcttcttgtggacacaatccttgatgtttcnttttgatggactgaactttttgattttgtt

SEQ ID NO: 5238 - DNA, 101 bp, rice(Oryza sativa)
  misc_feature (71): n=t or c
tggcaagcttcctttctctctcggcatatattgctttcaaggctggctcatcgtaagggatgtcaagatcnaggtccttagccatgtctaggagcgagggc

SEQ ID NO: 5239 - DNA, 101 bp, rice(Oryza sativa)
  misc_feature (71): n=a or c
cagaatgaaggacaagtgggccatcgccaaggatatcccaggcgaggtatgttaagtcctactactccctntgccaaaaaaaaaaaaaaaagagcttttca

SEQ ID NO: 5240 - DNA, 101 bp, rice(Oryza sativa)
  misc_feature (71): n=a or c
cgaaggaaatgatgggtgctatgaatggagtaatctttgagccactgaaaactagaggcaactagtccatnttaatttggctgagaaatttttaaaaaaaa

SEQ ID NO: 5241 - DNA, 101 bp, rice(Oryza sativa)
  misc_feature (71): n=t or c
tatccttcaactgagttatggaaagttgaggcttcagcaacatgggacaagtcatctgtgtgagatcactnacaacaaattagatcaagacaaaagagaat

SEQ ID NO: 5242 - DNA, 101 bp, rice(Oryza sativa)
  misc_feature (71): n=t or c
caatggtggatactctcgtcaatattggaatatctcggcacttttctagtgatataaagcgcattttgganaagacatacatgtaagaaccatgtctaatc

SEQ ID NO: 5243 - DNA, 101 bp, rice(Oryza sativa)
  misc_feature (71): n=a or c
atgtcaagctgctgcgtggagtcatattttgtatataaacctatttaattatcatggttatgacttctagnatgttactttacggttattttttttaaaaa

SEQ ID NO: 5244 - DNA, 101 bp, rice(Oryza sativa)
  misc_feature (71): n=t or c
ttatctaaagaaaagtgtttgagcatcaaatcttaatcaaaccccttcaccattttacacaaattagggangggaggctagaatacttaggcacttggaga

SEQ ID NO: 5245 - DNA, 101 bp, rice(Oryza sativa)
  misc_feature (71): n=t or c
cagtaaataaattattaccagtataattgccttgatgttcgttgtgccgaaggggaattcgaggtcgcccngatctctgatcctgagaaggacgttgacaa

SEQ ID NO: 5246 - DNA, 101 bp, rice(Oryza sativa)
  misc_feature (71): n=a or g
tcatccggctgcattccggcagggaggctccaatcgaagtagtagagaaggcgtgccacgatgagctccancaagaccataccaaatgtatcaccagggca

SEQ ID NO: 5247 - DNA, 101 bp, rice(Oryza sativa)
  misc_feature (71): n=a or g
caacttgccattgttcatgccagaacgccggtcaggccgtatgatttgcaggtcatagggcaccacttgtngttgtggatactggatagatgagcaaaggg

SEQ ID NO: 5248 - DNA, 101 bp, rice(Oryza sativa)
  misc_feature (71): n=t or g
accccgaccagcagccgtacttgtcggccctgatgctgggctcgatggccggcttgagcgccacccagttnatgaggtcacgtgacactgagtgcgcccac

SEQ ID NO: 5249 - DNA, 101 bp, rice(Oryza sativa)
  misc_feature (71): n=a or c
agatcagttaagtacgagcaaagtgtgcaggagatggtaaaaggggacgagaagaaagcgacacggcacangtagtaggtggtgttcagtgggcactgcac

SEQ ID NO: 5250 - DNA, 101 bp, rice(Oryza sativa)
  misc_feature (71): n=t or g
cgtttgcagggttcgttgacacggacatcaccaacgggaagatatctctgaggagcctggtacgtaatagnaccaaattatcgggaaaaaaggaaaatgtt

SEQ ID NO: 5251 - DNA, 101 bp, rice(Oryza sativa)
  misc_feature (71): n=t or c
acataattaagggcaatcagttttttcttttccgctgaaactcaaaaatctagctagctactgaaggtagntctcatcatgcattgcatctatctctctca

SEQ ID NO: 5252 - DNA, 101 bp, rice(Oryza sativa)
  misc_feature (71): n=t or c
gttcaaagtgatttttttaatacgggtgaccgtaaacgtattttactcttttgtttactcgagtctccagnatgttacttgtgcagttgctaggcgcgccg

SEQ ID NO: 5253 - DNA, 101 bp, rice(Oryza sativa)
  misc_feature (71): n=a or g
caggagtaaatgtatcaaacttgatgtacctgaataccaatttgacacagtcaaatggatgccttcagcanttgagttcccatcttaaagctaaccaacaa

SEQ ID NO: 5254 - DNA, 101 bp, rice(Oryza sativa)
  misc_feature (71): n=a or c
cctcatcagttgcatttatcagatcaacgacgttatcgcaccaaccattaaatatctcgagcaatcttttntttttacctgccaataaaaagcattagtgg

SEQ ID NO: 5255 - DNA, 101 bp, rice(Oryza sativa)
  misc_feature (71): n=t or c
tattgagctataacttcgattttattttgagctcacatgtagatacataatctgaaaatactcactagatnggcatggttgttattactcaccatatgtta

SEQ ID NO: 5256 - DNA, 101 bp, rice(Oryza sativa)
  misc_feature (71): n=t or c
tagtaataagtaaaacaaaattcagctgttgaatgtctccacctaagaaccgttgcaatgcatttatagtncgaaagaagttccaacaaatatttgatgcc

SEQ ID NO: 5257 - DNA, 101 bp, rice(Oryza sativa)
  misc_feature (71): n=t or c
agatatattttgtccatgccgattgcttgcggtggtggtggtgcggtgcttcaccctgtaacatcctccantgtttcaactttcatctgctattctataga

SEQ ID NO: 5258 - DNA, 101 bp, rice(Oryza sativa)
  misc_feature (71): n=a or g
aggattagttagtaagccaggggtacctttttttcctattatcagcaactacacaaatatgtgaccctccnaatatgaggtttactcatattcagaacgat

SEQ ID NO: 5259 - DNA, 101 bp, rice(Oryza sativa)
  misc_feature (71): n=a or c
gaaggacgagttcttgagctctgaagactataagaagatggaatatacccaacatgtaagatgatcgttcnatacatgctttaggattagttagtaagcca

SEQ ID NO: 5260 - DNA, 101 bp, rice(Oryza sativa)
  misc_feature (71): n=t or c
tcccagggacgccctatgccaaagctgtgcaggcatgcaactcaacatctcatttacacaagtcgttaaantgtcaataaaattttcaggccattttattt

SEQ ID NO: 5261 - DNA, 101 bp, rice(Oryza sativa)
  misc_feature (71): n=a or c
accacacaggagcaacaagtgtcatcttaccatgcaattaagtactgtaccattatttcatgtgacagcanaaggtaatgctgctgtcctgtcccagcagc

SEQ ID NO: 5262 - DNA, 101 bp, rice(Oryza sativa)
  misc_feature (71): n=t or g
gcctgctgcgccctgttcttagcggtgcgtgacactgtaccggagcagcggcctccacttcgatcgattcngaccgaactgatatgacgctggtgcgcgcg

SEQ ID NO: 5263 - DNA, 101 bp, rice(Oryza sativa)
  misc_feature (71): n=a or g
gatggcgagctgaccgtagaaagtgaagtgggatcgcgggaggagcatgtcctcggcgttgcaggcgaccntcagcagacgcccccgccgcgggtcgatct

SEQ ID NO: 5264 - DNA, 101 bp, rice(Oryza sativa)
  misc_feature (71): n=t or c
actcgtacttcatgttgatggaacgggcactccgtcttacctctacaagaagaacatagccaccatcctcnccgccgccggtcgggacgaagaccggctcg

SEQ ID NO: 5265 - DNA, 101 bp, rice(Oryza sativa)
  misc_feature (71): n=t or c
acagtagttatttggttcccctgataattcctctccaccatgtacagattatcacaaaactctcttttatnaatacacgaggcaaaattcttgccttttca

SEQ ID NO: 5266 - DNA, 101 bp, rice(Oryza sativa)
  misc_feature (71): n=t or c
ttaagtgatgccaaaaattcgtcgacttcacatttggtggtctgttagctgtgtacaggatatgttctagncttttaaattcttgtcgaatgggttaagat

SEQ ID NO: 5267 - DNA, 101 bp, rice(Oryza sativa)
  misc_feature (71): n=t or c
tttaggaggtaccgggaaataaatcttgtcgctctgatcagtgcctccttactagtctcgtgatctgttgnaagtaatagttagacatgcatatatatcat

SEQ ID NO: 5268 - DNA, 101 bp, rice(Oryza sativa)
  misc_feature (71): n=a or g
gagagaaggcgccgggagaagctcaacgagatgttcctgattctcaaatcagttgtcccgtccattcacanggtaatactaattactacttcatccgtttc

SEQ ID NO: 5269 - DNA, 101 bp, rice(Oryza sativa)
  misc_feature (71): n=t or c
gtgcgccctctcgacgacgacagtagcagctgggcggtcgcggatccctggtcgtcctttcagctagttcngacgtcttctccggcgccggatcaggcgcc

SEQ ID NO: 5270 - DNA, 101 bp, rice(Oryza sativa)
  misc_feature (71): n=a or g
caccacttattctaacttaactttgtggaatctgtctaactaaatgatttccaatgggtactattaccatntgttctggtggtaaatttcattccaatatt

SEQ ID NO: 5271 - DNA, 101 bp, rice(Oryza sativa)
  misc_feature (71): n=t or c
ctattagtttttggtttttttattaagaaacctaaccagcttcattggaagtaattaaagttatgtaactnatgttcgatctttaatataagcgcatgcat

SEQ ID NO: 5272 - DNA, 101 bp, rice(Oryza sativa)
  misc_feature (71): n=a or g
ttccgcttgctattggcgggcaaaacggcgagcgataggaaacgcacctttttcgcgtccgcccgccgacngtggatgccggaggggggaggggggtctag

SEQ ID NO: 5273 - DNA, 101 bp, rice(Oryza sativa)
  misc_feature (71): n=a or g
tcaacatcacttttcctggtatgcttagccttgccatggggatggatttagaattccctgtcagacagacngatgttgatagacttcttcacctccgggag

SEQ ID NO: 5274 - DNA, 101 bp, rice(Oryza sativa)
  misc_feature (71): n=a or c
atctcctgttgctgaagcttccagtttccgtgaatcacttcaaggatatttaaatgataagaaatctctantcgaattatacaaggcttcaaaagtcagta

SEQ ID NO: 5275 - DNA, 101 bp, rice(Oryza sativa)
  misc_feature (71): n=t or c
atcagctgccatttgcacgccagaagttgacatattgctacctttctgctgctgctaccatattcccccgngaattgtctgaagcccgcattgcatgggct

SEQ ID NO: 5276 - DNA, 101 bp, rice(Oryza sativa)
  misc_feature (71): n=t or c
gttcataattagtatcacatttatacagattagtcaacaaatttgtgggcagagaatgagatagctgcaancatataacatcaagtaaaaccgaaaatttt

SEQ ID NO: 5277 - DNA, 101 bp, rice(Oryza sativa)
  misc_feature (71): n=t or c
ctttaggagttaggtctagagtgtggttgtggagtagcctagctaaaatcagcattttatgagagtgctcnacctagcttcgctcctattttaggtgaagc

SEQ ID NO: 5278 - DNA, 101 bp, rice(Oryza sativa)
  misc_feature (71): n=t or g
atgcaggagcttgccagtgtaccgaaagtgttttttcttcactagtgaggatattcctcacaactcacaanatgcatggatcactaaaatacaaattcaag

SEQ ID NO: 5279 - DNA, 101 bp, rice(Oryza sativa)
  misc_feature (71): n=a or g
ccaaattaattaagaggtcaaaaaccatatagagaaaaggaaaacgcagtagtttgagaaaggggagatanagaagattgggaagatacgcaaaacaaggt

SEQ ID NO: 5280 - DNA, 101 bp, rice(Oryza sativa)
  misc_feature (71): n=a or c
atttgctcattagccggaacaactcgctgcattcttggcttcttatgacagaatcaggcatctttggtccnaacaagatacaatgctgggagcacaacggg

SEQ ID NO: 5281 - DNA, 101 bp, rice(Oryza sativa)
  misc_feature (71): n=a or c
ttcatagtaggtcgaattggcacttttcatagcctgcagagttcatcaaaaacagcataagagagagaaantgacttcttagttgcaacaaaaactcagca

SEQ ID NO: 5282 - DNA, 101 bp, rice(Oryza sativa)
  misc_feature (71): n=t or c
ggcttgcaggtattgacaaaacctattactctgctgatgaagctcttgttctaaaggttaggaaattatgngtaattgtgatttcatttacatggaagcat

SEQ ID NO: 5283 - DNA, 101 bp, rice(Oryza sativa)
  misc_feature (71): n=a or g
tataacccaaatcaatgatgtcatgcaacgtcaaaaagggataagatgctcccacatttagggagtgatangggacggatagagaatgggataggatatga

SEQ ID NO: 5284 - DNA, 101 bp, rice(Oryza sativa)
  misc_feature (71): n=a or g
tgagcacgacacgcttcagtattcaggtgtacacgcggcaactgaggaagggactgaaggataggatcaangaaggaagataggacgactatgtgaatcca

SEQ ID NO: 5285 - DNA, 101 bp, rice(Oryza sativa)
  misc_feature (71): n=t or c
acacagcacacaacttggaatttggaaaccttccaagtcatggctgcaattccacgtcaggcttggtgatngacctagtagttcttttgcttcttgtgacg

SEQ ID NO: 5286 - DNA, 101 bp, rice(Oryza sativa)
  misc_feature (71): n=t or c
cggttctttgaactgtggtggcgtgtcactgtctctgtcagtgccactgtccatcgtcgtccggctgttanagccggattgttactgctagtaattggctt

SEQ ID NO: 5287 - DNA, 101 bp, rice(Oryza sativa)
  misc_feature (71): n=a or g
caatcacacagtgagtgttggtgtggttaagggatgcatgcagcagagatgtgaaacggggttcatgttcntcacctctaaagttagcctgccatggcatg

SEQ ID NO: 5288 - DNA, 101 bp, rice(Oryza sativa)
  misc_feature (71): n=a or g
tagccctttgaagctgctgctgccctcactgaggttgtgagatcgacgcgaccgcttccgggtgagctgcngggatgacggcttgtcaggatcacaagcag

SEQ ID NO: 5289 - DNA, 101 bp, rice(Oryza sativa)
  misc_feature (71): n=a or g
acggtgcacacatttgatgtccacagtcttgcacctcaatggtgcaagcctggtcgaagcagatgcagcanagctccgtgtcgctcacctgtgcccaaatg

SEQ ID NO: 5290 - DNA, 101 bp, rice(Oryza sativa)
  misc_feature (71): n=t or c
ttgacagtaaaatctcatgtagctggttcatccaaaaaaaaaattctcatgtagctgggcatacacgagcnttttttttttttaagaacttacatacacga

SEQ ID NO: 5291 - DNA, 101 bp, rice(Oryza sativa)
  misc_feature (71): n=t or c
gcaacgaagcatcaggtacatatctatatatttagagggctcagggctccatcgtttagccttcagtttanaggcataagaaaaaataaattttatagtta

SEQ ID NO: 5292 - DNA, 101 bp, rice(Oryza sativa)
  misc_feature (71): n=a or g
gtatacatatggatatgtactgaagtagtactatgaagaattaaaaatgaaaaccccatatgctaacatantaagttaaaattataacataaactgcagct

SEQ ID NO: 5293 - DNA, 101 bp, rice(Oryza sativa)
  misc_feature (71): n=a or g
agcttcctaatccccactggtccataggcatcgtctgcaatttaaccagcaattcctatgcttttccctcnctggcattgtcgctgtcatcatcgtcaatt

SEQ ID NO: 5294 - DNA, 101 bp, rice(Oryza sativa)
  misc_feature (71): n=a or g
aacaccattgcatgtgaagatatatttgtatggaaaagtattttctaattgtgtatcatacatgtagtttnaatagttataaaaaatcatagaatttgata

SEQ ID NO: 5295 - DNA, 101 bp, rice(Oryza sativa)
  misc_feature (71): n=t or c
aaaaaacaaaaataataaaatcaggcaataaatactagtaaaatttgttatttttacttcgtgtgtagatngaatttaattttacatatttatatagtgtt

SEQ ID NO: 5296 - DNA, 101 bp, rice(Oryza sativa)
  misc_feature (71): n=a or g
gatcatccgtgcaatttagtataaataaatctggtcattttaaaagacggaataatgtgagcctagtatgntgctttctacttgtagtagaaaacaattta

SEQ ID NO: 5297 - DNA, 101 bp, rice(Oryza sativa)
  misc_feature (71): n=a or g
acttattatatagaatctcatttttgtttttctaatgagttatgagttacaagctcctaggatacaatggnattttcgcaaagttgatctttacgagtttt

SEQ ID NO: 5298 - DNA, 101 bp, rice(Oryza sativa)
  misc_feature (71): n=t or c
gataatgaatgtccttcttttcggcattggactttccaatcaattaattgatggtaaaactcgtaaagatnaactttgcgaaaattccattgtatcctagg

SEQ ID NO: 5299 - DNA, 101 bp, rice(Oryza sativa)
  misc_feature (71): n=a or c
gtactgttgtgttctgtggcagcttcttcgtggtggcgtatgccgtggcggccgcgtatagcctgctcgtnctggccgtgccggcagggagtgccctctcc

SEQ ID NO: 5300 - DNA, 101 bp, rice(Oryza sativa)
  misc_feature (71): n=t or c
tttaaagactaccagcctattgcacctgggaaacaggaggttgaacatgcatatgagtgagtgcactactngccctctcagatgaacatgggcatttggcc

SEQ ID NO: 5301 - DNA, 101 bp, rice(Oryza sativa)
  misc_feature (71): n=a or g
tactaaatgttaccaacatttatgtttacgctggttacgtaggttcctttaagtgtgtgcgagtggtttanagactaccagcctattgcacctgggaaaca

SEQ ID NO: 5302 - DNA, 101 bp, rice(Oryza sativa)
  misc_feature (71): n=t or c
atgatggagaccaaggaactctttgactgggttttaaagcaaagatgttttgaggtctgcatgcatccatntctgcaacctttgtgctcatgctttttttc

SEQ ID NO: 5303 - DNA, 101 bp, rice(Oryza sativa)
  misc_feature (71): n=t or c
tttttgcacatttttttgctggttgctctactatgtacagaacgacaagttgaagtcctttttttctcccntttcacttctaagatatgacctgagaggtt

SEQ ID NO: 5304 - DNA, 101 bp, rice(Oryza sativa)
  misc_feature (71): n=a or g
ccaattgctaggctagctgcagctcaggtgctcctctgatgatgacgcccttctctttaccggcaaccagntcgcctgctgttggtgcacctggtgaagaa

SEQ ID NO: 5305 - DNA, 101 bp, rice(Oryza sativa)
  misc_feature (71): n=t or g
gtacgactcctaccgccgtttcctcgacatgttcggcaacgtggtacgtactcctcatcagatcacactcncccggctcgctgactcggcagctagctgcc

SEQ ID NO: 5306 - DNA, 101 bp, rice(Oryza sativa)
  misc_feature (71): n=a or g
attttttttaacgactaacacaagcagtaaattcgttctacgtagtagagctggaagatatgtcaacgacntaggctgcgtttgagcgcaggagaaagaga

SEQ ID NO: 5307 - DNA, 101 bp, rice(Oryza sativa)
  misc_feature (71): n=t or g
tgcagcaaacaaaaacgcacgacacccccagaactgaaatgcagaataaaaaacagtataaaccggttctnttcttgtccttttaaaaaatcattcttgcg

SEQ ID NO: 5308 - DNA, 101 bp, rice(Oryza sativa)
  misc_feature (71): n=t or c
actgctgaaagcttaatcattccatcatttggaatcttgggggtaagacaaactgtaatgactctatctanatagagctagtgactcccaatcaatttggt

SEQ ID NO: 5309 - DNA, 101 bp, rice(Oryza sativa)
  misc_feature (71): n=a or c
ttgacttatatatggtacaagctagatagtgtgtgtacccactcctaaaataaatatgcttttattatganttgctttgaataattgttctcagaaacaat

SEQ ID NO: 5310 - DNA, 101 bp, rice(Oryza sativa)
  misc_feature (71): n=a or c
cagagcagctgctggtttgagaattgagaggcgcggttgacatggagagttccaacctgggcggcggcggnggcggaggcggcggcggtgggccgccgccg

SEQ ID NO: 5311 - DNA, 101 bp, rice(Oryza sativa)
  misc_feature (71): n=t or c
ccgccgcccacgccgccgccatgcccatgccctccatcaccatcgagaacgatctatcgatgaaccaacgnaacgcaacgaaggaacgaaacgcacgcaga

SEQ ID NO: 5312 - DNA, 101 bp, rice(Oryza sativa)
  misc_feature (71): n=t or g
gtccacaccaatgctgacttgtgggccccaccggtgatcgatccttctttttttttttttgctctcttttncatcatatatgcacgtatacatgcataaag

SEQ ID NO: 5313 - DNA, 101 bp, rice(Oryza sativa)
  misc_feature (71): n=t or c
tataaaaaaaactaaatagatatacatttttaacaactttaccaattaaaatatcattaatctgaacaacncctaaattcccgatcataacaacatctcga

SEQ ID NO: 5314 - DNA, 101 bp, rice(Oryza sativa)
  misc_feature (71): n=a or g
gaaacaagagttgacactgaaaacaagatcactgatcgttgtgatcacaaagtagtactccctccgtttcnaaatatttgacactgttgactttttagcat

SEQ ID NO: 5315 - DNA, 101 bp, rice(Oryza sativa)
  misc_feature (71): n=t or c
cctggctgttttcggttccagctaaagaatccctgaacttttagtgttcatcggaaactttggtgatcgtngccaagcagttgtccacaggccggggatga

SEQ ID NO: 5316 - DNA, 101 bp, rice(Oryza sativa)
  misc_feature (71): n=a or g
tctccagtggcgagagacatgatttaacgagagttgaacacaagatctagactctagaataaaaaaagacncgaatattagaaaatgatctaatataaaat

SEQ ID NO: 5317 - DNA, 101 bp, rice(Oryza sativa)
  misc_feature (71): n=t or g
cataagttcctttgaagtatgggttgttgttgaggtttaggatcctaggagcctcgagtgctgcctgcagntagcatcaatacacgaattagttatgaatc

SEQ ID NO: 5318 - DNA, 101 bp, rice(Oryza sativa)
  misc_feature (71): n=t or c
tcgaacttcttctttccagtaccctgaaacacacacggatcaaaattatacacatcatttgccactgaatngagaaatgctcagaggtcttccggctaact

SEQ ID NO: 5319 - DNA, 101 bp, rice(Oryza sativa)
  misc_feature (71): n=t or g
aggatatcataccttcgtaagcagtttcttatgccaaaccaaaatgtttcaataaattggttatatgagtntgtgattaaaaccagaacctcagttatatc

SEQ ID NO: 5320 - DNA, 101 bp, rice(Oryza sativa)
  misc_feature (71): n=a or g
ggctcatgataaactgatgctacaaaataacagctcaagaattaaaatgttaaatttcgcgatcaaagctnttaagaataaagagcaatgtattggggaat

SEQ ID NO: 5321 - DNA, 101 bp, rice(Oryza sativa)
  misc_feature (71): n=t or g
cttggcaggaatatggcatattgattaagcatgaaacatttcaagttactgtgcagtgtaaggtcgaattncatcatagaatgttccttataaatgcagaa

SEQ ID NO: 5322 - DNA, 101 bp, rice(Oryza sativa)
  misc_feature (71): n=t or c
ataagtatgatgaacaaacatgcaatttagctgaaaccgttcagaaaattgccagcagcaaacttcatagntgaaactacagtagtactgtttaccacaca

SEQ ID NO: 5323 - DNA, 101 bp, rice(Oryza sativa)
  misc_feature (71): n=t or g
tcttcaaccgatgctcccagctggcacaacaccaaaaaagaagatgatgaatttaaacatcattgaagganaattcaacttatgaacaaactacttgaaga

SEQ ID NO: 5324 - DNA, 101 bp, rice(Oryza sativa)
  misc_feature (71): n=t or g
agagctgtcgagtatatcacttcgctgtgtggcttctcgtccccactcgcttcaccccaaatccctcaacngcagcaagagagagaaagaagagagagaga

SEQ ID NO: 5325 - DNA, 101 bp, rice(Oryza sativa)
  misc_feature (71): n=t or c
ttgttgtagccggtgttgcaactcaacatgcccgataatgacatgcaaaactggcttgcacatctgcacangccatcccatttgtcaccaagcctgtgcat

SEQ ID NO: 5326 - DNA, 101 bp, rice(Oryza sativa)
  misc_feature (71): n=t or g
caaaaaaccctgaaggtttatagttttgcttactagctgcagctgctagctattgcagcagcagcaagttncagggagcaaatatactgtgatagaggcag

SEQ ID NO: 5327 - DNA, 101 bp, rice(Oryza sativa)
  misc_feature (71): n=a or c
tccctaaggttagggtcacttgggcttggtgcatctgggtctaccatcaccttcaggtacacaccacaaanaaccatgacaaacatcaaattaatgcattt

SEQ ID NO: 5328 - DNA, 101 bp, rice(Oryza sativa)
  misc_feature (71): n=a or g
gatccgatcccttcagtgttgtgttggcgaattagagtgtggtgccatcgatggggacatggtatgttgcngaatccaagcccaagccgacatatcatggc

SEQ ID NO: 5329 - DNA, 101 bp, rice(Oryza sativa)
  misc_feature (71): n=a or c
caggccacgacagcttgcataactcagttgatgaagccctcctgttaaaggtaaataacgctttacaaaanttcctactattagttaaatcaagagtaaaa

SEQ ID NO: 5330 - DNA, 101 bp, rice(Oryza sativa)
  misc_feature (71): n=a or g
ccagatttttgcagttttttaattggattgggggaagtggtcactttcgtggtgatctggagtaaatgtgncaacttatgtgttggaaatggagttgttca

SEQ ID NO: 5331 - DNA, 101 bp, rice(Oryza sativa)
  misc_feature (71): n=a or c
cgccggcgcggcggccgtggttggttaccctacctacgctactacacgcctcaggggcaatggaggctagngcggggctggcgatgcagtcgcgggcggct

SEQ ID NO: 5332 - DNA, 101 bp, rice(Oryza sativa)
  misc_feature (71): n=a or c
gttgagatctgtttatttatcccttcattttgttagacagtagcttttgtttggagaatgtttttccactnaaaagtactagtatgaactctaaaacattg

SEQ ID NO: 5333 - DNA, 101 bp, rice(Oryza sativa)
  misc_feature (71): n=t or c
aaacattctccaaacaaaagctactgtctaacaaaatgaagggataaataaacagatctcaacaagaaaanaaagatacttttctacttccaagctgcgat

SEQ ID NO: 5334 - DNA, 101 bp, rice(Oryza sativa)
  misc_feature (71): n=a or c
agatatctttctcatcaatggaggcgggtatagtaccagacagcacggtgatagatatgccaaattccagnatcctgacacctgctggagcaatcaatctc

SEQ ID NO: 5335 - DNA, 101 bp, rice(Oryza sativa)
  misc_feature (71): n=t or c
ccccatatatatgcctataagatagcgtctcatgagtcccatcagaaccatggaacagtaccatagctacngtcagatagagctgcagtggagaacatctg

SEQ ID NO: 5336 - DNA, 101 bp, rice(Oryza sativa)
  misc_feature (71): n=a or g
ggttttttaatatgctagaaaaaaatgtatgtgcactgctaggggagaaattaaatttatcatgaacatcntagtatttttttttaaaatgtacgacgcca

SEQ ID NO: 5337 - DNA, 101 bp, rice(Oryza sativa)
  misc_feature (71): n=a or g
tccgacggtggcggggagttatataatatatatttatgatgaattgtattcccctgcttttgttgaaacanagtgttctttcaatatctcattcactattc

SEQ ID NO: 5338 - DNA, 101 bp, rice(Oryza sativa)
  misc_feature (71): n=t or c
attatttgcccacagcccggcgctccattcttctccggccatgtcttaaccgtcatcgcgtctctggctcngcagggagagggagtacagggtcgccatca

SEQ ID NO: 5339 - DNA, 101 bp, rice(Oryza sativa)
  misc_feature (71): n=a or g
aaggaaaaggagtgcttgccacaagttggtcagtggaacatggtgaacaaggttagattccccgttttccncagctgtatacaacagacgtccttttatat

SEQ ID NO: 5340 - DNA, 101 bp, rice(Oryza sativa)
  misc_feature (71): n=t or c
agcttgagcttcttttggccatcctccctgacaacaatggttctttatatggtgagtgtcggtttggtaantgcatcgcaatttttccttggaatcctcat

SEQ ID NO: 5341 - DNA, 101 bp, rice(Oryza sativa)
  misc_feature (71): n=a or c
attttgggacggaggaagtactacactgcttgtggttgaaaagacaatatgaagtctcctcaaatacttantcacagaagacatggggaccagagtaacga

SEQ ID NO: 5342 - DNA, 101 bp, rice(Oryza sativa)
  misc_feature (71): n=a or g
gagcgtgtgcaccgtgcataactgcatcagcaaatgtaccaagtcagacaatttctatagagagaagctcngagtgcaaaggataaacttaacaagattca

SEQ ID NO: 5343 - DNA, 101 bp, rice(Oryza sativa)
  misc_feature (71): n=a or g
attaaagcttggttattagcaacatttcaaactgctcgtatcaaagaattgggggagatagtggcgtggcnaatagagctcctggacttacagaggcgact

SEQ ID NO: 5344 - DNA, 101 bp, rice(Oryza sativa)
  misc_feature (71): n=a or c
ttataacaggatttcttttgaaggaaatccttgagtctttataacagaatctttctggaatccgccttgtncttaacccttgagtctttgttacacccttt

SEQ ID NO: 5345 - DNA, 101 bp, rice(Oryza sativa)
  misc_feature (71): n=t or c
tgaaatttaaataaaaaaaatgtatatttccccttctgttacatgatatgctcttccactgaccataagancagtgccatgtgcaggtggatccaatttaa

SEQ ID NO: 5346 - DNA, 101 bp, rice(Oryza sativa)
  misc_feature (71): n=t or c
tcgagaccatcgtcgaccgcgccgccgtcccctggtgtgagtgatcggaaaagctcttcctcctccgtgcnctactttggaccgcttggaatttttgtgga

SEQ ID NO: 5347 - DNA, 101 bp, rice(Oryza sativa)
  misc_feature (71): n=a or g
tggagcaattggcagttgctgaacctggagcagcggctgctgaaggcgatgcgatgtcgaattcatcgtcngtggtagaggtcctctctcggtatttcttt

SEQ ID NO: 5348 - DNA, 101 bp, rice(Oryza sativa)
  misc_feature (71): n=a or g
tgacatcttcatgggtaaataaggttccaccttcttcgagctggagttctttggtatcggactctttttcnatcatatccccctgctgttctggactcagt

SEQ ID NO: 5349 - DNA, 101 bp, rice(Oryza sativa)
  misc_feature (71): n=t or g
aaaatccacataattctttttcaaaaaaaaacaaaatctaaataaaaaaatcaattcaagcctgccaggantgacctaacatgaaatctcccaggtagcaa

SEQ ID NO: 5350 - DNA, 101 bp, rice(Oryza sativa)
  misc_feature (71): n=t or g
cgatacatcctagtaggatgtgttgtggcaaaattttgggacgaatgaagtaataattaatttgaatggtngtgacaaaccgtaaaacaatatataggttt

SEQ ID NO: 5351 - DNA, 101 bp, rice(Oryza sativa)
  misc_feature (71): n=t or g
attccttttactatatcgtttgtataacattggtcagctgtgcatatacaagtatacaactctacttcacntcctatgaaggtaagatcatatcaggaatg

SEQ ID NO: 5352 - DNA, 101 bp, rice(Oryza sativa)
  misc_feature (71): n=a or g
gggcagaacaacaaaggaatctgctactctctcctgttgctgcctctgcaaggcagtagtagcatcaaganagagagaaagtgagagaggagatgattaga

SEQ ID NO: 5353 - DNA, 101 bp, rice(Oryza sativa)
  misc_feature (71): n=a or g
caacaaaaataaaacctacttgggattgattaattggtaaaacatgaaacttgagaacctcagtttatcanagagagagagagagagagagagagagagga

SEQ ID NO: 5354 - DNA, 101 bp, rice(Oryza sativa)
  misc_feature (71): n=a or g
tactccggccatctctaaaagagtgtatttttagctatgaatgaatctggataatactctttcagggacanagggagtatatataatatgatggtactagc

SEQ ID NO: 5355 - DNA, 101 bp, rice(Oryza sativa)
  misc_feature (71): n=t or c
ccggagtatcattatatgtctatagcatatacttctacttaacatatataaatacatactccctccgcccnaaaataagtgcagttttgcactattcacgt

SEQ ID NO: 5356 - DNA, 101 bp, rice(Oryza sativa)
  misc_feature (71): n=t or c
agctaggggaggaggggaaaggtagagtgagaaactgaaaatatgaggggttgggggagaatgggggatgntcattccttgatgagagagtgagagggggg

SEQ ID NO: 5357 - DNA, 101 bp, rice(Oryza sativa)
  misc_feature (71): n=a or g
ttctgctatgcgtaatagctaaatgaatatgtgcatattagtaaagttgaagttgaaatgtcttatctccngggctaatgatctgaactagcagttctatt

SEQ ID NO: 5358 - DNA, 101 bp, rice(Oryza sativa)
  misc_feature (71): n=t or g
accatgacaaggaacaaactttatatctggaccatgacaaagaacaaacttttaatgtgcttaaaataaanaatggttctaactataactaatataattga

SEQ ID NO: 5359 - DNA, 101 bp, rice(Oryza sativa)
  misc_feature (71): n=a or g
cggccatcggcaacctcccggcgctgcagacgctgtcgctggagtccaacaacttctccggagcgctgccnccggagatcggcaatctcaagaacctgtcc

SEQ ID NO: 5360 - DNA, 101 bp, rice(Oryza sativa)
  misc_feature (71): n=t or c
ggcccggttcccgccgggctcttcaacctcccgcaggccaacatggtggagctcaccgacaacctgctcancggcgagctcccggacgtgatcggcggcga

SEQ ID NO: 5361 - DNA, 101 bp, rice(Oryza sativa)
  misc_feature (71): n=a or g
ccctctctccgccacctcaacctctccaacaacaacctttccggccacttccccgtccccgactccggcgntggcgcctccccctacttcccctcgctcga

SEQ ID NO: 5362 - DNA, 101 bp, rice(Oryza sativa)
  misc_feature (71): n=t or c
tcatgcacacagagaagccctcagggaagaaaaatagtattaagcataagttggaactagaagttagatantatgcatatagttgcaaatttcaaagattt

SEQ ID NO: 5363 - DNA, 101 bp, rice(Oryza sativa)
  misc_feature (71): n=t or c
gatatcaggattgattgtagtgcattatgcctagaggttatagctcaacagcacattaccctcaagtgccnggtctggcactggtgttttctgcttgttct

SEQ ID NO: 5364 - DNA, 101 bp, rice(Oryza sativa)
  misc_feature (71): n=a or g
gatttagtttagatagaattgggctcatcatttggtgttacaatttaatttactttgtaataggaatccanggcatgcatcaattgctctataagtttaga

SEQ ID NO: 5365 - DNA, 101 bp, rice(Oryza sativa)
  misc_feature (71): n=a or c
aatggatatactccctgaaatcattgggacaattgattacttactaataatttctgttcactagtggctanttaaattacccattttttgacttgcgatta

SEQ ID NO: 5366 - DNA, 101 bp, rice(Oryza sativa)
  misc_feature (71): n=a or g
tggaggtggaggaggagggaaaaggggggggagggatggatgggacgtgagggagacgaagggtatcgcangtaaaaccatttttgtgctgcgtctccgcc

SEQ ID NO: 5367 - DNA, 101 bp, rice(Oryza sativa)
  misc_feature (71): n=a or c
tccttggtccaattgcgcatctaacaacacagcacgaaccaatccatcataaaccatcacaggccggtgantgaacctccccttagaacctaaagaatcac

SEQ ID NO: 5368 - DNA, 101 bp, rice(Oryza sativa)
  misc_feature (71): n=a or g
gctggagaatggtaggctacccctggagtccacatccacctgaagatttgatgttgactcttcacacactngccatttactattggaacaccacaggtgtt

SEQ ID NO: 5369 - DNA, 101 bp, rice(Oryza sativa)
  misc_feature (71): n=a or g
agtagatgaaagtgagagaagtataggaatagcaagcacatatcaaactgagaagagcaaagtactactanctgaaccttgcagcctcaatttcactgtca

SEQ ID NO: 5370 - DNA, 101 bp, rice(Oryza sativa)
  misc_feature (71): n=t or c
gatgctctatatttccatgaatgctcacgttagctctgaaatttcgaactttcactccataacatgctcanttaggctgtgtttagatccaaacttcagtt

SEQ ID NO: 5371 - DNA, 101 bp, rice(Oryza sativa)
  misc_feature (71): n=a or c
agaacagcggctgctacctgataatgggcgttctcagtggggacgaaggattcagagcaggacgcgctgcnttgcttctcccaagcctcaccgggtgagtc

SEQ ID NO: 5372 - DNA, 101 bp, rice(Oryza sativa)
  misc_feature (71): n=a or g
ttcaacttacattcagacagagcttgatctcagaaatgacttaacatgaacacaaaaaatattggatacanattcatctatttttctgtgacaaaatttac

SEQ ID NO: 5373 - DNA, 101 bp, rice(Oryza sativa)
  misc_feature (71): n=a or g
cacctgaccctgtgtaaatgtagattgttgagagactgaggaatcagatatcagaggtaaattttgtcacngaaaaatagatgaatctgtatccaatattt

SEQ ID NO: 5374 - DNA, 101 bp, rice(Oryza sativa)
  misc_feature (71): n=a or g
tattctccctacaaagagaactgctactggaattatttcttccagagaaacatatgtgctctcttaacatnagtcatgtgagtttattgtagtcaggagtg

SEQ ID NO: 5375 - DNA, 101 bp, rice(Oryza sativa)
  misc_feature (71): n=a or g
aaatgaatcaaacaaccaagtcgtcaagaagatgaaaagaacagaaactttcacatgttgcgagttcattntgccactgtgctcaatttcaacacaaaatt

SEQ ID NO: 5376 - DNA, 101 bp, rice(Oryza sativa)
  misc_feature (71): n=t or c
tacgcgaaaaaacaccaaacacgtataccgttacgcaccccgggctccaccttacgtggcagcatcagctngccggcggtgatggatggatggatgctcac

SEQ ID NO: 5377 - DNA, 101 bp, rice(Oryza sativa)
  misc_feature (71): n=a or g
ccatcggcaaggtggacctctcgtggaacgacctcgacttcgacctcagcaagctcgtcttcccgccgganctcacctacctggacctcagccacaaccgc

SEQ ID NO: 5378 - DNA, 101 bp, rice(Oryza sativa)
  misc_feature (71): n=a or c
atctttctttccgcccgtactgatgaagcacatgaattttttttcacctattattccattcctttttatanaaaaaaaaatggaagtgaacgtgttcacca

SEQ ID NO: 5379 - DNA, 101 bp, rice(Oryza sativa)
  misc_feature (71): n=t or g
gtttgcttaattgaaaaccataaacatggttatacttgaacagtatagctatgtcaatcagtttattgttntcctaaaaaatccatttcaagaaataaaca

SEQ ID NO: 5380 - DNA, 101 bp, rice(Oryza sativa)
  misc_feature (71): n=a or g
gagtagatgatcatacaaagaaagatgtgtgttagggataatgtcaatatcctagacaagaaataaaaaanggaacagaaggagtatttggtagcatagaa

SEQ ID NO: 5381 - DNA, 101 bp, rice(Oryza sativa)
  misc_feature (71): n=t or c
tatgctaacttgagttggtctatctactgctcaaggcaactcttaggtgaacaattggacacactaacaanaaaagaactccagcaattggaacatcaact

SEQ ID NO: 5382 - DNA, 101 bp, rice(Oryza sativa)
  misc_feature (71): n=a or c
gaccaaggactactcatcgatcagagagaaaaaaaaatgcagcagatatgcaaagatcgttacaagacagntatagaacagagaagctcaaggcgtcatta

SEQ ID NO: 5383 - DNA, 101 bp, rice(Oryza sativa)
  misc_feature (71): n=a or g
tattgatggtcctacttcaagtttgctttgtacagtatagtcgtgtagctagtgataagttctatcatttnagctataaatatctctgtctatactctata

SEQ ID NO: 5384 - DNA, 101 bp, rice(Oryza sativa)
  misc_feature (71): n=a or g
ctggcattgagaagctgggagcttgtttgagcttgtcagttagtgaaggatttctgaaccatagtggaacngaatcaattattgatggtcctacttcaagt

SEQ ID NO: 5385 - DNA, 101 bp, rice(Oryza sativa)
  misc_feature (71): n=t or c
tttcatttttatggaaagtagcttatggtggaatggattttcacctaattgaatgaactaaagtaaactgntgaaattgtggttcttctcagacatagtaa

SEQ ID NO: 5386 - DNA, 101 bp, rice(Oryza sativa)
  misc_feature (71): n=a or g
gcccaagaatcagatttgtcctgaacttttgacttgtgtactcatgtcagtaaactctaaactttcggtcntattcaggccatctttttctccaattctgg

SEQ ID NO: 5387 - DNA, 101 bp, rice(Oryza sativa)
  misc_feature (71): n=t or g
ggagctggagctgtgcgatttggggtcggtgagagatacggagatggatcgatgacgatggaggcagcccncgtggtgtcaggtgtggagtggtggtggga

SEQ ID NO: 5388 - DNA, 101 bp, rice(Oryza sativa)
  misc_feature (71): n=a or c
gcacaaaagtaactagtaccaatccaatagtgatttagtgactaggacctgccaactaacgaagcacacanacaatatacacttgttgttgcgcaccaatc

SEQ ID NO: 5389 - DNA, 101 bp, rice(Oryza sativa)
  misc_feature (71): n=a or g
catccatcaacaggcccataacaacggaataccacaaaggcaaccaaaaggctagtaatccagtcccatcntcaaggcacaaaagtaactagtaccaatcc

SEQ ID NO: 5390 - DNA, 101 bp, rice(Oryza sativa)
  misc_feature (71): n=t or c
aatggcatcttctatatactaaattaagtgaatcatgctgacaacatatgagaaaaatagatatttgaacngggacagaacaaatgagctgcattaacacg

SEQ ID NO: 5391 - DNA, 101 bp, rice(Oryza sativa)
  misc_feature (71): n=a or g
taacatattttacaactcttttctttactcagttggcatggcattataatcctcaacaatattttcatgcnagccgatcaaccagtacaagatctgctcaa

SEQ ID NO: 5392 - DNA, 101 bp, rice(Oryza sativa)
  misc_feature (71): n=t or g
ggaggggaaggagaaggagagggggaattttggtgtttagccccctccgtttattcctttttgcttttcgnattttttttcccttctttacaagttcatcg

SEQ ID NO: 5393 - DNA, 101 bp, rice(Oryza sativa)
  misc_feature (71): n=t or g
ttgcttgtccgctcactttttactctgagcatagcaactctggcaatataattaattttgactaaccttanaatgaatcatatgaaatagacctttttaat

SEQ ID NO: 5394 - DNA, 101 bp, rice(Oryza sativa)
  misc_feature (71): n=a or c
ccactccctgcaaaatataaaatacagtgaatatatagttgagaatttctaacacataaaaacagaaaaancaatctaacataaatatgactgtatattgt

SEQ ID NO: 5395 - DNA, 101 bp, rice(Oryza sativa)
  misc_feature (71): n=t or c
atcatgttagcaagatcagaagaagctggtttcagaacataatgatctgatgatatcacttctgtccaaanagttctgaaattaggtaacgtgacagttat

SEQ ID NO: 5396 - DNA, 101 bp, rice(Oryza sativa)
  misc_feature (71): n=a or c
attggagcatggctcttcctgtaacagatccaaccgcctgagggcaggtgcatccccatcacagtatctgngccacatgtttctgtatgcagattccagac

SEQ ID NO: 5397 - DNA, 101 bp, rice(Oryza sativa)
  misc_feature (71): n=a or c
aacaaccagaactcacaggatatcattattatttcagaataaccaggaaggccgcgccactcatggtaatnatgtatagctgaactgaacaaatagcatta

SEQ ID NO: 5398 - DNA, 101 bp, rice(Oryza sativa)
  misc_feature (71): n=t or g
gatgctccaactgactgcatattccattaaaatttcagtaacagcttgcatcatacaacttatgttaccancatactagaacaaacataaagtgttttgct

SEQ ID NO: 5399 - DNA, 101 bp, rice(Oryza sativa)
  misc_feature (71): n=a or c
acctattctggccaaaagaaccaggacccatagattgtggaacttgaagctgaccaatctgttgagcaggnccctgcaagggttgtcccagctgattattc

SEQ ID NO: 5400 - DNA, 101 bp, rice(Oryza sativa)
  misc_feature (71): n=t or c
atggaataatggcatttggggcaccagggttactagattgcactggctgaccctgtagtggaaacagaaanggttaaaaaaaatgtcagccgtaaaccaca

SEQ ID NO: 5401 - DNA, 101 bp, rice(Oryza sativa)
  misc_feature (71): n=a or g
tactgagggtaggtaggtatttttctcaccttcagtctcaacttttccaagcacgttcttgtgcagattgnatgccctaaatgttaccgagattaattctg

SEQ ID NO: 5402 - DNA, 101 bp, rice(Oryza sativa)
  misc_feature (71): n=t or g
aatatatacagtagtacttaaaaaagaagaagagaaaactagctctccaaagccccgcaaattctctcgcnctctctctctctctctctcccactcctctc

SEQ ID NO: 5403 - DNA, 101 bp, rice(Oryza sativa)
  misc_feature (71): n=a or g
ggagaaaaaccaccgaatcatcattcagtgcgataccgaaacgatccatcagttacgcattcgagagatantgctacacggagaaaccagaaaccaactcc

SEQ ID NO: 5404 - DNA, 101 bp, rice(Oryza sativa)
  misc_feature (71): n=a or g
taaaaacatagttgggcttataattttgagtccaacttttctgcgagttgttcttaaatattcttccacancttgcagaattctagttctgaaggtatggt

SEQ ID NO: 5405 - DNA, 101 bp, rice(Oryza sativa)
  misc_feature (71): n=t or g
tgagctgtatggctggctattaacaatatcttgttgaatgctttgcaggaaatggttgaaggtagtggtgngaaaaacttatgtgtgcttaccaggcattc

SEQ ID NO: 5406 - DNA, 101 bp, rice(Oryza sativa)
  misc_feature (71): n=t or c
gtgatgtatctgaagttcctaaaatcattagttttcatctaaagcagcaacagcttcagtacatgtatatncttcacaagtattacagttagacaatgttt

SEQ ID NO: 5407 - DNA, 101 bp, rice(Oryza sativa)
  misc_feature (71): n=a or g
agccatggcacggacactcaccacgcaatcctccacgtatcgcgtgaacttggcattcctcggttgaaccngcgcatccgcactggcctccgcctccgtgc

SEQ ID NO: 5408 - DNA, 101 bp, rice(Oryza sativa)
  misc_feature (71): n=t or c
ttatttagataagagtaatttcgaacatattacttcagaggcttataaacaccgtgttgaatcatgcctanggtatttaagcggcaatttattacatcgta

SEQ ID NO: 5409 - DNA, 101 bp, rice(Oryza sativa)
  misc_feature (71): n=t or c
aacagggtatgattattgctgagaatatgataattgttacaaaaggcagttatcaaataaatttgtcatangtaaacagcagtttctcgtacaaattgcag

SEQ ID NO: 5410 - DNA, 101 bp, rice(Oryza sativa)
  misc_feature (71): n=t or c
acggcgtcagtaagaaatattgaaagaagtgttattgggaaaaagaataccattatccaaattgtcatcantcaagtacaagttaatgatctcctcatttg

SEQ ID NO: 5411 - DNA, 101 bp, rice(Oryza sativa)
  misc_feature (71): n=a or g
tcgactgactgacaattggtctcccttctgtcttcccagtagtcctgctgctactgttgtacatgttccantaacatttctttcggccaatggatgtacat

SEQ ID NO: 5412 - DNA, 101 bp, rice(Oryza sativa)
  misc_feature (71): n=t or g
tccttttgttgttggtgctgttgttattattgttattgttattgctgcctattcgctcgccagtgatgaanaatagtcctgcctatatttgcctgtagtac

SEQ ID NO: 5413 - DNA, 101 bp, rice(Oryza sativa)
  misc_feature (71): n=t or g
tcgatctcttgatgccaattttttttttgagctggttgagtagtcgaactgggaacaattactgcttgagnctacaaaatttctggccgacaatacgtctt

SEQ ID NO: 5414 - DNA, 101 bp, rice(Oryza sativa)
  misc_feature (71): n=a or g
aatttcaccatatataagcatctacttttatctttttctctattttaaaatgtgatcatagtgaagttatntacattctatctgcttaacgctccacatta

SEQ ID NO: 5415 - DNA, 101 bp, rice(Oryza sativa)
  misc_feature (71): n=a or g
ggtcactgcatcccaattcccaatcaccaaccgttaaaatacacacaccattctttctacttaaacaaacngcagttccattatcagaggccagaagtgtt

SEQ ID NO: 5416 - DNA, 101 bp, rice(Oryza sativa)
  misc_feature (71): n=a or g
ctacgtcgtgcatggagaagatgcatcacaagaagccaacaaaaccaacgtcaaagccgctgaaggctacnagaaaattaagtcgagtatggttttcttcg

SEQ ID NO: 5417 - DNA, 101 bp, rice(Oryza sativa)
  misc_feature (71): n=t or c
aacaattttaatctctcagattggcatccatccatctgttacatatcaattaaatcgttataaaaaaaatnaaaatatttgataatatagattcacatata

SEQ ID NO: 5418 - DNA, 101 bp, rice(Oryza sativa)
  misc_feature (71): n=a or c
ctgctggctagctaggactaagagatccgagggagcagacatggctgctgctacttcgaccatgtccctgnttcctcccatcacccagcagcagcggtggc

SEQ ID NO: 5419 - DNA, 101 bp, rice(Oryza sativa)
  misc_feature (71): n=t or c
atacaacactcttcttctcacttaacccgctctctcttataatcaccaacctgcagcgagctgaactgacngagaagccaatccgcgaagctaccaaaccg

SEQ ID NO: 5420 - DNA, 101 bp, rice(Oryza sativa)
  misc_feature (71): n=a or c
tcaatataaggcacataccctgaataaaagtggagaacaatatctgctgaaatacccaaagttgggagcangaattgtcgatggaaccagcttagctgctg

SEQ ID NO: 5421 - DNA, 101 bp, rice(Oryza sativa)
  misc_feature (71): n=t or c
ttacattagagaacacgatatattcagtgattcttgataaccataaaatccctttaagattatggtgtttnctttaagtactgttaaaaaaaaaccaatag

SEQ ID NO: 5422 - DNA, 101 bp, rice(Oryza sativa)
  misc_feature (71): n=a or g
cccccttttttttgagtggaagagttttttttattgagaggtatcgagaagtactatatttttcgtgtaanctagccaaatatcagtgcgttgcaacttgc

SEQ ID NO: 5423 - DNA, 101 bp, rice(Oryza sativa)
  misc_feature (71): n=t or g
gaataaaaattttgtaaaaatatttatgacgcaacacaattcgatactaatatagaagctcaaaggttatngcctaaaagagaatgtaatgtttggagcct

SEQ ID NO: 5424 - DNA, 101 bp, rice(Oryza sativa)
  misc_feature (71): n=t or c
gaccaggttgaccgcgagaggaactggtatgccaaacaccataaaattacgtacaacccacgcggtgtgtncgtggcggctagcttcaccttcgagattaa

SEQ ID NO: 5425 - DNA, 101 bp, rice(Oryza sativa)
  misc_feature (71): n=t or g
tgaagaagaatcaggcatgcgattactacaatttgtatcggcgatcaccagttaaaacctgtatcgtttgnatgccctaattgccagcaatacttctgtac

SEQ ID NO: 5426 - DNA, 101 bp, rice(Oryza sativa)
  misc_feature (71): n=t or g
atctactaggtgcatgggtagtctaaaaatatgagttctgtatgtaaactatgcagaatctgttcatgctntattaatctgctgtgcacatatgcccagtt

SEQ ID NO: 5427 - DNA, 101 bp, rice(Oryza sativa)
  misc_feature (71): n=a or g
atagtttacatacagaactcatatttttagactacccatgcacctagtagatttaagctaaggtttacttnatgataaccaacaaaataaatgataatgct

SEQ ID NO: 5428 - DNA, 101 bp, rice(Oryza sativa)
  misc_feature (71): n=t or c
aaaccacgttattattaatgtttttaagtcatgtataagccaattcatgctggtggacaaacccaactggnagaaagggctttttatctatttgtatgtcg

SEQ ID NO: 5429 - DNA, 101 bp, rice(Oryza sativa)
  misc_feature (71): n=t or c
tcaatgcccagagagagactgcagccaggaggcgctgagaaatgcagctccaattgtcccaaaattacgantctctgaaatcaaaccttttctgccatatt

SEQ ID NO: 5430 - DNA, 101 bp, rice(Oryza sativa)
  misc_feature (71): n=a or g
tttttttttccatcttattcattgagtttctccttgtgaataaacaactgtaccactttccgattgaaggncgcgaggtcataagctatgagagtccaaag

SEQ ID NO: 5431 - DNA, 101 bp, rice(Oryza sativa)
  misc_feature (71): n=t or c
agttgaggtccaagggggtgacctgcgatctttcttcacattggtgcggagcactcaacttcatagttggnttacgatttttttccctggttaaccataac

SEQ ID NO: 5432 - DNA, 101 bp, rice(Oryza sativa)
  misc_feature (71): n=a or g
tcattgttttttttagatttgctctggtccaacaaaaaatacctaaagatacagatacttgtacctcacantattaaatagttttcgatcattgcattgtt

SEQ ID NO: 5433 - DNA, 101 bp, rice(Oryza sativa)
  misc_feature (71): n=t or c
atggcgaaacatctcgagcctgaagccatttctcggaatccaaaccaagcttcctgtcaacaacatccatnagtctaccatgtagacccggttcaacgtac

SEQ ID NO: 5434 - DNA, 101 bp, rice(Oryza sativa)
  misc_feature (71): n=a or g
atattgtcccagtctccaaatttgatccatatccgccaagtctttcatcatctttttctttcttttttatnagcaaaaatcatctttttctttcaaagttc

SEQ ID NO: 5435 - DNA, 101 bp, rice(Oryza sativa)
  misc_feature (71): n=t or c
acaaatcaccatatatagtaccatgcatatagtttgaaataaatcttacaattttatttcgtaatctgagnagatgataactgaaaaaagtaagcaagtct

SEQ ID NO: 5436 - DNA, 101 bp, rice(Oryza sativa)
  misc_feature (71): n=t or c
ataaaattgtgcagaagaaaggtagccattggaatgcatgctgtctctagctgcaagaactgtgttgaagngaacacaagaacggaatgaaatgagtatac

SEQ ID NO: 5437 - DNA, 101 bp, rice(Oryza sativa)
  misc_feature (71): n=a or c
tggtaattgaatgttcatgtgaaaatggtattttatatatagttgtttaccttcctggctctgatctttgnaatgcctttctccaggcggctttcaagttg

SEQ ID NO: 5438 - DNA, 101 bp, rice(Oryza sativa)
  misc_feature (71): n=a or g
tgcgccgccacggcctgcacctgcgccgccgcctcgaacaggttcaacgggaagaagcacttcatgtccanctgcgccgccgccaccgcgaacggattctg

SEQ ID NO: 5439 - DNA, 101 bp, rice(Oryza sativa)
  misc_feature (71): n=t or c
tgaaagctacattaaacaaggtgcccttcctagttaactatataagtgccatatatatactagacaaagangataaaagaagtcattatcaacggaggaag

SEQ ID NO: 5440 - DNA, 101 bp, rice(Oryza sativa)
  misc_feature (71): n=a or g
ccctaacacttggatcaaagaacgaaaggtgtatgcactatagtatcctttatatattgcacaagtcaagncatttgttaaaacacacccagtgctagtaa

SEQ ID NO: 5441 - DNA, 101 bp, rice(Oryza sativa)
  misc_feature (71): n=t or c
ccaaaagtttgacatcaaacattaaaaacaagagagagtatttgcttaggagtacgtgtctttttccatgnctaagaacaggtacaatagcaggttataag

SEQ ID NO: 5442 - DNA, 101 bp, rice(Oryza sativa)
  misc_feature (71): n=a or g
ttctactagtagtagaaataatgtactagtagtttagtcgcctaaaaaaaataacaagggtatgaaacatntactttcatttacatttaataattaaaaat

SEQ ID NO: 5443 - DNA, 101 bp, rice(Oryza sativa)
  misc_feature (71): n=a or c
ctccggcggctgcagcagcagcgagtcgagcttgctcgtcagggaccgcatgatgacaccctgcgatgcantgaccgccggcgccatggatggagacctct

SEQ ID NO: 5444 - DNA, 101 bp, rice(Oryza sativa)
  misc_feature (71): n=t or c
cggtggcacaccagtggcagaacttaaaggaatccgcagcccttgtatctctgagagggcatacagccctngtatcaccgagttgaggcatgaccgcagcc

SEQ ID NO: 5445 - DNA, 101 bp, rice(Oryza sativa)
  misc_feature (71): n=a or g
agatatacataaacattctcatagactcatacttgatacttgatcataagacatcatataaccgtacgccntagttatacagaaatcattagtatagctga

SEQ ID NO: 5446 - DNA, 88 bp, rice(Oryza sativa); identical to SEQ ID NO: 4432
  misc_feature (71): n=- or a

SEQ ID NO: 5447 - DNA, 89 bp, rice(Oryza sativa); identical to SEQ ID NO: 4433
  misc_feature (71): n=- or c

SEQ ID NO: 5448 - DNA, 84 bp, rice(Oryza sativa); identical to SEQ ID NO: 4434
  misc_feature (71): n=- or c

SEQ ID NO: 5449 - DNA, 86 bp, rice(Oryza sativa); identical to SEQ ID NO: 4435
  misc_feature (71): n=- or g

SEQ ID NO: 5450 - DNA, 86 bp, rice(Oryza sativa); identical to SEQ ID NO: 4436
  misc_feature (71): n=- or t

SEQ ID NO: 5451 - DNA, 90 bp, rice(Oryza sativa); identical to SEQ ID NO: 4437
  misc_feature (71): n=- or c

SEQ ID NO: 5452 - DNA, 82 bp, rice(Oryza sativa); identical to SEQ ID NO: 4438
  misc_feature (71): n=- or a

SEQ ID NO: 5453 - DNA, 71 bp, rice(Oryza sativa); identical to SEQ ID NO: 4439
  misc_feature (71): n=t or c

SEQ ID NO: 5454 - DNA, 71 bp, rice(Oryza sativa); identical to SEQ ID NO: 4440
  misc_feature (1): n=t or g

SEQ ID NO: 5455 - DNA, 141 bp, rice(Oryza sativa); identical to SEQ ID NO: 4441
  misc_feature (71): n=t or c

SEQ ID NO: 5456 - DNA, 71 bp, rice(Oryza sativa); identical to SEQ ID NO: 4442
  misc_feature (71): n=t or g

SEQ ID NO: 5457 - DNA, 141 bp, rice(Oryza sativa); identical to SEQ ID NO: 4443
  misc_feature (71): n=t or g

SEQ ID NO: 5458 - DNA, 141 bp, rice(Oryza sativa); identical to SEQ ID NO: 4444
  misc_feature (71): n=a or c

SEQ ID NO: 5459 - DNA, 141 bp, rice(Oryza sativa); identical to SEQ ID NO: 4445
  misc_feature (71): n=t or g

SEQ ID NO: 5460 - DNA, 75 bp, rice(Oryza sativa); identical to SEQ ID NO: 4446
  misc_feature (5): n=a or t

SEQ ID NO: 5461 - DNA, 141 bp, rice(Oryza sativa); identical to SEQ ID NO: 4447
  misc_feature (71): n=t or c

SEQ ID NO: 5462 - DNA, 71 bp, rice(Oryza sativa); identical to SEQ ID NO: 4448
  misc_feature (71): n=a or c

SEQ ID NO: 5463 - DNA, 71 bp, rice(Oryza sativa); identical to SEQ ID NO: 4449
  misc_feature (71): n=t or c

SEQ ID NO: 5464 - DNA, 141 bp, rice(Oryza sativa); identical to SEQ ID NO: 4450
  misc_feature (71): n=t or g

SEQ ID NO: 5465 - DNA, 71 bp, rice(Oryza sativa); identical to SEQ ID NO: 4451
  misc_feature (1): n=a or g

SEQ ID NO: 5466 - DNA, 71 bp, rice(Oryza sativa); identical to SEQ ID NO: 4452
  misc_feature (71): n=t or g

SEQ ID NO: 5467 - DNA, 141 bp, rice(Oryza sativa); identical to SEQ ID NO: 4453
  misc_feature (71): n=a or t

SEQ ID NO: 5468 - DNA, 141 bp, rice(Oryza sativa); identical to SEQ ID NO: 4454
  misc_feature (71): n=a or t

SEQ ID NO: 5469 - DNA, 141 bp, rice(Oryza sativa); identical to SEQ ID NO: 4455
  misc_feature (71): n=a or t

SEQ ID NO: 5470 - DNA, 141 bp, rice(Oryza sativa); identical to SEQ ID NO: 4456
  misc_feature (71): n=t or c

SEQ ID NO: 5471 - DNA, 71 bp, rice(Oryza sativa); identical to SEQ ID NO: 4457
  misc_feature (1): n=a or g

SEQ ID NO: 5472 - DNA, 141 bp, rice(Oryza sativa); identical to SEQ ID NO: 4458
  misc_feature (71): n=a or c

SEQ ID NO: 5473 - DNA, 71 bp, rice(Oryza sativa); identical to SEQ ID NO: 4459
  misc_feature (1): n=t or g

SEQ ID NO: 5474 - DNA, 71 bp, rice(Oryza sativa); identical to SEQ ID NO: 4460
  misc_feature (1): n=a or g

SEQ ID NO: 5475 - DNA, 71 bp, rice(Oryza sativa); identical to SEQ ID NO: 4461
  misc_feature (1): n=a or c

SEQ ID NO: 5476 - DNA, 141 bp, rice(Oryza sativa); identical to SEQ ID NO: 4462
  misc_feature (71): n=a or c

SEQ ID NO: 5477 - DNA, 141 bp, rice(Oryza sativa); identical to SEQ ID NO: 4463
  misc_feature (71): n=t or c

SEQ ID NO: 5478 - DNA, 141 bp, rice(Oryza sativa); identical to SEQ ID NO: 4464
  misc_feature (71): n=a or g

SEQ ID NO: 5479 - DNA, 141 bp, rice(Oryza sativa); identical to SEQ ID NO: 4465
  misc_feature (71): n=a or g

SEQ ID NO: 5480 - DNA, 71 bp, rice(Oryza sativa); identical to SEQ ID NO: 4466
  misc_feature (71): n=t or g

SEQ ID NO: 5481 - DNA, 74 bp, rice(Oryza sativa); identical to SEQ ID NO: 4467
  misc_feature (71): n=c or g

SEQ ID NO: 5482 - DNA, 71 bp, rice(Oryza sativa); identical to SEQ ID NO: 4468
  misc_feature (71): n=a or g

SEQ ID NO: 5483 - DNA, 71 bp, rice(Oryza sativa); identical to SEQ ID NO: 4469
  misc_feature (1): n=t or c

SEQ ID NO: 5484 - DNA, 71 bp, rice(Oryza sativa); identical to SEQ ID NO: 4470
  misc_feature (1): n=t or c

SEQ ID NO: 5485 - DNA, 71 bp, rice(Oryza sativa)
  misc_feature (71): n=t or c
tctgacacctgcaatctccttatgattcgcatatttcagtgaccatttgccgattccatctcagatatctn

SEQ ID NO: 5486 - DNA, 71 bp, rice(Oryza sativa); identical to SEQ ID NO: 4471
  misc_feature (1): n=a or g

SEQ ID NO: 5487 - DNA, 71 bp, rice(Oryza sativa); identical to SEQ ID NO: 4472
  misc_feature (1): n=a or g

SEQ ID NO: 5488 - DNA, 73 bp, rice(Oryza sativa); identical to SEQ ID NO: 4473
  misc_feature (71): n=a or t

SEQ ID NO: 5489 - DNA, 141 bp, rice(Oryza sativa); identical to SEQ ID NO: 4474
  misc_feature (71): n=a or c

SEQ ID NO: 5490 - DNA, 71 bp, rice(Oryza sativa); identical to SEQ ID NO: 4475
  misc_feature (71): n=t or c

SEQ ID NO: 5491 - DNA, 71 bp, rice(Oryza sativa); identical to SEQ ID NO: 4476
  misc_feature (1): n=t or c

SEQ ID NO: 5492 - DNA, 71 bp, rice(Oryza sativa); identical to SEQ ID NO: 4477
  misc_feature (71): n=t or g

SEQ ID NO: 5493 - DNA, 141 bp, rice(Oryza sativa); identical to SEQ ID NO: 4478
  misc_feature (71): n=t or g

SEQ ID NO: 5494 - DNA, 71 bp, rice(Oryza sativa); identical to SEQ ID NO: 4479
  misc_feature (71): n=t or c

SEQ ID NO: 5495 - DNA, 74 bp, rice(Oryza sativa); identical to SEQ ID NO: 4480
  misc_feature (71): n=c or g

SEQ ID NO: 5496 - DNA, 76 bp, rice(Oryza sativa); identical to SEQ ID NO: 4481
  misc_feature (6): n=a or t

SEQ ID NO: 5497 - DNA, 141 bp, rice(Oryza sativa); identical to SEQ ID NO: 4482
  misc_feature (71): n=t or c

SEQ ID NO: 5498 - DNA, 141 bp, rice(Oryza sativa); identical to SEQ ID NO: 4483
  misc_feature (71): n=t or c

SEQ ID NO: 5499 - DNA, 141 bp, rice(Oryza sativa); identical to SEQ ID NO: 4484
  misc_feature (71): n=c or g

SEQ ID NO: 5500 - DNA, 141 bp, rice(Oryza sativa); identical to SEQ ID NO: 4485
  misc_feature (71): n=t or c

SEQ ID NO: 5501 - DNA, 141 bp, rice(Oryza sativa); identical to SEQ ID NO: 4486
  misc_feature (71): n=a or c

SEQ ID NO: 5502 - DNA, 141 bp, rice(Oryza sativa); identical to SEQ ID NO: 4487
  misc_feature (71): n=a or g

SEQ ID NO: 5503 - DNA, 141 bp, rice(Oryza sativa); identical to SEQ ID NO: 4488
  misc_feature (71): n=a or c

SEQ ID NO: 5504 - DNA, 141 bp, rice(Oryza sativa); identical to SEQ ID NO: 4489
  misc_feature (71): n=a or c

SEQ ID NO: 5505 - DNA, 65 bp, rice(Oryza sativa)
  misc_feature (52): n=a or g
aggagtgcgtgtcggagttcatcagcttcgttacaggcgaggcctccgacantgccagcgcgaga

SEQ ID NO: 5506 - DNA, 101 bp, rice(Oryza sativa)
  misc_feature (71): n=a or g
gtgcgagctccatcctcgcgcctgcaggaccaaaaaaaaaatcgccatcgtgagggtaagagcatcccganaggccaatcggttgagccggcgagcggcgg

SEQ ID NO: 5507 - DNA, 101 bp, rice(Oryza sativa)
  misc_feature (71): n=a or c
ccaaatccggctacacaaacgaaaccccacattccccgacacgattcaaaccaccaccaacgaacctcttnttcgccggcgacgacgatgtccaaggccgc

SEQ ID NO: 5508 - DNA, 101 bp, rice(Oryza sativa)
  misc_feature (71): n=a or g
ccatgcaaattacttcgagattctttacaaggggcttaatctcgctttgtcttggcaggttgtggtggtgntggtgaggagcgagttgtagaggaggaggg

SEQ ID NO: 5509 - DNA, 101 bp, rice(Oryza sativa)
  misc_feature (71): n=a or c
cgaccaacacaaaaatccacaccggccgcggctcttctcctgctcaatctaactcctcaagaaaaaaaacntgagacacaacgagatcgagaaacatgtga

SEQ ID NO: 5510 - DNA, 101 bp, rice(Oryza sativa)
  misc_feature (71): n=t or g
ggtacagccatagaaacttctaagcatgaagagaatggcaatattgcttctaccactgttcactaattcantgatagaaactgcatgaagagtatatgtat

SEQ ID NO: 5511 - DNA, 101 bp, rice(Oryza sativa)
  misc_feature (71): n=a or c
taaagaactacaactagcaatttcagtgataactatactccaaactttgtcacatagtaactagagatgcnacaccaatattttcttttgactcagacatc

SEQ ID NO: 5512 - DNA, 101 bp, rice(Oryza sativa)
  misc_feature (71): n=t or c
ccactaccacaaggtgaagaagcttttcagctgcacagccgccatcatcgtcatcatcaatcagagctcanagctgaaaaaggctgggggaggagaaagaa

SEQ ID NO: 5513 - DNA, 101 bp, rice(Oryza sativa)
  misc_feature (71): n=a or c
catgggagtatacccggtgatgataactgatgatatatcaggagtggcgatggaaggcaacggaggcagcngcgacagccaccacccctctctctctctcc

SEQ ID NO: 5514 - DNA, 101 bp, rice(Oryza sativa)
  misc_feature (71): n=t or c
attagtaggaagaatctggttataaaatgtcaggaagcaaaagcacacatacaatatatttagcctcctcnggtgaggagcataggctggggagaaggctg

SEQ ID NO: 5515 - DNA, 101 bp, rice(Oryza sativa)
  misc_feature (71): n=a or g
tacattttttattgttataccaaggcagcacttcttgagatggaacagcttacattgacatcgtgttatcncaccaacacgaacttgcgaccaagtttcat

SEQ ID NO: 5516 - DNA, 101 bp, rice(Oryza sativa)
  misc_feature (71): n=t or g
ggtggtgagaggagacatggccatggcttttttggggggtttgggtttctgtgggttgtgtcaccttttcnatctcctatgtgtgttggcgtgctagtgtt

SEQ ID NO: 5517 - DNA, 101 bp, rice(Oryza sativa)
  misc_feature (71): n=t or c
tcaaaagaaggagatagcgcagaatcgtgctgcaaaggctgctctggataaattaaaggagacattggganaatcccaaactgaaccaatgtcagcagaag

SEQ ID NO: 5518 - DNA, 101 bp, rice(Oryza sativa)
  misc_feature (71): n=t or g
aatcaagcttcgttggtccatcgcagtgaactttcggagagcaaggagacacatggcagattttcggagangagaagcttaatttataggacgccacatgg

SEQ ID NO: 5519 - DNA, 101 bp, rice(Oryza sativa)
  misc_feature (71): n=t or c
ggagcagcactacataaaaagggcaggaggggatgatgcgggcgctacaaagtgcttcacatctttgcctngttcgtcctccggttttctccgcagtttct

SEQ ID NO: 5520 - DNA, 101 bp, rice(Oryza sativa)
  misc_feature (71): n=t or c
ccaccgtttcgcatcgcggattaactgtgttgctggaggcaggcaaggcatatgctgcgattccacgtttntttcttctcccaaataaaaaggcgtcttcg

SEQ ID NO: 5521 - DNA, 101 bp, rice(Oryza sativa)
  misc_feature (71): n=t or c
tgttgaaaaatcatacaaagggaaaatagaagaacaattaaatcaatcaaggagaatcttatactcccttngtcccaaaatataagcatttttggactatg

SEQ ID NO: 5522 - DNA, 101 bp, rice(Oryza sativa)
  misc_feature (71): n=t or c
aatgtgttgcccaaaaaattaagcaagataactatgacagtacaatcagtggatagagctacctgagaatnatatctggatcagtggcaacttcaccatct

SEQ ID NO: 5523 - DNA, 101 bp, rice(Oryza sativa)
  misc_feature (71): n=a or g
gagagcagttgtgtgtatgcaccaaacactaagctatggcaaattcttaactatctctctggtcagcttcnatcgatgctaagctagctacctttgtgctt

SEQ ID NO: 5524 - DNA, 101 bp, rice(Oryza sativa)
  misc_feature (71): n=t or c
ccagtttttcttttcccccactactttcatttcctttccttcgacctggagcaggggagctgcttgtttgntggctctggctcggtctggatggtggcgcc

SEQ ID NO: 5525 - DNA, 101 bp, rice(Oryza sativa)
  misc_feature (71): n=a or c
tatagtagcgaaaaattacatggttacaaccctaagagattataaccaacaccactacctgctattagctnctcatataaccgaaaataaactgacaccga

SEQ ID NO: 5526 - DNA, 101 bp, rice(Oryza sativa)
  misc_feature (71): n=a or g
aggcaggatctcctttttagagtcgatttcgaatttatgagttatttgtggtgatttggttggtgttggcngaaatctgggatggtcatgatgggaacaga

SEQ ID NO: 5527 - DNA, 101 bp, rice(Oryza sativa)
  misc_feature (71): n=t or g
ttatctttgatagaaacctccaaatatgataagtttcctgttaaccatgctatctatattggggtgggttnaagaatcaaataacaaacatcctcttctcc

SEQ ID NO: 5528 - DNA, 101 bp, rice(Oryza sativa)
  misc_feature (71): n=t or g
ccggatagatatgggagcaagacaacaggtgatgatgagaactggaacacaagctaagctacatgttcaangatactcaggtacctcgctctgccaacaag

SEQ ID NO: 5529 - DNA, 101 bp, rice(Oryza sativa)
  misc_feature (71): n=a or g
tccttgtctattagagactgttgccactcaatccattcctgtaattgaggacagttcgtgataatacattnctgaagctgctgttgaagtggttgtaaagg

SEQ ID NO: 5530 - DNA, 101 bp, rice(Oryza sativa)
  misc_feature (71): n=a or c
aaagcatgcgtgtgttagtgatatgttactactatataaacccctagcatagagtgccaaaggccattgcngcagcagcagcagcacaaatcaagtgatcc

SEQ ID NO: 5531 - DNA, 101 bp, rice(Oryza sativa)
  misc_feature (71): n=t or c
ctgcttataaaaaggcagtgctgcacggtggtgagcgtacctagctagagcatagagaagcaggaaagttntggagatcgatcgatggcacagcagcaagc

SEQ ID NO: 5532 - DNA, 101 bp, rice(Oryza sativa)
  misc_feature (71): n=t or g
ctacatggctttccaaatgtgaagttcagctttcgtgtattagagatatgcttcagctcgatccttctatnctgatatgattgcatttgattttcctgaca

SEQ ID NO: 5533 - DNA, 101 bp, rice(Oryza sativa)
  misc_feature (71): n=t or c
taataatagtcaaccacaggttcatgctaccagcatccaagcaccaagacaataccagaattatactcganaacgcccggccagaaactacaatcaccaag

SEQ ID NO: 5534 - DNA, 101 bp, rice(Oryza sativa)
  misc_feature (71): n=t or c
ccgcaccgccccaccatcacatcgcccgcgtgagattgctacccaaaaatcctcacctccgacgacgaatngaggaggaggggagagagagctcaaaaacc

SEQ ID NO: 5535 - DNA, 101 bp, rice(Oryza sativa)
  misc_feature (71): n=t or c
ccataccttgagcttcgcccaagttgccaagctcaagtttttggagtttttcttagggtgctttcctctangagagtttatcaatattcaatttattaatc

SEQ ID NO: 5536 - DNA, 101 bp, rice(Oryza sativa)
  misc_feature (71): n=a or g
atccatgatcactgaagcttcttgattcaggccagatacctgcatcaattgcatatgttttccaatttacncattaaggattttgcaagaatttgtatggc

SEQ ID NO: 5537 - DNA, 101 bp, rice(Oryza sativa)
  misc_feature (71): n=t or c
gctgatagttggatatcagtcccaaggtcccaaacacgcttttgcaagtgaatccatttcactatgaattnccaagcataacgaataagctacaactcggt

SEQ ID NO: 5538 - DNA, 101 bp, rice(Oryza sativa)
  misc_feature (71): n=a or c
ctcccaccacgctgaggaaagcaacaagcaccaccaccaatctctaccaaaccaaaagtagaagaacacantcacacacacacaaaaaaaaaaagaggaag

SEQ ID NO: 5539 - DNA, 101 bp, rice(Oryza sativa)
  misc_feature (71): n=a or g
tgcaaggtgactaccgctaccttgttttgttgaggtgtaacgaagacattagtgttgtcgactcgagtctnaagcattctattgtgagaggcacgtccagc

SEQ ID NO: 5540 - DNA, 101 bp, rice(Oryza sativa)
  misc_feature (71): n=t or c
caaattaaaccgtattttattaccatcacacgcagcccccttttcccgtggcaataatacaatcctctatncctctctcatgtctgccttttgagcacata

SEQ ID NO: 5541 - DNA, 101 bp, rice(Oryza sativa)
  misc_feature (71): n=t or c
ggggggtttgaattccgtttccagatctgcgcgtgcttggagcttttcgtgcggttcttcttctttttttngatcgggatttgggagggaggcccgttatc

SEQ ID NO: 5542 - DNA, 101 bp, rice(Oryza sativa)
  misc_feature (71): n=t or g
agcttgaaggatgaattgaagcttcgcttttcttgagctatggtgtttctttgggttttcttcttcgcagngaggtgaccaggcgctgtacaacgggttcg

SEQ ID NO: 5543 - DNA, 101 bp, rice(Oryza sativa)
  misc_feature (71): n=a or g
tcatatgccgcatggaatcttcaccaaccatgtgcattgttcttcatcccacatgatatctcgatcgtctngagtttattttctcccaagcttactcccaa

SEQ ID NO: 5544 - DNA, 101 bp, rice(Oryza sativa)
  misc_feature (71): n=a or g
tgctgtttgtcatgcgtcaatgtgtggtgactgcaaactaccagtgatttgatatgttccagatctgaatnactgttctcatcaccatcatagttcacaac

SEQ ID NO: 5545 - DNA, 101 bp, rice(Oryza sativa)
  misc_feature (71): n=a or g
cccatctccctcttctctactctctcaactctcaactcccttacttctcgaccgtgctgcaagaacttcanttcaattcctcttgagagagagagagagag

SEQ ID NO: 5546 - DNA, 101 bp, rice(Oryza sativa)
  misc_feature (71): n=t or c
cctcttgcttggctgccaaagctgttgctgcttcttgttccattgctctcctcactcttctctgttcttgngaaatctgtgctagtgcagccaaaggggcg

SEQ ID NO: 5547 - DNA, 101 bp, rice(Oryza sativa)
  misc_feature (71): n=t or g
tcatggttgaaacaacaaccaggctgtgcagttgagggggggaaaaagcagcagtagcagttccaatcctnttttgcaagtttatttcatctgcaacattg

SEQ ID NO: 5548 - DNA, 101 bp, rice(Oryza sativa)
  misc_feature (71): n=a or g
ccttttatcacttcctgagagagcacggcacgctttactcccttttattctggaaatattgttctcttccntgggttacagtttgtgtttcgatacagctt

SEQ ID NO: 5549 - DNA, 101 bp, rice(Oryza sativa)
  misc_feature (71): n=a or g
gaaggcggtgggggctggagaagcttgtcggctcattctactgccctcgacaaacgctactgagctcatcnttgttcccccgtgccgcaccgttgaactca

SEQ ID NO: 5550 - DNA, 101 bp, rice(Oryza sativa)
  misc_feature (71): n=t or c
tctccatcgtagacgcccttatggcggtgatcatgaacaaacccgattttgttcattattcaaccgcaccnacttgctcacagatgcctcagcttccaaat

SEQ ID NO: 5551 - DNA, 101 bp, rice(Oryza sativa)
  misc_feature (71): n=t or c
gtgaagcacggccggctataccttctcccgttggtacaccgtacacactgtataaaagcgatcgcatactngtagcgggggccgatcccgaggagagagga

SEQ ID NO: 5552 - DNA, 101 bp, rice(Oryza sativa)
  misc_feature (71): n=a or g
gtctctgcttcgatccactttgtgaacttatcgattgccacgaacaagaacttattgccacctcgtccctntgggaatgacccgagtatatcgagccccca

SEQ ID NO: 5553 - DNA, 101 bp, rice(Oryza sativa)
  misc_feature (71): n=t or c
cctactagtagcttctctctctctctcttcttcttcctcgctttgcttgggttgggttggagcggtgagangagagattgaggggaggagaggagaggaca

SEQ ID NO: 5554 - DNA, 101 bp, rice(Oryza sativa)
  misc_feature (71): n=t or g
ttgtggtgagattaaaatggtaatccaaggcgtttgggatgtctttagcatagggaaatacacctctattncatcttaaccactcaccaatggttccctgt

SEQ ID NO: 5555 - DNA, 101 bp, rice(Oryza sativa)
  misc_feature (71): n=t or c
acctcacctcaccaaggagggatgagatcttcttactagtaatataaaggcgaggcgcgagggtgcgtacnacccacgaccagaagaagtttctagtagcg

SEQ ID NO: 5556 - DNA, 101 bp, rice(Oryza sativa)
  misc_feature (71): n=t or c
aatggaggacgagatgagctccatccgtggaaatgaaacctgggagtttgcaaggcttccagaagggcatngagccattgggcttaagtgggtttttaaag

SEQ ID NO: 5557 - DNA, 101 bp, rice(Oryza sativa)
  misc_feature (71): n=a or g
ctccttggcgagggtcagaacaagcttgattacgtgcttgcactcactgttgagaacttcctctagcgccncctctagaccatcgtcttcaagaatggcat

SEQ ID NO: 5558 - DNA, 101 bp, rice(Oryza sativa)
  misc_feature (71): n=a or g
agtgtgcacgcagaggacttggatgtcatggcaatcgaccaagcaagactgggtgaagatccagcagactngcgaaccccattcgtaaaatacttcaagag

SEQ ID NO: 5559 - DNA, 101 bp, rice(Oryza sativa)
  misc_feature (71): n=a or g
aaatccacacgcctcagatccacggcgagcaccccctttcacccacgaaatttaccatcccagcttcccancccagcgcgagcagcagcgtccacaaccag

SEQ ID NO: 5560 - DNA, 101 bp, rice(Oryza sativa)
  misc_feature (71): n=t or c
caagggctgttttccgagttcactagaagtactacatgtttatgaaagccaaagcgaagagctcaaaaggnagtgccgcaagctaaaaggaacaattgcaa

SEQ ID NO: 5561 - DNA, 101 bp, rice(Oryza sativa)
  misc_feature (71): n=a or g
gggaccgacacccacatcgtatctcccttgcatatcaatcgactcaccactccaatctaattcatccttcntgcgggaaattaactcctcaaatgtgggtt

SEQ ID NO: 5562 - DNA, 101 bp, rice(Oryza sativa)
  misc_feature (71): n=a or g
cgacacgtatgatttgtgtggtagtacatagcacgcacgcacaggaagccgcccttcaatcaatttcgatngtcaaagtgaaaaaaaaagaagaaaagaag

SEQ ID NO: 5563 - DNA, 101 bp, rice(Oryza sativa)
  misc_feature (71): n=a or g
tgattctctttcagagtttgaagttggaaatcaaccttgttgttctctgtagcgctttcctttggattgcngagaatttcaaacaaaaccaacaaaccttt

SEQ ID NO: 5564 - DNA, 101 bp, rice(Oryza sativa)
  misc_feature (71): n=a or g
ggatccaaagagaccgtgtcgtctcgtctagagtaggtctctatctaggctctgatcttgagcctcattcngagaccatgtactaggctccattgccgatc

SEQ ID NO: 5565 - DNA, 101 bp, rice(Oryza sativa)
  misc_feature (71): n=a or g
gagcttggttgagtggctgatggttgtacttcagtacttggttgctttagcttcaacatctgcatcagctnctctagagccaaagtattagatgtctgcac

SEQ ID NO: 5566 - DNA, 101 bp, rice(Oryza sativa)
  misc_feature (71): n=a or g
tgcagtagctgttgttgttgcatcccaagcccaccggattccaccagtgatctcccatccgttccaacctnccgccaccaatcacgcctatggccaccgga

SEQ ID NO: 5567 - DNA, 101 bp, rice(Oryza sativa)
  misc_feature (71): n=a or g
ttgcttgaccaaactactgatctagactggttaagcaggaccaatgtgccatcttgtgagatggcaagctnggactcatctagattggagattggtgcttc

SEQ ID NO: 5568 - DNA, 101 bp, rice(Oryza sativa)
  misc_feature (71): n=t or c
tggggaatctacaggaaacacgacctccattccccaatgggagaagccactgttcccctcagtatccatgntactctgagctactgagctctctgctaagt

SEQ ID NO: 5569 - DNA, 101 bp, rice(Oryza sativa)
  misc_feature (71): n=t or c
acgtattcctgtcatcttccacctccggacctccctacttgcccccaattcacaaggttgagatatctctntccaccgcagcagccatggctgagggcgag

SEQ ID NO: 5570 - DNA, 101 bp, rice(Oryza sativa)
  misc_feature (71): n=a or g
gcagctacgagtatctcattaaaatctcccgccatcagccatggctgagctggattcatcgccaagcttcncaaagtgtcccatgtcttgaatctaagatc

SEQ ID NO: 5571 - DNA, 101 bp, rice(Oryza sativa)
  misc_feature (71): n=a or g
ccaaccgtaccaaggaaagaaacagccgagactacggacactcaagtagtagccatgattgaagctgactngagatagcccctcatcaaatttttgaccaa

SEQ ID NO: 5572 - DNA, 101 bp, rice(Oryza sativa)
  misc_feature (71): n=t or g
gcatatcgagtacactcaagtggatcttccagctttcatggaactggaggatgaggaggagaaccagccanaatatcctgacacaaatcatttgcctccat

SEQ ID NO: 5573 - DNA, 101 bp, rice(Oryza sativa)
  misc_feature (71): n=t or c
gtgggttggtcgcttttataggtagcaatggatggattcctcagcattcgactgcatcgcgcctttatcanttgggactcatttaggacatgatacagtga

SEQ ID NO: 5574 - DNA, 101 bp, rice(Oryza sativa)
  misc_feature (71): n=a or g
ccattgttgatggttggctggtctatggtttggccctctcttttgtttcctagcagcagaaaccgcgtatngtttgtcattcgggttgagctcggaacccc

SEQ ID NO: 5575 - DNA, 101 bp, rice(Oryza sativa)
  misc_feature (71): n=t or c
aaaggagcattgcgagtttttggcgccaagaagcaagaaaggtcatggacagcagcaagcagcagctcgcngtttggccggtgtccgccgccaagaagtac

SEQ ID NO: 5576 - DNA, 101 bp, rice(Oryza sativa)
  misc_feature (71): n=a or g
cggaaacactatcacattgttgaagtgggtctttctcttttgtctcatgcatcaatgcatcttaagtcctnggatgaagcttttgttgcggctacttatct

SEQ ID NO: 5577 - DNA, 101 bp, rice(Oryza sativa)
  misc_feature (71): n=a or c
gaggatctgatgggatctggagcaatgggagaaggagaagatggatgtgttcttggctctgcagtctgcantgagaggagaggagtggcttttggtgatgg

SEQ ID NO: 5578 - DNA, 101 bp, rice(Oryza sativa)
  misc_feature (71): n=a or c
tgacggcgacgggcgcggccgcgagactccacacgtacgaacctcgccggaaagcgacgcctcactcaccnaccaccacgaaagcacaaacccacccactg

SEQ ID NO: 5579 - DNA, 101 bp, rice(Oryza sativa)
  misc_feature (71): n=t or g
atttctgatttacgtggcttgtgagtagggcgcctcctcattactgatgttgccctctccgtcggatctanacccttctccgccgacctcccaccccaggc

SEQ ID NO: 5580 - DNA, 101 bp, rice(Oryza sativa)
  misc_feature (71): n=a or c
ccagatcatcaggtcctcatgacctttaggtcggtttcctatataagcctctttcctttattaatgtagcnccccccacaatgatcttcattgaatgaact

SEQ ID NO: 5581 - DNA, 101 bp, rice(Oryza sativa)
  misc_feature (71): n=t or c
cttacttgcgctgttgattcatatggcttcttttggtcttctgctcttgtgcagtttccacgcgcaccacntgttcgacgaaacgccactgcgtgatcggc

SEQ ID NO: 5582 - DNA, 101 bp, rice(Oryza sativa)
  misc_feature (71): n=a or g
tcatcacaaccattggcaattagcaaaatacttagagaggaggtagctggcattacagtcgaagataggtngataggctcctaactactctagttggtggt

SEQ ID NO: 5583 - DNA, 101 bp, rice(Oryza sativa)
  misc_feature (71): n=t or c
cccccccgaccacctgacctcccctgctactagcaccccgacttttttttttctttccttcgcttcttcgntgtgttcccaactcggcaactgcttcttcc

SEQ ID NO: 5584 - DNA, 101 bp, rice(Oryza sativa)
  misc_feature (71): n=a or g
cttccccaaactcatgccatttgcaaacattgacaggatgttgccaccatgcacccgaccctcgtcagctngagctgccacacgacgaggagcctccatag

SEQ ID NO: 5585 - DNA, 101 bp, rice(Oryza sativa)
  misc_feature (71): n=a or g
tcagctagctccagctccatcctcaccatcttcctcacgtgctccacgtacgcctggtgtgccgacgcttnctgcatctgcatcaatagtaatagtagcag

SEQ ID NO: 5586 - DNA, 101 bp, rice(Oryza sativa)
  misc_feature (71): n=t or c
gaggaggagagcgtggagcaatttgtggggtaggtgcccaaccatggaggcagagctgctcaccacgtttnaggaggtggccatcgtcgacaaggtcaccg

SEQ ID NO: 5587 - DNA, 101 bp, rice(Oryza sativa)
  misc_feature (71): n=t or c
tgctcttgtgggcccgagcctttttagtcaaaaaagcatccaacccaatactatgcagaaggatgtagaanaagccaagggcaagagtgcagtagtacagc

SEQ ID NO: 5588 - DNA, 101 bp, rice(Oryza sativa)
  misc_feature (71): n=a or g
tcttgtggtgcgagatctgggcgcgagaggagaaaccccgatcttgatttgggtggcgtcgcgtcgcgtcngcggcggtgatgtggggggacgggaaggcg

SEQ ID NO: 5589 - DNA, 101 bp, rice(Oryza sativa)
  misc_feature (71): n=t or c
cttcgcccatatacatcagtcataccactgcttccacaactgttagattcggtgccgccgacgacatccancgcgctgtcgtagtccgagcgccgctaccg

SEQ ID NO: 5590 - DNA, 101 bp, rice(Oryza sativa)
  misc_feature (71): n=t or c
ctcgtccttcgcaattctttcaagattttcgcgaagccaagtcttcgcgcaatctcgaccaccgtcctccnagaacccctttcgaaaggcccttaaggccg

SEQ ID NO: 5591 - DNA, 101 bp, rice(Oryza sativa)
  misc_feature (71): n=a or c
tgttttatcattaatttgtgaaaattattcttgatttaagatcctctactgcagtgatagtttgctaaagntgaatcgtatgtctgatattatttctcttt

SEQ ID NO: 5592 - DNA, 101 bp, rice(Oryza sativa)
  misc_feature (71): n=t or c
ggcgtccacgctttcctctccttgccaccaccacctctcctcctattatagccaccaactccgccgcctcngcctccgcctccgcccctccaccgccgcct

SEQ ID NO: 5593 - DNA, 101 bp, rice(Oryza sativa)
  misc_feature (71): n=a or g
ggggaggaaggggggaatagattacggacgcgacgatgaggttgagctggttggggccggtgaagttgccnacgcaggagtgggtgacgctggtgggcttg

SEQ ID NO: 5594 - DNA, 101 bp, rice(Oryza sativa)
  misc_feature (71): n=a or g
tgaaatgcaaagagtggctttccaggctagtcacaaaggaagtgcacaatggaagagatgtgagtttttgnaatgatgtttggtgttataatgtacctttg

SEQ ID NO: 5595 - DNA, 101 bp, rice(Oryza sativa)
  misc_feature (71): n=a or c
attgggcccatattagtccagtggtagcccaatgcgtgccacgacaatctcgtggaaggcccaaagtagtnaagtctcaacggatcgaagctcgcggccgc

SEQ ID NO: 5596 - DNA, 101 bp, rice(Oryza sativa)
  misc_feature (71): n=t or c
cagtcctgctcctgcgggcgatacctagctgctccggggcggccatttcctccgattgcccgcgctgcctngtaccctctccgccaccgaccagtcccttc

SEQ ID NO: 5597 - DNA, 101 bp, rice(Oryza sativa)
  misc_feature (71): n=t or c
catagaaagggactcctcaatttcatccttatgtttccctgcaactcgacttctcagcgattctaatacantctttagatttttcagaaggatgtctcgct

SEQ ID NO: 5598 - DNA, 101 bp, rice(Oryza sativa)
  misc_feature (71): n=a or c
atcgatcttgtctccgacgatgtaaatttatactttcgttcttctgaagttggcaatgtggaagaactatntggagacctgaactgggggttcccatcgat

SEQ ID NO: 5599 - DNA, 101 bp, rice(Oryza sativa)
  misc_feature (71): n=t or c
ctccagctagcttagctaatggcagagtagtactggactactggatcagcaagctccaggagacaggagcngctgctgattcagctcactgttagctagct

SEQ ID NO: 5600 - DNA, 101 bp, rice(Oryza sativa)
  misc_feature (71): n=t or c
tttcctccttgacttcccaatagagacaggcaggccaagatatctttcattttttgcctcctgattaatanatagcgctgatctaacttccatcctatcac

SEQ ID NO: 5601 - DNA, 101 bp, rice(Oryza sativa)
  misc_feature (71): n=t or c
atggagaatgggctgggcggacttggtgagaagggatggcgagaggccaggaagaatgggtgaactcatcngacgtggtgtcaaagggattccggtgacga

SEQ ID NO: 5602 - DNA, 101 bp, rice(Oryza sativa)
  misc_feature (71): n=a or g
atccccttgccttccttcaagaaaaagaggacattcctcctttcagtctcaacaactcaacaaggtggggnaaaaaagaaagaatgaaaaaaaatgaaagc

SEQ ID NO: 5603 - DNA, 101 bp, rice(Oryza sativa)
  misc_feature (71): n=t or g
caccacatctctccagtggcgtgtaggcaggaagcgatggtcaccacggtctctcccaccggatctggttnaggagcgaatcaacggcctcatgggcatga

SEQ ID NO: 5604 - DNA, 101 bp, rice(Oryza sativa)
  misc_feature (71): n=t or c
ggttttaattttgtgaaaatataagcggctacgaataagcaaattgtaatggctttgatctgaatagtcanatttgcaatggcatgcatcaaattaactct

SEQ ID NO: 5605 - DNA, 101 bp, rice(Oryza sativa)
  misc_feature (71): n=t or g
gaggaggaaaacctaggaattaagccgccggccggccggatcgaggatttatgcgagggattagctgatcnatcgatcgatggaagggagatgtgtggagt

SEQ ID NO: 5606 - DNA, 101 bp, rice(Oryza sativa)
  misc_feature (71): n=t or g
cggcggccgcgcgcgcggtgcggaggatgactgtttattttgcggtgtttggtaagtttagttggtcgacnactcgacggtctggaccgcggactcggccc

SEQ ID NO: 5607 - DNA, 101 bp, rice(Oryza sativa)
  misc_feature (71): n=t or c
tctggatccagcggcggtagaacactctgcagaggaaacaggggaggaacgagcttctgaacctactctgnagatcatgaagatggtgacgaagacccggt

SEQ ID NO: 5608 - DNA, 101 bp, rice(Oryza sativa)
  misc_feature (71): n=a or c
tgggttgatgaaggcttcatgttaacatttgtgtcattccaagtcgaactttggaagcatgaatatatttngcatctttaggggcttaagatgcatttttc

SEQ ID NO: 5609 - DNA, 101 bp, rice(Oryza sativa)
  misc_feature (71): n=t or c
tctgcatggaaccatggatcaatatagaataatctgcatgcaaaaattattgtttttggacatgtgttaanggctgttaagtactgaattaatgccgtcaa

SEQ ID NO: 5610 - DNA, 101 bp, rice(Oryza sativa)
  misc_feature (71): n=a or g
actaggccaagcatcttgagcttgaggtagttatgatgataaattgcttcgaacttggtcaaagtgcctcngccgaagatggcattataattgtatgggat

SEQ ID NO: 5611 - DNA, 101 bp, rice(Oryza sativa)
  misc_feature (71): n=a or g
cctggtagtggatgaactgctcgaactccctcctggccttgcctcccatgatgctccactcctagcggtcncctcccatggaacgctggccttggttggaa

SEQ ID NO: 5612 - DNA, 101 bp, rice(Oryza sativa)
  misc_feature (71): n=t or c
agcctccttcctcgcaagcccaatatcagctagggggattggtcagccccagtccgcatctcagtatggtnagttcgagtctaggcaacaacagccacaag

SEQ ID NO: 5613 - DNA, 101 bp, rice(Oryza sativa)
  misc_feature (71): n=t or c
acctctcccgcacgatggtaatgtgggattgcaccttaagcgcggcgtgggtgtgcgggattggaggccangtcggtcacgctgggtgggtgcgcggcaca

SEQ ID NO: 5614 - DNA, 101 bp, rice(Oryza sativa)
  misc_feature (71): n=t or c
taatagcaaactgtatgaagatagcaatggaaatttcttgggcatggtagaaatgttggctgagtttgacncggttattcaagaacatattcggcgtatta

SEQ ID NO: 5615 - DNA, 101 bp, rice(Oryza sativa)
  misc_feature (71): n=t or c
tgctcgtatacgtacgatactgccgtagttgcatcgtattcttctccgacggatacgtatatacgtacccnatccgtcctaaaatataagtatttttagac

SEQ ID NO: 5616 - DNA, 101 bp, rice(Oryza sativa)
  misc_feature (71): n=a or g
ggaagctgcatatccgaccaatccccactcgcccgaccattctgccaccagtgacggggtggaaagggctngggtctgaggagagccccaccgtcgcccat

SEQ ID NO: 5617 - DNA, 101 bp, rice(Oryza sativa)
  misc_feature (71): n=a or g
tctaagttgagtgtgttgaagcaaactttcagtactactagtttttcatttgctgtgacatcggatatctngacatcccaacaccaaagaacatcttacct

SEQ ID NO: 5618 - DNA, 101 bp, rice(Oryza sativa)
  misc_feature (71): n=a or g
agtgtcgatggctttgccgttgtcgatctgcctatccatcttcctgttctacgtgctcaccgcttcccctngcgctcgtcaacgtgcacctcgcaccggag

SEQ ID NO: 5619 - DNA, 101 bp, rice(Oryza sativa)
  misc_feature (71): n=a or g
agcccagaaaaaattcttaaccatgattttgattttttgggacagaaattggaaaagagattgggaacttnggaaacaaatacactttcacatgctggtag

SEQ ID NO: 5620 - DNA, 101 bp, rice(Oryza sativa)
  misc_feature (71): n=t or c
agtcttgccatctgcaggaagagggaaagcagaagagccaggcatggcttgtgactgtggagaagcaagcnaagcagtcggtggcagtgagaaccagagac

SEQ ID NO: 5621 - DNA, 101 bp, rice(Oryza sativa)
  misc_feature (71): n=a or c
atcggccgtgccggcctcccgaccatcacccaaaccaaccccttggtgccaccagcaccacgccagcgtcnctccgccacctatgtgttaacgaccaaatt

SEQ ID NO: 5622 - DNA, 101 bp, rice(Oryza sativa)
  misc_feature (71): n=a or g
acagaccgacctagtccgagccctacaaatctcgcgccgccgccgctgctctgctttcttcttccaacctntttccctttcccgccgctgctctcaccgcg

SEQ ID NO: 5623 - DNA, 101 bp, rice(Oryza sativa)
  misc_feature (71): n=t or c
ttatgttttttccctgttcactcaatttaatataattattagttatgttttctaagaggttaaacgtcctnaatatcatactgctacataaattacatgga

SEQ ID NO: 5624 - DNA, 101 bp, rice(Oryza sativa)
  misc_feature (71): n=a or g
gttaacgtatttgacatcaaaaaacttatttgaagtataataaaaactgcaagtgcttaaaggaaaactcnggtatggtatatattataagacactttgac

SEQ ID NO: 5625 - DNA, 101 bp, rice(Oryza sativa)
  misc_feature (71): n=a or g
ggtggtgaaggaggtggatccagcggcggctgccatgacgacgatgatggctaccgcgacaacgacgactnggctacttgttggtgtgaaaacacgacggc

SEQ ID NO: 5626 - DNA, 101 bp, rice(Oryza sativa)
  misc_feature (71): n=a or c
tcgacaattggctgtgttggcaagaacattgaagcaatttgctcctaggtcagccgattgatgttctgtcnagcatgttgcggttgttctctggtctggac

SEQ ID NO: 5627 - DNA, 101 bp, rice(Oryza sativa)
  misc_feature (71): n=a or g
ttgcgatgaaatcctagggcgtttgatcgaggattgggggtggtcgcgtggggttggtgttggtggggganagagaagaggtggtggtgggggtgaggaag

SEQ ID NO: 5628 - DNA, 101 bp, rice(Oryza sativa)
  misc_feature (71): n=t or g
ccgacaaattaaagtgatcaactctcctctcaccctcatgttttgattggtggcgtagaggacactacaanataattgagctattgccaccaatttatttc

SEQ ID NO: 5629 - DNA, 101 bp, rice(Oryza sativa)
  misc_feature (71): n=a or g
tttgataaatttcatctgacttcaaatttaaaaggaaaatgtaaaaagctcaggaaaaaatcatggaaatngtacttaaattgcataattatctgctgaag

SEQ ID NO: 5630 - DNA, 101 bp, rice(Oryza sativa)
  misc_feature (71): n=t or c
gccccccggtttgcgtttccgtctctccctctcgcggattactgctcgctcgcttcacgcatcgtccctcntgtctcgctcgctagctgtgttcccacttc

SEQ ID NO: 5631 - DNA, 101 bp, rice(Oryza sativa)
  misc_feature (71): n=a or c
tgatctgatccaatttttctaaactgttaggctgagttggaaagcctcatggatgaacaacctgagctggntgaagatgatcaaggaagagttgcatggaa

SEQ ID NO: 5632 - DNA, 101 bp, rice(Oryza sativa)
  misc_feature (71): n=a or g
ttaatgccatcgcgactaggacaagagatattaagatcaaagcaacgcagatgaagatgttcaagacgccncctggaactgaattttgattccatccctac

SEQ ID NO: 5633 - DNA, 101 bp, rice(Oryza sativa)
  misc_feature (71): n=a or g
ttatatgaagcatacaaaatcgtgtcatttagttgaaagaacacatcttcatcttatatttattttctatntttatcatacgaaattcccgtagcaatgcg

SEQ ID NO: 5634 - DNA, 101 bp, rice(Oryza sativa)
  misc_feature (71): n=a or g
ttcacccttagaaatttctgacatctatcattacttagatgataattcgctaagtacgccttggaccctcnctcatagccgacgaagatcatcttgcagcc

SEQ ID NO: 5635 - DNA, 101 bp, rice(Oryza sativa)
  misc_feature (71): n=t or c
ctttatcttcaatagtttgttcagcagctcgagggcttgagaagattcttcgcccataggaagggagttcnagatatcttggtacttgggcgggcagcacg

SEQ ID NO: 5636 - DNA, 101 bp, rice(Oryza sativa)
  misc_feature (71): n=a or g
tagctgccaccagggctcccttgagctgggatcctatcccatctctcctggattggattgttgcctccctntgcctatcaagacaatgaggacatggagtt

SEQ ID NO: 5637 - DNA, 101 bp, rice(Oryza sativa)
  misc_feature (71): n=t or c
catagccatcaccatcacactcacacatgagcctcattgcagtggatattgtctccacttcgtgcccccantgccgccaccagctttgtcgtccgctcgtc

SEQ ID NO: 5638 - DNA, 101 bp, rice(Oryza sativa)
  misc_feature (71): n=t or g
tactactacatctgaagaaattgttggtgtgttagttcatggctgctgctgctgcttcttcttcagcaatngcggcgaaggcggcggtggtcatggcgctg

SEQ ID NO: 5639 - DNA, 101 bp, rice(Oryza sativa)
  misc_feature (71): n=t or c
cggctacgtcgcccgctccgcgttcaaggtcagcgccttcctcctcacccctctcgctcgtacggtttgcnaactgctcccgtctcacgcgaggagccgct

SEQ ID NO: 5640 - DNA, 101 bp, rice(Oryza sativa)
  misc_feature (71): n=a or g
ggtcttgcagatgtttcatccttaggggactttcctggtgctacaacattgaaagaatcaaccgcttccantcccacttcctccctacaggcagtaccaga

SEQ ID NO: 5641 - DNA, 101 bp, rice(Oryza sativa)
  misc_feature (71): n=t or c
tgccaatcggctgactcaggaacaggttgctgcaatgtttctaccaaatccacaaacagctgacccagtanagtcaatgctgaatcagcaaacgccgccaa

SEQ ID NO: 5642 - DNA, 101 bp, rice(Oryza sativa)
  misc_feature (71): n=t or g
gagggtgcgggcggcaacggagggtttggggagttaggtagtgggcattattttgcgaaaaagcccctatnattttcactttttacatataggttcctatc

SEQ ID NO: 5643 - DNA, 101 bp, rice(Oryza sativa)
  misc_feature (71): n=t or c
cctctggaattattttcttcagctagagtttctaagtatctggaattattttctgcaagtcgcgtattgtnccttaaatgacacagttggtaacataagtc

SEQ ID NO: 5644 - DNA, 101 bp, rice(Oryza sativa)
  misc_feature (71): n=a or g
gccatgaagcgtgtcgggcacggaggcgtgttcctctgcatcaggggtcgagggcgagcacgatgcagtgnaggaggtcgatgagagaggcggcgaggtgg

SEQ ID NO: 5645 - DNA, 101 bp, rice(Oryza sativa)
  misc_feature (71): n=a or g
acggctgcctcagcacacatacctggactactctgtcacaaatctccttgctgctgctgtgattgccatcncatttgggcaggttggagagaccaggccta

SEQ ID NO: 5646 - DNA, 101 bp, rice(Oryza sativa)
  misc_feature (71): n=t or c
cttgggcggtcgaggctggtggttgttgtaattgccgcgcttgacgatgttgacagtttcttcacccttcngttttactccattgttcttggaggacttgg

SEQ ID NO: 5647 - DNA, 101 bp, rice(Oryza sativa)
  misc_feature (71): n=t or c
agcttgctgatcatctgaagttgaaagctgaaaccttgtcggtttaatgttccagccgtggattgactcanagccatagactcggcggcccatgtacttgt

SEQ ID NO: 5648 - DNA, 101 bp, rice(Oryza sativa)
  misc_feature (71): n=t or c
tcactgggctacagcaactcacaatagtggagccgtacacctgcatgaattacaagcaacaaatgtggggngatctaatgcatggatcatgaagaaacaca

SEQ ID NO: 5649 - DNA, 101 bp, rice(Oryza sativa)
  misc_feature (71): n=a or c
tatcatcacgatccatttctcgccactttctgagtatgaaatcagtatgatgaagttccaaactaagcttnagcttctacccagaaggttccaattgcatt

SEQ ID NO: 5650 - DNA, 101 bp, rice(Oryza sativa)
  misc_feature (71): n=t or c
caccgacgacacctaaaccatcgccatggaggtcggaggtggccaaatccgacgacccccgacttccaggnagccagtccggcagccccctacctccatgc

SEQ ID NO: 5651 - DNA, 101 bp, rice(Oryza sativa)
  misc_feature (71): n=t or c
tgtcgtacgtatagcaattttcgataacagagagataacacaagaattgggccgcaatttcctgagttttnttcctgagaatctcaacaaaattacaatac

SEQ ID NO: 5652 - DNA, 101 bp, rice(Oryza sativa)
  misc_feature (71): n=a or g
gaaggagtacaacgaggccattggcgagctagctagtttgttggtgttgtctttcttgtttcttgaaaggnatggatcgatgtgtttggtgatccatgttg

SEQ ID NO: 5653 - DNA, 101 bp, rice(Oryza sativa)
  misc_feature (71): n=t or c
ctccccatgattgctagtgcaaatgggtaaaggagaaacataacccacatgttgaataggagtcccattgnagcatgtctcttctgtgctatcgtccatac

SEQ ID NO: 5654 - DNA, 101 bp, rice(Oryza sativa)
  misc_feature (71): n=a or g
ctctttctttcatcaaattatggcaaatagtgacactggccttaccatgcctgcgaggatcagaccatcantaagccccccatcataatgggtccaaagat

SEQ ID NO: 5655 - DNA, 101 bp, rice(Oryza sativa)
  misc_feature (71): n=a or g
cctagaggttgcatctcgaattgtcaagctcgttcatgagtctcctgctagcagtggccaatatctaagcnacatcgttttgtttggaaacaagaagagga

SEQ ID NO: 5656 - DNA, 101 bp, rice(Oryza sativa)
  misc_feature (71): n=t or c
tgtatacaccccggccctttggtaacagtatggatgatattagctataggtgggaactgtcttcgtagttnttgatcaagcgcaaggtcaactgaacccac

SEQ ID NO: 5657 - DNA, 101 bp, rice(Oryza sativa)
  misc_feature (71): n=t or c
aggagcatgtcaggaggcggcaagggatggaggcagccagcaatgatctcgaacaaggtagatttgccggnaccgtcgggatccataatatcttcatcttg

SEQ ID NO: 5658 - DNA, 101 bp, rice(Oryza sativa)
  misc_feature (71): n=t or c
ccttggctcatctgcaggctgtagcacacctgggacgctaacaatcccctcctcttgagatttggcttgtncccaagccaatgcatttggaaacctttgct

SEQ ID NO: 5659 - DNA, 101 bp, rice(Oryza sativa)
  misc_feature (71): n=t or g
cccaaaatactttgcctctgtcatggttgctgattctcagaataaatcaaccttgtcatggcactcagctnttgattcacaaaagcaaagtgtcgtgacca

SEQ ID NO: 5660 - DNA, 101 bp, rice(Oryza sativa)
  misc_feature (71): n=a or g
aagcttcaagatcaacgcaaagctgagcaggaggcactttatggatcaaagccaagctcttcaaaatctcncagcactaagaaggtacccagaaactccac

SEQ ID NO: 5661 - DNA, 101 bp, rice(Oryza sativa)
  misc_feature (71): n=t or c
tacatttaaccccactgatggtcctcgtgccgcaatcaattcgaacaaaaacgccaggtatgaattgatgncctgttgataacacaaacatgtcacttgaa

SEQ ID NO: 5662 - DNA, 101 bp, rice(Oryza sativa)
  misc_feature (71): n=t or c
gttaagctttaggatttggtgggttataattttatagtaagaggggattttacttctccccccttgtccanggccccattcctggcttcccccatacgcct

SEQ ID NO: 5663 - DNA, 101 bp, rice(Oryza sativa)
  misc_feature (71): n=t or c
tacctaccttgatttctcttattcccacaccaatcttgtcataccctctgggatgaaatttcaaggcctcnattaagcatgatttatcttgttctgtgaca

SEQ ID NO: 5664 - DNA, 101 bp, rice(Oryza sativa)
  misc_feature (71): n=a or g
ccagatgcgatgcctttaatgattcggaacctttgagcccaactcagtataggcttatcctcctcgctatncagatatttatcgaggctaccatttggtat

SEQ ID NO: 5665 - DNA, 101 bp, rice(Oryza sativa)
  misc_feature (71): n=a or g
cagacatgattaaccttcctagaattcctcctagcttcagcaaaccactgctcgtgcaaagttaccttctntgtaagatgcgacaagctttcaaagtcttc

SEQ ID NO: 5666 - DNA, 101 bp, rice(Oryza sativa)
  misc_feature (71): n=a or c
gccgaatccgaatcaaatccttccacatcatcagtttcggctatgggatgctctctcgaaccatcagcacngaagaacgaagaatttcgaacttcgggatg

SEQ ID NO: 5667 - DNA, 101 bp, rice(Oryza sativa)
  misc_feature (71): n=t or c
agaaatagctatgaaactgcttctccagatcggcccagctgttaatagatccatacggtaaagcagaaaancaagtaaaagccgatccagccaaagacaac

SEQ ID NO: 5668 - DNA, 101 bp, rice(Oryza sativa)
  misc_feature (71): n=a or g
cagagaaaacaatggtctggcagtagggcagagggccagatcagacaataactgagcagagtaagggtctnaaaggtagccatcacttacttcttggagcc

SEQ ID NO: 5669 - DNA, 101 bp, rice(Oryza sativa)
  misc_feature (71): n=t or c
catcaagctcaccatggccatcatcagcttcaccaaagtgtggaggcgaatcagctgccgatgacctcggncagcttgctgcttgctcctcggtcgccaga

SEQ ID NO: 5670 - DNA, 101 bp, rice(Oryza sativa)
  misc_feature (71): n=t or c
tcgcgccgtctcctgcgggtcgccttgagcgcgatggaggaggaaactgcccattcctcctccctcgccanggtaggcacgacgtggaacatgacgccctt

SEQ ID NO: 5671 - DNA, 101 bp, rice(Oryza sativa)
  misc_feature (71): n=t or c
gtgagggaagaagcggggaggcggtggcgaggcagagataaaagaggagaagaggcggcagcggcttgcanccctctcctccgagtgggaagttccatcgc

SEQ ID NO: 5672 - DNA, 101 bp, rice(Oryza sativa)
  misc_feature (71): n=a or c
gttttgtgtgtgcagcggatagtccagctgatgcaactggcgggggcggtcatggaggagcttgggaactngcagggtccccgccccgagaaagtcgttgc

SEQ ID NO: 5673 - DNA, 101 bp, rice(Oryza sativa)
  misc_feature (71): n=t or g
atgttattacggtcaatcacaggattgttgttcttccattcgtcttcgttatcgagcgccacgtccagcangtcatccttccgcggctcgccggcttcacg

SEQ ID NO: 5674 - DNA, 101 bp, rice(Oryza sativa)
  misc_feature (71): n=t or c
caaaaggcctcggcacatgcacatttgagtatgtgagcttataaaattagttgtgtatttgtcagagttcnagatgaaagaccattcatgaccaatgccgt

SEQ ID NO: 5675 - DNA, 101 bp, rice(Oryza sativa)
  misc_feature (71): n=t or g
cagttatctagacttcttcgagaaaaagaaatcaaatggtaccaaagggcaaaagttactgacctcctacnaggggacaacaacaccaagtattaccatat

SEQ ID NO: 5676 - DNA, 101 bp, rice(Oryza sativa)
  misc_feature (71): n=a or g
tccagcagatgaagtgaggagatcagtagctggcactagcactgattcaaatgctctaggtacagaaggtncggcacttgaaacaagctcaggttccatcg

SEQ ID NO: 5677 - DNA, 101 bp, rice(Oryza sativa)
  misc_feature (71): n=a or c
tttttccaataccttgaagtcaaggctccaacatatataaacataacagcttcaccatcaccaggcttctnactttaccatttacatgcccacttaggctt

SEQ ID NO: 5678 - DNA, 101 bp, rice(Oryza sativa)
  misc_feature (71): n=a or g
cgggaattgcagttgcccatcagagattcattcctctccaatctacagagatcggccaggtctcggatgtnagctggcgacgccgatttcttgccgggatg

SEQ ID NO: 5679 - DNA, 101 bp, rice(Oryza sativa)
  misc_feature (71): n=a or g
tgcatgcactcagccctcgcaaccttcccatcgacgaagatgggtgtgaagtcatcccacacctttgatcngagccttttgggccgtgtgcctaagagcaa

SEQ ID NO: 5680 - DNA, 101 bp, rice(Oryza sativa)
  misc_feature (71): n=t or c
aacttgttagcatatccagttccgtataggtttgtaccttttgggaacaacagggagaatccaagctattnggagcttatcaataaaattataacagatgt

SEQ ID NO: 5681 - DNA, 101 bp, rice(Oryza sativa)
  misc_feature (71): n=a or g
ctcgccacgcagcaatccaggcggcgcatttattcgttgcgcatccacatcggccggcggagagagggacncttccccagctcccagggtgctgctcagtt

SEQ ID NO: 5682 - DNA, 101 bp, rice(Oryza sativa)
  misc_feature (71): n=a or g
ttgacgtcatatggatgcaagataactgttgttccagccaattggcctgcttctgaggtacttaacttgangcctgatggtgtgttttttagcaatggtcc

SEQ ID NO: 5683 - DNA, 101 bp, rice(Oryza sativa)
  misc_feature (71): n=t or c
acagaaaactacagttttgtatactaatctgaattccagacctggctgttcgtcaggttagccttctcctngacatgagcagcggtgctcgtcaggttggt

SEQ ID NO: 5684 - DNA, 101 bp, rice(Oryza sativa)
  misc_feature (71): n=t or g
tgcagttattggaatatctcaaaatccagcaaaagaaggttcagcctttattcagttaagtggaggaaggnttgttgaatactgctcaaaagtgaatttgt

SEQ ID NO: 5685 - DNA, 101 bp, rice(Oryza sativa)
  misc_feature (71): n=a or c
gctcttacttgctctatgcacaatgctaacaaaatactattataactatcagtccagttagctcggtcagnagtgctcaccggagggccgccgaagctgcc

SEQ ID NO: 5686 - DNA, 101 bp, rice(Oryza sativa)
  misc_feature (71): n=t or c
tttgggcagctgcgaaaatttgcaacatattgagctggatcataataatttaagtggaggtattccccctncgtttggcaaattaattagcctaaagtttc

SEQ ID NO: 5687 - DNA, 101 bp, rice(Oryza sativa)
  misc_feature (71): n=t or c
cttgttatctgaatgatcagttttagtgcatgaacaactagtacttgtcaagtatgtgctgcatgagatangctgaacgaattaactattattctgcatca

SEQ ID NO: 5688 - DNA, 101 bp, rice(Oryza sativa)
  misc_feature (71): n=a or c
cagtttctagcagaagcagtttatgagaaaaactgcagctgacacaaagctccccaaacagagccttggtntctagtctctactgcacaagcagagcaagt

SEQ ID NO: 5689 - DNA, 101 bp, rice(Oryza sativa)
  misc_feature (71): n=t or c
gtcactagcgtcgagatcatctcgacggggacggcgtccaacgcctttcgatcttcatgcagctccaccangcctcctcccgaatcgatgatgccccacaa

SEQ ID NO: 5690 - DNA, 101 bp, rice(Oryza sativa)
  misc_feature (71): n=a or g
cgcggtacggccaagaaggaggggatcatgatcaggtcggctgcactggttgaattacctccagactgacntcaagcactgcaacttcagcgccaaggagc

SEQ ID NO: 5691 - DNA, 101 bp, rice(Oryza sativa)
  misc_feature (71): n=t or g
tcatttgttccttataaatccaatttacatcatgaggaaaccaactcacctttgaatttaacagtgcacancactccccttcttgaatatggtcatcgatc

SEQ ID NO: 5692 - DNA, 101 bp, rice(Oryza sativa)
  misc_feature (71): n=a or g
aaatcaagctaattccgcttttatgccacctaataatgtcatgagccttggtggtacttcttcctcttgcnctgttgctggagttagccagaattctagta

SEQ ID NO: 5693 - DNA, 101 bp, rice(Oryza sativa)
  misc_feature (71): n=a or g
gtcaacaaccttatccacatcaagcaaaagcacactgacagctaaagtcttcacattgtgcaccacctctngcaaactttcgttcttaactccctttaaca

SEQ ID NO: 5694 - DNA, 101 bp, rice(Oryza sativa)
  misc_feature (71): n=a or c
cgagcattatccggacataactcgccaaatgcaactcttacctcctcactcctttgtttataccaatcaanaagttccaagaaatttcccttatttaggga

SEQ ID NO: 5695 - DNA, 101 bp, rice(Oryza sativa)
  misc_feature (71): n=a or g
gccatacaagggcaccgtacaagggcacaaagtaccagatcaccaagtttcaaaacgcgccagaaccaganggtaaagaggaggtatttaactacgcacat

SEQ ID NO: 5696 - DNA, 101 bp, rice(Oryza sativa)
  misc_feature (71): n=a or g
ccaggctcctcttactggatctggcaaccactgagccggatatggcagagcgaagcggagtgggcgagganagggaggcggtggcagcctggcggggccga

SEQ ID NO: 5697 - DNA, 101 bp, rice(Oryza sativa)
  misc_feature (71): n=t or g
tttatttgatttcacatgcatcaacaaacgcaggggccgcggcaacgatcgatgccaactgctgcgaccanatcgatctcgtcacaatgtgctggatggcg

SEQ ID NO: 5698 - DNA, 101 bp, rice(Oryza sativa)
  misc_feature (71): n=t or g
tgagagggcgccgacgaccatcgatgcccttgcgtatgtcttcgttggtctccagagggaggccataaaantcagggactccgaggactactacttgaaga

SEQ ID NO: 5699 - DNA, 101 bp, rice(Oryza sativa)
  misc_feature (71): n=t or c
gaggagcaaaggtctaaactgaaagcctccctcaaacacttggctaatctagtcaagtcctccaaagagancccagggaccacagagcaagatcaggagga

SEQ ID NO: 5700 - DNA, 101 bp, rice(Oryza sativa)
  misc_feature (71): n=t or g
cgcccagtccgccatctcctgggtcgtctccttcttcaccaccaggagtcgtcggcagcaggaggaggagnagtcgtacggatacgactacgatgacgatc

SEQ ID NO: 5701 - DNA, 101 bp, rice(Oryza sativa)
  misc_feature (71): n=t or g
atcgagtgctcaaactgttgagcaggaggcaatcctttaggctcatcaaagactgaacagaattcttgcanaagttcagagataggtgctggcaattctgt

SEQ ID NO: 5702 - DNA, 101 bp, rice(Oryza sativa)
  misc_feature (71): n=t or c
tggtttctaatcaactccactttatcagtattcaccccgagcaaaatccctccagaagcacccctagaggntttccaggcccaagaaaaggtcttggagcc

SEQ ID NO: 5703 - DNA, 101 bp, rice(Oryza sativa)
  misc_feature (71): n=t or c
tcctgaccatcgacttcattcattaagccataaaggccaaacacaactcgttccatagtatctctatccgncttgacatacccagtgtgtatcagcttgtt

SEQ ID NO: 5704 - DNA, 101 bp, rice(Oryza sativa)
  misc_feature (71): n=a or g
tcagtggagtggagaaggcttcacggttgacccaggcccagtgcgcctgcatcatcccgtcccacctaccngccaccgcatcaccgccctacgtgtaacgt

SEQ ID NO: 5705 - DNA, 101 bp, rice(Oryza sativa)
  misc_feature (71): n=t or c
tagttacaataagcacggtgtgaaactgtgagaaaccataaagcaatctaacactaaacctaccatgggcngtttcttctggaaagcagcatcatatgcat

SEQ ID NO: 5706 - DNA, 101 bp, rice(Oryza sativa)
  misc_feature (71): n=t or c
aagctatcatagtggatgtctctaactgaagtcctttgtttaataacatggcaggccaatacagggagagncaaagaattcaatgcttcactgcaaaagct

SEQ ID NO: 5707 - DNA, 101 bp, rice(Oryza sativa)
  misc_feature (71): n=t or c
tctttcaattttgctagtctacccatgattatgttatttctttgttgcttgcagtcaacgaagggggtacnagagtatggagtaggatggctgctggctgc

SEQ ID NO: 5708 - DNA, 101 bp, rice(Oryza sativa)
  misc_feature (71): n=a or g
gacaggacctcctggaagagatcagaggagatggtcccgtagagccacgtgaggacaacacagtccatctntgcccagtccggatgggagggaggatcgtc

SEQ ID NO: 5709 - DNA, 101 bp, rice(Oryza sativa)
  misc_feature (71): n=a or g
agttgcaaaacagaaatgacaaagaagtaaaaaaactatttagctacatacctgccaagttctaccatctngcaacctagaagtatggatcctctatttgc

SEQ ID NO: 5710 - DNA, 101 bp, rice(Oryza sativa)
  misc_feature (71): n=t or c
tcttctcagaggatcggcttaagtaggaggaggaggaggagggacctgagcggcgtcgttgtcgcggaagngagcgccgccgccggtgtcacgccggcgtc

SEQ ID NO: 5711 - DNA, 101 bp, rice(Oryza sativa)
  misc_feature (71): n=t or c
gttttgttttacgcttaccattgtccagatgaaatacgcaaactcgaacgcgttctggaacaggatgaagnggaggagggcgagcacgagcctggggctgt

SEQ ID NO: 5712 - DNA, 101 bp, rice(Oryza sativa)
  misc_feature (71): n=a or g
aggtggaattacttggctggagaacagtgagttaggaactacaacagggaggttttctgggttaatcaatnacgtggatgtcagtccaatttcaataactt

SEQ ID NO: 5713 - DNA, 101 bp, rice(Oryza sativa)
  misc_feature (71): n=a or g
tcgagctttttggtggtggtacgtgttgttttttttaaggggtggatagcgtggaggtggacgtggcgatngagaaggtgagggtgacggggtacgtggac

SEQ ID NO: 5714 - DNA, 101 bp, rice(Oryza sativa)
  misc_feature (71): n=t or c
ttcaagagatatactacattctggacaaaatatgctggactaattggcattgtgcttttttgctttcaggngtttcctcctggttttccattggtgcataa

SEQ ID NO: 5715 - DNA, 101 bp, rice(Oryza sativa)
  misc_feature (71): n=a or g
agaacctactgaactccctcctaagcgatattgtgaccatagtattcctcttgtacctgtggcaacacctnttaatttgaggccataccgctttaatcctg

SEQ ID NO: 5716 - DNA, 101 bp, rice(Oryza sativa)
  misc_feature (71): n=a or g
cgcgtggaggaagtggagccgtggagtggaggcgtggaggcggtggagcgacggagtggtcgagaaagatnagcggtcgagacagaggcggctagggttag

SEQ ID NO: 5717 - DNA, 101 bp, rice(Oryza sativa)
  misc_feature (71): n=a or g
acaaactaaaaagacaccaacactgcaacacaagataaaagaacctatatccgaaattgacaaaaaatatntatataatcgttgactcaagtttatgacat

SEQ ID NO: 5718 - DNA, 101 bp, rice(Oryza sativa)
  misc_feature (71): n=t or g
cttcaggtcgtgcttctacagaaccaaataatgcctctaaaagttgtgggatttttgctccgggtatcagnccaaagggtggtgaatctcttgttcctagt

SEQ ID NO: 5719 - DNA, 101 bp, rice(Oryza sativa)
  misc_feature (71): n=t or c
cacggaggtggtgatggtgaaagatcttgccccgtttgcatttcacggtgatggtgatggagaaaattctnctccgtggaggcaggtctggtggtgtaacc

SEQ ID NO: 5720 - DNA, 101 bp, rice(Oryza sativa)
  misc_feature (71): n=a or c
atgggcataatccacgcaagtttcaggtgtgataaaggctggaaatgctgaaggtcttacgtaatcccctnccggaaattgtctcttaaacatcccattag

SEQ ID NO: 5721 - DNA, 101 bp, rice(Oryza sativa)
  misc_feature (71): n=a or g
ttgctactatatgagcttctagttactatatacccgtttacatttccttgcttttttagtatttctgtttnacttttgtcatgcctatgtgttgtgatgca

SEQ ID NO: 5722 - DNA, 101 bp, rice(Oryza sativa)
  misc_feature (71): n=a or g
ggacagggcgagacatcagcactgctggagtccctatgcaatctgcacaagatccaaactttggacattgncctaaatcttaatccaaatgagggtgtcac

SEQ ID NO: 5723 - DNA, 101 bp, rice(Oryza sativa)
  misc_feature (71): n=a or g
atggcctcaccatgttcacctggctaatcctctcctccacctcccaagctccgctcctattgcttcttccnctttccatggccaccgtgaccttggtgcac

SEQ ID NO: 5724 - DNA, 101 bp, rice(Oryza sativa)
  misc_feature (71): n=t or g
gttctggactcaacacatttgtcagcttagcagccaccgtgatggcaccatatacaacaaccagctttatnggaaaaataattatgatatcgatgtcacta

SEQ ID NO: 5725 - DNA, 101 bp, rice(Oryza sativa)
  misc_feature (71): n=t or c
acctcactggtgtttttgagcttttgatcgagatgcattcttcctcatcgtccaaaatgctgcgcggtacngattctgcaactcaacaacagtataaataa

SEQ ID NO: 5726 - DNA, 101 bp, rice(Oryza sativa)
  misc_feature (71): n=a or c
ctgcaataagatctgttgtccatctttgttcaccatcaaagtccttgtggaccaatcaactgtcatagggntgtgctgcatcaaccagtccattcccaaga

SEQ ID NO: 5727 - DNA, 101 bp, rice(Oryza sativa)
  misc_feature (71): n=a or g
aatccacttcaaacatggctaaactgcaatatttctaaaggatggggtggaaaggtgccagtactaatccngatgctacagatttcaccaagactgcgtcc

SEQ ID NO: 5728 - DNA, 101 bp, rice(Oryza sativa)
  misc_feature (71): n=t or c
atggcttgaatagacagtaacatattctctggttgagtctccaaacaggccaccacatctaacatttcatnagtcaacatttcagaattttgctccacttc

SEQ ID NO: 5729 - DNA, 101 bp, rice(Oryza sativa)
  misc_feature (71): n=t or c
aaacttcaattgtgaccagctcaagacacatcttagaaggttgtataagctggaatacatggttgatgacnccttggcaccaagaggctacaatatgtggt

SEQ ID NO: 5730 - DNA, 101 bp, rice(Oryza sativa)
  misc_feature (71): n=a or g
accacgcgaattggatctatcagacggggccaaaagccaaaaagggacgcttacctgcggatcgccactanaatcggagaagttcacgagctcgccggagg

SEQ ID NO: 5731 - DNA, 101 bp, rice(Oryza sativa)
  misc_feature (71): n=a or g
ttgagcttgttgtcaaaaaatgccaaaagctggagctagttgctcacaagcttccttcactgacaaagatnacagtggaaggatcaccaaatttctgtggt

SEQ ID NO: 5732 - DNA, 101 bp, rice(Oryza sativa)
  misc_feature (71): n=a or g
aattactggggtgacaaaatgggcatgacctctctattagatccttgcaagaggaaaggtcatattaggcncctattcaggctgtctaaagcaatgaagcc

SEQ ID NO: 5733 - DNA, 101 bp, rice(Oryza sativa)
  misc_feature (71): n=t or c
ggagccttccgagctgtaaacaagtctggtggttatgatttcctggttcgtgaccaccgtggatgtgctgntcttgcgggtgccggctgcctggaacatgt

SEQ ID NO: 5734 - DNA, 101 bp, rice(Oryza sativa)
  misc_feature (71): n=t or c
cggaacgtatatgtagttcttagcaccatcacgatagtatgtctgcgacctgttgcctctgaaattatcanggctaccaccacgaactttaccaacaggtg

SEQ ID NO: 5735 - DNA, 101 bp, rice(Oryza sativa)
  misc_feature (71): n=a or g
cccagctgacttgcaacgtttccgcttgccgtcaggccagtacatcgcttgccgtatcatcttctccattngagggagcctatcaagctcctcacccctaa

SEQ ID NO: 5736 - DNA, 101 bp, rice(Oryza sativa)
  misc_feature (71): n=a or g
tcaaacagttacaacttcgggcgcaaggacgacgagaaattgggttgggacttgatgaagtccagtacaantgctttcagctctttctcatggcctgtgta

SEQ ID NO: 5737 - DNA, 101 bp, rice(Oryza sativa)
  misc_feature (71): n=a or c
cttcttcgtgcctgtaagttgcaaaggctgcgcaccctaataatttggaataaagaaagatgttattgctnacgagtttgtgtgggagtagattttttcaa

SEQ ID NO: 5738 - DNA, 101 bp, rice(Oryza sativa)
  misc_feature (71): n=t or g
cccgccgcaggaatactatgactcaacgctgctgccgttccctccatgccagaagaagccttccgtggacnagcaattcgctcggttcatggatgtcatcc

SEQ ID NO: 5739 - DNA, 101 bp, rice(Oryza sativa)
  misc_feature (71): n=t or c
taataaggcagcttctcatactgcagataaaaccattctggtgctgcatccttttttgtcttcaaaagcanacctcttcttagtgatttggccaccacaat

SEQ ID NO: 5740 - DNA, 101 bp, rice(Oryza sativa)
  misc_feature (71): n=t or g
ctgtgccaatatttctgaccacgattcaggcagacaggttcatgctcatgttatcaaatccaaccaagctnctgcacatactgttgggaatgctctagtca

SEQ ID NO: 5741 - DNA, 101 bp, rice(Oryza sativa)
  misc_feature (71): n=t or c
atgatgtggtaccgggtaggccaatcatctatggatttcttgtcctgctccgtggtgtcccacatatcagnaccggtttcttccatgtccatactacttgc

SEQ ID NO: 5742 - DNA, 101 bp, rice(Oryza sativa)
  misc_feature (71): n=a or g
acaaggaattggtttcttcatctatgaagaacaccaaacaaacagtgatggcttggttattagcaacagcncctgggactacaagatcccaagtgtggaca

SEQ ID NO: 5743 - DNA, 101 bp, rice(Oryza sativa)
  misc_feature (71): n=t or g
aaatttttcttctctagaaattgatatcatgatatcgcgtatgatatcgtggactcgacagctcttgatanttccttccatattcactcttgatggttgca

SEQ ID NO: 5744 - DNA, 101 bp, rice(Oryza sativa)
  misc_feature (71): n=t or g
ctgaggctggccattggactttggacttcgatttgtccagtcctgtatttgatgacatctggactgacttntgtgattggaagattgccttcttccacccc

SEQ ID NO: 5745 - DNA, 101 bp, rice(Oryza sativa)
  misc_feature (71): n=a or g
cgaggggtcatggccagatcatctgcgaggagtagtcgtttgcaaaactgccagcgtagagggaggggatnttgtgctgcttgattctcgggatggaaaaa

SEQ ID NO: 5746 - DNA, 101 bp, rice(Oryza sativa)
  misc_feature (71): n=t or c
acagacaagaagattactgagttactcactgaagcaaacttgcttcctctcctgatatccttacttgaganaaacatcacagcgccattgacaccattgag

SEQ ID NO: 5747 - DNA, 101 bp, rice(Oryza sativa)
  misc_feature (71): n=t or c
taaagttgtagattttgcccgtttggttgatagagtggagagaaaactaacagcaagctctatgtttcttnctcaagggggacgtctcactctgataaact

SEQ ID NO: 5748 - DNA, 101 bp, rice(Oryza sativa)
  misc_feature (71): n=a or g
cacttccgcaaccaccttatgcccaagatgctcgctgtcccaaacattgacaaattcgctctactcatccntgagcagcgcaaggtttgttccctttagtt

SEQ ID NO: 5749 - DNA, 101 bp, rice(Oryza sativa)
  misc_feature (71): n=a or g
gacgccgtgtcgcgccattcctcgtcgctttcctcagcacgtcgccgattgccaggatggaggccgatgtngaacagccatagcgcaggaaaaaggccgac

SEQ ID NO: 5750 - DNA, 101 bp, rice(Oryza sativa)
  misc_feature (71): n=a or g
atactgctaaaatgtaagttgcaaccctatatttaagagtttaatctgtaattgccatgtttttacctccnctggtgcagaacatagcatgtaaaagcaat

SEQ ID NO: 5751 - DNA, 101 bp, rice(Oryza sativa)
  misc_feature (71): n=a or g
ggcggtgtcaaataccccagaagctggggcaattaagaagctttatacatctgttgtggttcaaaccaacnaggagcgggatgaaaagaataagtttggaa

SEQ ID NO: 5752 - DNA, 101 bp, rice(Oryza sativa)
  misc_feature (71): n=t or c
tgctcttcactgtcctgtttcgtaacaggtcttcctcaagcagcacctgacagctgtggttattgattcanatttctccactgaaggtaccattccattta

SEQ ID NO: 5753 - DNA, 101 bp, rice(Oryza sativa)
  misc_feature (71): n=t or c
acatcactagcgcggctgctgctcccgctaagtgtattgccttgggtcgaactactgttgccatcattgtncaccatgacaatcttgaccaagttgtctgg

SEQ ID NO: 5754 - DNA, 101 bp, rice(Oryza sativa)
  misc_feature (71): n=a or g
atatagcaaaacccagtgacaaccctttaaggtcccagggagagaagattgaaagaatccaaacaattttngagatataaatgtagacttttcagttaaat

SEQ ID NO: 5755 - DNA, 101 bp, rice(Oryza sativa)
  misc_feature (71): n=t or c
actttccgacaagccactcagccccagttttgcatcactaaagacaaggttggggcggtatctccatgaangtagaaatgtgtgagacacgcatgcagtac

SEQ ID NO: 5756 - DNA, 101 bp, rice(Oryza sativa)
  misc_feature (71): n=a or g
catgaactgtacgcccccccaatcatccaccatgcgtagcaacaatggaggcttcccatcatcattgtccntaagaaatagatgcttgccagtttttccga

SEQ ID NO: 5757 - DNA, 101 bp, rice(Oryza sativa)
  misc_feature (71): n=a or c
agcaggagctctggcctgagctgccttgttaggctcccttgcagattgaccagggtatcttggacgaagcncattgctcgcctttggtttcgcagatccct

SEQ ID NO: 5758 - DNA, 101 bp, rice(Oryza sativa)
  misc_feature (71): n=a or g
cttctcatttataaaccgatcaatgtcagactgtaggctagctttagcttctgactcagacaatgtaagcnatagcttggcaattctgttcttcaaaaacc

SEQ ID NO: 5759 - DNA, 101 bp, rice(Oryza sativa)
  misc_feature (71): n=t or c
ttgacatcccagagtccctgatagaatctgcattttttctggagatacattgatggggatcatgcaggatntatgaaaatttatcttgagccctatatttt

SEQ ID NO: 5760 - DNA, 101 bp, rice(Oryza sativa)
  misc_feature (71): n=a or c
cagtaatctgtggtgcatccagggaactgagaacctgaatcttgggattgtagatggtgaccttccatgcnatgagatctgctcattacagcattatctac

SEQ ID NO: 5761 - DNA, 101 bp, rice(Oryza sativa)
  misc_feature (71): n=a or c
tttggttttcttcccatttctatagcaggtagcaaacaaattaagcatggagctcaaacttgtattcttcntcgtcttcctcttctgtatttctggtgcga

SEQ ID NO: 5762 - DNA, 101 bp, rice(Oryza sativa)
  misc_feature (71): n=a or c
ccttactggggatgttgatgtcagtctcatgaaacaacctaagggggttgttattttcctcttcacccagnattgcaatagttgtcaggttcttgcttggc

SEQ ID NO: 5763 - DNA, 101 bp, rice(Oryza sativa)
  misc_feature (71): n=t or c
cagagacctgtatatcgcggcatttggcacgatgagcatttcgtggatcagcttctcggcattgttaagtngaccagcccggctcagcatgtcaatcatgc

SEQ ID NO: 5764 - DNA, 101 bp, rice(Oryza sativa)
  misc_feature (71): n=t or g
cagtggattttactcttgaagaactcaagtcactgagggtgaaacaacgctacaatttcagggaccaacantacaatggtatgaattgatttatcttcctg

SEQ ID NO: 5765 - DNA, 101 bp, rice(Oryza sativa)
  misc_feature (71): n=a or c
acactgcattcccttcagtttcatccccaacctggaaagctattgagcatggattgcaattgttgaagganggtgttatatggaggattggtaatggaaca

SEQ ID NO: 5766 - DNA, 101 bp, rice(Oryza sativa)
  misc_feature (71): n=a or g
aattattggtttgttacctaccaactgtttaatctgtactgcaatgcagaatccacggaatgtgccttctntgtcgtcgaattcgcggctttcgcctcttc

SEQ ID NO: 5767 - DNA, 101 bp, rice(Oryza sativa)
  misc_feature (71): n=a or g
agcatcagcacatgcaagaagggaagcaaggggctgagcatcatcataagtgtaggtcgaaaggccgccanccaagaatgtttcatttatttgatgcaata

SEQ ID NO: 5768 - DNA, 101 bp, rice(Oryza sativa)
  misc_feature (71): n=t or c
actgcagctttagcttcttggatagtgaaaggccctgaaatatcctgccagacagaattgaagagtccctngctagtggggtataaatcgtggagagagaa

SEQ ID NO: 5769 - DNA, 101 bp, rice(Oryza sativa)
  misc_feature (71): n=t or c
tgaaggaaaggcaaggaatccttacttgtagatcagcggacaaatccttcacgttatcttcagaaagtttnttttcctatgtaagcatgtgaaagcagtta

SEQ ID NO: 5770 - DNA, 101 bp, rice(Oryza sativa)
  misc_feature (71): n=t or c
ttgtacggaagtggcgagatgagataggctcttttgttaactttaccccactcgtcttcttcttcttcggnggcggcagcggcggcggccgtggcagcatc

SEQ ID NO: 5771 - DNA, 101 bp, rice(Oryza sativa)
  misc_feature (71): n=a or g
ccatgttatattaatgactttcgaatgtgccgtatgcagaatcccaaatcctctcagtttgccgatcacanggcggagatcgaggcggttggcagcgggga

SEQ ID NO: 5772 - DNA, 101 bp, rice(Oryza sativa)
  misc_feature (71): n=t or c
cctgcagagaagcacaacccatatattcatcatgatcagtccctctttgagccgctaccattctggccggngaggatcctggagatctgcagcccccggct

SEQ ID NO: 5773 - DNA, 101 bp, rice(Oryza sativa)
  misc_feature (71): n=a or c
catcttggtcgagttcctagagcgctgcgagtacttccggttctggaaccagtaccacacctcccgcgcancaccaaccccggcccggatcaacgtgtcag

SEQ ID NO: 5774 - DNA, 101 bp, rice(Oryza sativa)
  misc_feature (71): n=a or g
taaagtgtaaagttcagaatgtccatcgatccagttgaacaaaaaaaaatcaaactcataaacggcgctgnggtagtagtatgtgtataaaaaagaaaata

SEQ ID NO: 5775 - DNA, 101 bp, rice(Oryza sativa)
  misc_feature (71): n=a or g
tttataaattcagatgaattatgtcaatgcagaaaaacttaactcccaccttccatttttgccagctcttngcaagaccttttcagctaagaagaggaaaa

SEQ ID NO: 5776 - DNA, 101 bp, rice(Oryza sativa)
  misc_feature (71): n=t or c
cctcaactcaaccctagctgtttgtgggctgttagagatgcctctaacggagtggttatttttgactctcnaaatatctatattgccaggctgataaaaat

SEQ ID NO: 5777 - DNA, 101 bp, rice(Oryza sativa)
  misc_feature (71): n=t or c
cgacctcgtggccacgtcgacgtcgtacatgacccctctcccaaacatgggcaccgtcatcctgtacgtgncgccctggtggacctccgactccggccgcg

SEQ ID NO: 5778 - DNA, 101 bp, rice(Oryza sativa)
  misc_feature (71): n=a or c
tctttcctttcaccaaagattgtttgtgttcgtcaaagatgcgtgatggggtcccaaagtaggaagagttntcgccaccagctatcctggaccttaataca

SEQ ID NO: 5779 - DNA, 101 bp, rice(Oryza sativa)
  misc_feature (71): n=t or g
cgcccggcagggcaggccgcaggcgatagcgtcggcgtgcaggaaacgagggtcacgtaccctgagtctcngactccgtgaggctgtgggctatatatgct

SEQ ID NO: 5780 - DNA, 101 bp, rice(Oryza sativa)
  misc_feature (71): n=a or g
gggaaacggaatatgagagcacggggaggcttttgataggctcgggtggtggagatcgtggccgagcatgncgaatttgaagtgggaaggggcgccggcga

SEQ ID NO: 5781 - DNA, 101 bp, rice(Oryza sativa)
  misc_feature (71): n=t or c
cttgatgaggggcatattatcaagaatccaaagactcagagggctcaaagtctatttgaaataccctgtgnacatcgtattgtcatcagtggaacacccat

SEQ ID NO: 5782 - DNA, 101 bp, rice(Oryza sativa)
  misc_feature (71): n=t or c
gggagggaaacctcacgttgctgattttgttcatggatcggatggacttggtaacacgtcctttcctgatnctaccaccaccaacaaagttgagcagtcag

SEQ ID NO: 5783 - DNA, 101 bp, rice(Oryza sativa)
  misc_feature (71): n=t or g
ctggtgctgttcatcgtcatctaagaaaaagtactgctcatcacaatgttggtgatgcggcagctggatgntgaagagccgatcgtgatcgctcatgatag

SEQ ID NO: 5784 - DNA, 101 bp, rice(Oryza sativa)
  misc_feature (71): n=t or c
aaaaccaccttgccgaaatcgagtcggtaatagccgtcatcaaggtcgtctaggacgcaggcctccagttngggcgccgcgatcacggttacattaacgcc

SEQ ID NO: 5785 - DNA, 101 bp, rice(Oryza sativa)
  misc_feature (71): n=t or c
ccgggcttggcgacggcgagcttcctggtgttggagaagtagagcgcgatcaagcagccatcgccaccggngaggccggcgccgcacaccgatagatcgcc

SEQ ID NO: 5786 - DNA, 101 bp, rice(Oryza sativa)
  misc_feature (71): n=t or c
ttgctccgcgcctacggatgtcgccaccaatgcggcatttagcaagcttaacacaatcaggaagtttttgnccatggtgacaaatgagatggacggattga

SEQ ID NO: 5787 - DNA, 101 bp, rice(Oryza sativa)
  misc_feature (71): n=a or g
caactgatcgcttcatcgtaggctttgcacatggtgatgatggaattcaccacttgttgcaccgagccatntgcatcattaaagacttgatcatttctttg

SEQ ID NO: 5788 - DNA, 101 bp, rice(Oryza sativa)
  misc_feature (71): n=a or c
acatccaattgcttatggccaagatcaagggaatagtgggcatggggaaagagattggaatcgggcgtacnggagaactttggagatgatggccccgaagc

SEQ ID NO: 5789 - DNA, 101 bp, rice(Oryza sativa)
  misc_feature (71): n=t or g
aatcgcggagacagccaggatactgtcagtctcaaggatgattggcagaatcgaccaatgtagagccaaanccagaccaaatttacaggccagtagttctg

SEQ ID NO: 5790 - DNA, 101 bp, rice(Oryza sativa)
  misc_feature (71): n=a or c
ttgagctcatcctccgccctgcgcatgtgctgctgcatcgggttgtcttgcttgaccttgcagatggaggnggaattgcagccgagcttcttgccgtcggc

SEQ ID NO: 5791 - DNA, 101 bp, rice(Oryza sativa)
  misc_feature (71): n=a or g
gcttgagagtgatgccatgacgctctcgtctctcgtgcctgatgttcagatcgagccatcgagagtgttcnaggagagagtaaaatggaaaagagtaaatt

SEQ ID NO: 5792 - DNA, 101 bp, rice(Oryza sativa)
  misc_feature (71): n=t or c
tactgactagctcatctggtttaaggcatccaaacagaagggtctttagctttgatgtatctagtttaccnctcatgaaatctaacaagttcaaagcacaa

SEQ ID NO: 5793 - DNA, 101 bp, rice(Oryza sativa)
  misc_feature (71): n=t or c
gtaatttttatggtacggaggtggtagagaatacgagccaccgatgaggctcgaagatgcatggaaagtcngggcatggcgcgtgggaatgcgaatgcgag

SEQ ID NO: 5794 - DNA, 101 bp, rice(Oryza sativa)
  misc_feature (71): n=a or c
accatgtgtagatttgtctcaaaaagtacttccatagcatatcgtgtttgataaaaaaaaatcagaatagnaataagtggccaaagttgcagttttgaaac

SEQ ID NO: 5795 - DNA, 101 bp, rice(Oryza sativa)
  misc_feature (71): n=t or c
tggtaatcacaggctgttaacttagccggtgactgcatgaagaagtcctttttctgcagctcccaccttgngaaatgcagcggggtagtgtctggttcttc

SEQ ID NO: 5796 - DNA, 101 bp, rice(Oryza sativa)
  misc_feature (71): n=t or c
aatagcaggtccagcatcttgaggcaagtgctgtctgccagttagcatttctgaagaggaagacgcctggncttttgaatttgtagtcaatctagttgtaa

SEQ ID NO: 5797 - DNA, 101 bp, rice(Oryza sativa)
  misc_feature (71): n=a or g
caaatctaatttcttttctcacaatttaaagggaatgctagggggtcaggaagtcgctattaaaaggttangcaggaattctcaacaaggaacgaaggaat

SEQ ID NO: 5798 - DNA, 101 bp, rice(Oryza sativa)
  misc_feature (71): n=a or g
gttaagtatacccagtcaaacttctatgagaagctgtccactgtcatcgatgacttcccaaggttggatgncatccatcctttctatggtgatcttcttca

SEQ ID NO: 5799 - DNA, 101 bp, rice(Oryza sativa)
  misc_feature (71): n=t or c
ccttctggagatggagttgggaagtcatcaagcaacaaatccgaaattgggaccagctcatcgcagttggncggtctaaccaggccctctggccggtctga

SEQ ID NO: 5800 - DNA, 101 bp, rice(Oryza sativa)
  misc_feature (71): n=t or g
gctgcttccttgctttggatttcttctcagcattgttctcgggcaatcttgctggggagctccagaatttnttgtcatcagcaccaggttttggggacccg

SEQ ID NO: 5801 - DNA, 101 bp, rice(Oryza sativa)
  misc_feature (71): n=a or g
atgcatgaatttgccaaataactatttgagcactggaagctctgtaaattttgcgcagcagcaattcatcngttccaatgctttacctcaacaatttggtt

SEQ ID NO: 5802 - DNA, 101 bp, rice(Oryza sativa)
  misc_feature (71): n=a or c
ccgtcagccctgaacttgtgcttgaaaatccatttgccggtgacaatattgacttgagtcggtcgaggganaagctcccatgtgttgttctgaaggagggc

SEQ ID NO: 5803 - DNA, 101 bp, rice(Oryza sativa)
  misc_feature (71): n=t or c
ccactcctgcaatccacccgccctctgttttgtcaaacttctcatctccccttcccttccgccgccatgcngccggccggtagcctcaccgacaagcagct

SEQ ID NO: 5804 - DNA, 101 bp, rice(Oryza sativa)
  misc_feature (71): n=a or g
acacgaccaattgggccaaaattcacaagtctgcatattggaacaaaagagcaggccacctgccgaaattnggccaggccgacccagcccatggttcggcc

SEQ ID NO: 5805 - DNA, 101 bp, rice(Oryza sativa)
  misc_feature (71): n=t or c
attcaaatagtcagacagataatttagccactggtcagacaaacaaacctcataagtagacttgagatgcnggtacaaatcaccggcagtcactccaggtg

SEQ ID NO: 5806 - DNA, 101 bp, rice(Oryza sativa)
  misc_feature (71): n=t or c
cttaaaagagatttccaatattccaagatgtgatatgtcaattcttcctttgtgttcagcaccctaccatnttcttcaagcgatgtaatagtacatttcct

SEQ ID NO: 5807 - DNA, 101 bp, rice(Oryza sativa)
  misc_feature (71): n=t or c
tgacagccttggcaaaggaatggaccatcccagcgacgcaagttcccaggttgtgatgaatcttcatgtanggatatcccttgacttggttttaactccac

SEQ ID NO: 5808 - DNA, 101 bp, rice(Oryza sativa)
  misc_feature (71): n=t or c
ccaggaaacatccttatctgcaagaacacagaggcaagacttctctttctcttcctttttttggcaatggnattttcttgttgaatatagttttgtggtgg

SEQ ID NO: 5809 - DNA, 101 bp, rice(Oryza sativa)
  misc_feature (71): n=t or c
cccggtgctcggccacaacggctggtctgctcgccgcgtcgtctcctcctcattcttcatcttcctcttgntcgtcggcgcggtgcagcgcctgtacatat

SEQ ID NO: 5810 - DNA, 101 bp, rice(Oryza sativa)
  misc_feature (71): n=a or g
ttcatcagtactgttggtgacgcgccaaagttttcatcagattactcagtttaccttttcttcagattgcncagtagcaccattggacttttgtagatcct

SEQ ID NO: 5811 - DNA, 101 bp, rice(Oryza sativa)
  misc_feature (71): n=a or g
atggatgtcatctagaagatacacatgaacatacggtcgctcatgggtgcaatgcgagtgccaacatacgntcgctatctgaaggacatcctgaataacaa

SEQ ID NO: 5812 - DNA, 101 bp, rice(Oryza sativa)
  misc_feature (71): n=t or c
tggcccggcagcggcgggcagccggcggcgaacttggtgttcttggtggagaagaagttcaccgtcaggtncagactgaacaaacacaatattcagcaaca

SEQ ID NO: 5813 - DNA, 101 bp, rice(Oryza sativa)
  misc_feature (71): n=t or c
cattccgacaccacagtagagtgacaccattatgagaggtaggaaaggaaatctgctgccaaatacatagnggtggaatacttgagaccataattctatag

SEQ ID NO: 5814 - DNA, 101 bp, rice(Oryza sativa)
  misc_feature (71): n=a or g
gccaccagaaaatgtgagggaccatgtaatggctgcaacaagagccctccgcaagggtgactaccagaagnctttcgatgtcattaattcgctggagatct

SEQ ID NO: 5815 - DNA, 101 bp, rice(Oryza sativa)
  misc_feature (71): n=t or c
ctagcccaattccccaaagtaggatccaaaacatcagaatcatgattgggagaggtaggagagggagtacngaaggtttgaccagaagcatccggagcagg

SEQ ID NO: 5816 - DNA, 101 bp, rice(Oryza sativa)
  misc_feature (71): n=t or c
gtaactatggcgataggcattccatgcagtttatgtatgttatccataaatatctgtaccacctgctccanagtataaggatgagacaatgctaagaaatg

SEQ ID NO: 5817 - DNA, 101 bp, rice(Oryza sativa)
  misc_feature (71): n=a or g
catggcaccaacagagttgggtgtaaacgagaaagtgtagattcctgtttacccttgagagtgagcctaanagtagatgtcaggatgcatataaggtactt

SEQ ID NO: 5818 - DNA, 101 bp, rice(Oryza sativa)
  misc_feature (71): n=t or g
cttcaaggtctctctccaacctgctgaaattgcagatatgaagagggtggttcaacaacatatgattggangcgtgaatgataatggccttattaccttca

SEQ ID NO: 5819 - DNA, 101 bp, rice(Oryza sativa)
  misc_feature (71): n=t or c
attcaaggtggagaacaaagatgaaccaagagaagtgtatgcttgtggttcataagagactgttggaggcngcggttggctgaccgagagaacccaggaca

SEQ ID NO: 5820 - DNA, 101 bp, rice(Oryza sativa)
  misc_feature (71): n=t or g
gaggggttgccttgctgcttgatgccaattcaggagccatgtatcctatggtgcctaccacacgggttgtntgtgcatcgacaccacgatcgtacaacctt

SEQ ID NO: 5821 - DNA, 101 bp, rice(Oryza sativa)
  misc_feature (71): n=t or c
atttcctatgaaagcggccagaaggagcaccaaaatgtaaaagacaagggaagtaccagcccaaaggcccntgtcatcctgtgttcgttcatgctggcttc

SEQ ID NO: 5822 - DNA, 101 bp, rice(Oryza sativa)
  misc_feature (71): n=t or c
atctttccaacaagaaagttgtactgagacttcaaatccttgtagagtgtcttcagcttagtgtaatcctngatcaggtccttccgcttattctgctcgag

SEQ ID NO: 5823 - DNA, 101 bp, rice(Oryza sativa)
  misc_feature (71): n=t or c
cgtggcatccctgtcctctgaatcaatgtgacctttacgaagatgttccacgaccaaattgcatgtttctngcagctttgccacttccttttgcttgtgca

SEQ ID NO: 5824 - DNA, 101 bp, rice(Oryza sativa)
  misc_feature (71): n=a or g
agcagtagcactgcctctcctctccctgcttgtgttgtttcttcttcgatcgatcggtctttgatcagccngctcgctgatagtatctttgatggtgggca

SEQ ID NO: 5825 - DNA, 101 bp, rice(Oryza sativa)
  misc_feature (71): n=t or g
caagcaaggttttggaagtgatggaggtaccaaggagaaaaaagcacgtgtagaaaggattcttgctgcanggaaggcgctgttaaatttcgttcaaattg

SEQ ID NO: 5826 - DNA, 101 bp, rice(Oryza sativa)
  misc_feature (71): n=t or c
gacagttcgatttacctgataactgatgagaattgctcgtccgagcggttgcccgcgaatcggataaaagncaaggtagcggtcaccggtcacgggcagta

SEQ ID NO: 5827 - DNA, 101 bp, rice(Oryza sativa)
  misc_feature (71): n=t or c
tcatggacgttacccttcactgcagcctgatgctgagagaatgctctcgggttgaaattttcgtcatggcngtctccgaatgcaacccagccatcaccgcc

SEQ ID NO: 5828 - DNA, 101 bp, rice(Oryza sativa)
  misc_feature (71): n=t or c
attttagtttctattgaccgggaacataaatatcctatggctgtagtaaggaacttggaaaaggtgttctntgatcatgtgccccttttagtggatacagg

SEQ ID NO: 5829 - DNA, 101 bp, rice(Oryza sativa)
  misc_feature (71): n=t or c
attctgcaaaatctacggtttctggccctttcgaaaaacccgtcatttccaaagttaaatgcctctgccanacgacacacgacaccaccacccttcttgaa

SEQ ID NO: 5830 - DNA, 101 bp, rice(Oryza sativa)
  misc_feature (71): n=a or c
catgtagaacaacagaagttgagtgattactcttgtaagtatgaacaaaccttgagccctaagacgcctgnatttaataggctctctagtgcacttggatt

SEQ ID NO: 5831 - DNA, 101 bp, rice(Oryza sativa)
  misc_feature (71): n=a or g
gggctactttaatgatcttgtacaaagatcattcttcgagagatctttgttagaccttccaatagagtatntcatgcatgacttgatcaatgaccttgcca

SEQ ID NO: 5832 - DNA, 101 bp, rice(Oryza sativa)
  misc_feature (71): n=a or g
atttgtgactttaggccaggaagataaagaaaagattgtcctcgagaaatacttgaagaagtacaagtacntgcatttcaatggtgagcgcgttcgggtgc

SEQ ID NO: 5833 - DNA, 101 bp, rice(Oryza sativa)
  misc_feature (71): n=a or g
caatgttattgcaaatagtttgttttccaagttccactcttgaatgcatttgagaacagcattgaaaatcnctacaccagtgtgtggcgtctccaagacag

SEQ ID NO: 5834 - DNA, 101 bp, rice(Oryza sativa)
  misc_feature (71): n=t or c
tcatctggcccctcatctctccacctccagccttggtggattgctcactcccagcttgcgaggagcccccntggtgcgccactgcgggagggcgaccttcc

SEQ ID NO: 5835 - DNA, 101 bp, rice(Oryza sativa)
  misc_feature (71): n=a or c
gttggtatggtgaattgcgagacctcatcctggctgatctctgaatctaaccctttgtaaaaatggcttgncgcctctgacccaaccaagaaagtcacctt

SEQ ID NO: 5836 - DNA, 101 bp, rice(Oryza sativa)
  misc_feature (71): n=t or c
ggatcttctcgtcctccatggataaatgtcagctttggtgttatacacctgccctgcttcaactcattaancatggttctcaaaagacctacgtgatatgc

SEQ ID NO: 5837 - DNA, 101 bp, rice(Oryza sativa)
  misc_feature (71): n=a or g
tgcgtcctgggctccgatgggcttgcaaactctgtactctaaaggtcctggagagcttgcctctgataatngaggagcaactcttcctgccggttcagggg

SEQ ID NO: 5838 - DNA, 101 bp, rice(Oryza sativa)
  misc_feature (71): n=a or g
gttccctttccttagcttcacggcttgtttgttgaatactatgtgattgtcataaccaccatgatgattgncatgctcatgcccatcttctggattgccaa

SEQ ID NO: 5839 - DNA, 101 bp, rice(Oryza sativa)
  misc_feature (71): n=t or c
ttgccgccgtcacggacagctgcattggacatcaattttctgacggtgatcacaacgcatccgaggaagangacgagagcaacgaggccaaagcaaactcc

SEQ ID NO: 5840 - DNA, 101 bp, rice(Oryza sativa)
  misc_feature (71): n=t or c
aataactaccttgaagcggtactttccagtggagcatcctcatcacacagtttatttatcatcaattcatntctgaggacataaatatgagcaaaagcaca

SEQ ID NO: 5841 - DNA, 101 bp, rice(Oryza sativa)
  misc_feature (71): n=a or c
cagtgcccctaatagccacatgctctttcttataatgccctttcttagtgccagtccccaactgagcagantcatgtgccaaagcaaccaaataagcctga

SEQ ID NO: 5842 - DNA, 101 bp, rice(Oryza sativa)
  misc_feature (71): n=t or c
caagaagcatcagtgtcccctgtagatttcttgtactcaggcttgagctcatgcgttccctggtttggtcntcgtttgttgtaaaaacacagatcattcag

SEQ ID NO: 5843 - DNA, 101 bp, rice(Oryza sativa)
  misc_feature (71): n=a or g
aagtaatgggaattccaactcaagaaattatgggttacctaaaaagaaagacggcaatgacaaggttactntctgtcagtctctggtatgttatatttcac

SEQ ID NO: 5844 - DNA, 101 bp, rice(Oryza sativa)
  misc_feature (71): n=t or c
gaagatattatggaagttgaggagaagctgattgatgatatttccggaagcccttctagtcatttgcctgntgctttaaaatcaactgagtcaaatcagcc

SEQ ID NO: 5845 - DNA, 101 bp, rice(Oryza sativa)
  misc_feature (71): n=a or c
actgaatttatcagatattcacaactgttgcatgtgtctttttttcccttgttgcgatattccaattcagncatcaattgagttgccgaagcaaggtcgtg

SEQ ID NO: 5846 - DNA, 101 bp, rice(Oryza sativa)
  misc_feature (71): n=t or g
tttcttatatacatgtatattgatttttttttaaaaaatggccttatgagttgcagatggtctaagggaantttcggtgtcatatggaagtaaaggtgaag

SEQ ID NO: 5847 - DNA, 101 bp, rice(Oryza sativa)
  misc_feature (71): n=t or c
aattctatcaatcggcccatatcaccatggagctcctaagctgacagccatggagagagaaaaatggaagngtttagactttattctcaagttgaattgtg

SEQ ID NO: 5848 - DNA, 101 bp, rice(Oryza sativa)
  misc_feature (71): n=a or g
tgggaataattttttaaaatatacctcttcggtaacgcgggaccgcacgcggctggatcgttcaatgcttngcagccggtgctgcgccatggttccgcggg

SEQ ID NO: 5849 - DNA, 101 bp, rice(Oryza sativa)
  misc_feature (71): n=a or g
gggcccaacatgaggcgggatgggagcacgattggtgggatgggaggaagtcgaagagcattcactatacnaactcgccatctcctcgcatgcactcctct

SEQ ID NO: 5850 - DNA, 101 bp, rice(Oryza sativa)
  misc_feature (71): n=a or g
atgtcaggtttgtgggatactgagacgaatgccgtgcaatcgaattgatgcccgatcttgtcgtacacatnttttgcaagagttgttttaccgagacctcc

SEQ ID NO: 5851 - DNA, 101 bp, rice(Oryza sativa)
  misc_feature (71): n=t or g
cattttaaaacctagcactgctcttacttcaatggagcattttcagaaaaatgggcatgataacctggatnattctgaagcccctgttatatcaaggcatt

SEQ ID NO: 5852 - DNA, 101 bp, rice(Oryza sativa)
  misc_feature (71): n=a or c
aggttgcaaagaagagcagtgttgtaccgctagaatcaaaaccatcaaagaaagctactgggattagtcanagtgctggtactgatgctgtgaagagtaag

SEQ ID NO: 5853 - DNA, 101 bp, rice(Oryza sativa)
  misc_feature (71): n=t or c
ggcggtgccgcctgcaacaatgaagcactgcaccttcgccaaccgcctcgcctcattctttccaaaccatnccatggagaacaccccgcaccccacattgg

SEQ ID NO: 5854 - DNA, 101 bp, rice(Oryza sativa)
  misc_feature (71): n=a or g
ttgaatatctctgtgtgctgctgccaacgtagcagcagacttggttgactcctgatcatgaagatctttgncatttcgaatagcaacttgaagtgctccca

SEQ ID NO: 5855 - DNA, 101 bp, rice(Oryza sativa)
  misc_feature (71): n=a or g
gagtactttgagcattgtttagctaacttgaatcagaatgttcatatgttaccaggtgatcgaatcatcanaagctgaaagggagagagaggcaaaggtgg

SEQ ID NO: 5856 - DNA, 101 bp, rice(Oryza sativa)
  misc_feature (71): n=t or c
ctctcgccgcgcttgcctggtgtttcaccaacacagctaagcgcttgcagagctggggcgaccgtcacatnggtagcgtccgtctccaccttcaaatggcg

SEQ ID NO: 5857 - DNA, 101 bp, rice(Oryza sativa)
  misc_feature (71): n=t or c
tccttctcttgaattgccatggctatctccctgtcttgcatgatctgtattgctttctttttgtcctcctnagctaacaactcaatcttagcaggggtgta

SEQ ID NO: 5858 - DNA, 101 bp, rice(Oryza sativa)
  misc_feature (71): n=t or c
ccacagagccaaactaagctaagcattctttgtcagaatttggtaggtgtggggtaaggcgcgatgtgagnggcgcgttgggagagggtatggccccgtgc

SEQ ID NO: 5859 - DNA, 101 bp, rice(Oryza sativa)
  misc_feature (71): n=a or g
tattatggaccatttcgtgtgactgagaaggtgggggcagtagcatatagattgttactacaagaaggaantctcattcatccggtgttccatgttagcca

SEQ ID NO: 5860 - DNA, 101 bp, rice(Oryza sativa)
  misc_feature (71): n=t or c
gtcgcagcatgagctgcaagaacaattgaggcaccttggtcttttgcacttgggtgagcacttgcaacagnagcaaagacatgaaatgcagatacacaatt

SEQ ID NO: 5861 - DNA, 101 bp, rice(Oryza sativa)
  misc_feature (71): n=a or g
tgcgtttgctaagagcagctggacaacttctgaactcatctttttaacaatggcttttgtggttgcagccnttgaaaataaagtcagtacattttccaatg

SEQ ID NO: 5862 - DNA, 101 bp, rice(Oryza sativa)
  misc_feature (71): n=a or g
ctataactttcactactacagtctagcccaaggattccaatccctatttgactttgcacaacatcttgccncaaatgttgacattgtcttcccggtgatcc

SEQ ID NO: 5863 - DNA, 101 bp, rice(Oryza sativa)
  misc_feature (71): n=t or c
cttcttgagctcgtcctcgtgcattgctttcatgtcgccggtgccagagctcaaggtggcgtgcttcatgnagtaccgcttggcgatgacgttgtcggcga

SEQ ID NO: 5864 - DNA, 101 bp, rice(Oryza sativa)
  misc_feature (71): n=a or g
attacaggcttgcaaaggtgtgcgcaatatcttcgcttcaagaaaagtaactctggtgcctataagagagntggctgatgtactctctgttcagagcaagt

SEQ ID NO: 5865 - DNA, 101 bp, rice(Oryza sativa)
  misc_feature (71): n=a or g
tctttggcttcatgagtttctgggatgacgttgccacggtggagtttgtgaatgaagttcttccgatggcncgcattgactttcaagtggaaaaacttagt

SEQ ID NO: 5866 - DNA, 101 bp, rice(Oryza sativa)
  misc_feature (71): n=t or g
actgcacgatattccaattgggcctaattcttggatcacacgtaagtcatatattttccttatctggatantttgcaccatttggccttcatatctggact

SEQ ID NO: 5867 - DNA, 101 bp, rice(Oryza sativa)
  misc_feature (71): n=t or c
ataagtatatacattaggggaaataccagcattctccatttcactaagaagccgaaaagcatcctttttgntatgatgacggaaatgtccttcaataatga

SEQ ID NO: 5868 - DNA, 101 bp, rice(Oryza sativa)
  misc_feature (71): n=a or g
gatgaagactacaagtactactcggtgtacaaggacccaaaaaaaaagaatatcagtctagctatcttgcnggaagaactcttaaaagcaaaagtagccga

SEQ ID NO: 5869 - DNA, 101 bp, rice(Oryza sativa)
  misc_feature (71): n=t or c
aaaccatatttttcaataacaaacatctgatgtggagacaacgatgaaacaacccgacgaaaatacttggnagaaaaccttgaaaatgaaccatcactctt

SEQ ID NO: 5870 - DNA, 101 bp, rice(Oryza sativa)
  misc_feature (71): n=a or g
tgcccagttgaggagttcccatgcaaatatttgggtttgactctttccatcagaaagctgtgtcgtgaggncctccaacctctggtcgataggattgcgca

SEQ ID NO: 5871 - DNA, 101 bp, rice(Oryza sativa)
  misc_feature (71): n=t or c
atgcaatgataattcaatgtagaaaccagcttgccactctgtaaaggataaggataggctcaccactctgnctaatgacgttcttctcaacattcttgagc

SEQ ID NO: 5872 - DNA, 101 bp, rice(Oryza sativa)
  misc_feature (71): n=a or c
cataaatctttagtgtgagtatgagtatggtcaggaagaacatatcaccaaacaccaacatcacatggtanaattgtgcatctctgaggagatatttgcag

SEQ ID NO: 5873 - DNA, 101 bp, rice(Oryza sativa)
  misc_feature (71): n=t or c
ccagatagaaaaggatgtttctgatgctgataaggctgcaaatcatccatccagcgcgatcacagagaatngtctacacaaagcaaatgagatcgatgctt

SEQ ID NO: 5874 - DNA, 101 bp, rice(Oryza sativa)
  misc_feature (71): n=t or c
cgacatgtggaggtggatgaagatgcagatggccccacccgtggactccttgaacatgaagcatggcagcncgtgcgtgctccttttgacagagtggaaga

SEQ ID NO: 5875 - DNA, 101 bp, rice(Oryza sativa)
  misc_feature (71): n=a or g
gagcaccacttttagtcgaaggccgaggctggaaccatccgcaagaatgggtacatcgttattaagaaccncccctgcaaggtggtggaggtttctacctc

SEQ ID NO: 5876 - DNA, 101 bp, rice(Oryza sativa)
  misc_feature (71): n=a or g
ccaaaccctagtgaagcctgcctttggcacgggaaagatagtgtagcgatgtgcgagcggagaaggcggcnccatggcgcgagcaaagatggcgtggtgtg

SEQ ID NO: 5877 - DNA, 101 bp, rice(Oryza sativa)
  misc_feature (71): n=t or g
cagcgcctgcggcctcttggcctacctcaacttcgatcagctcgtcaagcgtggctacgtgccactcaaangtagtagtaacagctaactgattaaacacg

SEQ ID NO: 5878 - DNA, 101 bp, rice(Oryza sativa)
  misc_feature (71): n=a or g
ccttcaaaaaacataagggtcttcagcattttctttccaccttctccagcagtcccatgctcttcaacatntttctccacatggaatagatcacaatgccc

SEQ ID NO: 5879 - DNA, 101 bp, rice(Oryza sativa)
  misc_feature (71): n=t or c
tttaatcggacctgcaatcaactcgttcacgacaagaagtgctctgatctttaaaaagacatatccatganttttgagattccatttccatgtccgggcct

SEQ ID NO: 5880 - DNA, 101 bp, rice(Oryza sativa)
  misc_feature (71): n=a or g
ctcgcgcgtcgaagcccagtgtgtcagttcagatacagtgtgacgagagcccaaaatggcagataccacangcatctggatgaagttgaatgtggatgggt

SEQ ID NO: 5881 - DNA, 101 bp, rice(Oryza sativa)
  misc_feature (71): n=a or g
ctcctgcaagaattaatatatctttcagactcccagagattacacctgatcgatcgaattgatcgcgatgncgacgatggctaaggtgatcacttcggttg

SEQ ID NO: 5882 - DNA, 101 bp, rice(Oryza sativa)
  misc_feature (71): n=t or c
gaagagagggtgaagagtgcagacttgtctggttctcacagtgattacgttggtggggactcttgttcatnaggagaagatcaagaggttgaggaaattag

SEQ ID NO: 5883 - DNA, 101 bp, rice(Oryza sativa)
  misc_feature (71): n=t or c
agcgaaaaaatcatccgagtttaaatttatttatttaccatgaggatcggacagatgaaaggagcaggganacaaacttctggtgatgccggtggaaagta

SEQ ID NO: 5884 - DNA, 101 bp, rice(Oryza sativa)
  misc_feature (71): n=t or c
ggagtgcttggctattcttcttgcggttgatcattggcgctcttaccttcaaggttctgagttcattattngcacagaccagcggagtttgattcatttgg

SEQ ID NO: 5885 - DNA, 101 bp, rice(Oryza sativa)
  misc_feature (71): n=a or g
aaatcttctttaacaggggagttctctttcaacagaagatctgcgtgatctttttaccttccatgaacaantcaggtgaattatgttcatttgaattgtgg

SEQ ID NO: 5886 - DNA, 101 bp, rice(Oryza sativa)
  misc_feature (71): n=t or c
tacaaaagattgcacgaaatccattagttgaatctttgcccacttataggatgcatcagggttaccccccngaggcggatgtctccatggtgcaccgaaag

SEQ ID NO: 5887 - DNA, 101 bp, rice(Oryza sativa)
  misc_feature (71): n=a or g
ggttaacaatatggacataccggtaatgctgcagacaacagcagcagttcacccaggggcaagtggcggtnttcttcttgattcgcttggccgaatggtgg

SEQ ID NO: 5888 - DNA, 101 bp, rice(Oryza sativa)
  misc_feature (71): n=t or c
tcgcccctagggtcgctactgcctacgaaaccacctttaccggattcgccttcttcttgccgaggactatncgtcgacgcttaggacgccgccatcctccg

SEQ ID NO: 5889 - DNA, 101 bp, rice(Oryza sativa)
  misc_feature (71): n=a or g
ggcactacatactatagtcagttaccactaagtaaccaagcagatcaacagaaggcttcacgttggcaggntccaatttcaaacgtttcttcagtcaatca

SEQ ID NO: 5890 - DNA, 101 bp, rice(Oryza sativa)
  misc_feature (71): n=a or g
gagaggatgggatggccgatggcaccaagaggaggaagaagaagcttggggggtggagaagatgatgatgnttgggtttggcattgggggcgtcgcaggag

SEQ ID NO: 5891 - DNA, 101 bp, rice(Oryza sativa)
  misc_feature (71): n=t or c
cgatagtacacttaaagtttaccatctttactgtaggatatccaaagaacatatattattaactgtggganaccaaataacatgcatggtaactatcgaca

SEQ ID NO: 5892 - DNA, 101 bp, rice(Oryza sativa)
  misc_feature (71): n=a or c
gagaccttcttgagtgtcccattgttgcttggaggtataggcactcttcttctctttggctggggcaaacnaagcatactgggcatgccactgcaccagtt

SEQ ID NO: 5893 - DNA, 101 bp, rice(Oryza sativa)
  misc_feature (71): n=a or g
aaggaaggtggtcctggatgacgatgacgtgcatgaagtggagaacacaggagaatggttcctggttaccngggccacgaatcacatgacgggggcgcgct

SEQ ID NO: 5894 - DNA, 101 bp, rice(Oryza sativa)
  misc_feature (71): n=a or g
gagccaaacggaaagctgagagaagtggcagacgagcttgctgctgcactggtgttagagaacaatgaggnagcaggtgctgccggcgaagtggccaagga

SEQ ID NO: 5895 - DNA, 101 bp, rice(Oryza sativa)
  misc_feature (71): n=a or g
tagctactcgatccatactgaaaaacattcttcaaaattactggtatgtggacccggagattaattagtanttaacgacggcggcgggacaatgacgacct

SEQ ID NO: 5896 - DNA, 101 bp, rice(Oryza sativa)
  misc_feature (71): n=a or c
gatcaccaaccaatcttgcagcaactaatttaaccactcgataggcccatgtgtgcaagactatgttgtcntcacaaactaaacaaatgaggcatctctct

SEQ ID NO: 5897 - DNA, 101 bp, rice(Oryza sativa)
  misc_feature (71): n=a or g
gtcacacttacataaaaattaaaatcacctgaagttgttgttgttcattgcagggtttaagagagagactntgttagtgccgtgcttcatgaacggcaatc

SEQ ID NO: 5898 - DNA, 101 bp, rice(Oryza sativa)
  misc_feature (71): n=t or c
gggataatttggacaacagagtggtctaacttcagagagttaagttcttctccagaatatgaatcaagaanagataggacaccaggagcagcactatctgc

SEQ ID NO: 5899 - DNA, 101 bp, rice(Oryza sativa)
  misc_feature (71): n=a or g
gcacgagcactggaagcaccaatggctacctggtcagctcgagaatctgcttgcacattgtcagcactacnactggcaggatcggtaagagcttctgccaa

SEQ ID NO: 5900 - DNA, 101 bp, rice(Oryza sativa)
  misc_feature (71): n=t or c
ccattaggccagaattcttctgtcaaaaaggatgatgagtcaaatcctgaatcacgaaaggctggaggcantcctgcctacgggttctctttcaagtgtga

SEQ ID NO: 5901 - DNA, 101 bp, rice(Oryza sativa)
  misc_feature (71): n=a or g
gttagaatacctgtcaaagaactcactgtcagattatacatgttcagaaagctctgttacaaatagggggnaaaaatcagcttttagggaaaaaaaatgat

SEQ ID NO: 5902 - DNA, 101 bp, rice(Oryza sativa)
  misc_feature (71): n=a or c
ccttactgcgaaaaccgccatggaaggaagttctgcaagccaggccaaggccttgttcaaagccactcttnttggcctggccatcctatccatggtgacat

SEQ ID NO: 5903 - DNA, 101 bp, rice(Oryza sativa)
  misc_feature (71): n=t or c
tctgcctttctctctctgcgccacatcaccattgccgctctcgtcgtcgcctggagagcactcccagccangcctcctagagcgccctcccatccgcgccc

SEQ ID NO: 5904 - DNA, 101 bp, rice(Oryza sativa)
  misc_feature (71): n=a or g
cctcttggaacttgcggaacattccagcaaggggagtgccattcaattaactcaaactctgttcttgaaanggtgagaacgctgtttggtcattttggtct

SEQ ID NO: 5905 - DNA, 101 bp, rice(Oryza sativa)
  misc_feature (71): n=a or g
aaggatgtcagggctctagcgcataaaaatgtgaccaaacgttagcaccttgtcgatccaaatcatacccncccatgctgacgagcatcacattcacgcgc

SEQ ID NO: 5906 - DNA, 101 bp, rice(Oryza sativa)
  misc_feature (71): n=t or c
aagagtggtgctccattggctttgtccactagctcagaggcccgagaacagaaatcatcaaagtcgtctanataagcagacagacagagtaaataagaaaa

SEQ ID NO: 5907 - DNA, 101 bp, rice(Oryza sativa)
  misc_feature (71): n=a or g
attgacagagtccatcatcctccaatattcagaggaagcaagagcctttttcactggtggtccacgcccangctttgctgtaaataaaatcaaggcagaga

SEQ ID NO: 5908 - DNA, 101 bp, rice(Oryza sativa)
  misc_feature (71): n=a or g
tgcttcactcatattggtagagcaaagctcggtcctaagatatgacaagcttggaacaacacgctctatanccaatgcatgtccatattgtgtgtctgaca

SEQ ID NO: 5909 - DNA, 101 bp, rice(Oryza sativa)
  misc_feature (71): n=t or c
ttaccagctgctctgtatctgtaagggtaagtccttgtaggatccaaaagtgttgccatattgagatcacntcttgcttcatctctttcaccatattccga

SEQ ID NO: 5910 - DNA, 101 bp, rice(Oryza sativa)
  misc_feature (71): n=t or c
aagaacatcaagaagatctagctgcaaaaaaattcagcaatcaaacaaacctgaagaagaagaagacgcantggatctccgcgccacggcggctctcgaga

SEQ ID NO: 5911 - DNA, 101 bp, rice(Oryza sativa)
  misc_feature (71): n=t or c
gcttgaacaccagcaggaacaagaaccggatcaacagcagcaggatggatatgagacggatcaccttgaangccatccggaacaccaagacctaaataagc

SEQ ID NO: 5912 - DNA, 101 bp, rice(Oryza sativa)
  misc_feature (71): n=t or c
tcaaatactccgctttccatatcccaattgctggaagaggagaccacgggctcttccaaggaaaagtttgngggcacaaatgtgtcgcccctagtaaagtt

SEQ ID NO: 5913 - DNA, 101 bp, rice(Oryza sativa)
  misc_feature (71): n=t or c
ttcccgcattgcatagcccagctatcattgtggtgtaagccattgtatctggatccacatgatcccttctnatctcctcccaaaccctgatgcaaccctcc

SEQ ID NO: 5914 - DNA, 101 bp, rice(Oryza sativa)
  misc_feature (71): n=t or c
tcctgcctttcacggagtgtcaaatacccgttgtcgtacggctttgcatactcgtacgtcctgactcctgnggtccacggcgagcggctcaggccgctcga

SEQ ID NO: 5915 - DNA, 101 bp, rice(Oryza sativa)
  misc_feature (71): n=a or g
gacgaaccagtggttttgggcgaaccgaaaaaaataaataaaaaaaagagccgaaaaaagtgaaaggcctnggagcgaagcggcagagaatggcagggaaa

SEQ ID NO: 5916 - DNA, 101 bp, rice(Oryza sativa)
  misc_feature (71): n=t or c
atattatcatatccaggctgccttttgcaagtgcaggcaggtgctgatctatcagcaacatgaacctcttntgcaacacctgcaaggtcccttgagatgtc

SEQ ID NO: 5917 - DNA, 101 bp, rice(Oryza sativa)
  misc_feature (71): n=a or g
ttatatactaacaaccgtatatcatatcctttatatttgatcctggaactcttgtcattaccaggctctgnaatctggtgatcttctctgtggtggtacag

SEQ ID NO: 5918 - DNA, 101 bp, rice(Oryza sativa)
  misc_feature (71): n=a or g
tcttttttaacttgcagagtagcaattgtttcaccatgggatcctgtttgtgtagcagcacgaaaaatgcntgaattacgggttaactcagtggttatcac

SEQ ID NO: 5919 - DNA, 101 bp, rice(Oryza sativa)
  misc_feature (71): n=a or g
ctttgacatttgctttgtgtatgacattccatttgacattgggttctcactacaataggtgaatccagaancaaatgatgcatcggtatcaatgatagaca

SEQ ID NO: 5920 - DNA, 101 bp, rice(Oryza sativa)
  misc_feature (71): n=a or g
atatgattgaataacatgggacgaatctactttttgagatgtttgatttaagggtgagtgggatgggttgntccctggagagaaatattcctctcagatcc

SEQ ID NO: 5921 - DNA, 101 bp, rice(Oryza sativa)
  misc_feature (71): n=a or g
tggtcccttattttgtctatcagttgtcgctcatcttcagatgtgtcatcagtgatccctacctcagtatncatttgtctttaaatactctttatgtcagg

SEQ ID NO: 5922 - DNA, 101 bp, rice(Oryza sativa)
  misc_feature (71): n=a or g
gccagatccatcctccaaatctatcaccttgtgctcgcaacctctgggagctcatgggagaaaaggccccncaccactaacatccttgtcaccgcaagatt

SEQ ID NO: 5923 - DNA, 101 bp, rice(Oryza sativa)
  misc_feature (71): n=a or g
gcacgttctccttcgctggtcaggatctccgtccccgtcgccataccctacacatgagtcaccgaggtccntgccgccaagactccgtcgcgccaaccctg

SEQ ID NO: 5924 - DNA, 101 bp, rice(Oryza sativa)
  misc_feature (71): n=t or c
gttgcaatatttgaaaatgggagtcaaatcacacagggtggtctttctaaactacaaatcgagattttacnagtccatgatgatttcttcactgagcgagg

SEQ ID NO: 5925 - DNA, 101 bp, rice(Oryza sativa)
  misc_feature (71): n=t or c
aagtcacaaagaaccatacggaaaccagagtcaccagattcagatggattgcaggagaaagctactgtcangaaacaaaaagcagaaggcgagcttctcgc

SEQ ID NO: 5926 - DNA, 101 bp, rice(Oryza sativa)
  misc_feature (71): n=a or g
ataagtgaaaggcatgtttcccactttgcagttaaacatgttggtaattcttaactcctcatctttctctncacccatcacatagatctcacttttctgat

SEQ ID NO: 5927 - DNA, 101 bp, rice(Oryza sativa)
  misc_feature (71): n=t or c
tagctgtatgatttttagtttagccatacagcatttcttagggactcaacttcaaaaaccgaatataactnaccctcaacttctaaaaccgctcaatttac

SEQ ID NO: 5928 - DNA, 101 bp, rice(Oryza sativa)
  misc_feature (71): n=t or c
tcttcagctttcagctggttctatcgagacacttattgttgacaatgccgatcaaataagagattatgatnttattcttcctttaactctccgcgatgtca

SEQ ID NO: 5929 - DNA, 101 bp, rice(Oryza sativa)
  misc_feature (71): n=t or c
atttctcactgatttcattgttcaattttcaggagcttgaggagaagaggaaggagaaggccaaggttgcntatgacaggaggaagcaactggcgaagctg

SEQ ID NO: 5930 - DNA, 101 bp, rice(Oryza sativa)
  misc_feature (71): n=a or c
acatctgataaaaactgtcaaaagcatcgccatgtgtcattgtcacttataccttgatgctatgaacaacnttgtagttgtagtactacttggcatgaact

SEQ ID NO: 5931 - DNA, 101 bp, rice(Oryza sativa)
  misc_feature (71): n=a or g
ccctagcttacctgtagtatcaaattgtactcgaacgacgtaaacaaatggccatatcctccgtcagtgcntgcagggcttgtggtttcgcgatgataatg

SEQ ID NO: 5932 - DNA, 101 bp, rice(Oryza sativa)
  misc_feature (71): n=t or c
cgcacaactcaagtgcaagcgctgcgaccaaattcgctgcttgatggagtacattcctttgattcttaggnatggtttagttctcaattttttttcctaaa

SEQ ID NO: 5933 - DNA, 101 bp, rice(Oryza sativa)
  misc_feature (71): n=t or c
ccattctacaaggcaaccattctacatgattcaaccttcggaagaagttgttcagaaggagaaattctatnatcactgcctactgatcacatctgatgtca

SEQ ID NO: 5934 - DNA, 101 bp, rice(Oryza sativa)
  misc_feature (71): n=a or g
tttatactcactgtttgtattccgatttaatatttcatgctatcattatgtcaggcaataacaagcatccnaactcatccaattgtagaagttatatcata

SEQ ID NO: 5935 - DNA, 101 bp, rice(Oryza sativa)
  misc_feature (71): n=a or g
tttcactgcacataacattggatccaactttgcgttcggtttggcacatacaggcagggcctgtttgcacnggaaggttccgcatggaccgggcacgtcat

SEQ ID NO: 5936 - DNA, 101 bp, rice(Oryza sativa)
  misc_feature (71): n=t or c
gaggagccgccggccaccatcatcaccaagaaggacgacaaggatgtgcgggtcaccaatcccgcgcatancgagtgggtggcgcaagagcagcaggttct

SEQ ID NO: 5937 - DNA, 101 bp, rice(Oryza sativa)
  misc_feature (71): n=t or c
ggttgctgttcctggtctgtattttcttgaactcctctttgtcgctggcaaccccagctgaacacttcgangtggctttcagtaaaaagccgagtctctga

SEQ ID NO: 5938 - DNA, 101 bp, rice(Oryza sativa)
  misc_feature (71): n=t or g
ctgtctctaatattatcttgtgtaaactcacaatttcttttgtattcagagagtactggagcattgcactnatccaaaaacacaggaaatagtcatggatg

SEQ ID NO: 5939 - DNA, 101 bp, rice(Oryza sativa)
  misc_feature (71): n=t or g
tatagctatggtccttgttgagcaaatgcaaatgtctgcctgcgattttacagcatcctgcggagcagcancgaggagttcgtcgagcaatgcatcaacca

SEQ ID NO: 5940 - DNA, 101 bp, rice(Oryza sativa)
  misc_feature (71): n=t or c
acaggccttcttgaccctgtccaaacaagggaagaattccttcagctgtttgccaagttggacggtgacgntccagttctggttgcatcgaccgtgaatgc

SEQ ID NO: 5941 - DNA, 101 bp, rice(Oryza sativa)
  misc_feature (71): n=a or g
tggactgtagtagtgtggatgcttacgtcgtagtggtggaagttgtcgttcttgaggccgacgaagaagtngttgaccttcacgaggcactcctctccggc

SEQ ID NO: 5942 - DNA, 101 bp, rice(Oryza sativa)
  misc_feature (71): n=a or g
tcgggcttctggcacctgtccttttggccatcgtcgcgatccaagaagacaacaatgctagcgctgccctnctcatgcccgttcccgccgccgctgtagcc

SEQ ID NO: 5943 - DNA, 101 bp, rice(Oryza sativa)
  misc_feature (71): n=a or g
gctcctggagtgcgatgttctcgagtggttaagcctcaccttctgctccctgcaacaccgtgatctggtcntccaacaccagcagccactgcagcgtctgc

SEQ ID NO: 5944 - DNA, 101 bp, rice(Oryza sativa)
  misc_feature (71): n=a or c
gaaagtttgaaatccacctctcctgaatgaaatcaaagatctcacctcgccgtcgtcggtgccttgcctgngcaggtcggcgatgaactcgtacgcgtcgc

SEQ ID NO: 5945 - DNA, 101 bp, rice(Oryza sativa)
  misc_feature (71): n=a or c
tcacgtacaacaagcagttccacaacgtgatggcggtgagcaagtcggactacaagaactgcgacacgagnaagccgatcgccacctggtcgacgggcaac

SEQ ID NO: 5946 - DNA, 101 bp, rice(Oryza sativa)
  misc_feature (71): n=t or c
taagatgcgaagaaacagttttgagcatgttgctacatcaatagcacaatcatcacctaccaatgcctcanatgaagtcatcgtggctcacaaatttgcat

SEQ ID NO: 5947 - DNA, 101 bp, rice(Oryza sativa)
  misc_feature (71): n=a or c
tatcctccctttgtaactttttgactggctcgatagatatggttttcccttcagatccattttttctaacntttttccgaccaaaaatagttttcattgac

SEQ ID NO: 5948 - DNA, 101 bp, rice(Oryza sativa)
  misc_feature (71): n=t or c
catgatgacatgatgagcattttctcaaacgatggtccagcgcgtgttagagattcaagcagcaatgaaangaggaggagccatagaagggttctgtggga

SEQ ID NO: 5949 - DNA, 101 bp, rice(Oryza sativa)
  misc_feature (71): n=t or c
ttctcaccacctagtcctcctccaccaccaactactaccttaggcgtggtgttccctgtcaccccaactangccgcggtcgccgccatctacctccccatg

SEQ ID NO: 5950 - DNA, 101 bp, rice(Oryza sativa)
  misc_feature (71): n=t or c
tgggatatcttttgagttcagggcagttggtgctaacattggggatgttacacctgcaatgctagattgtngtcctggggaagcactagttgtcaattttg

SEQ ID NO: 5951 - DNA, 101 bp, rice(Oryza sativa)
  misc_feature (71): n=a or g
caagtcccgttccccacctttgccgaagcccgcgctcaactcctcctcgacgagctgaccaagggacatcngcctaccggcgctgccacggctcttctcgc

SEQ ID NO: 5952 - DNA, 101 bp, rice(Oryza sativa)
  misc_feature (71): n=a or c
ctgcgaagataagttgtccaagaacattgacacgggttcgattgcgaatattttgttactagctgagaaanatagttgccacgcgctcaaggaggcatgct

SEQ ID NO: 5953 - DNA, 101 bp, rice(Oryza sativa)
  misc_feature (71): n=t or c
cctcgcgcgcaacatgtccatggtggatgaccgtgtgtgcccattaacattctcgacatgcacgcagatcnaggacctcgcggtgggttggttgtcctcgg

SEQ ID NO: 5954 - DNA, 101 bp, rice(Oryza sativa)
  misc_feature (71): n=t or c
cccattggtggcaccatgagacagccagttgcaacgttattgctcggtgcatctgtgtaagggtacgcagnggcagcagcgtcagtggctccgatggatgg

SEQ ID NO: 5955 - DNA, 101 bp, rice(Oryza sativa)
  misc_feature (71): n=t or c
attcacatgagtatctgaagaaagcacagaatgactttgttcagtatcttacttctcagctgctcaatcancagctgccacagctccactgttcttgcaag

SEQ ID NO: 5956 - DNA, 101 bp, rice(Oryza sativa)
  misc_feature (71): n=a or c
accatggtgtatggatacgccaagaatggaaaagttgagattgctcactccatattcaatggaatgccagngaaggacgtggtatcttggagtgctatgat

SEQ ID NO: 5957 - DNA, 101 bp, rice(Oryza sativa)
  misc_feature (71): n=t or c
gaagcgtgctgtgccaaatcgtgcatgaggttatctaggaaataaaatgtttggttgtctttgctggcagnacagaagaatgaccgtgaaagcagatcata

SEQ ID NO: 5958 - DNA, 101 bp, rice(Oryza sativa)
  misc_feature (71): n=a or c
ggggagacctcctcgccgatgaagtgggtcaacttgattgccactggaaagggccagaaggcgattagtanttgggttgaggtgttcgtgagcacagccgt

SEQ ID NO: 5959 - DNA, 101 bp, rice(Oryza sativa)
  misc_feature (71): n=t or g
gagatggtcactgtgcaatttctggatctgagaattcatcgcatgcccgccaacgacgtcctacaacttcntcgccgtcttcctcctctggagttgaactg

SEQ ID NO: 5960 - DNA, 101 bp, rice(Oryza sativa)
  misc_feature (71): n=t or c
ggtcctcttctccaccatctcagatgattccagaagcagaatatcactggttgcatctttttggtgttccncctcaagatcaagtcttctcttgcttgaag

SEQ ID NO: 5961 - DNA, 101 bp, rice(Oryza sativa)
  misc_feature (71): n=t or g
gctgtagcccatgatagggggaatggcgtttatggaattgagggaagtgttccctccaggtgccgaaggtngattgaaaacaagtggcccctcatatgcac

SEQ ID NO: 5962 - DNA, 101 bp, rice(Oryza sativa)
  misc_feature (71): n=a or g
gctcaggggtctccgaatatggccccagtatcatctcatctaccgcaccaagaggggttgccataaccacntcgcctcggtggctaggtccccagatttga

SEQ ID NO: 5963 - DNA, 101 bp, rice(Oryza sativa)
  misc_feature (71): n=t or c
tcctacctttctgcgggatctcccggtgactattgcagttggaaaaatcttcgctgcatccctcacggtcncacgcatctaacagtaattagaattaaaca

SEQ ID NO: 5964 - DNA, 101 bp, rice(Oryza sativa)
  misc_feature (71): n=t or g
atgtggtggtgacaaacaagctcatggtttgttaaagccaacagatcaaaagcatcttctgggtctaccanattattcagaacacattgataaatctggtg

SEQ ID NO: 5965 - DNA, 101 bp, rice(Oryza sativa)
  misc_feature (71): n=t or c
gcaataaccttcacgtgctcatcgcatatatcatcgttgggcataaacaacttcagttccctcaaattctntagctggccaagttcttttacaatgttaga

SEQ ID NO: 5966 - DNA, 101 bp, rice(Oryza sativa)
  misc_feature (71): n=t or c
aactgtgaaccatgaggaggaagatatgagcgaggagtcagctgagggtgaagaagaagcaaatcctcctncagtcagggatgtggcgatggaaaacgagc

SEQ ID NO: 5967 - DNA, 101 bp, rice(Oryza sativa)
  misc_feature (71): n=t or c
aggtggcctattccttaaatagtcatcttgttctcgtggatccatgaagtccctattctgatgcccatacntttcccttgaatctacaggataatgctcat

SEQ ID NO: 5968 - DNA, 101 bp, rice(Oryza sativa)
  misc_feature (71): n=a or c
tggccggtctgagaacgagtcaccatggtgtgacctgtctgctgctgttgatctgtagcactacggaacgntcgagaggagcgaatcgggccatgaatagc

SEQ ID NO: 5969 - DNA, 101 bp, rice(Oryza sativa)
  misc_feature (71): n=a or c
cggcttgtttgacacctctgcatatttcaggcattgacgaacaacgcagatttgttcaaacgtacctcagntcttcaggtaagcaggatgcaccttggcac

SEQ ID NO: 5970 - DNA, 101 bp, rice(Oryza sativa)
  misc_feature (71): n=a or g
tgaaattgttatagccacgccaggaagactgattgatatgatagaatcacatcatacaaatttgcggaggntcacttaccttgttttagatgaggcagacc

SEQ ID NO: 5971 - DNA, 101 bp, rice(Oryza sativa)
  misc_feature (71): n=t or g
ccttccgccgccagcatcaattgtccttctctccgctgcttgcctccctcgttcctcgtctttcatggcancacaaccttcttcgttgcttgcttttctcc

SEQ ID NO: 5972 - DNA, 101 bp, rice(Oryza sativa)
  misc_feature (71): n=t or c
cagaactctgccctctattgggtcattttcgtaccatttctccaactgcccaaaagaagagacaaccaganaaatgtactgcatgttgatgtaatctaggg

SEQ ID NO: 5973 - DNA, 101 bp, rice(Oryza sativa)
  misc_feature (71): n=a or g
tctaaataagctctgatgagtttgagctacctaccttactcatgctaccttctttccctgcagaatctganctcaaacttcacactttggaggcttggaac

SEQ ID NO: 5974 - DNA, 101 bp, rice(Oryza sativa)
  misc_feature (71): n=t or c
aacagaaggacatcagtgccttctcaggcgccggccaaatcctcatccgccacccacaaagcacaggcatnatctcatggtgccaagaaggccaatgggca

SEQ ID NO: 5975 - DNA, 101 bp, rice(Oryza sativa)
  misc_feature (71): n=a or g
aagaaaaatcaaataaacctgaatagcttctggagatgaaaaaaaatgatttaaattcatcccagagtccntctgctgttgtgcactctgcccaatcggtt

SEQ ID NO: 5976 - DNA, 101 bp, rice(Oryza sativa)
  misc_feature (71): n=t or c
gctgcccgtgcccggcctagtgttgtgcttgagcagggagtgcgtcgtgtctcgcatcctctccatgaganggaggatctcgacggtgtcttgcgaagcgg

SEQ ID NO: 5977 - DNA, 101 bp, rice(Oryza sativa)
  misc_feature (71): n=a or g
gagttcattgtcaatcattgatgttaaagctgctaattcagcaaatgatgataaacatccaaagggcaaancaaagttaaaagtaactttagtaagaaatg

SEQ ID NO: 5978 - DNA, 101 bp, rice(Oryza sativa)
  misc_feature (71): n=t or g
ggtacttctgtgcttcaactagcttacctaacaacatgatagttcctgtgccaaacttgccacagagaatncccaatgagaagctccgcgacgagctgcgc

SEQ ID NO: 5979 - DNA, 101 bp, rice(Oryza sativa)
  misc_feature (71): n=t or c
gattgcggcggccgccaccaagtgcacacgaaatccaaggccgacgctgaagcctgcgcggaagtgtatanctgctcttcagcgccctgcagctgctgcta

SEQ ID NO: 5980 - DNA, 101 bp, rice(Oryza sativa)
  misc_feature (71): n=a or c
tttcatggctacaagtgaaccgcaatgacgtggagtcatagggtttccggcggagagtgagcctggccacnttcaagtaacatgctgcggctgcagtagga

SEQ ID NO: 5981 - DNA, 101 bp, rice(Oryza sativa)
  misc_feature (71): n=t or c
tgtcttggccttgtatatcccatagagcagcttcaggtcgaagtcatagaggaacagttttgcccctggcnggatcttctccaccacatcgatcttcccct

SEQ ID NO: 5982 - DNA, 101 bp, rice(Oryza sativa)
  misc_feature (71): n=a or g
ttcacaatagataccaagatataattgtagggaagagtaggaacttacagacaagatgaaagtatccaaancaggagatgcgtggagaactgaaaccaaag

SEQ ID NO: 5983 - DNA, 101 bp, rice(Oryza sativa)
  misc_feature (71): n=a or c
gtcaattcgaaaagtgataacatcaaatctttatacattgtacgaaatgaattgcgagctgcactcaagantcttttaaaggtattcttccacttaattct

SEQ ID NO: 5984 - DNA, 101 bp, rice(Oryza sativa)
  misc_feature (71): n=a or g
ggccacaacatggtggtgaactcacgagccgcattgcaagcattagcagagtactttcagtgccaaatccntgtccttcctccgcgacttacgagccgcat

SEQ ID NO: 5985 - DNA, 101 bp, rice(Oryza sativa)
  misc_feature (71): n=a or g
gaaacatgtgcttgtgaccgggacagaaagctctgaggaaccttgatatatgctgcaccagggtatcctgnaactgtcttgccattgaagagatcagactt

SEQ ID NO: 5986 - DNA, 101 bp, rice(Oryza sativa)
  misc_feature (71): n=a or g
catcttttactgtgttcatatgataaatggtttacattttctattgtagccagggtctgtgtggagtgatnttctaatatcaagtgggcatgttcagtggg

SEQ ID NO: 5987 - DNA, 101 bp, rice(Oryza sativa)
  misc_feature (71): n=t or g
ttgaaggagggcgttgccaaggaggcatctgacgctgttgctggtggcagtgttccgaagaaagggagganattctcgtccgtggtcaggacccgctggaa

SEQ ID NO: 5988 - DNA, 101 bp, rice(Oryza sativa)
  misc_feature (71): n=a or g
gcggcaacggtcaggtaaatgtgccggaaacgggcggaagtggagaagccacactgctctcgagttgtctncgtcatcctcgagggcggtaaaagccggcc

SEQ ID NO: 5989 - DNA, 101 bp, rice(Oryza sativa)
  misc_feature (71): n=a or g
caataatcagatggtgcgtacctctgatttagccaaggtcgagtctttctcagcaaaatgcttaattagtnaacggtgatttcttaagtcatcctctgagg

SEQ ID NO: 5990 - DNA, 101 bp, rice(Oryza sativa)
  misc_feature (71): n=a or g
atcaatattttcacttctaaatttcagttacatcgacaacaagaaggaccattggtatcctggtgcaatgnttgtcctccgtgatgtggatgacaccaaca

SEQ ID NO: 5991 - DNA, 101 bp, rice(Oryza sativa)
  misc_feature (71): n=a or c
gccgactcctcattgagctttgccctagccattttgtggaaaagcttgccactcttggcatactccaaagnaaagtaaatcttgctcttggtagccattac

SEQ ID NO: 5992 - DNA, 101 bp, rice(Oryza sativa)
  misc_feature (71): n=a or g
ataaccctgctaagcgtgcgttggtgaaagagtctgtaatctcctctagttcctctgtcgtttgttttcangagtccaagttgtccgctgtcaaccagtcg

SEQ ID NO: 5993 - DNA, 101 bp, rice(Oryza sativa)
  misc_feature (71): n=t or c
tgacatttgaagtcacgagaagcagtggccctctgcatgaatctcgagtcaagaggaaatgtcggtagtanaattatactctttgagcctaacctaaaatc

SEQ ID NO: 5994 - DNA, 101 bp, rice(Oryza sativa)
  misc_feature (71): n=a or c
gcgctgcccaaccgcgtcccgcaccatagtccgcagctcgtccatgttgtagacgagtttcgctttcatcngcaccatggcgtcggcgtggcgcggcgggc

SEQ ID NO: 5995 - DNA, 101 bp, rice(Oryza sativa)
  misc_feature (71): n=t or g
aggattagccgggaagtgctgctggttagacgcctgcgatccatagccttgagcagcagcaggagcaggancaggaacagctgcatcagcgaaccgcgcgt

SEQ ID NO: 5996 - DNA, 101 bp, rice(Oryza sativa)
  misc_feature (71): n=t or g
gaatttcgatcttatacggcccacgcatatcttgttaatttccagcgctgcgagcctgcacgaactcacgnagccccggaggaagaagactctcggtcaag

SEQ ID NO: 5997 - DNA, 101 bp, rice(Oryza sativa)
  misc_feature (71): n=a or g
atttcgctgaaaaagttatgtttttgtgttgtatggatgcagctgtcgaacacggagcagtacccggggcnccacgacgagatcgacatggagctgctggg

SEQ ID NO: 5998 - DNA, 101 bp, rice(Oryza sativa)
  misc_feature (71): n=a or g
ttttggtactgttcctactgatgggatccagtccaagacatcagaggcaccaaagaccacctccaatggangtgaagttggcgcagatgtttgtgatgcaa

SEQ ID NO: 5999 - DNA, 101 bp, rice(Oryza sativa)
  misc_feature (71): n=a or g
agtgccccatattacagactgcaatcaaggggagaactggaccataatcaccttcaagccagatcttgctnggttcaacatgacctacctcgaagaggatc

SEQ ID NO: 6000 - DNA, 101 bp, rice(Oryza sativa)
  misc_feature (71): n=a or g
tcgctatctatctcgtgaatgccgagctatatatttgctccatctgtcccataaaaactaacttagtatcngatatgatatatctcagtgctatgaatcaa

SEQ ID NO: 6001 - DNA, 101 bp, rice(Oryza sativa)
  misc_feature (71): n=t or g
ttatatcctcccatattgaaaaggtctgctggcagaccaagaagcaggaggctcaaaggagttgaagaagngtgttcagggaaaaggaagcatagatgcaa

SEQ ID NO: 6002 - DNA, 101 bp, rice(Oryza sativa)
  misc_feature (71): n=a or g
gaaaacaacagggtccggatccctaatcgcagctttgagcaagccacgagcatcttctgcagaatatgganccagaaccttaagacccggaacatgtgcat

SEQ ID NO: 6003 - DNA, 101 bp, rice(Oryza sativa)
  misc_feature (71): n=a or c
ttaaatttcaggcttacttgaagtctggagttttatccagcagctcgatggtcgagccgtcagaacactcntgcatttccaccaagctctccggcatcgtg

SEQ ID NO: 6004 - DNA, 101 bp, rice(Oryza sativa)
  misc_feature (71): n=a or g
aaactgtatatctccgaacaaatgctacgagatttttcgacggtcgaggtgtcaaacgtttgatcttctcngaggcatcggtgattcacccgtccttgagc

SEQ ID NO: 6005 - DNA, 101 bp, rice(Oryza sativa)
  misc_feature (71): n=t or g
aagatatttattatcttactctgaggaaccatgtaatttgggagaagaatggttcagaggagatgcttacntttcaagcaaggaatacatcttcttgagag

SEQ ID NO: 6006 - DNA, 101 bp, rice(Oryza sativa)
  misc_feature (71): n=a or g
atattcttggagaagtattgttcggggggtgcaggtgttgaaggttggcctaatctggcgtgttggtgatngtaccgacatagatatgtggaacgacccat

SEQ ID NO: 6007 - DNA, 101 bp, rice(Oryza sativa)
  misc_feature (71): n=t or c
taaggttgaatcatcagctttggtggctgtttcgggtatcgctccaccagtggcatatagtgattcatggncctgaaactctgatgcttcataacaactcc

SEQ ID NO: 6008 - DNA, 101 bp, rice(Oryza sativa)
  misc_feature (71): n=t or c
tccacctccagccaagatgtcggttgtgggttcttctctcgaaaccttccattttgccacctctgacaaangaagccaccacctcctacaaccttcatcac

SEQ ID NO: 6009 - DNA, 101 bp, rice(Oryza sativa)
  misc_feature (71): n=a or g
ccaccacgaacccgctgctgtagccttttcaccgactagcgggggcgtgggcaactgcggtgtcaccgacncagcagggaggagggccggcggagaccgtt

SEQ ID NO: 6010 - DNA, 101 bp, rice(Oryza sativa)
  misc_feature (71): n=t or c
acccccgcaactccctctctcattttcctttttccaccaagctcaaccgtgccctcctttgctcctgcgcngctacacccaccgccaccgccttttagcca

SEQ ID NO: 6011 - DNA, 101 bp, rice(Oryza sativa)
  misc_feature (71): n=a or g
aagacgagcaactcctcccccaaatgctcaagctggagttggcaatggcgcagcaaatggagaagcttccnctactccagcaccaatggcagcagcacaga

SEQ ID NO: 6012 - DNA, 101 bp, rice(Oryza sativa)
  misc_feature (71): n=t or g
gagataatgcacaaatgaacaagcggaaaggaaaatgaagggagcagagggagagaccttcaaaattaatntcctttttgaggaaacgattagggttgaac

SEQ ID NO: 6013 - DNA, 101 bp, rice(Oryza sativa)
  misc_feature (71): n=t or c
ctaagaggatgacacaacagctcaaattctatcaggtgaattgtactgggttcttcatggatcaatggacngctggtttgcaaattagaattatgcttttg

SEQ ID NO: 6014 - DNA, 101 bp, rice(Oryza sativa)
  misc_feature (71): n=t or g
ttgagatttaatcatggagatgaagctgaccatcaagcgggtgcccaccgtggtttccaactaccaggagnatgctgccgccaccgccggcgaacgccccc

SEQ ID NO: 6015 - DNA, 101 bp, rice(Oryza sativa)
  misc_feature (71): n=a or g
aattattaatggttatcaacaggatccggatgcttgcagtaaggttcaggctctttgcatcaataatgctncagttcctcagtttactttgaagaatggaa

SEQ ID NO: 6016 - DNA, 101 bp, rice(Oryza sativa)
  misc_feature (71): n=t or g
gttctggttgaccaattcacgattttcctcagtgattttcatgtgctcgtatttaagcttttcactttctncttcctgtcaaagcatattaaaaatattgt

SEQ ID NO: 6017 - DNA, 101 bp, rice(Oryza sativa)
  misc_feature (71): n=t or c
tgcctcttccctgtcgatctccacaaccattatcgtcgcctatgcatgctaggtctggagaggttggtggngtggtggctttgtctaggaccagaccttct

SEQ ID NO: 6018 - DNA, 101 bp, rice(Oryza sativa)
  misc_feature (71): n=a or g
acaaggatcaacaaaattgctggaggagcaaggacaatggcagaggaaaggaaatataacgatgagaaaangatcaaagaaaaggcaaataaaagacggtt

SEQ ID NO: 6019 - DNA, 101 bp, rice(Oryza sativa)
  misc_feature (71): n=a or c
ggatgatgctcctacatcaggttctgaccctgaaatggacaatggtgcaacacacccagttgtgactgcanctcttgcaaatggcttgcagtgggtgccca

SEQ ID NO: 6020 - DNA, 101 bp, rice(Oryza sativa)
  misc_feature (71): n=t or g
ccgccatgaacgcctcctggaccttcttgttcatggacaccttgagcaccttcacggcgacctgcaggccnttgggcagctcccccctgtagaccacgccg

SEQ ID NO: 6021 - DNA, 101 bp, rice(Oryza sativa)
  misc_feature (71): n=t or c
tatcgatacgtgcttcctgcctttccattccaacgttggtaagagatagtgtgtccccatgaacagaagtnatttcagaattctttggcttgttctctggt

SEQ ID NO: 6022 - DNA, 101 bp, rice(Oryza sativa)
  misc_feature (71): n=a or g
tattgcacacaatgatatggttagctttggatacctcgatacaaggtactccaatttctcggaaacaaaanctgctgcctctgcaggcgtaccggtgaaat

SEQ ID NO: 6023 - DNA, 101 bp, rice(Oryza sativa)
  misc_feature (71): n=t or c
caccgaaacactggcacctcctatgggtaaatcgtagggcacacatgggagtgggatatcatcataacaancgcactatggctgacccgacatttgttggt

SEQ ID NO: 6024 - DNA, 101 bp, rice(Oryza sativa)
  misc_feature (71): n=t or c
aaattctcatttggttggaaaccatagatggttagcttagtcaggttgtaatgcctgaaaccatcaggtgnagatgactcccactccacgtttgttttttc

SEQ ID NO: 6025 - DNA, 101 bp, rice(Oryza sativa)
  misc_feature (71): n=t or g
agggctggggtttcttcatatagcaaggatgagaatgaagacgatgccgaagatgaatccaccacaagtgntttgcaggggggcagttttacatggaagac

SEQ ID NO: 6026 - DNA, 101 bp, rice(Oryza sativa)
  misc_feature (71): n=t or g
gggaggggtgaggacgaagtggtcagagaaatatatagatgaggatagcgtgctctgcacggcagattccngtggccgttgctgccgtgctcggagacgga

SEQ ID NO: 6027 - DNA, 101 bp, rice(Oryza sativa)
  misc_feature (71): n=a or g
ttttgatttctacaatcaccttcctggagcaggctggctttattatccagggctgtagaattggtgttccnttctatagaatgcctatgtgtctgcatttt

SEQ ID NO: 6028 - DNA, 101 bp, rice(Oryza sativa)
  misc_feature (71): n=t or c
acgtccagtacgatatcgggcagcgcggccgggagatgcctccaccgtttagcgagtatcgctgttcttantgcgtcgcgtaggtcgacacgtttcaggat

SEQ ID NO: 6029 - DNA, 101 bp, rice(Oryza sativa)
  misc_feature (71): n=t or c
gcatcctttcttttttttttccttttagataatatcaccatttttttcctcccatatttttgcaggggttnatcgcgacgaggagccgaggagggggaggc

SEQ ID NO: 6030 - DNA, 101 bp, rice(Oryza sativa)
  misc_feature (71): n=t or c
tataaacccggggcacttgtccaggccgacatcgtcgatgccatcttgaggcggatcatggaatcggatgngcagcagggagtcctggagcgggtcatggc

SEQ ID NO: 6031 - DNA, 101 bp, rice(Oryza sativa)
  misc_feature (71): n=a or c
tttcactgatcctttgcacgatatggatcaggggacaagccagattggaggcgagcaatccgcggtaaatncacgagggaattgccgggagccggctctga

SEQ ID NO: 6032 - DNA, 101 bp, rice(Oryza sativa)
  misc_feature (71): n=t or g
tcttgaagaccgcattatttgcacaaataattctgcacctctctcttggtacaaccgcacacagatcattngggagatttgttgtgctctgcttttccttc

SEQ ID NO: 6033 - DNA, 101 bp, rice(Oryza sativa)
  misc_feature (71): n=t or c
tttgttagtgattattcgattcgggccaccaaaacgacatgtgatgccgtggatgaacttgaccgtgccgngtactgcttataactttaatgctccgaatt

SEQ ID NO: 6034 - DNA, 101 bp, rice(Oryza sativa)
  misc_feature (71): n=t or g
tgccacatggtttcatcaagtaattgacatgaacacctgtttgttagttttctgctctgcggctgctactnctcccagggagggcaaggagttgcttgtcc

SEQ ID NO: 6035 - DNA, 101 bp, rice(Oryza sativa)
  misc_feature (71): n=t or g
cttggcataagattttttgtttcattgtgttgttgacagtatggacacttgcctatagaagttgccgcacnttgtggtgcgcggaaagatgttgagaccct

SEQ ID NO: 6036 - DNA, 101 bp, rice(Oryza sativa)
  misc_feature (71): n=a or g
aaggcccattccttcaactcttcctcttccatcttcacccacattgcaggctgggatgacaggtcaaggcngaaggcctcgccgatggaggcggcgagcag

SEQ ID NO: 6037 - DNA, 101 bp, rice(Oryza sativa)
  misc_feature (71): n=t or c
aaccaaatcataattctgaatgtacctctgtggctgatcgttgggcttggtgcatatagttcctgctgtangttaacacgtctgctagttgctgcaggtgg

SEQ ID NO: 6038 - DNA, 101 bp, rice(Oryza sativa)
  misc_feature (71): n=a or c
ctcaaggagaaggtctgaaaaactcacagatataaaaatggatagtacttctaatgttagcaggacctctntcaaacagagaaattctgatgaagtgaatc

SEQ ID NO: 6039 - DNA, 101 bp, rice(Oryza sativa)
  misc_feature (71): n=t or g
gctttttcttagcttgtgaaacctctctaaatggtgttgattctttaactgaaacaggttacagatttgcngtcacacgcactggcaatttcgttgccttt

SEQ ID NO: 6040 - DNA, 101 bp, rice(Oryza sativa)
  misc_feature (71): n=t or g
tatctgcaaggttgggcgcatggcaggtggacatcttcgaggtacctggatggtaagctcgtgctccatgnccgctcgtcgaacaccttcctcgccaccgg

SEQ ID NO: 6041 - DNA, 101 bp, rice(Oryza sativa)
  misc_feature (71): n=a or g
tttttcgagcaaaaaaaattccaataaaaaatccctaatccccaatcgtcggatgccgtcatcgagctgcntcggcgaaggagggagcttgttgcagacgt

SEQ ID NO: 6042 - DNA, 101 bp, rice(Oryza sativa)
  misc_feature (71): n=t or c
tcaaatgtaacagaagatttggttgtgctgatgccaaatttgctatcatttctgaaacatgatgatcctgnggttgttaatcaatccatagctagtgggac

SEQ ID NO: 6043 - DNA, 101 bp, rice(Oryza sativa)
  misc_feature (71): n=t or c
agctcctccagactaggctctgtgtaataatcggcatgcactagcttaggcgcaagcctctcaacagaagnaccattcccatgccttgtcacagtatcagg

SEQ ID NO: 6044 - DNA, 101 bp, rice(Oryza sativa)
  misc_feature (71): n=t or g
tgccaaacacaaggagagactctgaatcgatcaaggaagaggcaagttccttcatctcagtatcaagtttnaaaacctcgctgacattgcctgtgtagtaa

SEQ ID NO: 6045 - DNA, 101 bp, rice(Oryza sativa)
  misc_feature (71): n=t or c
tactgttttgagtgtgcaccgaagagcagtcaattccttcgaagattcctgaaaatcctgttggatctgantaatgttctcctctttcttcaaaacctaca

SEQ ID NO: 6046 - DNA, 101 bp, rice(Oryza sativa)
  misc_feature (71): n=a or g
agcatgccccagacctcctctctcttttccaaccctaacacgagtttttcccgtgctctagagccgccgcngcgcttgtcttctctgtccgccgccaccgc

SEQ ID NO: 6047 - DNA, 101 bp, rice(Oryza sativa)
  misc_feature (71): n=a or g
ctgtgcaccaacaggtgctgggaaaaccaacgtggctgtgcttacaatccttcagcagattggcttgcacntgaaagatggagagtttgacaataccaaat

SEQ ID NO: 6048 - DNA, 101 bp, rice(Oryza sativa)
  misc_feature (71): n=t or c
tgctgagccatgggcgtcgccgttcttcatgttctcgacacgacatgtcgagcccttaggaggtcctgtanccaccatgccaatggctagttcctcatgcc

SEQ ID NO: 6049 - DNA, 101 bp, rice(Oryza sativa)
  misc_feature (71): n=t or c
acagcagatcacaagggaaatgacaattccaaaatggtgaataatgctgataaaatttcggtgttaaaggnacagcggcgagctcaaggactatgttacat

SEQ ID NO: 6050 - DNA, 101 bp, rice(Oryza sativa)
  misc_feature (71): n=t or c
cggcaagtgcagtttgggtacagctgcaccccctgcaattgcatttcaagcactatcctcctggctgccgntccacctcttccctatcctcgtcgaacaaa

SEQ ID NO: 6051 - DNA, 101 bp, rice(Oryza sativa)
  misc_feature (71): n=t or c
atatgatataacatgacataccatccatacatgaaatcctttactctttcagtggcagcaatatcttcagntgactctgtgagtgggtagaaccacatgga

SEQ ID NO: 6052 - DNA, 101 bp, rice(Oryza sativa)
  misc_feature (71): n=t or g
gcctccgaaaacccttaaataaggtatattcactgagtatttcttcttcagctcttccttcagtttcttangtcctaatgaggggtcatcccgcagcaact

SEQ ID NO: 6053 - DNA, 101 bp, rice(Oryza sativa)
  misc_feature (71): n=a or g
cctcttattccctttattttgaccgagatgatctgcagagtgtgacggactgaaatatgtctcggcatagngtcgtccttacggtgtgtatagcgcatggg

SEQ ID NO: 6054 - DNA, 101 bp, rice(Oryza sativa)
  misc_feature (71): n=t or g
tcatttttgatatgacaaagacagaagaagcagtcgacgaggcggagtacatctggaggaggatgccaganctcgatggacggatgctgttcgttggacat

SEQ ID NO: 6055 - DNA, 101 bp, rice(Oryza sativa)
  misc_feature (71): n=a or c
taaccatacggaatctgtgggaaatcatggggatagtgctgcacagcctcattcagaatcctttgatcgtnaactgatcctagccatccgaaatcacagaa

SEQ ID NO: 6056 - DNA, 101 bp, rice(Oryza sativa)
  misc_feature (71): n=a or c
ccatgataattaacaagaaatggaccgtatactatgcatttcacctgcaggaagaactggagctgatctgnaataactcgtttcagcagcagcagcagcag

SEQ ID NO: 6057 - DNA, 101 bp, rice(Oryza sativa)
  misc_feature (71): n=a or g
aatctcgggccttgcgctgaagcgaaatcgattgcggcgcgactttgtggtcctcctccagtcgccgcctngatggacgccgccgccaccgggaacaatga

SEQ ID NO: 6058 - DNA, 101 bp, rice(Oryza sativa)
  misc_feature (71): n=a or g
gctcctttcaccacggagatacttcacggattgcgatgattacagttacaccgacgacgatgacgattatnatgacttcgtcgtctccacacccacaccca

SEQ ID NO: 6059 - DNA, 101 bp, rice(Oryza sativa)
  misc_feature (71): n=t or c
gggaaaaatttcaattgcctcagaggtgtaaagcagggagaccctatctctccccttctgtttgtccttgntgctgatcttcttcaatctatgatcaacaa

SEQ ID NO: 6060 - DNA, 101 bp, rice(Oryza sativa)
  misc_feature (71): n=t or c
cggcgcaagatccatgtcatcgaggacccagagattctgaagcagaggcagaaaaagatgcatccgatccngagtctgcggagccgagcaagccacgtatc

SEQ ID NO: 6061 - DNA, 101 bp, rice(Oryza sativa)
  misc_feature (71): n=a or g
cgagatagtttgacatgactgaggtattgttcttctgcaactgatgagaggcgaggagcaaagtgctgccngatgtcggaggatagaacctgatgaacaga

SEQ ID NO: 6062 - DNA, 101 bp, rice(Oryza sativa)
  misc_feature (71): n=a or c
ggagggagaagaccggtaccctttcgctgctgctgcggcttcttgttgtgcagctgcttcagccatggaanaatctgctgttctgatgaacaggccgtagc

SEQ ID NO: 6063 - DNA, 101 bp, rice(Oryza sativa)
  misc_feature (71): n=t or g
ggtagttccttgcgagatagagcatcagcagctgcatttgataatccctttcgataacaaattctatattnaaggcccaacagcttagtgaaagctttttg

SEQ ID NO: 6064 - DNA, 101 bp, rice(Oryza sativa)
  misc_feature (71): n=t or g
gaaccttgagtggccactgcgtgtctacggcatcgttgctgtccgtgactcgctggatcacaagaggaacntcctcttccgccgcgacagggacgactgcc

SEQ ID NO: 6065 - DNA, 101 bp, rice(Oryza sativa)
  misc_feature (71): n=a or g
aggagggattgctgaagaggttgttcgcggagagctcgaagttcttcgagctgccgatggaggagaagatngcgctgcggaggaacagcaaccaccgggga

SEQ ID NO: 6066 - DNA, 101 bp, rice(Oryza sativa)
  misc_feature (71): n=t or c
cggcaaccctctagatctaacactcgaagaacaggaaggtttaaaactgagggcattgtccagccatcaanatggcatatactaattgcacggatataggg

SEQ ID NO: 6067 - DNA, 101 bp, rice(Oryza sativa)
  misc_feature (71): n=a or g
cctcttgcctgagcatgccatggctagtgctacttttggtgcaatggactctgtcctcagcaagctcaccnacttgctgaccttcgaatacaagttgcttg

SEQ ID NO: 6068 - DNA, 101 bp, rice(Oryza sativa)
  misc_feature (71): n=t or g
ttctcgtcgaggatgaggtcgaaggagatgtagtcggcgcagccggagttcttgccgttggggtagtaacngatgcgccattgatggcctccgatggcgaa

SEQ ID NO: 6069 - DNA, 101 bp, rice(Oryza sativa)
  misc_feature (71): n=a or g
agtttatcagtgagtgaccttggtccttaccagaagcatattagtcggagtcacccaccggaccggcaacncaaccactccggccttggtaccaccactgt

SEQ ID NO: 6070 - DNA, 101 bp, rice(Oryza sativa)
  misc_feature (71): n=t or c
caggaccagcttggtgagagcttggaacccctgcaatgggggaatcacacagtccaccagcttcaggcttngcaaacgggatctgtgcgggtcattgcaga

SEQ ID NO: 6071 - DNA, 101 bp, rice(Oryza sativa)
  misc_feature (71): n=t or g
ggatcgcgacacggagctggaaaccggctcaccagcaggcatcgacaatgactacctggacgctgaccacnatgatgatgccccactccggttctgcagca

SEQ ID NO: 6072 - DNA, 101 bp, rice(Oryza sativa)
  misc_feature (71): n=a or g
tcaccaagcactagaacccaatcaccaaagtccttaagatctctacaaccttgctcaccaaggtcaccgtnaagaagtctcatattgattgtcagtataag

SEQ ID NO: 6073 - DNA, 101 bp, rice(Oryza sativa)
  misc_feature (71): n=a or g
aagaaaaccacgcactgccctgcagatgtcattctccaaaaaattccaatgagattggtagaaaagagctnggaaaccatctgggctgggtgccttagttg

SEQ ID NO: 6074 - DNA, 101 bp, rice(Oryza sativa)
  misc_feature (71): n=a or g
tagtctagatgacagcaagtttagcagactgtatttctcactggattcatgcaaaagaggatttctcagtngctacagacctgtcatttgcttggatgctt

SEQ ID NO: 6075 - DNA, 101 bp, rice(Oryza sativa)
  misc_feature (71): n=t or c
cggcaagctcggttgaaggcaaagaaggttgaggaccttgcagcacaggacccagctgagaacttggtagnggtggcaccgacggtggcaggaagacgtgg

SEQ ID NO: 6076 - DNA, 101 bp, rice(Oryza sativa)
  misc_feature (71): n=a or g
cggccaagctggaaccggtcggttgggctactcagagagttctctgataggggagagggggaaaatggctngggagcgagcgcgtgagggagcgccctcac

SEQ ID NO: 6077 - DNA, 101 bp, rice(Oryza sativa)
  misc_feature (71): n=a or c
agcatggacttgttacctgactgcatatagtggtttattccatgagatgggccagctatgacctccaaagntaggttgcttcctgcacttctagcaaatga

SEQ ID NO: 6078 - DNA, 101 bp, rice(Oryza sativa)
  misc_feature (71): n=t or c
tttccgtgggactcgctttgatctatttcctctagccgactcttcataccgagcctcaccacaaacagtgnagttttctttatgctcgttttccttataga

SEQ ID NO: 6079 - DNA, 101 bp, rice(Oryza sativa)
  misc_feature (71): n=t or g
tcaaggtagaatttttatggagtcaccacgaagtggagaagaagggttcattcaacatgatgcaacatttnttgtcatggatgaagattatgaaactggaa

SEQ ID NO: 6080 - DNA, 101 bp, rice(Oryza sativa)
  misc_feature (71): n=a or g
tgttacactgtcgagatcggtcagcgattttagctgacgaccgaggttcgcaatcgtcttctggcactccncgagttttccagcagcactggagagctctt

SEQ ID NO: 6081 - DNA, 101 bp, rice(Oryza sativa)
  misc_feature (71): n=a or c
agtccattccaaactatccaagtcaagcaagaagcagtcaaaactcccagcatctgataccataaaacatntcttaagcacaacaaacccagatatattaa

SEQ ID NO: 6082 - DNA, 101 bp, rice(Oryza sativa)
  misc_feature (71): n=a or g
catgagggaggttgccgaccagaagcacgatagggccacagtatggggtgcactcaagcgatggcggttcnaacaaggggctgtgatggaatgggacatgg

SEQ ID NO: 6083 - DNA, 101 bp, rice(Oryza sativa)
  misc_feature (71): n=t or g
taaggtccctgatgttgtgagcaatttgttcaatttgcgctaccttgatttggcctatacaagagttaagntgattccaagatcactgtgccgactgaaca

SEQ ID NO: 6084 - DNA, 101 bp, rice(Oryza sativa)
  misc_feature (71): n=t or g
cgaaggactggttgaatttgtaaagatacgtagtaaatcattggtctctcttgatatttctttctgcaatngttgcataacatacagatccctgtatgcaa

SEQ ID NO: 6085 - DNA, 101 bp, rice(Oryza sativa)
  misc_feature (71): n=a or g
acgaagtcaagaccatagtgggactctacctacaaaagcaaggtgtacaatggcgtgcccatgagcgagcntctgagaatcttcaacattgaggagggcga

SEQ ID NO: 6086 - DNA, 101 bp, rice(Oryza sativa)
  misc_feature (71): n=a or g
tgccatgtcaatcatggggatggtgtggccttgtgccatgaatggtatcaatacaaagtgtggctttggancatcatctaagctgttcatggctacctatc

SEQ ID NO: 6087 - DNA, 101 bp, rice(Oryza sativa)
  misc_feature (71): n=t or c
accaattcttcaatcagatcttcatgtgattcaacattaaaaccttcatatggctgaaccctttcttttgngccaacagaaatgttatcaggttggcaaat

SEQ ID NO: 6088 - DNA, 101 bp, rice(Oryza sativa)
  misc_feature (71): n=a or c
atgtcaattctccactttctttcatatctgggcattcatgcaacacagcatcgcaacatcctctgagaganattgcaacctactggaatctgtagctctct

SEQ ID NO: 6089 - DNA, 101 bp, rice(Oryza sativa)
  misc_feature (71): n=t or c
aaattgtcaaggtggtgagcaccatttctttggtttttttgctgtgtgcaggacgacgacgaggcggagcnccggaggagacgatggaagccctgggggga

SEQ ID NO: 6090 - DNA, 101 bp, rice(Oryza sativa)
  misc_feature (71): n=t or c
agtgtttgtacaaaaatcacaatacaagacggagaaagtttactccttgtaaaggggaggatgctttcccngagatccgacacgctggacatcacgttctc

SEQ ID NO: 6091 - DNA, 101 bp, rice(Oryza sativa)
  misc_feature (71): n=t or c
gatcgtcctcacagccgatcgaccacgtggttcaggatatggagcccagcgataaactgtacgtgcggagnatgcttctgaacggtgtccaacaactaaca

SEQ ID NO: 6092 - DNA, 101 bp, rice(Oryza sativa)
  misc_feature (71): n=a or g
attatgcaactgctcataggtgaactcatctacaatggtaggcagacctttcacagcaccatttgctgccngtgatgctgccatggatgacagcatcacag

SEQ ID NO: 6093 - DNA, 101 bp, rice(Oryza sativa)
  misc_feature (71): n=a or g
gtcctcacaggtccttctatttcaagggcagtaaagttgctcaatggcgttgtcggcgtcaaactcaaggnccgcttcttctttggtggctccttgtgatc

SEQ ID NO: 6094 - DNA, 101 bp, rice(Oryza sativa)
  misc_feature (71): n=t or g
agtgtattttagcagttccaacagacacatcaccatgttgccaactcggcaactcaatacaccagacgatnaacaccgggtttagtccccacgaattacag

SEQ ID NO: 6095 - DNA, 101 bp, rice(Oryza sativa)
  misc_feature (71): n=a or c
aacagacgagttaattcttggcaagtccaacccgttcagctcgctcttccaccacagggttctgatgaggnggcggcagcagcaaccacatcgactgcgca

SEQ ID NO: 6096 - DNA, 101 bp, rice(Oryza sativa)
  misc_feature (71): n=a or g
agcataaccactaagtgactcattctcctgatcacgctcgctagcttctaaccagggaggaggagcacccntgtgcacatttgctttcaagccttcataac

SEQ ID NO: 6097 - DNA, 101 bp, rice(Oryza sativa)
  misc_feature (71): n=t or c
ttcttgctggagaccttcctcttgtgcacatcattgttcttggctttgctgtagacggagccccaggcccncagcagctgcagttgcgcgcgcaccgcgcc

SEQ ID NO: 6098 - DNA, 101 bp, rice(Oryza sativa)
  misc_feature (71): n=a or g
gacttgcgtgtgttagggcagccggcccaatcagcatcagaataagccactaggtcggtcgaaggagagcnccgaatgtgtagtccaaggtcaagcgttcc

SEQ ID NO: 6099 - DNA, 101 bp, rice(Oryza sativa)
  misc_feature (71): n=a or c
aattaggaagtaattacttacctactaggaaggagataagagagtagataacaatcacaaagagaaagatnaagcaaaatgactgaaatcaagaaaaaaat

SEQ ID NO: 6100 - DNA, 101 bp, rice(Oryza sativa)
  misc_feature (71): n=t or c
ctagcccagcgtcatgttcccaagcctactatcgccatccatggcactcttgtcaacgccgtcactagatnaggtcgaaggaagggcggatctagccatga

SEQ ID NO: 6101 - DNA, 101 bp, rice(Oryza sativa)
  misc_feature (71): n=t or c
ctttttgcactaagacataagggtggaaaaaagtttactctagacaaactagagctgccaaagggattgcngaattctcagtgtatgctgttttctattga

SEQ ID NO: 6102 - DNA, 101 bp, rice(Oryza sativa)
  misc_feature (71): n=a or g
agcagtggtggcatctgttccctcggtgcatctggtgctgccgttggaagttcttctgcaattctgatgcntaaccgagtaattcgccatggaagcaattg

SEQ ID NO: 6103 - DNA, 101 bp, rice(Oryza sativa)
  misc_feature (71): n=t or c
gtctcttgaatgaaaaccataaaatgttccgttgctgccacgaacgctgctactgagccaaatccttccancggagccacctccggtatcggatctagcaa

SEQ ID NO: 6104 - DNA, 101 bp, rice(Oryza sativa)
  misc_feature (71): n=a or g
ctcattgcttgccgagcctggccactgcttcatcatcggcaactgcttcctctccggcttgcttcttaccnagcccagctcaagggctggaggatgggacc

SEQ ID NO: 6105 - DNA, 101 bp, rice(Oryza sativa)
  misc_feature (71): n=a or c
ttggaacttttgaagacaataatatcacatcctcttcataacaaatcagcgtcatttaatcctttgcattnttttgcacaagcagcctggaaggggatttg

SEQ ID NO: 6106 - DNA, 101 bp, rice(Oryza sativa)
  misc_feature (71): n=t or c
tgcgtgtggttttggtgctcgatctgtgtgtgtttgagcagcatggcggactcggaggatggagatcacgntgcgacgacgacgacggagcagcgctacga

SEQ ID NO: 6107 - DNA, 101 bp, rice(Oryza sativa)
  misc_feature (71): n=t or g
acactgcgcctgcctgcgagatccaaaatccgaccagccagcgttagctcggagaggcgaggcgagaatgncggccgcggcgggcgggtacagggcggagg

SEQ ID NO: 6108 - DNA, 101 bp, rice(Oryza sativa)
  misc_feature (71): n=t or g
ggcggtgaaggtgcatgatatgatgctggaggtcatagtgtccaagtccctggagaactttgtcaactttntaggagcccaatacggcggagggacaccat

SEQ ID NO: 6109 - DNA, 101 bp, rice(Oryza sativa)
  misc_feature (71): n=a or g
aaatggaaagctcctttgtgcaattggaagggatgctaataatcaaatgtatctagtggcatgggcagtgnttcacaaggagaacaatgaagagtgggatt

SEQ ID NO: 6110 - DNA, 101 bp, rice(Oryza sativa)
  misc_feature (71): n=a or g
agcaagtatgctgagagccgcattcgagcccataattgttcagcattttggaccgaccggatgcgatgganaagaagggatcatggatgagttcgtgagga

SEQ ID NO: 6111 - DNA, 101 bp, rice(Oryza sativa)
  misc_feature (71): n=t or g
gtggacgccggagaccttgaggaacccgaaatcgtagggctcggtttgcgggtacagatccttcctcagcngctgctcctggtgctgctgctgcagttgcc

SEQ ID NO: 6112 - DNA, 101 bp, rice(Oryza sativa)
  misc_feature (71): n=a or g
aagaaaccttcaaaaaataaatcgacggatcacggatggatctggaggagatgatgatgagagagaccaanccaattaaggtggtggtgacactgacgagt

SEQ ID NO: 6113 - DNA, 101 bp, rice(Oryza sativa)
  misc_feature (71): n=t or c
tgtagtccgagactgccatttttttgtttcatatagaaagtctgattcactcctctgacggcttggtcctngaacaataacagcagaaaacatgtggtgtg

SEQ ID NO: 6114 - DNA, 101 bp, rice(Oryza sativa)
  misc_feature (71): n=t or c
ctcctatcatcaatttgcttgatcagttgatctaacctatccaaactcctcacctctgcatcctttgcttncttgatcttctctatagctctaataacttg

SEQ ID NO: 6115 - DNA, 101 bp, rice(Oryza sativa)
  misc_feature (71): n=a or g
gtcgatcttcgcgatactatcaaccagcgctgcgcggcaagagaatacgcttcccaccattcactagatcnctacgacaacgacgtggatggagttgctgc

SEQ ID NO: 6116 - DNA, 101 bp, rice(Oryza sativa)
  misc_feature (71): n=a or c
ttcttctcagacaacctgatccatacaccggaaatacccccagaagatacagacaacacagtacatacacnggaaattcctccagaagatacttatccaca

SEQ ID NO: 6117 - DNA, 101 bp, rice(Oryza sativa)
  misc_feature (71): n=t or g
gacacagcagctcgccatcttctgatatagcggttccaggaacgtcagacacttgcacgagagccgcctcngcagcacgcggccgcacctcctccccaagg

SEQ ID NO: 6118 - DNA, 101 bp, rice(Oryza sativa)
  misc_feature (71): n=a or g
agctcctccaaaacagcatgccacttgggttcatcatgaagaaccttccaatagtgcaaaactgtgaatgnaccttcgttaggatagtcattcacataaaa

SEQ ID NO: 6119 - DNA, 101 bp, rice(Oryza sativa)
  misc_feature (71): n=t or c
tcaattccagagagagactctagctcggtgaaggaccaggtaatcttctcaagcttacaggcagattcctnggcgaagttgatgcccgagatcttggagca

SEQ ID NO: 6120 - DNA, 101 bp, rice(Oryza sativa)
  misc_feature (71): n=t or c
gcagcgcgacggacggcgcaccggtggggcgatcctgtgttgttagctgctttcccgtttcccttcttctncgttgccttttcttttttcttcttcaatct

SEQ ID NO: 6121 - DNA, 101 bp, rice(Oryza sativa)
  misc_feature (71): n=t or c
tgcactcgttttgggaccttgttgatgttgtattcgccagttgggtctatgacataatgacgaatgaaccngcaaaactcgtcagtgagagttttgaagac

SEQ ID NO: 6122 - DNA, 101 bp, rice(Oryza sativa)
  misc_feature (71): n=a or c
aggcggaggcgtggcggggcataatcaccatcctcatcatcatcagtacgggatggaggcgccgccgccgntgacgatgatgcagatgggcggcgggggtt

SEQ ID NO: 6123 - DNA, 101 bp, rice(Oryza sativa)
  misc_feature (71): n=a or g
tccaagggcactcactatgcgaagaaaaatgggtcttcccatacgaaatcttgtacagaacatgctctcanggtaaagagggtcttcactgaagtagtcag

SEQ ID NO: 6124 - DNA, 101 bp, rice(Oryza sativa)
  misc_feature (71): n=a or c
actgcatccatgatatctgtttcgatcctcaaaacttcatctttgagttgcctctgtgagtattcccttgnttcaagatccttctggagatgatccagctg

SEQ ID NO: 6125 - DNA, 101 bp, rice(Oryza sativa)
  misc_feature (71): n=a or g
tcgcccctgccgccgcctctgccctgggatgtgagtgccctcggctatctgttcctctccatcgttgtttncttgaagaaaagagcaatcgcgatcgtgtg

SEQ ID NO: 6126 - DNA, 101 bp, rice(Oryza sativa)
  misc_feature (71): n=t or c
accatctttcttggagggagaatcgaggagcaagaagagcggggagcagcgctaaccttggagcttgtctntgatgtcgacggccacagcttcgccaagga

SEQ ID NO: 6127 - DNA, 101 bp, rice(Oryza sativa)
  misc_feature (71): n=t or g
ggccccgtcatcgccgatggcgttaggaggctagacatcgaggtcaatgttgtcggcgccaggttcagcancttccatggtgttcttgacgctctcgcctc

SEQ ID NO: 6128 - DNA, 101 bp, rice(Oryza sativa)
  misc_feature (71): n=t or c
tccttgtcaccgcacgtacctccttggtatcggcggctatcgctgcggccgttgacgccatagtcacgatngcgggctcgtggtgagtgcgtacgctcgcg

SEQ ID NO: 6129 - DNA, 101 bp, rice(Oryza sativa)
  misc_feature (71): n=a or g
tccctcaccagcagtactcattgtcccccagaccttcttggcaagctggtagatattgtggtcatgcggantggggaatacttccttcccagtcttggcgc

SEQ ID NO: 6130 - DNA, 101 bp, rice(Oryza sativa)
  misc_feature (71): n=t or c
gctacagaaggcggccatgcatgcaagatccgccgcaacaacaagaccgatcgcccaacctcctgcaacgnctgtgtccatgctacccgtgccagtgcctc

SEQ ID NO: 6131 - DNA, 101 bp, rice(Oryza sativa)
  misc_feature (71): n=a or g
gccgccgcccgccggtgcctccatccgccgccgaaagacggaactgcatagaagaggaaccaaagaataantcaaatgagccatgtaagcgccacatcagc

SEQ ID NO: 6132 - DNA, 101 bp, rice(Oryza sativa)
  misc_feature (71): n=a or g
acaattgagataggtttaccctcccacctgcgtgcagagcacgtgatacgcgctactccggatgtgggacngagcggtccaccacttttcccacaggcgga

SEQ ID NO: 6133 - DNA, 101 bp, rice(Oryza sativa)
  misc_feature (71): n=t or c
cgacgacgaggactggggcaacggtggacttggtgggagtttgcgttggatggagatggggtttagtcctncatcccttcctctgtcaccggtgaagttgg

SEQ ID NO: 6134 - DNA, 101 bp, rice(Oryza sativa)
  misc_feature (71): n=t or c
aaggaggacggtcaacaaacttacagctttgaccgtggagccactcttggagtaagagaggctattggctntgatgatttgtactgccctacattcgatta

SEQ ID NO: 6135 - DNA, 101 bp, rice(Oryza sativa)
  misc_feature (71): n=t or c
gcttgaaagggatgagatgaaatggagagttctgataaggcctaagtttaaagacaacgattatgtaccgngcaaaattgttctgcacgacccagtaggta

SEQ ID NO: 6136 - DNA, 101 bp, rice(Oryza sativa)
  misc_feature (71): n=t or c
tacttgtagaatgaagaaggcagaccagcaaaagcagcttagcaaaatcataaagatacccataagccagnggccattattgtggtcactactatcagaga

SEQ ID NO: 6137 - DNA, 101 bp, rice(Oryza sativa)
  misc_feature (71): n=a or g
gattggggggtttggaaggcaccaatcccagcagactacccgcctaagatttggcaaatggatcagatcanctctgtcaaacccacaagtgacaatttcaa

SEQ ID NO: 6138 - DNA, 101 bp, rice(Oryza sativa)
  misc_feature (71): n=a or g
gaggatattacggcatgagaaaaagtggtctacatatttgaagaaaattaacaaggaaaagtacaagagtntaacttctaacccaactcatgttgtgaatg

SEQ ID NO: 6139 - DNA, 101 bp, rice(Oryza sativa)
  misc_feature (71): n=a or c
gttgtcagaaatagattacgttttgtcagatatccataacactccaaaaaaaagttacataccattgcagnatcttgatttaaatctaaatctgttctttt

SEQ ID NO: 6140 - DNA, 101 bp, rice(Oryza sativa)
  misc_feature (71): n=a or g
atttgttatggttgttgatatataggttgtcattatcagaggatcctgccttgatgatggcattttcaatngcacgtcgtgcagctgcagtcccacttctg

SEQ ID NO: 6141 - DNA, 101 bp, rice(Oryza sativa)
  misc_feature (71): n=t or c
cacagcttctgtgcacacatcagcttcaacctcttcaatgcgtacatgtccaccgccatgagcaagctctngaaaaatccggttgtcgtcgacgtcgagct

SEQ ID NO: 6142 - DNA, 101 bp, rice(Oryza sativa)
  misc_feature (71): n=a or g
cagcccatttgcctcctcttccttccaagtacacaatgcgtccctccccttccaagagtcgccaacaagtngggcccacctgtcaggctctccttcaacct

SEQ ID NO: 6143 - DNA, 101 bp, rice(Oryza sativa)
  misc_feature (71): n=a or g
catggccttggccaatcttctcaagaacgactatgctgatgcagcaggctcattgccatcacgacaggccnttggaccaagtaatcctccaaggccattgc

SEQ ID NO: 6144 - DNA, 101 bp, rice(Oryza sativa)
  misc_feature (71): n=t or c
aggctcgccgccgccgacggcacgttgaagtgctcgccgtcggagctgattaggaggattgtgtcgctgcngctgccggcggcggcgtcggcaacctcctt

SEQ ID NO: 6145 - DNA, 101 bp, rice(Oryza sativa)
  misc_feature (71): n=a or c
ctcaagttaaagaattaccaccatccattgttctacttcagcaattggttcgtctgtctgtcaattctgangtcatgttccctgcagaaggtgttagcaag

SEQ ID NO: 6146 - DNA, 101 bp, rice(Oryza sativa)
  misc_feature (71): n=t or c
ttttttccctgatcacttccttggaaagcaaagcaaaattaagcaatcatgatcagctccaagaagctagntcagctttccaagaagtggcagggaatggg

SEQ ID NO: 6147 - DNA, 101 bp, rice(Oryza sativa)
  misc_feature (71): n=a or g
gaattgccagtatagatatgatttctcctgtgagaatttgaagcaattgagcttgagacggattgtgaccntggaagaaataggactccgctctctcctgg

SEQ ID NO: 6148 - DNA, 101 bp, rice(Oryza sativa)
  misc_feature (71): n=a or c
ctgccatcagctaatggcatcgacaccctaattttaacttgccagtattggagaatttgcagagttagatntttttggtatcagtgtcttaatttatctat

SEQ ID NO: 6149 - DNA, 101 bp, rice(Oryza sativa)
  misc_feature (71): n=a or g
gctcatcgacgtggtgggccgtttcaagatccaggccgttggcttcttcatgatgaccctcttcatgctcnccctcgccctgccgtaccaccactggacgg

SEQ ID NO: 6150 - DNA, 101 bp, rice(Oryza sativa)
  misc_feature (71): n=t or c
cttttgctaagtttggaaccgaggcttgtttatttaattagtatagaaatgttaggcttaattccaggagnatgcacaagaggcctgggtgttccgggtgg

SEQ ID NO: 6151 - DNA, 101 bp, rice(Oryza sativa)
  misc_feature (71): n=t or c
gtagaagatgaaggtcatttggacccgctggatgcacatgagtttgagggtgactatgagattgagccacnggaacatatgtacagtacaccgataccaat

SEQ ID NO: 6152 - DNA, 101 bp, rice(Oryza sativa)
  misc_feature (71): n=t or c
cgccgagtgaatggttcatctgcaatgaggccgactcgcacacccattgcttcgttatccaatgctccgantcactcgtctcgtggcaagccaacctcgtc

SEQ ID NO: 6153 - DNA, 101 bp, rice(Oryza sativa)
  misc_feature (71): n=t or c
tttaagatgtaacaattaaggatttgccactcgaagacttaaagtctataacatgtgcatcattatgtgtntaaggtatgtgggttcagtggtaaatcttt

SEQ ID NO: 6154 - DNA, 101 bp, rice(Oryza sativa)
  misc_feature (71): n=t or c
cgagattgagagccccaagctccgcgatttgccgctgcccttgccctctacgggcaactggcctttgttcntcaatcgctgcccctactattgtcgtgaca

SEQ ID NO: 6155 - DNA, 101 bp, rice(Oryza sativa)
  misc_feature (71): n=a or g
tcaagggcctctgaaggccctagagctggttcaagggatctggaggcccatgagccggctcaaaggctccngagctcttgccatggctccaaagccgaagc

SEQ ID NO: 6156 - DNA, 101 bp, rice(Oryza sativa)
  misc_feature (71): n=a or c
acactaacagtactgggcattcagttcactgatatccctgctctcattgcaccagagcttttcgttggagnagcgtagtggtgccaagaaatacatgatgc

SEQ ID NO: 6157 - DNA, 101 bp, rice(Oryza sativa)
  misc_feature (71): n=t or c
gacatgtggggcctacataaatcatatcctccccctctctttctcttcgtgagcgttggacgggagctagnggcggtggccggcgcctcctccaactccat

SEQ ID NO: 6158 - DNA, 101 bp, rice(Oryza sativa)
  misc_feature (71): n=t or c
aatttggcaatctgacatatgaaaatataagctgtacctatggctccaggtgctttcgttttttggtgagnatgaaaggatcaaggcacacaattgcagct

SEQ ID NO: 6159 - DNA, 101 bp, rice(Oryza sativa)
  misc_feature (71): n=a or g
gtttgtttgcacttggcaatgcctagcaatctgattctgtttcttccttcatgtggaaccatagggcacancatctcccaagactacaactcctactggca

SEQ ID NO: 6160 - DNA, 101 bp, rice(Oryza sativa)
  misc_feature (71): n=a or g
ggtggcaagcccccgggtggtggaggccatctacctggagtgtgtccccgtggtgatcggcgacgactacncgctaccgttcgctgacgtgctcaactggg

SEQ ID NO: 6161 - DNA, 101 bp, rice(Oryza sativa)
  misc_feature (71): n=a or g
tcttggtttttcatttatagtttccttcggtgttccctaccagaacaagagaaggatcctaacgatgcgantctactgcgctgctgatgaaggttagtcta

SEQ ID NO: 6162 - DNA, 101 bp, rice(Oryza sativa)
  misc_feature (71): n=a or g
acaattgatgacaggcttcggtggcaggcgatgcgatgccctctggattgtgctttttttttgggtaccgngtgtatatgtgtttgtaacgatgatggcac

SEQ ID NO: 6163 - DNA, 101 bp, rice(Oryza sativa)
  misc_feature (71): n=a or g
ctgctgtcaacacctaggacaagtgttctacaacattcctcttgaagttctttataatggactcactcccntgttccacaatcacctggacgtggcggctg

SEQ ID NO: 6164 - DNA, 101 bp, rice(Oryza sativa)
  misc_feature (71): n=a or c
gacatagggctacggtcatccagagtaaactcaatgaaggctaatccattcccttgtgttactccttcagnatatattatatctttctctgaaggttcata

SEQ ID NO: 6165 - DNA, 101 bp, rice(Oryza sativa)
  misc_feature (71): n=a or c
ttcagtggcaactctacctgggcttatcacaggatgtgaagagcaccttatgtcgttgtttgtaattgaanaaaatgaaattttactactttttaaccatt

SEQ ID NO: 6166 - DNA, 101 bp, rice(Oryza sativa)
  misc_feature (71): n=t or c
gtcatctttggttgatgctgctgctctgtcctgctctttcttctgcgccctaataagtgcccgtcttgccngggggcgcatctcgcgcacctgacgcggtg

SEQ ID NO: 6167 - DNA, 101 bp, rice(Oryza sativa)
  misc_feature (71): n=t or c
tgaccaaaactatgagacaacactccaactaatctctgagcaacaattaagtatggtacaaaacaggcgtnagttaaaagttaacaaaatctagtgaggca

SEQ ID NO: 6168 - DNA, 101 bp, rice(Oryza sativa)
  misc_feature (71): n=t or c
gttgcaggggctcctcagcgaaatacttggagcgccagcgacgacgccaattctcaaggtggacaacaagnccgccattgctctatcaaagaacccggttc

SEQ ID NO: 6169 - DNA, 101 bp, rice(Oryza sativa)
  misc_feature (71): n=a or g
ctatccagaaactaatagtaagtagtgttcccaaatattttacctgtgcaccttgtcgaactcgtatatcnatacctttgctatcaattgatataagagct

SEQ ID NO: 6170 - DNA, 101 bp, rice(Oryza sativa)
  misc_feature (71): n=t or g
taacctctctagttgcaaataatgtatcgagccatccaactgtgcagcatcccacaaatcatttctttcanacaattgttttctattctcagtaccctcgt

SEQ ID NO: 6171 - DNA, 101 bp, rice(Oryza sativa)
  misc_feature (71): n=t or c
caccacgaagctttgtatgattgtagtgaccacccgcagcgagaaagtcgcaaagcttgtgcagacaatgncaaacttctataacctagaatgcttgagtt

SEQ ID NO: 6172 - DNA, 101 bp, rice(Oryza sativa)
  misc_feature (71): n=t or g
atgcaatcaaagattcaaacatcagattctttaccagctaaaatatcaaaaaatattaagacttggcagtntagttatctttttactaattcttatagata

SEQ ID NO: 6173 - DNA, 101 bp, rice(Oryza sativa)
  misc_feature (71): n=t or c
ttagctgcagatgaaggagaatacattccaggaaggaacagccatggcgtcgtcctcctcatcatcgtccnttctcgctcatccatcgtcgctgctgcgtc

SEQ ID NO: 6174 - DNA, 101 bp, rice(Oryza sativa)
  misc_feature (71): n=a or g
atttgcagaaattaaacttaaactctatgtatcagaatgaggaaaaaaacacttacatctttccagttgcntcaagtgatggtgatctcgtctaagaaaag

SEQ ID NO: 6175 - DNA, 101 bp, rice(Oryza sativa)
  misc_feature (71): n=a or g
tcaaggatttactatcaataatagtttgtccaagtttagcttttacacatcatttaacttggttttcgagnatgggaggtaattctattgcatcctttaat

SEQ ID NO: 6176 - DNA, 101 bp, rice(Oryza sativa)
  misc_feature (71): n=t or c
tttttatttttcaaaaagtgttgcccacacaaacaaaacacttaatcgattgctaaaatagcccatacganacatttttatttttttaatcttataagcaa

SEQ ID NO: 6177 - DNA, 101 bp, rice(Oryza sativa)
  misc_feature (71): n=a or g
gttggaaacttttattcgggggagctccgcatggcctgttctcactgcttcaacgccagtatcgtggagcnggcaccgtgcagaaggaataatgtttagat

SEQ ID NO: 6178 - DNA, 101 bp, rice(Oryza sativa)
  misc_feature (71): n=a or c
ctctgttccagcattctgtatcctctttgtcagctgttcagtttcttcatctgtgaaggtgacagatggcntggtctttgacagcagtggtagaattgtga

SEQ ID NO: 6179 - DNA, 101 bp, rice(Oryza sativa)
  misc_feature (71): n=t or c
tcaagccacgcaaggcactcatgcctctctgctctatctctcctctcgtcggccttctcgaccaacggccngatgcagtagaacggcggcaatgccgggcc

SEQ ID NO: 6180 - DNA, 101 bp, rice(Oryza sativa)
  misc_feature (71): n=a or g
cttgtttaaaagctaattgatcatgttcaccactttaaaattatttaactaagaagtccaaaagttccacnagcaactaattagccattcaattctatatt

SEQ ID NO: 6181 - DNA, 101 bp, rice(Oryza sativa)
  misc_feature (71): n=a or g
acctctcgatgtcctcagctttggacagtttctgatatcaagctctctaagttcattcatctgttcaaatnccaatggagcagcctccagatcttcacaat

SEQ ID NO: 6182 - DNA, 101 bp, rice(Oryza sativa)
  misc_feature (71): n=a or c
atccgactccttgatgagagacttgccaaggaagcaggagagatcttcgccaaggcgacctggatcggggncggtagcggcggccttagcaggcttacacg

SEQ ID NO: 6183 - DNA, 101 bp, rice(Oryza sativa)
  misc_feature (71): n=t or c
cttgtttttcctggtgtcattcatctcaaccatcttctcgctctgcacccgcttcagccttgatctggtcntctcagtgccagctcgtggcgttgaattct

SEQ ID NO: 6184 - DNA, 101 bp, rice(Oryza sativa)
  misc_feature (71): n=a or g
gggcttggagcacgatcagtttgttctgtctgctcttgtgaccatgtactccaagtgcggcattttggaanattttgtcaaggtgcagatgtctgtttcat

SEQ ID NO: 6185 - DNA, 101 bp, rice(Oryza sativa)
  misc_feature (71): n=t or g
acccatccaccatcgcttagagtaagactgccaatctaaggatgatgacagattgaaaccagaataaatgnccctcgaagaacaatcctcctcaaaacaac

SEQ ID NO: 6186 - DNA, 101 bp, rice(Oryza sativa)
  misc_feature (71): n=a or g
tcgagcatctcgaaggatcccaagaaggggatccagaactcgagcctcggggccatgtcgcatgtgtggangcccttggcgccgccgggcaggaggaggag

SEQ ID NO: 6187 - DNA, 101 bp, rice(Oryza sativa)
  misc_feature (71): n=t or g
aacccttagagaagtcggtactgcctgaacaatattcagctaaccgtataggaccacttcagggggctgangggagcatgatgagatctgattctagtatc

SEQ ID NO: 6188 - DNA, 101 bp, rice(Oryza sativa)
  misc_feature (71): n=a or g
attgcaagtgggtgtacaagatcaagaggaaggctgatggctctcttgataggtataaagctggactaatngccaaatgtttcaagcaaaggtatggaatt

SEQ ID NO: 6189 - DNA, 101 bp, rice(Oryza sativa)
  misc_feature (71): n=a or g
acacagttccagcaaagggctaatgctgatgagtcgctgccgcttccttcatctagcttggccagctcagngaaaccagcaacattcaagagtacttggtc

SEQ ID NO: 6190 - DNA, 101 bp, rice(Oryza sativa)
  misc_feature (71): n=t or c
tatgtacaagagcatgacgcgcgtctgcttcaatgctagtagctccacagagacacgtcagcgatgtcgcntgagtcgacgatggcgtcgtcgtcgtcgtc

SEQ ID NO: 6191 - DNA, 101 bp, rice(Oryza sativa)
  misc_feature (71): n=t or c
cattgttcaggtgtaagaaacgtgtcaccgggatcaagctcgtgttgtggttgatctccaagctgcgggantgctttggcctgtcttttggacttgtcgtg

SEQ ID NO: 6192 - DNA, 101 bp, rice(Oryza sativa)
  misc_feature (71): n=a or g
gggcctctacgcttgctcgatgtgcactgttgccacatgcttgatccatcggaccagaccactcatggggnaagcgaggacggtgccaatctctctttctc

SEQ ID NO: 6193 - DNA, 101 bp, rice(Oryza sativa)
  misc_feature (71): n=a or c
aagattcattccttcaaaagaagaaaattcagttcatcagtcgaggtgcaaggttgcaatgattcggaagnaagcaccatcataagcaacgattgtttatg

SEQ ID NO: 6194 - DNA, 101 bp, rice(Oryza sativa)
  misc_feature (71): n=a or g
gacgagccctacctgccgtcgtcggtgacgtggttcttccagaacggcgcgctgctgtaccagaagggtanccagaccccgacgccggtcgccgccgacgg

SEQ ID NO: 6195 - DNA, 101 bp, rice(Oryza sativa)
  misc_feature (71): n=a or g
ggcggcggcgacgagcaagagcaacagcaccaccgtgggcgacatggcggacacgacgttcaagagcatcngcgacgtgctgaagctgctgccgacggcga

SEQ ID NO: 6196 - DNA, 101 bp, rice(Oryza sativa)
  misc_feature (71): n=a or g
agttgtagacgattactctttgcccgaccccggtgatgaggaagacaaagacgatgactggaacaccgacnagaaggcccctccgcttgcatcacccgaca

SEQ ID NO: 6197 - DNA, 101 bp, rice(Oryza sativa)
  misc_feature (71): n=a or g
tcgagagatgtgacagatatatgggcatgtctggagataatctgtcgccagaatagttttcaatttttgcnggaacgtattatgcaaacagctgcctacaa

SEQ ID NO: 6198 - DNA, 101 bp, rice(Oryza sativa)
  misc_feature (71): n=t or c
tttacagtagcaactttgggtgaaacctttagcttctttcctcttcggcgtttacccgatgaatcccctgnagaagcatcactagtaccaccagtcgctgc

SEQ ID NO: 6199 - DNA, 101 bp, rice(Oryza sativa)
  misc_feature (71): n=a or g
aaaagttgttcaaaaatacaaggtgaaagtggttgttgccgttgaagttggaacaagctcatctcaaggtngtaagagtgctgcagatggctcgggcgaca

SEQ ID NO: 6200 - DNA, 101 bp, rice(Oryza sativa)
  misc_feature (71): n=t or c
gctagcagggtggccctagcattgacggcactgggtggagcagcggcagggcgaacatcctcctctctttnccttatcctcttccccttccggtctcgtcc

SEQ ID NO: 6201 - DNA, 101 bp, rice(Oryza sativa)
  misc_feature (71): n=t or c
ggcgagcgtgcaggtgatggcgacgctccgtccggagcatatggaggcgtttaggtcgcaacttctttacnggtgagtgacagcaccgttgagctgtgatc

SEQ ID NO: 6202 - DNA, 101 bp, rice(Oryza sativa)
  misc_feature (71): n=a or g
aggaaaattgagcaaccccagagtatggcacctgttgctgcggaagaggacgatgtgccaaggttgaggancactcggtcaagggcaacaaggcggcagcc

SEQ ID NO: 6203 - DNA, 101 bp, rice(Oryza sativa)
  misc_feature (71): n=a or c
aagctgaatgtccgccatgattcagagtctgagaaccgcatctcggatgatgatgaagatgaagatggtanttcaatgattcacaaagctacgcagagaag

SEQ ID NO: 6204 - DNA, 101 bp, rice(Oryza sativa)
  misc_feature (71): n=t or c
ccaccatcgatcgcggccaccggctgggtgatagccggtgcgaggggaaatatccggaaggaggctacttnctctgtttcataatgtaagtcattttagca

SEQ ID NO: 6205 - DNA, 101 bp, rice(Oryza sativa)
  misc_feature (71): n=t or g
tcggtgacaagaatgacagattctatgcttcgctggtagggagtactcgtctacttttaatttcttttttntgcagggaacactttgatatatatatatat

SEQ ID NO: 6206 - DNA, 101 bp, rice(Oryza sativa)
  misc_feature (71): n=a or g
gaagaagcgcgccgacatctggtggcgcaatggcgtggcgacgaaactcggtatttaagaatagaataccntccacaagtatatttatataatgatagaaa

SEQ ID NO: 6207 - DNA, 101 bp, rice(Oryza sativa)
  misc_feature (71): n=t or c
gtgatagtgatcccagtcttgttccgaaacttgcgggtgaaccaaggcaaggtagaagtcttcatggcggngctctggcctatgagggatggtgatgtcga

SEQ ID NO: 6208 - DNA, 101 bp, rice(Oryza sativa)
  misc_feature (71): n=t or c
atccccacaaaattaacatcccaaatcaacacaccacactggagaaggaagtagccgccgctgccggatcngtcctcggccaccaccactgtggccgctgc

SEQ ID NO: 6209 - DNA, 101 bp, rice(Oryza sativa)
  misc_feature (71): n=t or c
tcgctggattccttcatttgctcctgtcctccttgcaaccttcatcctgctcctcttcctagacctgttcntcctcatcctattcctcttcaccagcggaa

SEQ ID NO: 6210 - DNA, 101 bp, rice(Oryza sativa)
  misc_feature (71): n=t or g
caataatcttcctcaagaacatgttcagctgtactactcgcagagggccacaaatggcggccttctgatcnctgaagccaccggggtctcggagactgctc

SEQ ID NO: 6211 - DNA, 101 bp, rice(Oryza sativa)
  misc_feature (71): n=t or g
tgcagggggaggacgaggtcgttcacccatttggggagctcgtcgtcgtcgccaatcttgggtacacgctngatcctccattgctccggcgactgctccgg

SEQ ID NO: 6212 - DNA, 101 bp, rice(Oryza sativa)
  misc_feature (71): n=a or g
tcggctaattccaggtggtgacagtttggaattttggcggtgtcatttcgtcatcgacacgcagttgatantacctgtggctgcggttaacgatgacttga

SEQ ID NO: 6213 - DNA, 101 bp, rice(Oryza sativa)
  misc_feature (71): n=a or c
gttgaggaagacaaatatacctttcgcgcttcatgtcccggcaataaggctttaagctggaatttgggagnagaattacttgaagaaaaaagtacggctgt

SEQ ID NO: 6214 - DNA, 101 bp, rice(Oryza sativa)
  misc_feature (71): n=t or c
actttgcttgttaagttgtttgctcattattcttttaagtcgttcttgtggtgtttctttcttttcagtcnggacggttttgccaggccccccagtggcac

SEQ ID NO: 6215 - DNA, 101 bp, rice(Oryza sativa)
  misc_feature (71): n=t or c
tctctagccacataatgagcaaatgagcggacaacatcatgcatcgtgcagtgccattgatcaacatactntatacttggctccaaaagatttctcatgat

SEQ ID NO: 6216 - DNA, 101 bp, rice(Oryza sativa)
  misc_feature (71): n=a or c
atagtttcagattcaatcacacagctttctatctcatccctcaggtccggatgctcagagtatgcatgacntaatttttgtttggttctactcaaaatata

SEQ ID NO: 6217 - DNA, 101 bp, rice(Oryza sativa)
  misc_feature (71): n=a or c
tcaccgtggttacgcaagtcattatccagttaacccagcggtgagcgaaacccaaccgattcattgccatntcaaggaaacgccaatccaccctgtcataa

SEQ ID NO: 6218 - DNA, 101 bp, rice(Oryza sativa)
  misc_feature (71): n=t or c
ggacacatccaaccaccttactcactgccttttggtcgccggaggatcggtgtccatcttccatccctttntatttcttgtttcgactagagaagacgatg

SEQ ID NO: 6219 - DNA, 101 bp, rice(Oryza sativa)
  misc_feature (71): n=t or g
cagcattggttttgggtacggcccaataactctgcagagcgaggaatagaagctaagttgttctttgcttncaatgatggcagtgcacctgaggacaactt

SEQ ID NO: 6220 - DNA, 101 bp, rice(Oryza sativa)
  misc_feature (71): n=t or g
ggtgcactacaacgtgaagccgagcaacatcctgctcgacgagcagtgcaacccgatgattggcgacttcnggctggcgcgactgctgccgaagctggaca

SEQ ID NO: 6221 - DNA, 101 bp, rice(Oryza sativa)
  misc_feature (71): n=t or g
ctcaagaagctactaatatttggctgtgagaagctttgttccgtctcaggacagctggatgcactcaagcncttaattattgatcactgtaataaactgga

SEQ ID NO: 6222 - DNA, 101 bp, rice(Oryza sativa)
  misc_feature (71): n=a or g
catgataaccgaggaaactgcacaggatcccatggttgaagatgagaaaaccatgacaaccgaggaaaccntacaggagcccatggttgaagatgagaaaa

SEQ ID NO: 6223 - DNA, 101 bp, rice(Oryza sativa)
  misc_feature (71): n=a or c
aaccaggccatggccagccactccgtcgtcatcaccaacaagctgctccaattcttccgcggcttcgacgncggcgccggcgtggatgtgctcgtcgacgt

SEQ ID NO: 6224 - DNA, 101 bp, rice(Oryza sativa)
  misc_feature (71): n=a or c
tgacagttgggaatttgtacacagtgttcacgacatctaatgtgcactgccaaaaagcatttatatgcagnacaagcatcttgaaagaagatctgagatat

SEQ ID NO: 6225 - DNA, 101 bp, rice(Oryza sativa)
  misc_feature (71): n=t or c
tcaacaatacagacctccgcatttagtttagaaatggataattttgtgtcgtcttgcaagtatgaaagctncttcttaagggctttcttctccctttctga

SEQ ID NO: 6226 - DNA, 101 bp, rice(Oryza sativa)
  misc_feature (71): n=a or c
tttagtgctggtagggcccacccgtgctgttgtgttgtcaatgccggatcctctgatcatcgatgttgaantgaaagtgaagggcaccactgaatctgagg

SEQ ID NO: 6227 - DNA, 101 bp, rice(Oryza sativa)
  misc_feature (71): n=t or c
tcaggaacaaccagggcgctctcatcgctgctgccattcgcctgctttacgttactatcttggtgctcttngtaactgattctctcaaccattgccacttc

SEQ ID NO: 6228 - DNA, 101 bp, rice(Oryza sativa)
  misc_feature (71): n=a or g
cggctttggggggaacccggcctggagcgtgtaatcaccggcttctcctggccttgttgtgtcgatgaacncccgcacatccgcgatcgtgtggctcgtgt

SEQ ID NO: 6229 - DNA, 101 bp, rice(Oryza sativa)
  misc_feature (71): n=t or c
ggtgatggtgatgaaaccatggcagactgcaaagggcatagtcaagaagcaaacccaatcaaggcctccangatggaggttgaagctttcatggccaaaca

SEQ ID NO: 6230 - DNA, 101 bp, rice(Oryza sativa)
  misc_feature (71): n=a or g
gggcacgacgaagaggagatcaggagccaaggaagccattgagcggccatcaatccattggtcagtctagnagagcaccgattcaccatccccggcatgaa

SEQ ID NO: 6231 - DNA, 101 bp, rice(Oryza sativa)
  misc_feature (71): n=a or g
gaagcaggggctcgttgcaggaggaaacaacagcttgcctaccattatctttgaccgcatccacagatgcngagggccacccaatctgtccctccttgaca

SEQ ID NO: 6232 - DNA, 101 bp, rice(Oryza sativa)
  misc_feature (71): n=a or g
caacatgtgaggttttttaattgtgtgagtacatgttgtaggtcatggagtgtttgggatggcactaccangctgcccggagacatttcaatcggtgcagt

SEQ ID NO: 6233 - DNA, 101 bp, rice(Oryza sativa)
  misc_feature (71): n=t or c
ccacatgttagttaatgcaataactacaagactactctcacttgagcatgaagaagtatcacctcgagcgngttttgccttttccaccttcctcccaggtg

SEQ ID NO: 6234 - DNA, 101 bp, rice(Oryza sativa)
  misc_feature (71): n=t or g
cgcggcggggagggagagggagtgcatggatgagtccgtggaggggttcgtcgccgggtttgatccgtgcncgctgccgccgccgttcacggaggaggaga

SEQ ID NO: 6235 - DNA, 101 bp, rice(Oryza sativa)
  misc_feature (71): n=t or g
tagtaaacgcatagactgaggaaaacattatgaacctgaatatttagtatcaggtccctcatctcttctgngctcttgctatggaattctggtccttctat

SEQ ID NO: 6236 - DNA, 101 bp, rice(Oryza sativa)
  misc_feature (71): n=a or g
ctatccaaattcatgttcccattttaaaatctccctcagaatcccaaatccacatattccacaaatccacnttcctgcaaaaaagaaacctaaaatcccta

SEQ ID NO: 6237 - DNA, 101 bp, rice(Oryza sativa)
  misc_feature (71): n=t or c
tatgactgcacccgatctcaactcggttttgttgtgaataatctgttgctggtcccgaccaaatggctagncattcaattcgcacgactacaatgccggtg

SEQ ID NO: 6238 - DNA, 101 bp, rice(Oryza sativa)
  misc_feature (71): n=t or c
ctacgctgtacgcttttgccttttgttaattagaacggccatgttaagcttccatgcgtgatggggagcgntagctatactagcgtcgatcacggtattat

SEQ ID NO: 6239 - DNA, 101 bp, rice(Oryza sativa)
  misc_feature (71): n=a or g
gattaaactgcaactaacactgaaactgatcgagcagatgacaatgactgttcattcatcgagacaccaanctgcatcggatcaggtggcgaatcatggat

SEQ ID NO: 6240 - DNA, 101 bp, rice(Oryza sativa)
  misc_feature (71): n=t or c
tgccaactctctggcaaatttagcccttcatcctgcaaggcttaattttaatttgcggaatgaaattgtgncgtatgattctttttcttttgaatcttctg

SEQ ID NO: 6241 - DNA, 101 bp, rice(Oryza sativa)
  misc_feature (71): n=a or g
gacgcgcttgacggggttgagcttggaggcctggttgagcagccaggtgacgccgaaccagaagtcgccgncgatcgagatccaccagagccacatggcgt

SEQ ID NO: 6242 - DNA, 101 bp, rice(Oryza sativa)
  misc_feature (71): n=t or c
cggcgatctcgccctgctccatcccgctctcccgtttccaatcccccaaccggagcagaaatggccatctnctccgccctctccttcctctccgatcgcaa

SEQ ID NO: 6243 - DNA, 101 bp, rice(Oryza sativa)
  misc_feature (71): n=t or c
acatctgcttcctccccatggtcggagctccgccttctctcagggtaacagcgcagccacccacctgatcngacaccttccgaggtcagagcggtcgggtc

SEQ ID NO: 6244 - DNA, 101 bp, rice(Oryza sativa)
  misc_feature (71): n=t or c
cctagggagcttctatgcgcgatggattgaatggtggctcaccggagcgggtggaatcaaagatggagctngctggccggagttggagaagacgatgccga

SEQ ID NO: 6245 - DNA, 101 bp, rice(Oryza sativa)
  misc_feature (71): n=t or g
gcggcagctcgcgccggtcaggaatgacgagacgctgaccctcgtcaggaacatcaaggccgcctcctccngccatggcggcggcggcggcaagaagccgg

SEQ ID NO: 6246 - DNA, 101 bp, rice(Oryza sativa)
  misc_feature (71): n=a or g
ggtaacgctgcatcgacgaagggcaattgccaatgtttggaggaaggtggagacgacaacggggatggggngaagcaggcagcgactgctgggtgtggggc

SEQ ID NO: 6247 - DNA, 101 bp, rice(Oryza sativa)
  misc_feature (71): n=a or g
ttgcatcgtgctatgctcacaagctctggaagccagttaaggcttaaaccatgtcataaaggtaattgcancgtgtagtagccatgtggcttggtgttcct

SEQ ID NO: 6248 - DNA, 101 bp, rice(Oryza sativa)
  misc_feature (71): n=a or g
ccacttgaggctctcttccggaccggccaggggggcagtgatgttgttgttgttgctttcttcggtgtgcntgatgtcggtcccacctcgtacactcgttg

SEQ ID NO: 6249 - DNA, 101 bp, rice(Oryza sativa)
  misc_feature (71): n=t or c
gacaccactagggttggcacggcgccgaggtggaggagcatcatgtcagggctatgcttagtggcaaggtngcggagggagatgtggggcaaggagccgat

SEQ ID NO: 6250 - DNA, 101 bp, rice(Oryza sativa)
  misc_feature (71): n=a or g
ttcttcattccttcatactctgttccatcttcttgttttacccaccggaactctttcttgatgtcagggcnaggagggcgttcccgaaacatgtcgggctt

SEQ ID NO: 6251 - DNA, 101 bp, rice(Oryza sativa)
  misc_feature (71): n=t or c
agtacaacctagtagaatcttcttcttcatgtggaccttgatcatccatgttgtggcttcagggacaatgnagttgccctcgttcaacaagaagcaaacgg

SEQ ID NO: 6252 - DNA, 101 bp, rice(Oryza sativa)
  misc_feature (71): n=t or g
aacacttactctctcaatagcatctttgaatatatccacagccttagctccatcccctgccaattcaattnttgctcctagttggttcaacacttttctct

SEQ ID NO: 6253 - DNA, 101 bp, rice(Oryza sativa)
  misc_feature (71): n=t or c
tccgggcacatcaaggacaggtctccagtcatcccaccctgaacatggccgtctgcaacgccgaaagccgnggcgatcagacacaaaccaacgaacggtgc

SEQ ID NO: 6254 - DNA, 101 bp, rice(Oryza sativa)
  misc_feature (71): n=a or g
cgtcgaatggaacgatctcttctgggtggtgcaccctggagccccgtcgatcttggaccaaatcgagagcnctctccggctggagcccgggaagctggcgg

SEQ ID NO: 6255 - DNA, 101 bp, rice(Oryza sativa)
  misc_feature (71): n=a or g
tttttgctctccgtctttcttctcttccacctcaacatcttcaacgtcggaggtgcagatgtagcaatctnccgtagcaacgtatgcccgttgactagggc

SEQ ID NO: 6256 - DNA, 101 bp, rice(Oryza sativa)
  misc_feature (71): n=a or g
gaacatcgccacatcagcacatttttcttggtctcagattatgctgttaacaatgacattgcagtgagatntgacatgtaagcatgttgatcaacagtgat

SEQ ID NO: 6257 - DNA, 101 bp, rice(Oryza sativa)
  misc_feature (71): n=a or g
tgctccatcctccgagggcattgcatccggatgccagccagaaggacgagacatggacgaagtccccgctntcgccatgcggaggcaggctccgtagggga

SEQ ID NO: 6258 - DNA, 101 bp, rice(Oryza sativa)
  misc_feature (71): n=t or c
ttggtgcctactaatagtcaacccactcctttggtcatagtatagcagctaacaagtggtatgaacaaaanattggccaatgggatatctcaacagtctga

SEQ ID NO: 6259 - DNA, 101 bp, rice(Oryza sativa)
  misc_feature (71): n=a or g
ctctcgttcagttggacgaaatatgagccgagacctggatcaataaggtttttctttgatataccggtacnatgcaacccggtgaccttattccacccaaa

SEQ ID NO: 6260 - DNA, 101 bp, rice(Oryza sativa)
  misc_feature (71): n=a or g
gcccaatgcggaccgcgtggaggatcactgcaacggccttgttctactctggggtggcgtagctaaccccnccacccgacaatgggcgcctttccctgagc

SEQ ID NO: 6261 - DNA, 101 bp, rice(Oryza sativa)
  misc_feature (71): n=a or g
ccattgttcacaaatcacgacaggtttgcagaaggtgctgaactcatagatgtgtgctggttggaaatccntggcaggatacacagcaagatgctctcccc

SEQ ID NO: 6262 - DNA, 101 bp, rice(Oryza sativa)
  misc_feature (71): n=t or c
gagcccaatctgaccgataacactgaaattgttcagcactcaagtacctctgagcatgcatcgtcattggnactgtcatcaccgggcaaaggggatggcag

SEQ ID NO: 6263 - DNA, 101 bp, rice(Oryza sativa)
  misc_feature (71): n=t or g
gtgtggcagaggagaaaacgtgacacgaatgggagtgggaaggacaacgaggggaagggtggacagcatgnacgacgcgaaggtggcacattggagttgtg

SEQ ID NO: 6264 - DNA, 101 bp, rice(Oryza sativa)
  misc_feature (71): n=a or c
tagatgctttgcagcattttggtatatatgccataggcaaagacagtgacttgagtttaggaatacaatcntaatcgcctttgccattgcagcacactgat

SEQ ID NO: 6265 - DNA, 101 bp, rice(Oryza sativa)
  misc_feature (71): n=t or c
acaacccaatcgccacaaagcccagcattactacatgatgagttaaccatgcttaagtcacatactacacnggtaatttgaataaacaagtaacatagaaa

SEQ ID NO: 6266 - DNA, 101 bp, rice(Oryza sativa)
  misc_feature (71): n=a or g
tggactgcccctatggtcacgtcccgcggcgtgcgtttccaactgtccttacgcccaaaagagccaccggntgtctctcgcatgctgttcaaggcggtcgt

SEQ ID NO: 6267 - DNA, 101 bp, rice(Oryza sativa)
  misc_feature (71): n=t or c
gaccacctcccgagcgacaccgagaggacgtcgactccgtccttcatggcctcgtcgaacccggctagcanggcgtcgtcatcgcagcctgagccgttgca

SEQ ID NO: 6268 - DNA, 101 bp, rice(Oryza sativa)
  misc_feature (71): n=a or g
aggcgactcaagctcgtgctgccaaccgttgttgctaccatctctccccctttgtccgcaggaaaccgccnctattgccgctaccatctctcccctttgtc

SEQ ID NO: 6269 - DNA, 101 bp, rice(Oryza sativa)
  misc_feature (71): n=t or c
taattcacaacatacatacagatgatgaaatgcttcagttatactggcaatcccacttcttggttcttttngcaacaaccaaacagcgagaagagccaggt

SEQ ID NO: 6270 - DNA, 101 bp, rice(Oryza sativa)
  misc_feature (71): n=a or g
atcccctctccctcaaacacagccttattttgggacagagcgagtattgactttgcacacataggaggagngcataataacttatcttcagatcgaggctg

SEQ ID NO: 6271 - DNA, 101 bp, rice(Oryza sativa)
  misc_feature (71): n=t or c
tgagagatggtaaagtattcagacaccatgttttcagcgggcattgtcaccataatgtcgtcacaggtggngttctccagttcatcaaataatttctcttg

SEQ ID NO: 6272 - DNA, 101 bp, rice(Oryza sativa)
  misc_feature (71): n=t or c
cgagtggttgactatgtgccatggagactccacagggctcagcacagatagccttgctgatgcaggctacnctggtgctgctgcactaggagatgcagtga

SEQ ID NO: 6273 - DNA, 101 bp, rice(Oryza sativa)
  misc_feature (71): n=t or c
tgaggagagggtcaggcagctcatgttcaatgcccattttggcggtccgcggaagcgcatccatccagagnctttctacacaaactcatggccagagtgct

SEQ ID NO: 6274 - DNA, 101 bp, rice(Oryza sativa)
  misc_feature (71): n=a or g
cccgtcgccgtcgtcgtccaccatcgacctcgacgtcgccacgccgctcaagttcgacagcggttactacnccaacctgcagaagaagcagggcgcgctgg

SEQ ID NO: 6275 - DNA, 101 bp, rice(Oryza sativa)
  misc_feature (71): n=t or c
gggtcattgcgaaagtccatttgttgcattttggtctggaaattgttcggcgaaaaatctcggaatgcatnggtggatatgtcaattgcatcagcccatgc

SEQ ID NO: 6276 - DNA, 101 bp, rice(Oryza sativa)
  misc_feature (71): n=a or g
tggcaatttagcaatgaaagggagtatctttataggggaggtgccacgttttacgcagtggggagcagcancagacatggttggctaagtacatactagaa

SEQ ID NO: 6277 - DNA, 101 bp, rice(Oryza sativa)
  misc_feature (71): n=a or g
gccaagtccatgctagcgcggagtgacctaagtcacttagcaattccatcggtggagccggtcctcgcgcnaagctcttggacagggaatcgagctgcaag

SEQ ID NO: 6278 - DNA, 101 bp, rice(Oryza sativa)
  misc_feature (71): n=t or c
tccctcgtcatcgacttcttgtgtgcgtatgggctcgacgctaccgtagagcttggagtcctactcaccgnggggctggagaggagcaagcattctttcct

SEQ ID NO: 6279 - DNA, 101 bp, rice(Oryza sativa)
  misc_feature (71): n=t or c
gatgctaacatgagtaggcgtgacaaatcctcaacctcccttgtcacagttccagtggatgcttcatcgantgacaaggtatttgattaaacttgaatata

SEQ ID NO: 6280 - DNA, 101 bp, rice(Oryza sativa)
  misc_feature (71): n=t or c
tcgagctccttggcgccagatctggtctcaaggtggtcgaagaccactatatctggacggccccaagctgnagccacctcctccttcgccctctgccccaa

SEQ ID NO: 6281 - DNA, 101 bp, rice(Oryza sativa)
  misc_feature (71): n=a or g
taaaattgctcccagaaggcggtctcaaccttgattcgatggaccgggcatgtcagggttgtcgaacatgncattgggcgctgccgaggttgagggagcgt

SEQ ID NO: 6282 - DNA, 101 bp, rice(Oryza sativa)
  misc_feature (71): n=a or g
ggcacggttaatgccgcgccgccgtcgaacgtgaacacgagttccggcgcatctccagccactgctttcgngaagcagaggtcgtaaggcttcggcggcga

SEQ ID NO: 6283 - DNA, 101 bp, rice(Oryza sativa)
  misc_feature (71): n=a or g
tctacaaacaggcgagagagagagtgagaaaatcaaaaacgataaatggcaatgcgcgctcgatcaggccnccgtgcgaacggctcagctagcagcgcggc

SEQ ID NO: 6284 - DNA, 101 bp, rice(Oryza sativa)
  misc_feature (71): n=a or g
ggtcgtcatggaacctggaagcagcagtagggagggggagcagcaggagccagcaaacgaacgactaaccnccaccggaggaggaggaggaggaggaggag

SEQ ID NO: 6285 - DNA, 101 bp, rice(Oryza sativa)
  misc_feature (71): n=t or c
ggattttacagataacaccttaccggatgagctggtttagatgttgctggtgttgatttcttcttcatganagttttctttttctgcaaacacaagaccaa

SEQ ID NO: 6286 - DNA, 101 bp, rice(Oryza sativa)
  misc_feature (71): n=a or g
aaaccagagtagagaactcataaccttggtgacaatgttattactatcactgtgggttgccactgcagatngagctaggggaagaacggaactattgctac

SEQ ID NO: 6287 - DNA, 101 bp, rice(Oryza sativa)
  misc_feature (71): n=a or g
gtctttggaagcaagcctctgcgcgacgtagacgtcgaagacgatgcccgttgctacaacggagctcaccngcgagtagtcgcaccagtggaggcggacga

SEQ ID NO: 6288 - DNA, 101 bp, rice(Oryza sativa)
  misc_feature (71): n=t or c
ctcgcgtgccgcgggatcactcgattcgatcgtcgcctgggtcgccgtctcgcttggattcttcgcgtcgngcgagaggccgggagagttcgggcgccgcg

SEQ ID NO: 6289 - DNA, 101 bp, rice(Oryza sativa)
  misc_feature (71): n=t or c
tcagtcgagtcggtcgatgtggaaggttcagggtgtgattcgactgttaaaggctcctctatcttagacanggatgcctctagtggaggttcatcgcatgg

SEQ ID NO: 6290 - DNA, 101 bp, rice(Oryza sativa)
  misc_feature (71): n=a or g
atggtctaccagccgcttcacctccatgacggcctgctccttggcgctgaccgtgccgtgcttcaccttcncgtccttggacgtgtacacgttgtagaacc

SEQ ID NO: 6291 - DNA, 101 bp, rice(Oryza sativa)
  misc_feature (71): n=t or c
ttacaatctgatcgacacatggcactttgtgttacctcaagtgtgcattggcaccgtaaaaccctgcatanaagtcgatgaatgcttaagttcagtcatga

SEQ ID NO: 6292 - DNA, 101 bp, rice(Oryza sativa)
  misc_feature (71): n=a or g
tgaactcaatccaaataaataataataaaaaagaaacccacaattccgggcagatgcctctgtgtctgcancacggtcaatccacgcgcgcccctaacccc

SEQ ID NO: 6293 - DNA, 101 bp, rice(Oryza sativa)
  misc_feature (71): n=t or c
atgcatgagacacttggtgaagaactttcagaaaaggttcagtggtgaagtgtttgagaggaatctatggnctgcctcaagagcctataggcaggacatat

SEQ ID NO: 6294 - DNA, 101 bp, rice(Oryza sativa)
  misc_feature (71): n=t or c
acagtgacagaaaaaccttggcgctgcaaatgtcgtgcagcagttaagccagctggaccagccccaacaantattatcttttttccatacccaccagattc

SEQ ID NO: 6295 - DNA, 101 bp, rice(Oryza sativa)
  misc_feature (71): n=a or g
gaaacgttgggccataatacgtcacccggcaagagtttgggaaagagaagagctagcagatataatgtatngttgtattattttgcccaacatgatagttg

SEQ ID NO: 6296 - DNA, 101 bp, rice(Oryza sativa)
  misc_feature (71): n=a or g
caacatggaggcctaccgccagtggaaattcccctccctcgcttcttttgctgtggccatcgccaccaccntgccactcgttgcgccgttgaggaagagga

SEQ ID NO: 6297 - DNA, 101 bp, rice(Oryza sativa)
  misc_feature (71): n=t or c
caagcccgaaagccttcacagtctgtctgtgcatgaccttctgccttgcaaaacttgcaaaggaacttacnagcagagttctgacctgctagaacctgagc

SEQ ID NO: 6298 - DNA, 101 bp, rice(Oryza sativa)
  misc_feature (71): n=t or g
ccgcggcaccgacgagttcgtcccaatcaagctgctctacacctccgcgatgcccatcatgctgcacgccnccgccgtctcggcgttctgcgtcgtacgtc

SEQ ID NO: 6299 - DNA, 101 bp, rice(Oryza sativa)
  misc_feature (71): n=a or g
gacgatgatggtggcgatggccattgcgaggatgacgactgtagtgatggctgcgacgacgatggcttcgngagctaggttttagggatgaattgagggct

SEQ ID NO: 6300 - DNA, 101 bp, rice(Oryza sativa)
  misc_feature (71): n=t or c
tgtaagtttatctttcagtgatttttactagcttacattagtacttccagcagagaacggcattgtagccnggtggtatgggagcttccaggtgctcttgc

SEQ ID NO: 6301 - DNA, 101 bp, rice(Oryza sativa)
  misc_feature (71): n=t or c
atatccaagatcaaaatctgaacatttagtatagtttatcttacaatgtattttgcaaccaggaggaatgncaggaaggatgctccgatcaatatcgtctg

SEQ ID NO: 6302 - DNA, 101 bp, rice(Oryza sativa)
  misc_feature (71): n=a or g
ggagagtggttcaacaacttctatgatgggttccccaagaatgcaagaatctggtttgcatatgaaggacntagtgtttttgagctaccagaagatttttg

SEQ ID NO: 6303 - DNA, 101 bp, rice(Oryza sativa)
  misc_feature (71): n=a or c
tccttttgccaaaaattctctcagacagctggtgcaagctttctgaagatatcttgtcctcttgtggcgcnatcctaccttttgcaagttggccatgttgg

SEQ ID NO: 6304 - DNA, 101 bp, rice(Oryza sativa)
  misc_feature (71): n=t or c
aacctcccatttgctcttcctctccctaaaactcttgctccatcgaagagaaacaagatcgcgccgccgcngggtgtcgaacacctggtgagcgggggctg

SEQ ID NO: 6305 - DNA, 101 bp, rice(Oryza sativa)
  misc_feature (71): n=t or c
ggaatgatagctgatataaaataaaatacagcaagcgtggaagacagcaaatatatggaacacctaccctnaaaacatggttgatttgaaatgtatgaaat

SEQ ID NO: 6306 - DNA, 101 bp, rice(Oryza sativa)
  misc_feature (71): n=a or g
aagttcaaggtcgctgaacttgagagaactatattggaggtgaagagggaccaagctatggaggcgctccnaggtcgcgaggtatggttcaactcgtacct

SEQ ID NO: 6307 - DNA, 101 bp, rice(Oryza sativa)
  misc_feature (71): n=t or c
catttgacttatcattcttagtttgatcaggtaaccatgtaatcccctgtactcaatatggcaggactganccttagccatttaagtgattgcagcacaaa

SEQ ID NO: 6308 - DNA, 101 bp, rice(Oryza sativa)
  misc_feature (71): n=t or c
ccccatcccagcgcgtcgcgccagccagtgcaaacaccggatgccacgacaagcatccggtcatctccaantatcgacatgatccgcagaagcagctcaat

SEQ ID NO: 6309 - DNA, 101 bp, rice(Oryza sativa)
  misc_feature (71): n=t or c
gcatcttcatgccttttgttcgtttccatccactcagtaaacatagtgacccctgatcttggtcgtcttangatttcctgtaggtctgttgagtcaggaaa

SEQ ID NO: 6310 - DNA, 101 bp, rice(Oryza sativa)
  misc_feature (71): n=a or g
ttaaaacatcagcaagccatcgggatttccggtctagtaatggttctgcccagggggggcaagagtaaganccattgtgctcccaagcaaggttccaagtt

SEQ ID NO: 6311 - DNA, 101 bp, rice(Oryza sativa)
  misc_feature (71): n=a or g
atccaacgccggaccatctgcttatgtagtttagcgtgggaccgaaacttgcaaccgtcaacaaacactangagagaacatttatcataaaacaatagtaa

SEQ ID NO: 6312 - DNA, 101 bp, rice(Oryza sativa)
  misc_feature (71): n=a or g
ggctcgttccagatctagaagagaagcaagcaaaatcgagacaaaattaagtgggaggaagacacagatgnatgagaaagagaaatgtggaggttcgttaa

SEQ ID NO: 6313 - DNA, 101 bp, rice(Oryza sativa)
  misc_feature (71): n=a or g
agtgatttttttttgcaggaatgggacgccgaggcagcctttggtggtgccacttgccagagcaaccgtgntgcttgatccagcccgtgtccctgcggaag

SEQ ID NO: 6314 - DNA, 101 bp, rice(Oryza sativa)
  misc_feature (71): n=a or g
gactgacatttatttccaggtgccgcaatgttcgacgtcgactacgcccggtggctggaggaagacagccngcgcatggctgaactgcacggagggctgca

SEQ ID NO: 6315 - DNA, 101 bp, rice(Oryza sativa)
  misc_feature (71): n=t or c
tccgttaaatgcaagttctttttgttgaagatcaaatgaaatcaaacatgaatactccattttttttagtnatcggacaaagcacagttacaagagtaaaa

SEQ ID NO: 6316 - DNA, 101 bp, rice(Oryza sativa)
  misc_feature (71): n=a or g
ctgtggaataaagaggatgaggaaatgaagaaggcgggggttccggtgccaatggaagaatggaacatacnatccaagcattgggtaaaagaaaggacccc

SEQ ID NO: 6317 - DNA, 101 bp, rice(Oryza sativa)
  misc_feature (71): n=t or g
gcacctgcagtgccgtcttcttcctcgacaaagacgagcaagtcttcactagcgccggtgatggccggaanatggcactgaaagaagcgctggtgccgctc

SEQ ID NO: 6318 - DNA, 101 bp, rice(Oryza sativa)
  misc_feature (71): n=t or g
ataagtatgaaaagcaaggtggtgagaaaattcacaataaaggaaaacaaccaagatgtcacaccctgaanttcttctcccaagcctaaattgaatttata

SEQ ID NO: 6319 - DNA, 101 bp, rice(Oryza sativa)
  misc_feature (71): n=t or c
gagaaggtcgggcccaccttgaacaaggatgaaaagttttgggatagactaaacaagtgtgtttggggctncgagaattcagatgattttgagtcgcaatg

SEQ ID NO: 6320 - DNA, 101 bp, rice(Oryza sativa)
  misc_feature (71): n=a or c
tcggcttcggcaccggtttaggttccggttttggctttggatatggtttaggctctggttttggttcaggntttggctcgggcttcggttcaggctctggc

SEQ ID NO: 6321 - DNA, 101 bp, rice(Oryza sativa)
  misc_feature (71): n=t or g
atggttcttcacagcgagctgagagaggtcctcaacagcatgggggaggacgtggttgggtgcctcaacanggtggccgtggtggtgggcaataccagggc

SEQ ID NO: 6322 - DNA, 101 bp, rice(Oryza sativa)
  misc_feature (71): n=a or c
cggcggtgaacatggccaagttagcatgtcaaaatgcattccaagaggaggggaacttgttgatagaggtngagtaggagtggctggtagtgttggccatg

SEQ ID NO: 6323 - DNA, 101 bp, rice(Oryza sativa)
  misc_feature (71): n=t or c
agacacttctcgtgcgtaagcttcttattaagagatttctgcaccaaccgaatatcttccgtgttcatctncgagtcgcggatggcttttgcaactctaat

SEQ ID NO: 6324 - DNA, 101 bp, rice(Oryza sativa)
  misc_feature (71): n=a or g
caagaactccggcggagacaacgagcagtctatgtacgtcatgacgtcgccggcggagagcgcggcgaagnccgcggacgccgactcgatgtcgcacgagc

SEQ ID NO: 6325 - DNA, 101 bp, rice(Oryza sativa)
  misc_feature (71): n=t or c
ttcttgccgaaggagcagggacaacaccatagctataggtccctcgtgctggcccgcctccaacgtgactnggcgtgcgccgtggcgatgtcggcccgcgc

SEQ ID NO: 6326 - DNA, 101 bp, rice(Oryza sativa)
  misc_feature (71): n=t or c
tcataagatgcattagctgcattactgttatggtcaattatctcattattattattatccacaacccctgnatttccatcattatgtttatcaacattatg

SEQ ID NO: 6327 - DNA, 101 bp, rice(Oryza sativa)
  misc_feature (71): n=a or g
gtgatcacacttaggtcagctccaatagctgaggactttgtcgcggatcatcctttccttttcctgatccnagaagacatgacaggcgtggtgctgttcgt

SEQ ID NO: 6328 - DNA, 101 bp, rice(Oryza sativa)
  misc_feature (71): n=t or c
tagggtttcagccatgtggcctggtcggggtacagtttgcgatcaggaaggatcttggtgtacagcaaccngccgaagcccacgctgcggttgccaggtgg

SEQ ID NO: 6329 - DNA, 101 bp, rice(Oryza sativa)
  misc_feature (71): n=a or g
aatggatggatctagggcgggcagatcgtcagctgacttagctttctttgttttagtttttttcttcgganccggggctgaagtatctgcagccgatgatc

SEQ ID NO: 6330 - DNA, 101 bp, rice(Oryza sativa)
  misc_feature (71): n=a or g
atacgccaagaacgcacgaaaggcctccgatggagatcaaagtgcatcgaaaaagaaggacgatgatgacnatgccccgacaggttttcaagaccatcgca

SEQ ID NO: 6331 - DNA, 101 bp, rice(Oryza sativa)
  misc_feature (71): n=a or g
tcgacccagtatgtctcgcccctccaaactgcctggttctggggggggcaaaaaggggttcgatgatgccnctgacaaggccgactgcacgaccatgtatg

SEQ ID NO: 6332 - DNA, 101 bp, rice(Oryza sativa)
  misc_feature (71): n=t or c
gcagccgcacccttccccttcgttttgaccataggcgaagcaaccggttgacgtggagggctgtcgaagancctcgccgcagccgtcacgatccgttctgc

SEQ ID NO: 6333 - DNA, 101 bp, rice(Oryza sativa)
  misc_feature (71): n=a or c
ggtaagaagggggcggggttttactcatcgttactcatttgcaagacaataccgctcaccttctcctgatnattcattccgttatggtggaagaggtgatc

SEQ ID NO: 6334 - DNA, 101 bp, rice(Oryza sativa)
  misc_feature (71): n=a or g
ccggaaccgcaccttgcccttgatgtgcacgtccaccggcagcttcccgtcggacctgtccttcttcacgntcgcctccacgccccgcggcagcgccgccc

SEQ ID NO: 6335 - DNA, 101 bp, rice(Oryza sativa)
  misc_feature (71): n=a or g
accgccccagccgcagagcttgttcgtgcgctccgcgttgctctactacccgcacacgccctccatattcntggccgacttgcccctgccatgtgggcttc

SEQ ID NO: 6336 - DNA, 101 bp, rice(Oryza sativa)
  misc_feature (71): n=t or c
caaattcaggagatgtcaggtcggtaaatgtgcttattactgttggtagaggatggggatgatgccggcgntgtagatgccaatgttctcccaggcaggtt

SEQ ID NO: 6337 - DNA, 101 bp, rice(Oryza sativa)
  misc_feature (71): n=a or g
caaatatatatttgagtccaccatattgaatctctcgttgagacagtcgaaacggatatatggttcgcccnatttagtgtcggaagcactccgaacccatt

SEQ ID NO: 6338 - DNA, 101 bp, rice(Oryza sativa)
  misc_feature (71): n=a or c
aaagaaaatacagtgcatctctgaacatgcacccaaaagaaaatctacaagctaagcaatcatggcacatntgattgatcagagtatattatgaagcttta

SEQ ID NO: 6339 - DNA, 101 bp, rice(Oryza sativa)
  misc_feature (71): n=a or g
catactaactgttacttttgttgcaaggtaccatacacctgtggcttccaatcaaggtgggacaggattcntgggaagctgttcgctgcatgataatagct

SEQ ID NO: 6340 - DNA, 101 bp, rice(Oryza sativa)
  misc_feature (71): n=a or g
cgagctagagtaagcactgtaaattggccccaggatgaggggcagatgtctgttgtccgcaggctttcccncggatatagtggaaaccttcaacagcaact

SEQ ID NO: 6341 - DNA, 101 bp, rice(Oryza sativa)
  misc_feature (71): n=t or c
gccgggttccagctctgtgccgccatccccactgagatgtagcaattgctcgcctgatgctggctcctcgncgccagccccaccggaatgcggcaacttct

SEQ ID NO: 6342 - DNA, 101 bp, rice(Oryza sativa)
  misc_feature (71): n=a or g
ccgccgcagccggtggcggaggtgcaagtgtgcagcgaggaggttctggtgattgccgtgccagtgccgancgaggagagggcgattgtgctgcacaagcc

SEQ ID NO: 6343 - DNA, 101 bp, rice(Oryza sativa)
  misc_feature (71): n=a or c
actatcacaccgaaaactatataatcgatagtaactggcttggcctgttgattcttcatgtgatcgggatnttttctcttggagaaaatggcatatctatt

SEQ ID NO: 6344 - DNA, 101 bp, rice(Oryza sativa)
  misc_feature (71): n=t or c
tttctttttttggcttttttgatggaatatgagcgatatcaacccaatgtaggaccacataacaatttacntgaaaaaataaataacaaagttacccctaa

SEQ ID NO: 6345 - DNA, 101 bp, rice(Oryza sativa)
  misc_feature (71): n=t or c
attattcccctctcgcgcgcctataaaatccgcctccatctctgcttctcctcccactcctcttcctcctnctcctcctcctcctgcgatcccggcgcagc

SEQ ID NO: 6346 - DNA, 101 bp, rice(Oryza sativa)
  misc_feature (71): n=t or c
ttgcatgtctttggccaaacgattcagtggaggtccagggttgtaatttacaaaagaacaaacctaccagnaagtaaacatttagagaaaaaggattacac

SEQ ID NO: 6347 - DNA, 101 bp, rice(Oryza sativa)
  misc_feature (71): n=t or c
ggtcaatcgtctcgtgtcagggttgtggatatataatgcatacctcttatccttggggtcgtgagatatanggatacagtataccctcaagtatatgggaa

SEQ ID NO: 6348 - DNA, 101 bp, rice(Oryza sativa)
  misc_feature (71): n=a or g
tggagagttccaacttccaagtaggggcatgtttaggcccctttgaatcatataggaataaaaaaacaaangattaggaaaaatataggattctgacataa

SEQ ID NO: 6349 - DNA, 101 bp, rice(Oryza sativa)
  misc_feature (71): n=a or g
cggctccggcggcctcgccgtggatgctggcgccggacatgtgctgttgggtactgatggtacagacgacnttgctgacgtcggcaataagcagcagctat

SEQ ID NO: 6350 - DNA, 101 bp, rice(Oryza sativa)
  misc_feature (71): n=a or g
agaacaatatccatgcataatactattatatgtgaagcaattgggcataaccatcactgtaagtacctccntggccctgtccatagcttgagccttgctta

SEQ ID NO: 6351 - DNA, 101 bp, rice(Oryza sativa)
  misc_feature (71): n=t or c
agcaatctcaatagaacaacgagctttaccttggtgaagctctccgtgcccggcttcagatgactcctcgnggtgctgcttcttctttttcttcttcttga

SEQ ID NO: 6352 - DNA, 101 bp, rice(Oryza sativa)
  misc_feature (71): n=a or g
aaacaccacattgaagccaggcgatggtcgaagtctaaaaaacaaaaagcaaaagaactatgagcaacatngaaatgaagtaataaaacaatcggttcgag

SEQ ID NO: 6353 - DNA, 101 bp, rice(Oryza sativa)
  misc_feature (71): n=t or c
taggagtcccagccgctgctggtgtaaaccgtctggatcgggagcacgccgaactccggtgtgacggacangttcagcttctccttctgggcgcaggtgcg

SEQ ID NO: 6354 - DNA, 101 bp, rice(Oryza sativa)
  misc_feature (71): n=a or g
gggatttgtgccgaccgaacaccacggtggtcccaacaatgatggatcggtggcatgatggcggaggtggnggatcggcgaggatggggcagaggatgtgt

SEQ ID NO: 6355 - DNA, 101 bp, rice(Oryza sativa)
  misc_feature (71): n=t or c
ttctgggtgtatttctcaagaactaggtaacttggtaaatttagagaacttataccttagtgaaaacatgntcacaggttccatcccgaacagcttaggga

SEQ ID NO: 6356 - DNA, 101 bp, rice(Oryza sativa)
  misc_feature (71): n=a or g
tatacttcctagtttaaagcaagatgcagcaaacctgggttgcggacggtgccgtggaagaagtagccgcnggagaggaggagattgacgagccacgagcc

SEQ ID NO: 6357 - DNA, 101 bp, rice(Oryza sativa)
  misc_feature (71): n=a or g
gtgagtaaagtccataatggtattgttctgacacaagataaatatgccaccgatttattaaagaaagttgnaatgatgaactgtaaaccaatcacaactcc

SEQ ID NO: 6358 - DNA, 101 bp, rice(Oryza sativa)
  misc_feature (71): n=a or c
caccgctattgttgctgtgtgttctttctttctttccggcttgctgggggagcagaagatggagagggagnggatggagaagcgcaagaagaagctcgaga

SEQ ID NO: 6359 - DNA, 101 bp, rice(Oryza sativa)
  misc_feature (71): n=a or c
gccgctgctcctcgccgctgaagacggaggctcgccggagttcaccgccaaccacccctcgtccgctatcnaccgtaggcaaccgcccgaccctgagtcac

SEQ ID NO: 6360 - DNA, 101 bp, rice(Oryza sativa)
  misc_feature (71): n=a or c
gctagcatacatggacatagactcttcatggaggctgccttggttgaaactgagctcttctaaaataagcntatttcctgcactggtatccgaacattcag

SEQ ID NO: 6361 - DNA, 101 bp, rice(Oryza sativa)
  misc_feature (71): n=t or c
gccttcagcgcgccgtcggcgaacctgccgccgacgtagacgatcggcttgttctggacgcgtttgtaccncctggaagcctcgccgtagatcaccagccc

SEQ ID NO: 6362 - DNA, 101 bp, rice(Oryza sativa)
  misc_feature (71): n=t or g
agtgagggcaccatcgccgatgagcatgcaggttccgatcagcacgatgatggtgatcgccagttgcgccnttgggctgttctccaagaacagctgcagcc

SEQ ID NO: 6363 - DNA, 101 bp, rice(Oryza sativa)
  misc_feature (71): n=t or c
ggtgctatcctggataatattatcactagtagtgttcagttttcagaagacgaaatccgcaaagcttccgnttataattcgagcatggtggatatttagct

SEQ ID NO: 6364 - DNA, 101 bp, rice(Oryza sativa)
  misc_feature (71): n=t or c
aaagagatgcttgatgatcttcagagaggaattttagacagtgataggataaattatagggtgatttctcngctgccaaaaattaaggatgctaatacaat

SEQ ID NO: 6365 - DNA, 101 bp, rice(Oryza sativa)
  misc_feature (71): n=t or c
cagcgcaaagtccacccccgtagtatatttgcaggagctttcgctgctgtgctcatatcaaaatctccccnacgggccacacgcggcgacaccggcacacc

SEQ ID NO: 6366 - DNA, 101 bp, rice(Oryza sativa)
  misc_feature (71): n=t or c
gttctgagacaggttgaggtaccggagagaaacgcagcggtacacgctcgtcgggaacgtaccgttgatgntgttgttgtagaggtcgaggtgcacgaggc

SEQ ID NO: 6367 - DNA, 101 bp, rice(Oryza sativa)
  misc_feature (71): n=a or g
accaatggtaccacctctttgttggtggtgcatggatcagtagtttgaacgcctgagtcctttcctccagntttctcaagcttttcactgtctttcttatt

SEQ ID NO: 6368 - DNA, 101 bp, rice(Oryza sativa)
  misc_feature (71): n=a or g
gccaccgtcactgccggcgatgttcaacgcctccaccctatcccacatcaccctacacccctgccatgctncctcagccgccgtcgtgtggccgccggtga

SEQ ID NO: 6369 - DNA, 101 bp, rice(Oryza sativa)
  misc_feature (71): n=a or c
tcacagtaccaatcaacatctttagatggtccaaacccagcaacaggcagcaacaacatctactcttgtgncaggatcaacaagatgcaaatacaaacgag

SEQ ID NO: 6370 - DNA, 101 bp, rice(Oryza sativa)
  misc_feature (71): n=a or g
cttccgcagccaccggccgtagctagcgtcggtgagcccacttgcatcagctggttggactcgaagccganccgatcggtggtgtacatatgcttcggcac

SEQ ID NO: 6371 - DNA, 101 bp, rice(Oryza sativa)
  misc_feature (71): n=a or g
tgcagacggctagatccagttttcgcatgtggttgacctgcccgtgtacgagaaaaggtctgaaaaaatcnctattttcatatacgggtgcttatgtgagc

SEQ ID NO: 6372 - DNA, 101 bp, rice(Oryza sativa)
  misc_feature (71): n=a or g
caaaatgagcaaatgttcctttgcccagcagcacttggagtatttggggcacattattggcatacaaggantgccggagtggctacagacccagccaaggt

SEQ ID NO: 6373 - DNA, 101 bp, rice(Oryza sativa)
  misc_feature (71): n=a or g
aattagtctgacctacacgggtaggatgtggatgatgctcctgatgcatgggcctgatgattgtagcatgnaggaatggactaccaaacgatgctcctgtg

SEQ ID NO: 6374 - DNA, 101 bp, rice(Oryza sativa)
  misc_feature (71): n=t or c
tgcaatgacatgagcagatacgcgaagtcgtagagtttggttgcagcaaggacccatgagggtgtaggttntgtacagtctagtcccttcttctggtactt

SEQ ID NO: 6375 - DNA, 101 bp, rice(Oryza sativa)
  misc_feature (71): n=a or g
actagcaatggtgccagcaactcccagaaaagtgttgaggataaggacctgatcgactgtctagagaatancgtcaacttttggacggattattcaaaagt

SEQ ID NO: 6376 - DNA, 101 bp, rice(Oryza sativa)
  misc_feature (71): n=a or g
tcctcctctcctctaccacagccgcaatcggttctattggcccacgacgcctcctcctctccactaatgcngctgcagtcgccgacggtcctctttgccca

SEQ ID NO: 6377 - DNA, 101 bp, rice(Oryza sativa)
  misc_feature (71): n=a or g
ttcttctagaactccatgcaagaaggcattttgaacatctaactgacgaagactctaacctttagaagctnctaaggatagaacagttcttatggttgcag

SEQ ID NO: 6378 - DNA, 101 bp, rice(Oryza sativa)
  misc_feature (71): n=t or c
ttcctgttgatctagcttcatcatgcattagtaggagtctaggagaagctcttctgctcaccatgtctctngctaagattgtatcatcatcaaagctggct

SEQ ID NO: 6379 - DNA, 101 bp, rice(Oryza sativa)
  misc_feature (71): n=a or c
tatataatatacaaaatcacggtttcatcggtactcctctttcacacattgaaagaaacatggatgccccnatgaagttgacaatattccgtcttgcagtc

SEQ ID NO: 6380 - DNA, 101 bp, rice(Oryza sativa)
  misc_feature (71): n=t or c
aaattatcgtcattgaattgtgcatctgcttcatctagagcttcaaacttgtacaacaaattttcttcttnggcttgcacatgtcctgcgctttgtgcatc

SEQ ID NO: 6381 - DNA, 101 bp, rice(Oryza sativa)
  misc_feature (71): n=a or g
ggatagcctgtatccccagcgcgccccgaatgtcctggatccatcttttgctggcaaggccttcggccagngttcgctgccgtcggatttgagcagggacg

SEQ ID NO: 6382 - DNA, 101 bp, rice(Oryza sativa)
  misc_feature (71): n=t or c
tctgttgatgagtagaacaatgggtgtcgagacaggttgagacgacgcagtgagtagacacccttctcacngttctccattagtagattcacaaatcgatg

SEQ ID NO: 6383 - DNA, 101 bp, rice(Oryza sativa)
  misc_feature (71): n=t or c
attgaaagtttggactggtgcaagttagtttttgactggttgatggatcacattagcaagcttgagaaatngaaaacttttggtggttgtttattacattt

SEQ ID NO: 6384 - DNA, 101 bp, rice(Oryza sativa)
  misc_feature (71): n=a or c
acttgtcggcgatttggaattgcaccacaaagttgctgtcccgatgttcttcctggcgatggactcgcctnaaaattttgactctgatgctctggctggaa

SEQ ID NO: 6385 - DNA, 101 bp, rice(Oryza sativa)
  misc_feature (71): n=a or c
catactggtttgcacttttccaatcatctaaagaaggggactgtttgcaaataagaagggctgatgtcaanatagtgcctgttttgctcttctcatcccaa

SEQ ID NO: 6386 - DNA, 101 bp, rice(Oryza sativa)
  misc_feature (71): n=t or c
tcttctagccggttcataagtaacaagtggaaaacaaccaatcctaccatcaaaaatacaattctcatccntaaaccttggccgagcacaaacacacaaga

SEQ ID NO: 6387 - DNA, 101 bp, rice(Oryza sativa)
  misc_feature (71): n=a or g
cctatgctgccatctcgccgtggctgccgcagcagcagcgacatggataggacatgacgatcagcaagacnacgacgtgtccacctacatcgtgcacgtca

SEQ ID NO: 6388 - DNA, 101 bp, rice(Oryza sativa)
  misc_feature (71): n=a or g
ttgaaaagggagtacaaaaaggtggaacgtgaagtctgctccacttcgcaagcgactacctccaagatgangtggtcccagcacaagattgagggcctgtt

SEQ ID NO: 6389 - DNA, 101 bp, rice(Oryza sativa)
  misc_feature (71): n=t or c
gagtggcagtagtataccatgtatggaaataagtattcgtggcatgataccgagctggtaatcttgccacnatttattcccttgaccttacctacatatat

SEQ ID NO: 6390 - DNA, 101 bp, rice(Oryza sativa)
  misc_feature (71): n=t or c
acgatgaatacgcacccgctcgcttcttcttcttctgacgacgaacacctgatcgaatactgcttttgttngattttggagatcgatcttcttgagacgag

SEQ ID NO: 6391 - DNA, 101 bp, rice(Oryza sativa)
  misc_feature (71): n=a or g
aaatgaatttcgtccatcactaactctaggttgtgtctacatgtttgttgatgtcaatactgttgacattnaaaacaaaaaatatatttaccaccaccaaa

SEQ ID NO: 6392 - DNA, 101 bp, rice(Oryza sativa)
  misc_feature (71): n=a or g
gagtttgtgcccaagactgagttccaggaatgtgggggagtggaggagaagggtgataggattcaagactntggaaaagtggaggagaagggtggtgggat

SEQ ID NO: 6393 - DNA, 101 bp, rice(Oryza sativa)
  misc_feature (71): n=a or g
caccactgaatcttcctattctcgttgtcctcttggctataatcttggttcaccaggcccaacatttgatnaacaggaactcttgtctgccttagccgatt

SEQ ID NO: 6394 - DNA, 101 bp, rice(Oryza sativa)
  misc_feature (71): n=a or g
ttttataatgttgatgacatgccatttgaggaggctgtgggccggcttaaggcttacgaggagcgggtgcntaagaagaaggcagcagccggcggagtcac

SEQ ID NO: 6395 - DNA, 101 bp, rice(Oryza sativa)
  misc_feature (71): n=a or g
cttacccgacatgggcaccgaggagacgagtagtgggagaaggagtaggctggacatagccaagacggcgncgagatcacgagacctcatttccattacgc

SEQ ID NO: 6396 - DNA, 101 bp, rice(Oryza sativa)
  misc_feature (71): n=a or g
tagccatatctgtgccacgagtttttttttttttttgaagcagtgccacgaggttcagttgctccgtgganttctccaccagagcaaaatttgtgtcacat

SEQ ID NO: 6397 - DNA, 101 bp, rice(Oryza sativa)
  misc_feature (71): n=a or g
ccatgcaaatgcaatgcacgtttattgggccgaaacgggattcgacttaacgttttgtgccgggacgcccntattaatcacttgggccgaaaacggggtgt

SEQ ID NO: 6398 - DNA, 101 bp, rice(Oryza sativa)
  misc_feature (71): n=a or g
tatgatatacttatttctcttattcgctccatctttaatcttatcttactataactactagcaatttaatnttcactaacttctaaaactcaacgtataag

SEQ ID NO: 6399 - DNA, 101 bp, rice(Oryza sativa)
  misc_feature (71): n=t or g
ggcctgaagccccctcctgctgctgcattggcaccacctctcttcccccatttcagtatcgtgtttttttntatggcgtttcgtcgtgggtttgcataaga

SEQ ID NO: 6400 - DNA, 101 bp, rice(Oryza sativa)
  misc_feature (71): n=t or c
tgaatttaagatcaaatttcatgtaaatcaaaagttggtacttttctacagaaaataaattagagttaccnggagttgatcaccgaagagtttaacttgag

SEQ ID NO: 6401 - DNA, 101 bp, rice(Oryza sativa)
  misc_feature (71): n=t or c
ggtagagacatctaagcatttaaaccctttgtgaagattactaaagccaaggaacacacattgcttagacngaaactggagtttatgggaattgtaggggc

SEQ ID NO: 6402 - DNA, 101 bp, rice(Oryza sativa)
  misc_feature (71): n=t or c
ggtgctaacttcgacgtggattgctcaaggattggttccggcagaggcggctactactcgaagggcggcgntgtgcgcgatggcgaccagttggagtgccg

SEQ ID NO: 6403 - DNA, 101 bp, rice(Oryza sativa)
  misc_feature (71): n=a or c
ttgcaatcttgacccctttttcccctttctattgtagcacctttcccatcaggttgcaatccctgatttgngctaccaaaaccagttctttctgggcccca

SEQ ID NO: 6404 - DNA, 101 bp, rice(Oryza sativa)
  misc_feature (71): n=t or g
cctcctcgagcttcctcccggccctccttactccctctttgagttcccttgctaaccggccaccgccgccnaacccatcctcagcgcctagcgtgccatgg

SEQ ID NO: 6405 - DNA, 101 bp, rice(Oryza sativa)
  misc_feature (71): n=t or c
gtgaacttatgttgtgtgtattggtgcagcctcgtctatttgttggtaggggaatgcatgaaagtgccttntcacttttcatgtaagaacttgacattact

SEQ ID NO: 6406 - DNA, 101 bp, rice(Oryza sativa)
  misc_feature (71): n=a or g
tatagcgaatactagattgagctggattttttaaaaaaaagtgcaaattgattgcataccaatcccttgtngaatgcaatctgtggcacagaaaactttga

SEQ ID NO: 6407 - DNA, 101 bp, rice(Oryza sativa)
  misc_feature (71): n=t or c
agcatccaaactgaaatgcaattgccatcaccactatgtgaccaggtaaacagggccaaatgcctcccttntcatcactccatagttcacctggtcaagct

SEQ ID NO: 6408 - DNA, 101 bp, rice(Oryza sativa)
  misc_feature (71): n=t or g
ggcggaggattcgaagctcaaggcggatgattcgattcccatgtccaagcccgaggagcccaagcctgagnctgccgcgccgatggaggactcgatggagg

SEQ ID NO: 6409 - DNA, 101 bp, rice(Oryza sativa)
  misc_feature (71): n=t or c
atgcacgcgttcctcctcaggatgtcggattcggaggaggggaacgctgaccctcaggacaaggcctggangagggaggtgcgggagctctcctacgacat

SEQ ID NO: 6410 - DNA, 101 bp, rice(Oryza sativa)
  misc_feature (71): n=t or g
gacagcttatagaatttctgagaaagaataaagatcattaccccagatgtatgtccatttatccaccatgnagttcaaagagatttgggtaacatcctcca

SEQ ID NO: 6411 - DNA, 101 bp, rice(Oryza sativa)
  misc_feature (71): n=t or c
tactgaatacacaataacacaaccatgaaaatgtgggcagattcctgatacaaattttgacaatttgactntttgcaaaaactatttttacaaatgaaccg

SEQ ID NO: 6412 - DNA, 101 bp, rice(Oryza sativa)
  misc_feature (71): n=t or g
cgtgaatgagcagtcctaccacccggcaaaagcaaagaggcaactccagatgatgcaacagcaagaacaanctttttttcagacctaaggtaggtaacaat

SEQ ID NO: 6413 - DNA, 101 bp, rice(Oryza sativa)
  misc_feature (71): n=t or c
taaataatacattatgtatgacttatcttcctgaacagagaacagtgaaggcggattagtgaggacgacgntttgtcaagtaggtgctacaaggtaatcaa

SEQ ID NO: 6414 - DNA, 101 bp, rice(Oryza sativa)
  misc_feature (71): n=t or c
acaataagtatgttacaaaagggaagcaggggggattagtagtttggattttggactttgggactacgganaagctgcaggtgccactaaattcaggaaac

SEQ ID NO: 6415 - DNA, 101 bp, rice(Oryza sativa)
  misc_feature (71): n=t or c
gccataaatacgccgaaaaagagaggcgtgtagtcgtcctcatagccatcgtcgaagccgttgaagttgcngtagtcgtagtggtagccgaagtcgtcgta

SEQ ID NO: 6416 - DNA, 101 bp, rice(Oryza sativa)
  misc_feature (71): n=a or g
ttaggaatttttgacaataacctaagtggcgaaattcaagaagaatactaatgaggcgcctacaaatcggncgttgttctaccaagtagatcgaaaatgtt

SEQ ID NO: 6417 - DNA, 101 bp, rice(Oryza sativa)
  misc_feature (71): n=t or c
cgacgagaacacgtacaccaacacagtcgtctgcatgagcgcgcacccccgtcgacgccatcaccggcttnggctccggcaggaggccgcacagcaggatc

SEQ ID NO: 6418 - DNA, 101 bp, rice(Oryza sativa)
  misc_feature (71): n=t or g
catgtattgatgatagagacatgcatcgatctcatttggtatgatccatggacataaatatatatgcagantttggtgctcgacttcgtgaacaacgggct

SEQ ID NO: 6419 - DNA, 101 bp, rice(Oryza sativa)
  misc_feature (71): n=t or c
tgcataagttcctcaaatctagaatggtactcctccacacttcccatctgcactagcccatctaactcctncaaatgctcctgatacttatcccttccaaa

SEQ ID NO: 6420 - DNA, 101 bp, rice(Oryza sativa)
  misc_feature (71): n=a or g
ccctgcgaggctgcgaccccccatctggccgtctgtcctatgcctcgccacaccaacaggaagcaaggccnccgctcccgtgctgcttccactcaccgcta

SEQ ID NO: 6421 - DNA, 101 bp, rice(Oryza sativa)
  misc_feature (71): n=t or c
gcagcttcgcagctagcgtcgtcttcatcgccattcgcgcatcaacaacctcgccgtccgcactggttatngtcagccattcagggtcttcttcctctact

SEQ ID NO: 6422 - DNA, 101 bp, rice(Oryza sativa)
  misc_feature (71): n=a or g
cgccccgtcgagccactccagcagcgacattacagggacggtggcctcctcctctactccgtccggcgtcntcatcagggcagcgaggcggtcgcggtacc

SEQ ID NO: 6423 - DNA, 101 bp, rice(Oryza sativa)
  misc_feature (71): n=a or g
acagacagctgtgttatccctcataatcttgttattatctttagatcttgttgatgaggatttcatcacancagaatctgacaagtaagctgttgttcctt

SEQ ID NO: 6424 - DNA, 101 bp, rice(Oryza sativa)
  misc_feature (71): n=a or c
tgctaactcggcaatctcttcaagaaaccccatattctcattattcttgatttgatcatccaatagatcantgagcttattctccttcattgcagagagaa

SEQ ID NO: 6425 - DNA, 101 bp, rice(Oryza sativa)
  misc_feature (71): n=a or c
caatgatagcttctttctcgttaatttgattgatgatttccactatattaggcctattttccctatcagtntccatgcatttcagcgctatctcggtgcat

SEQ ID NO: 6426 - DNA, 101 bp, rice(Oryza sativa)
  misc_feature (71): n=a or g
ttataagacttgggaatgatcggctataagataaaatcacgaaagggattaacaagaaatacttacccttnagaagtgagctggagcagaaggagttggag

SEQ ID NO: 6427 - DNA, 101 bp, rice(Oryza sativa)
  misc_feature (71): n=a or g
gagggcgctgctcttcgccgtgtcgctgtccgcgctcgtggtgcttgtcaccgccaagcagacggtgatgntcccgttcgtcatccggccgccgcagttca

SEQ ID NO: 6428 - DNA, 101 bp, rice(Oryza sativa)
  misc_feature (71): n=t or c
tcgaaagccaagtcagcctcatgcacgatctgagggaggtggtggcggaagggggcaacaaggatggcaanggcagccatctggcgccgctcccacctact

SEQ ID NO: 6429 - DNA, 101 bp, rice(Oryza sativa)
  misc_feature (71): n=t or c
aaatggccgacaatgaggtcctaccggactgaggactggctgcgcaaggaggttgctgcggtgatgcagantgtggtggggagcaaggggaaaaacgacga

SEQ ID NO: 6430 - DNA, 101 bp, rice(Oryza sativa)
  misc_feature (71): n=a or g
cttgtgaacttaacgctttgttcttctgaatccaggaaaactgcaaatctgtgctacagaatctgaaacanttgcaggctaatcctccctcccttcatatc

SEQ ID NO: 6431 - DNA, 101 bp, rice(Oryza sativa)
  misc_feature (71): n=a or c
tacagcagagggcgctagctgctttgtgcaacagtcgtacgcacgcctagctagcagcagcagaaggcagngaaagctggaggaagcaagtggtgtggtgg

SEQ ID NO: 6432 - DNA, 101 bp, rice(Oryza sativa)
  misc_feature (71): n=t or c
catcgacctctgcacggacccgcgcacgatgttctcgaggttcgggcagatgctggcgtagtagttctgcntcagctgcgccaccgccaatggcgacgaga

SEQ ID NO: 6433 - DNA, 101 bp, rice(Oryza sativa)
  misc_feature (71): n=t or c
tttgtggtgctggacatggacacgggaaagaaaacgccactcatgttggggcttctattccttagcaccgnagaagccaacattgacgtgggaacgggaag

SEQ ID NO: 6434 - DNA, 101 bp, rice(Oryza sativa)
  misc_feature (71): n=t or g
gctctctgaaacctgtgaatgatatgatgatgcaggttcacccgcagacgccatcaaccggggcagcgagntggtggccgccggcatggcggtgaacgact

SEQ ID NO: 6435 - DNA, 101 bp, rice(Oryza sativa)
  misc_feature (71): n=a or g
gccctgcaggccatcgtcctcctcggcttccttcagctccttcttcgctacctgctcctcctctgacgccntcgacgaaccctccgcggcgtgcttgggaa

SEQ ID NO: 6436 - DNA, 101 bp, rice(Oryza sativa)
  misc_feature (71): n=t or c
caatggattcgcagctgcgaggagaacactgtccaccatctcgtcttcgccaaagattgctggaacgccgntgtcatcgttgaccagtacctcaccgccgt

SEQ ID NO: 6437 - DNA, 101 bp, rice(Oryza sativa)
  misc_feature (71): n=t or c
cgagccggctcttcttgaccacccacagtgccagcctcatcttaatccatccatccacctctgacctcccnccctctctctcgctcgctcgcccctcctct

SEQ ID NO: 6438 - DNA, 101 bp, rice(Oryza sativa)
  misc_feature (71): n=a or g
ggtggcggcggcgactggttgtatgatggaggtactgttggcgggctatatggaggtggtgaggctgtagntggagtgcttgatggaggtggtgacgtgat

SEQ ID NO: 6439 - DNA, 101 bp, rice(Oryza sativa)
  misc_feature (71): n=a or c
ggctgaaacttggccggccattgaaccagctggaggctcggagaaagggttaggcagcccgagccacacantgcttcagtggaagggagcattggggttgc

SEQ ID NO: 6440 - DNA, 101 bp, rice(Oryza sativa)
  misc_feature (71): n=a or g
tttgccgttgcggaagccagtggtgttggcgcggatgtcggtgtcgtaggagagcctgtttgagctgggcngcggcacgctcttggcgtagtaggtggtgt

SEQ ID NO: 6441 - DNA, 101 bp, rice(Oryza sativa)
  misc_feature (71): n=t or c
atgccttgcatgggcaggcactgctctgctctactgggctcacccgggtggccctgcatggggcaagtacnggagggcgagggggcagagcccgaggtgtt

SEQ ID NO: 6442 - DNA, 101 bp, rice(Oryza sativa)
  misc_feature (71): n=a or c
ggcggaggcgatcgaccatgtagttgacgaggttggcgctcatgccgtagtaggccaggcgctcgcagcantcgttccccaggatgaacgggcacgccctc

SEQ ID NO: 6443 - DNA, 101 bp, rice(Oryza sativa)
  misc_feature (71): n=t or c
atagggaacgaagtctaccacgacggccatttccaattcatggatgagaagaccttctcagccaggggagngaaggaacgcgccaactgatcgactttgct

SEQ ID NO: 6444 - DNA, 101 bp, rice(Oryza sativa)
  misc_feature (71): n=a or g
caagaacagccgacagcgagagcactgcactgcacataccaggatgtagaggagggaggcgcagatgatgntgcggtagcggccgagccaggagtcggcga

SEQ ID NO: 6445 - DNA, 101 bp, rice(Oryza sativa)
  misc_feature (71): n=a or g
ccacatatcgtacgaacagcaatacccacaagcagcgtatgcccactcacacatgcaataagtagtgacanaatactcttcgaatattaagttatatgtta

SEQ ID NO: 6446 - DNA, 101 bp, rice(Oryza sativa)
  misc_feature (71): n=t or c
gtatcttcgacttgttcaacatcggaaacctcggccgccatatttgttttccaacacagtaatataccggntaacttgtacctaaaaagttcaatatcttt

SEQ ID NO: 6447 - DNA, 101 bp, rice(Oryza sativa)
  misc_feature (71): n=t or c
gaggcggctatggctaggtcgacattaaccctagatgagggttggaaggcatcccgaactgccttggtgangacagatgtggtggcctcaattgcgggaga

SEQ ID NO: 6448 - DNA, 101 bp, rice(Oryza sativa)
  misc_feature (71): n=t or c
acagcaatttcaagaaggtagtggttaccgagggatactttcaccttggtcagagtttcccgttggttatngaggatataaaagcgaggattgaaacttgc

SEQ ID NO: 6449 - DNA, 101 bp, rice(Oryza sativa)
  misc_feature (71): n=t or c
gaacctgcgctagacccagccgacgaactagcccctcctacagagaccgagccagacctcgatccagaggnggacccaaccccagccgccgagccagaccc

SEQ ID NO: 6450 - DNA, 101 bp, rice(Oryza sativa)
  misc_feature (71): n=t or g
gcaggcgttcggcgcgaagaagtaccacatgatgggggtgtacatgcagcgttcgtggatcgtgctgctgncgtgcgcggtgctgctgctgcccatgtaca

SEQ ID NO: 6451 - DNA, 101 bp, rice(Oryza sativa)
  misc_feature (71): n=a or g
gggatcctcatctacatggccctcgtcgacctcctcgccgaggacttcatgaaccccagggtgcagagcanaggcaagctccagctcggcatcaacctcgc

SEQ ID NO: 6452 - DNA, 101 bp, rice(Oryza sativa)
  misc_feature (71): n=t or g
tgggccgtgccagcgccgaccttcaccacactgcttctgttgcctcgtgccctcgccggagaagacagtgngtggacgcgtcggcgcatcgggcggcgttt

SEQ ID NO: 6453 - DNA, 101 bp, rice(Oryza sativa)
  misc_feature (71): n=t or c
cacatcatgaaagagagcggttcaatggtatggatgagcaagaccagatgggacatatgtatgatggctangagagaaaacggcgtagatcatctgagagg

SEQ ID NO: 6454 - DNA, 101 bp, rice(Oryza sativa)
  misc_feature (71): n=a or g
cacaaacttaggagttaggacattgtttgacatttcgtctcatgcagtggagagaacattaatcattcagnctcaaataattcagtgtatgcgtattggtg

SEQ ID NO: 6455 - DNA, 101 bp, rice(Oryza sativa)
  misc_feature (71): n=a or g
ctgcatcgtgcaaagtacatgattcatacgcaaattgttcggtccatgattttccatgacgaactaaaggnagcaatagagaaagagaaagaaaaggaagg

SEQ ID NO: 6456 - DNA, 101 bp, rice(Oryza sativa)
  misc_feature (71): n=a or g
acccagctgcggattggatcggattggtggggggtaggatcgatcttggggttgaaagggcgtgccgaaancggcggagtggagaggaaagattggatttt

SEQ ID NO: 6457 - DNA, 101 bp, rice(Oryza sativa)
  misc_feature (71): n=t or c
tctgccaccaccactgccacacagcgagctaacaatgggtactggtgggatgtatggcgagccgttgctgnccccctcttcccggagaggaactggcagac

SEQ ID NO: 6458 - DNA, 101 bp, rice(Oryza sativa)
  misc_feature (71): n=a or g
cttgcgtctgccatccctttgttgcgagtctgtcggatgtccagaccctgttttcgatcactagccaagtnaagatcttgcactttcatggcgctcagggt

SEQ ID NO: 6459 - DNA, 101 bp, rice(Oryza sativa)
  misc_feature (71): n=t or c
atatttttttcaataatttgcatttatatatctcggagaaatttttttgcagaaatataccttccccgcangttggatatgcgggaacaagatggtaacgc

SEQ ID NO: 6460 - DNA, 101 bp, rice(Oryza sativa)
  misc_feature (71): n=t or c
gacagcattgctgccgcatcacctggcagctgctcagttgtagcctgcgtgactgctcccaaggtaggctnatcgggctgcactgttgcctcacgaactca

SEQ ID NO: 6461 - DNA, 101 bp, rice(Oryza sativa)
  misc_feature (71): n=a or g
agcgaggtataggagaagatgcagaaagaaatcgagcattagagctagcactacttgagaaaccatctttntctggtcggccaaaaaccacaataatcccg

SEQ ID NO: 6462 - DNA, 101 bp, rice(Oryza sativa)
  misc_feature (71): n=t or g
atgaacctcgcaatgagccgcatcacattctcatacgaggagcctcctttcgccatggcccttcgagcttnctcaccgtactccttggccttcctcctcct

SEQ ID NO: 6463 - DNA, 101 bp, rice(Oryza sativa)
  misc_feature (71): n=a or g
tgtggctaacatatggaatgctgaagaattccaggctaccaccggaggttgcaagggtgccatggaggaanccaaggtggtagacagtggaagcggaagcg

SEQ ID NO: 6464 - DNA, 101 bp, rice(Oryza sativa)
  misc_feature (71): n=t or g
ttgcaatgtggactatggaattggggttgagatgatgtaaactaatcccataaaactcaaggatccccctnaagaatttcgaagttggaagagagaaacca

SEQ ID NO: 6465 - DNA, 101 bp, rice(Oryza sativa)
  misc_feature (71): n=a or g
agggagtaatgcaccggcgcgtagctcggtgataggacagctacttagagtaagatggtatttagatccanaaacttattataggtgggttttattaatag

SEQ ID NO: 6466 - DNA, 101 bp, rice(Oryza sativa)
  misc_feature (71): n=t or g
cataactcataaccagctatttgctggttgtaatttggtgttttctaaccaagttccagtacagctggganttcaccataggagctggtttaaactagccc

SEQ ID NO: 6467 - DNA, 101 bp, rice(Oryza sativa)
  misc_feature (71): n=t or g
gcagaacgagcggatcacgccgtcgaaattcgcgcgcgcgaatccgagcttgtattcccggagcgccttcncgacgtcgtccttgagccccgggatgtcgc

SEQ ID NO: 6468 - DNA, 101 bp, rice(Oryza sativa)
  misc_feature (71): n=t or c
acaagccacttccagacttttagtgatattcttgaatcatgttttttccaaagttctttattagtcttctnagggtcaaaatacttagctttcagcctatt

SEQ ID NO: 6469 - DNA, 101 bp, rice(Oryza sativa)
  misc_feature (71): n=a or c
tggcgtgcgaatggggcaaatgacaacgctgggaaaatggtctggttggttttgggttagagcaaatatantagtaagcctgctaaatgataaggtggagg

SEQ ID NO: 6470 - DNA, 101 bp, rice(Oryza sativa)
  misc_feature (71): n=t or c
aaacagtatggctgagttggcgcaaacattgcggcaatttgctcctgagtcgcccgattgaggttctgccnaacatgttgtggttgttccctggtcaagac

SEQ ID NO: 6471 - DNA, 101 bp, rice(Oryza sativa)
  misc_feature (71): n=t or c
taagaaaggggatatagccgacggggacttatctcagcgtacttggctgatggcacatcagatgggttggnggaggacgacatcgctgcgggcggaaatct

SEQ ID NO: 6472 - DNA, 101 bp, rice(Oryza sativa)
  misc_feature (71): n=t or c
caaatgacgccgccattaaccagaatggtcaactagcctgcagtttagagtaaaacagtactaaccacaangttgcaatcgttcacggcagttgagttaaa

SEQ ID NO: 6473 - DNA, 101 bp, rice(Oryza sativa)
  misc_feature (71): n=t or c
gtcacaaacaaagagatcacaaatcacaaagagtcacaaacaaagaaagaaggagggggagagatggatcngccggtcgctgacaccgtcgcacctcctgt

SEQ ID NO: 6474 - DNA, 101 bp, rice(Oryza sativa)
  misc_feature (71): n=a or c
gcagcacgaagagctctccctctccttacatgggagggaaagatggccccgcagaatcgtcgtcccagggncacccgaatcccggcatgtccgggttggcg

SEQ ID NO: 6475 - DNA, 101 bp, rice(Oryza sativa)
  misc_feature (71): n=t or g
tagtatataatagacttagttaatagtcctaaaaaatatattcgatagggagctggttctggcgtcctgcntgaccacaactagcaaacgcgtcgtaatta

SEQ ID NO: 6476 - DNA, 101 bp, rice(Oryza sativa)
  misc_feature (71): n=a or g
aaactgggtagcgcctacaacattggtaatggggaggctgtcaggttttgggatgatgtttggttaggggnggtgcccttaaaaatccaatttccttacat

SEQ ID NO: 6477 - DNA, 101 bp, rice(Oryza sativa)
  misc_feature (71): n=a or g
ggtaacttgagccagtcctcgaaggtcgtgttgcagcactcgaggcagtcggagatgaggaccaggcgatnaacaggaccccggtgagcagcaaggatact

SEQ ID NO: 6478 - DNA, 101 bp, rice(Oryza sativa)
  misc_feature (71): n=t or c
gaggcaaatccgcccggctggtcggtccgtccgccaaacgacgcgactcctctcgagccgaagaaaatggncatgcggcaatacgcggctgctaccgctgc

SEQ ID NO: 6479 - DNA, 101 bp, rice(Oryza sativa)
  misc_feature (71): n=a or g
tgccgcctttgccgccgtctcctcccttgagctgcctgacaggctgtctcaccacaagttgcctgacacanccgtggatgccgaagctgtcgtctcgattc

SEQ ID NO: 6480 - DNA, 101 bp, rice(Oryza sativa)
  misc_feature (71): n=a or c
ggacgaggtaatcaagaaacgggattaagattagccgagaggctaatctaatgcagatggatttgctgctnctactctaatggtggcgtggatgacgagaa

SEQ ID NO: 6481 - DNA, 101 bp, rice(Oryza sativa)
  misc_feature (71): n=t or c
cgtcagcgtggccatctcgatcatcttcccctgcgcgttctacctcaagatccggtgggggcgggtgtcgnggcccgccgtcgcgctcaacgcggcgatga

SEQ ID NO: 6482 - DNA, 101 bp, rice(Oryza sativa)
  misc_feature (71): n=t or c
ggctgcagaggccggtgaccgcagagccaaatgtggcacggtcgaggatgagcagcgcgctagcggtggtnggccagtcaagctcaccatccgcctcgttc

SEQ ID NO: 6483 - DNA, 101 bp, rice(Oryza sativa)
  misc_feature (71): n=a or c
cttatcaaaagagcagagcaacagggactaatcaaggggttgggaatggatgtcatgagagaaggggtggntattttacaatatgccgatgataccatatg

SEQ ID NO: 6484 - DNA, 101 bp, rice(Oryza sativa)
  misc_feature (71): n=a or g
gtcgatccttgggaacgcctcgtgctgccggagcttgtcgacgtagacggactgggtgaggatgagcttcncgccggaggccttgaactgcttgtggatct

SEQ ID NO: 6485 - DNA, 101 bp, rice(Oryza sativa)
  misc_feature (71): n=t or c
ttgttggcgatttttcttgtgagttcgtcctcgagtaaaccagctgaagtggcgtttatgactgatgcctnaattatgtcttgaacttggcacgggcttgc

SEQ ID NO: 6486 - DNA, 101 bp, rice(Oryza sativa)
  misc_feature (71): n=a or g
tggatcctcttcttctccggggaagaagagggtattagatggaatcgattcgtccaccggggtccattccncaatgaagtcagccaggatttgactcttga

SEQ ID NO: 6487 - DNA, 101 bp, rice(Oryza sativa)
  misc_feature (71): n=t or c
aagtgcttgttttcgaatttccaaatttcaaaagtcttttgttttccgttgttgggtatgtttggtagagntccaacttttaaatttagcttagaaatcgg

SEQ ID NO: 6488 - DNA, 101 bp, rice(Oryza sativa)
  misc_feature (71): n=t or c
atgtcgttgctcatggtcacttgccgctgcattggcttggagttgccattgtgtcgccttcctcgggccgnaacatcaccgctctcgttgttttcatcgcc

SEQ ID NO: 6489 - DNA, 101 bp, rice(Oryza sativa)
  misc_feature (71): n=a or g
cgcggcggcgcgcaggagcggctgaacagggagagggagggcaaggtgcccctcattcttgaggaaggccngaggaggaccccggctccggtgtcgggcca

SEQ ID NO: 6490 - DNA, 101 bp, rice(Oryza sativa)
  misc_feature (71): n=a or g
caggtcccaaattagggctcattagtatgggccaaaatttaactaaaatcccaccctatacactgtacggnccggaatgtaggcccacgaatacgagacct

SEQ ID NO: 6491 - DNA, 101 bp, rice(Oryza sativa)
  misc_feature (71): n=a or c
ggcccttgcgatcaggagaccagctctctcctgtcggtagccgccgcgttccactacccggagattctcgncgttagctggaggcgagacgatccgtgcaa

SEQ ID NO: 6492 - DNA, 101 bp, rice(Oryza sativa)
  misc_feature (71): n=a or c
tggctttgctcctgagcacagccccctacctgcaaccagcgaaaccctagctcccaagttgatgtcatcgncgctgccaccactgccatcatcgtgctcgc

SEQ ID NO: 6493 - DNA, 101 bp, rice(Oryza sativa)
  misc_feature (71): n=t or c
tcttctcgtcgtgatagataaatttagtctcctttttttaattatctttcagggcaatggaatccaattcngagctcttatcatgctccacttgtttcttt

SEQ ID NO: 6494 - DNA, 101 bp, rice(Oryza sativa)
  misc_feature (71): n=a or g
ctagccaggactgcttccaacaagaccccaaccaacagaggcagatgctgcaccaggagcagcgcaagccngggcgcagcaaacagcgggagcacgatgaa

SEQ ID NO: 6495 - DNA, 101 bp, rice(Oryza sativa)
  misc_feature (71): n=a or g
gaatggggacgatggccagatttctggtcagagaggaaggagcagtgaggacgagatgcctaggcaaggcncctgttctagtagcggtccgtgttgccaag

SEQ ID NO: 6496 - DNA, 101 bp, rice(Oryza sativa)
  misc_feature (71): n=t or c
gatttctttggaaccaagatgataaaagaatggtttaaaggatccaggtccagagtactagagtagaattnagctgcaagtctgtagtaatcctgacaaat

SEQ ID NO: 6497 - DNA, 101 bp, rice(Oryza sativa)
  misc_feature (71): n=t or c
atcatggcagtccatgtccagacattcctcgcgggcatcctctcgaacaagcgcagggcataactcaccgnggcacacttggagtacatgttcactgccgc

SEQ ID NO: 6498 - DNA, 101 bp, rice(Oryza sativa)
  misc_feature (71): n=a or g
tgtctgcgaaaatcggtattttcccaaacaggtggccataaaaccctagctcccatccgtcctagccatcntcattgtcactgcagtctgccattgttgcc

SEQ ID NO: 6499 - DNA, 101 bp, rice(Oryza sativa)
  misc_feature (71): n=a or c
tttgatatgcatatccaattatccattccatcctcctgcatgatgtggacagcaaattgaaatgccaaaangttttttcttcctccttaaattgggccgta

SEQ ID NO: 6500 - DNA, 101 bp, rice(Oryza sativa)
  misc_feature (71): n=t or c
ttgacctaggttagggtagctggatcttcgtcgtcaatcgtcatcgtcatcggtgacctcctcctcgtccnccgcatagccctgcttgacgtaccggtcga

SEQ ID NO: 6501 - DNA, 101 bp, rice(Oryza sativa)
  misc_feature (71): n=a or c
aataattaaatagataggggagagggagaggcactaaacagaattgtgaccacatgctgcatcaagaatgnagttagaaggaaagctggaggttgaggaga

SEQ ID NO: 6502 - DNA, 101 bp, rice(Oryza sativa)
  misc_feature (71): n=t or c
gcatcgaacaccaacggcgagtccacggcggtgacgaccaataacttagctccgtcgacgcctaaggccgncgatgagtccacgacgtcgtcgaaaacaga

SEQ ID NO: 6503 - DNA, 101 bp, rice(Oryza sativa)
  misc_feature (71): n=a or c
gatcgccgggcttgggcggcatcgccattgcttccttctacctgtgagaagagaaccacacacaccacacnccagtggttgaagagaagaggaggagagtg

SEQ ID NO: 6504 - DNA, 101 bp, rice(Oryza sativa)
  misc_feature (71): n=a or g
cttaaactcgacccactttctgtcaaattcttcatgattatatggtgcgtggagaagtgctcgaaaatctnaaagcatatcaggacgaagatgtcttgcca

SEQ ID NO: 6505 - DNA, 101 bp, rice(Oryza sativa)
  misc_feature (71): n=t or g
gccaccggcctgcctgcccctgctagcttcaaccacacgatccatggagattggagaaacatcggagagangttgaagaaagcaacgacgagctatatatg

SEQ ID NO: 6506 - DNA, 101 bp, rice(Oryza sativa)
  misc_feature (71): n=t or c
gagtatgggttgtcgacgtagaaccacttctgcatccagttgcggtcccattttgccatcaacgcaggcancggccaggcgtccgaacgctccggccgaag

SEQ ID NO: 6507 - DNA, 101 bp, rice(Oryza sativa)
  misc_feature (71): n=t or g
tcatgatacggatatttcacgtttgtctcgtgaaagttatatgcttgttgtgaaatttggaatctaagtcntggagggatttttattcaacttatctgttg

SEQ ID NO: 6508 - DNA, 101 bp, rice(Oryza sativa)
  misc_feature (71): n=t or c
ccctcaaacaacaatattccaaaaaatttcttgcataatttcttggctgctttatggaatcagatgcttgnatatcaaagtcatactgcagctcatccgtg

SEQ ID NO: 6509 - DNA, 101 bp, rice(Oryza sativa)
  misc_feature (71): n=a or g
gagctgttgagcgcccacccggcgaaccccagcaagaagacgtacatgaggaggttcagcagcagcagcgnccccgccacgttcctcctcccgagatgctc

SEQ ID NO: 6510 - DNA, 101 bp, rice(Oryza sativa)
  misc_feature (71): n=a or c
agcgaatttccttgtgtaattttacgcagggcaaatgaaaatataattagatttgatatacaaaccttatnttctatttctataaatacaattgcattttt

SEQ ID NO: 6511 - DNA, 101 bp, rice(Oryza sativa)
  misc_feature (71): n=a or g
tgtaaaagggaccatacatttttctccagtcatgtaggctttttaccaaaatttgttcagcgcttgaaggncatcaattttttgagggaggatcttatttt

SEQ ID NO: 6512 - DNA, 101 bp, rice(Oryza sativa)
  misc_feature (71): n=t or c
tgcttctgtagtcactgctgcaggtttttcggccagtgctcatgatcatgcactttttgtccatacttcgnctcgtggtcgtaccattcttcttcactatg

SEQ ID NO: 6513 - DNA, 101 bp, rice(Oryza sativa)
  misc_feature (71): n=a or c
aacggatcaatggcaccgatgtacggtatccccttaggagatccccctttggccccgagcgtagacagcgncacctggtgatccagcgtccagtggccact

SEQ ID NO: 6514 - DNA, 101 bp, rice(Oryza sativa)
  misc_feature (71): n=t or c
ctcggtggggatgaaggggcggcggatgaagtaggcgttgcccttcttgccgacgctgacgacggtgtacncgaggccgagctgcttgagctcctcgatgc

SEQ ID NO: 6515 - DNA, 101 bp, rice(Oryza sativa)
  misc_feature (71): n=t or g
tgtgtttgtttacccgcgtgggtaatgctaatcatttgtcattgcgatcgaatgatgaatcttaccgtcgnagctactacgtggcatgtgtattctctccc

SEQ ID NO: 6516 - DNA, 101 bp, rice(Oryza sativa)
  misc_feature (71): n=t or c
cttttgttgcctagaagttccaataaccatacaacacatcctgtgtagaaaaacattgatatggttgcaanccacagatcacgtgatagtggctgcaggaa

SEQ ID NO: 6517 - DNA, 101 bp, rice(Oryza sativa)
  misc_feature (71): n=a or g
agatgagtgactatttttgtatggataacactcaatcaaatacatgtggtggtcacgttagacactgaacngtatattacttgggttgcctacatatacaa

SEQ ID NO: 6518 - DNA, 101 bp, rice(Oryza sativa)
  misc_feature (71): n=a or c
cttgggccatttcttccatcgttctatcttttctttcaatatctaggtccaatgtctcattttttgcattnatctgttatgaacagagagattattcagat

SEQ ID NO: 6519 - DNA, 101 bp, rice(Oryza sativa)
  misc_feature (71): n=t or c
tactgttgttagcatcatctcctacctccatcgatccatctatataacccatggtggctagcagcagtcgnccttcctcctcaacctctcagaggcttcac

SEQ ID NO: 6520 - DNA, 101 bp, rice(Oryza sativa)
  misc_feature (71): n=a or g
ccaggttgccgttggcgcccaccaccaggaagaacacctgcatcaggatcaacgcgatggtctcgccgccngacggcgccagcttccccagcacccgcggg

SEQ ID NO: 6521 - DNA, 101 bp, rice(Oryza sativa)
  misc_feature (71): n=t or c
tccaacagcacgttggaggccaccagcttcgccaactcttcttcgtccataagcgaagcgcccagataggnggtggtgtcgtcgtatatcctaccgggata

SEQ ID NO: 6522 - DNA, 101 bp, rice(Oryza sativa)
  misc_feature (71): n=t or c
gggggtaaatacctgagatggggttgattggagaagaggatccggcgaaggatgggcgcgacgcgggttgnggaggcggagcgggatggccacggtgaagt

SEQ ID NO: 6523 - DNA, 101 bp, rice(Oryza sativa)
  misc_feature (71): n=t or c
taggatggaaatggaattgagctgtgagctgttaccacaggcaagagatttggggtttctatggctggacnagtaaaaacgtgaatattagagaatgacct

SEQ ID NO: 6524 - DNA, 101 bp, rice(Oryza sativa)
  misc_feature (71): n=a or g
agcaaatgtatcaactcattttgaatcctaggtatgagataatgaacatgggtttcttcatttgtaatacnccgaatatgttcttgaataaccgggtcaaa

SEQ ID NO: 6525 - DNA, 101 bp, rice(Oryza sativa)
  misc_feature (71): n=a or g
tcctcatcttggaactcttgaagccactagaagccagctacatgagactaaagagctcgcgaggaaaactnagcatgatctgaggaatcgaatctccgagc

SEQ ID NO: 6526 - DNA, 101 bp, rice(Oryza sativa)
  misc_feature (71): n=a or g
ccgattgggctctcaattcttcttcacatgcttcttcgcgtcatgcataaacacataatgcatttgattgnttgatgatcacaagctaggcgacgacgtac

SEQ ID NO: 6527 - DNA, 101 bp, rice(Oryza sativa)
  misc_feature (71): n=a or g
actaacaggaggttggtatggctctgtgtaacccctgcgcttagggaccttgggcagtggcatcttggccntcaaggagggcttgcttcttcgcttcgaca

SEQ ID NO: 6528 - DNA, 101 bp, rice(Oryza sativa)
  misc_feature (71): n=a or g
ttcagagggctagaaactttaagaggctttctactgctgtggtatgctttcagcacttagttgtattgtgntttctgtttctgttaggaaaattacctcaa

SEQ ID NO: 6529 - DNA, 101 bp, rice(Oryza sativa)
  misc_feature (71): n=t or g
gggcacttcagccgttcacatacttgagatccctgaggaaagacggcttgattgtatttggtgaaggaatngtcgacacgcgctcgaactgtactatgccc

SEQ ID NO: 6530 - DNA, 101 bp, rice(Oryza sativa)
  misc_feature (71): n=a or g
ataataaaaggggattggtctcttgatcttgctcttcatcagaaccttgatccatgtcaacatcgtcaccntcatcttcacctccctattaagttcagacc

SEQ ID NO: 6531 - DNA, 101 bp, rice(Oryza sativa)
  misc_feature (71): n=t or c
tggaacatggatgacctaatcaggaggtcactaagaggtgaaggggctactcacttgaggtagtcgtcgcnatcccggcctccgcaccaagggtttgatcc

SEQ ID NO: 6532 - DNA, 101 bp, rice(Oryza sativa)
  misc_feature (71): n=t or c
ctcttgtatttacttggatggacaattcttttaaggcgataaagattatgtctggtaccagagcagttgcnagaagcatttagtgagtcgatgattcttat

SEQ ID NO: 6533 - DNA, 101 bp, rice(Oryza sativa)
  misc_feature (71): n=t or c
gttcctgctaaggaagcgggacggattctagggcaacccaaaccgtccctagaaaatgttaaggcgatcancacgaggggaggaaaatccactcgggatgt

SEQ ID NO: 6534 - DNA, 101 bp, rice(Oryza sativa)
  misc_feature (71): n=a or g
catcgtgtgaggtcaaaacattccgactacgcgctaaagaaaaccagagaggcctaccgacggattaggcnccttccgacgggtcccgagtacaaaggaga

SEQ ID NO: 6535 - DNA, 101 bp, rice(Oryza sativa)
  misc_feature (71): n=t or g
gacatcgtcgtcgccgtcgccgtcgtgttgcagtcgccgccgttgatggtgctgctgcatcatcaggacgntgccgaggccgccgtcttcgtcctcgtcgt

SEQ ID NO: 6536 - DNA, 101 bp, rice(Oryza sativa)
  misc_feature (71): n=a or g
cacgcttggtcctccatacactaaccagatcttgccgtagtggtgctggatctgccgccgtgggttcaccntgaacctatagccaatgactggtccacccc

SEQ ID NO: 6537 - DNA, 101 bp, rice(Oryza sativa)
  misc_feature (71): n=t or c
tgggcacgttggcaacatatggagccaagtaatcacggaggaccgcctgagccattggcttggggcttgangctgcaaatttgaccggattaggtgtcgag

SEQ ID NO: 6538 - DNA, 101 bp, rice(Oryza sativa)
  misc_feature (71): n=t or g
gctcgacatcgccctcatcgaccaccgtgacggcgaagagtactacaccaagcgcctcgtgacgagcagcngttgcgtcgctgtcgccgccgcagccgccg

SEQ ID NO: 6539 - DNA, 101 bp, rice(Oryza sativa)
  misc_feature (71): n=a or g
tcagcacagtaacttgtaagcaagcaaacagaacatcaatagccaagactttagcatacggaaccagtacncactcctgatacacgcgatagcatacaaac

SEQ ID NO: 6540 - DNA, 101 bp, rice(Oryza sativa)
  misc_feature (71): n=a or g
aatatcttccactggcaccggcgctattggagcaggagataacggttacgcaccaggaggagggaacaacnacataggagagaacgtcaacatcaatggag

SEQ ID NO: 6541 - DNA, 101 bp, rice(Oryza sativa)
  misc_feature (71): n=a or c
ggactccccggctgcggccgttaccatggactcatggaggtctccatggccaccgttctggccatgggggngctcacgccgttcgcgtcgcctgttctgct

SEQ ID NO: 6542 - DNA, 101 bp, rice(Oryza sativa)
  misc_feature (71): n=t or c
ttacaggggagaagaaaaaggagctcatatgataggaggccaaaaaggtacccaaaagtttctcacggctngaaaggacttttctctttgtgctcaaagag

SEQ ID NO: 6543 - DNA, 101 bp, rice(Oryza sativa)
  misc_feature (71): n=a or g
ggtctcgccgagtattgccatgagcacggcctttggtttggcctctcacacagcaccagagacaggaggangaggagcttggtgctctccgctctggacct

SEQ ID NO: 6544 - DNA, 101 bp, rice(Oryza sativa)
  misc_feature (71): n=a or g
gccgccgctagctaagctaggaattgaaatggggatggagaggccgcaagagaaggtggccaccaccaccnccgccgccttcaacctcgccgagtccggct

SEQ ID NO: 6545 - DNA, 101 bp, rice(Oryza sativa)
  misc_feature (71): n=a or g
ttctcctggactcacaaacaacaaacgtcgttgcctcattggcatgggaaacactattcatccctcaagtngatatcctttcgttttcacatgtcatttat

SEQ ID NO: 6546 - DNA, 101 bp, rice(Oryza sativa)
  misc_feature (71): n=t or c
cagactacgctcgtgaaatgaccgaaatgcctcttcctcaccttcctcaccttgtcgctcttcgacctcgncgttgtcattgtcggtgccagcggcgagga

SEQ ID NO: 6547 - DNA, 101 bp, rice(Oryza sativa)
  misc_feature (71): n=t or c
tagttcaagctggcgcatgtatggggttatatttgtatctatcacctcaatttccactttcacggtttagngagcccttatattatgagtggggtttctgg

SEQ ID NO: 6548 - DNA, 101 bp, rice(Oryza sativa)
  misc_feature (71): n=a or g
aaactttctgatctggcagcaattagacagaggcatgatggatctgttcgagattatattcagaggtttanggacatgaggaatagatgttatagcttggc

SEQ ID NO: 6549 - DNA, 101 bp, rice(Oryza sativa)
  misc_feature (71): n=t or c
tgatatagatccatccggaaaggactccgatccggctaacacaaaaacaagttcatccaaagacgctgggncgattcctgaagaccacccgactggcgctc

SEQ ID NO: 6550 - DNA, 101 bp, rice(Oryza sativa)
  misc_feature (71): n=a or g
ctctccatcaagtcatcatgatgagtctagtgctcgttcatccgtagacgtctcgatggaggatgctgacnttccacaacatctcttgagcgacaccgacc

SEQ ID NO: 6551 - DNA, 101 bp, rice(Oryza sativa)
  misc_feature (71): n=t or c
cctccaggtcctcttgctgcagaatcaaccatgggagagtggagatcgatcagcaaaatgactggttatcntagtagcttcgcacaactagagtttgtcta

SEQ ID NO: 6552 - DNA, 101 bp, rice(Oryza sativa)
  misc_feature (71): n=t or c
ggtggcggcggcaacagcaacaaccccttgctgggatgaagaactccttcgtaggcacagaggacgacgangaggtgggcccagggatgaagtaccgctgg

SEQ ID NO: 6553 - DNA, 101 bp, rice(Oryza sativa)
  misc_feature (71): n=a or g
ggaaacagggccaagccaagaaatcccggaagttgaagctcaggctgacagctctcgaggacaagacgctngtaatgacccaaggcctggatctccggcta

SEQ ID NO: 6554 - DNA, 101 bp, rice(Oryza sativa)
  misc_feature (71): n=a or g
cctttttcagatgaacagtactggccattgattcaattcaatcgttgaacatgtctttttcagaaatcagnaacttcaccaacatttgatcgattgacttg

SEQ ID NO: 6555 - DNA, 101 bp, rice(Oryza sativa)
  misc_feature (71): n=t or c
ccagtgatgaggtggcgcaccactgggcctggggacctccatcccacgcctttgtccaccgcaaaggtgancgtgccgctcatccacttggccaacctggc

SEQ ID NO: 6556 - DNA, 101 bp, rice(Oryza sativa)
  misc_feature (71): n=a or c
tacgtctcaggcgtccgtggccttgtttatttcttaatttggtacgatcggctcataaagatgttcaacgnacacgtcggaaggagctgtttctcgttttg

SEQ ID NO: 6557 - DNA, 101 bp, rice(Oryza sativa)
  misc_feature (71): n=a or g
tacgacccttgcatcctctactactccaacgtccccttcctctcctccgtcgacaacgccgcctcgacganccgcgtcaacctgcagaacgtcacgtcgga

SEQ ID NO: 6558 - DNA, 101 bp, rice(Oryza sativa)
  misc_feature (71): n=t or c
gcgcaggatgcgacaaagaacatcaccgacgtgcacaagcaccagccactatcgggcgaacatgccattgnggccccggtggcggacttcaacagcttcct

SEQ ID NO: 6559 - DNA, 101 bp, rice(Oryza sativa)
  misc_feature (71): n=a or g
cttcgcgtcgggatgcaccgtatggtcatcctcgtcaccccaaccattctccctgtggctccacgctcccntctccaacgagaaaatctccacgccggaga

SEQ ID NO: 6560 - DNA, 101 bp, rice(Oryza sativa)
  misc_feature (71): n=t or g
tgatgaattggagcccatctttgtaaaggatagcccccgttgcttcctccgatatttcaagaactgtgggngctatggcatgtcatggaatctcaccatca

SEQ ID NO: 6561 - DNA, 101 bp, rice(Oryza sativa)
  misc_feature (71): n=t or g
aaacaaaagggagcaaaataatacctgttggagatatggttgcctcctttttacgctgtctataatcacgnttcttttgaagcttagcctcttttttctcg

SEQ ID NO: 6562 - DNA, 101 bp, rice(Oryza sativa)
  misc_feature (71): n=a or g
gtgttcgtctcgctcgtggggctcgcgtccaagtggtccaagctgcggagcgacgccatggacagatcccngcgcgtcgagagccacggcgacgtcgcgct

SEQ ID NO: 6563 - DNA, 101 bp, rice(Oryza sativa)
  misc_feature (71): n=t or g
ccctcttcggagaataactaatggagctaaatttctctagagactcaaccagatacaatattcattgtgtntttttttttcttctcttgagactcaaacaa

SEQ ID NO: 6564 - DNA, 101 bp, rice(Oryza sativa)
  misc_feature (71): n=t or g
aattagtgtaaaatttagttatcttaagatgttttctcgatcataaaaattccctttttaaatgaaggtanaagtatagagcgggtaaccaaccggggttg

SEQ ID NO: 6565 - DNA, 101 bp, rice(Oryza sativa)
  misc_feature (71): n=t or c
gccgctgctccacgctgccgctcctcttccctgctccccatcgtcggtggaaggtgtcggcggaaaccggnccacaccgctgctcctcgccccctctgctc

SEQ ID NO: 6566 - DNA, 101 bp, rice(Oryza sativa)
  misc_feature (71): n=t or c
tttccaaatatcccaggagagtaggattagaatcgatttgacccccttccttttctccttagccattgcangaacggtctgaacccaccagtcctccagga

SEQ ID NO: 6567 - DNA, 101 bp, rice(Oryza sativa)
  misc_feature (71): n=a or c
ccggcggcgagcatgacgaccacgatggcattattgttagaagcagcacccaagcggagatgccagcgagnggcgggaacgcgacgtcgcgcggcgccgtc

SEQ ID NO: 6568 - DNA, 101 bp, rice(Oryza sativa)
  misc_feature (71): n=t or g
aggcgaacaaggccaagctgattcgtatccctcaaatctgaccatccgattactaaaaccgatataatttnactctctcaactgatttgagaatttttttc

SEQ ID NO: 6569 - DNA, 101 bp, rice(Oryza sativa)
  misc_feature (71): n=a or g
tgcacaggcgcgttctcgccccgattttcgtcctccttgccctcctcctcgccgtcgtccggcctgatgancttcgacgacctgaccgtgccgcggcggcc

SEQ ID NO: 6570 - DNA, 101 bp, rice(Oryza sativa)
  misc_feature (71): n=a or g
acgctgccggccatggccgcgctccggccatagcatcttgtgtcgccagccgccaccttgcacacctccgncgccgccttgccttggcatgcggcctcgac

SEQ ID NO: 6571 - DNA, 101 bp, rice(Oryza sativa)
  misc_feature (71): n=a or g
taatgcaccggcagcttttatggacttaatgaatcgtatattcaagccttatcttgatcaatttgtagtgntattcatagatgatattttgatatattcca

SEQ ID NO: 6572 - DNA, 101 bp, rice(Oryza sativa)
  misc_feature (71): n=a or g
attacccgcctcgagtgcgaaccctacagagattgtgagggtaggacccgaccggtctggaaaagacatcnagaaaatcagaacatgcattgccaacccag

SEQ ID NO: 6573 - DNA, 101 bp, rice(Oryza sativa)
  misc_feature (71): n=t or c
tgtataatgtgggggctctggatttttcttgtttctagcctcttgcacttttgaatatattcctttgccgntggctctagataataatttattcccaatat

SEQ ID NO: 6574 - DNA, 101 bp, rice(Oryza sativa)
  misc_feature (71): n=a or g
ttcataattagaaaaaatatcatacattgcagccctaacctcagttaaataagcataagtcataatttgcnacataatttgtagaacattggtaaaacctt

SEQ ID NO: 6575 - DNA, 101 bp, rice(Oryza sativa)
  misc_feature (71): n=t or c
tttggattaccaggttcccttaatgatatcaatgtcctacagagatcaccgctctttcaaaggcttactcnagggacagcgcccgagttggagtttatggt

SEQ ID NO: 6576 - DNA, 101 bp, rice(Oryza sativa)
  misc_feature (71): n=a or g
gccgcggcgctcaaggatccacccatgcgcgtgcaggctgccgttgccgatgccattggtactctcgctgnccggagcgctacgtgccaggagctctttgc

SEQ ID NO: 6577 - DNA, 101 bp, rice(Oryza sativa)
  misc_feature (71): n=a or c
gtcgtgtgggaaatttggaaggaaaggaaccagcggatcttcgagcacaaggagtccacaactacataccngcttgctaaaatcaaagaagaggctaggct

SEQ ID NO: 6578 - DNA, 101 bp, rice(Oryza sativa)
  misc_feature (71): n=t or c
tggggacctcgaggttaggcagtgacgaatgggatgggatcgacaacatcgggttggtgccatccatcgtngttgccatctgtaaactcaacttcttcctc

SEQ ID NO: 6579 - DNA, 101 bp, rice(Oryza sativa)
  misc_feature (71): n=t or c
tttgtcggccgtgaaaaaaaaatatctgccctacaattttggacggggattaaatgatgctccctccgtcncacaatataagggattttgagtttttgttt

SEQ ID NO: 6580 - DNA, 101 bp, rice(Oryza sativa)
  misc_feature (71): n=t or c
tctttattttcttcttacagatcccacaactaacatttgctctcttcgtccgttttaccttacatccagantcttgcggctcactgttcgatagagcgaac

SEQ ID NO: 6581 - DNA, 101 bp, rice(Oryza sativa)
  misc_feature (71): n=t or g
cttgtaggggaccaatctaatagaaaatgctgataccatcataccactcaagaagatggggaagttttaanatggggaagttttaatgtctaattagaaaa

SEQ ID NO: 6582 - DNA, 101 bp, rice(Oryza sativa)
  misc_feature (71): n=a or g
aaacatagaacaaataatctattcaataatccgatgaatgcgagttaaaaagaacatagtcttaactctcnagagattacatgatatcagtctcatatttt

SEQ ID NO: 6583 - DNA, 101 bp, rice(Oryza sativa)
  misc_feature (71): n=t or c
ttgtacaatttcatcatgcctctgtctaactgctgctaaatcagatagcttcatctcatgattaccactgnagaaataactatgaaactgtttctccagat

SEQ ID NO: 6584 - DNA, 101 bp, rice(Oryza sativa)
  misc_feature (71): n=a or g
acattttccatccatctccttccttctccatcttattccttctctcttctcatcttcttgcgttgcgagcnacaatgacggtggtggccgagcccgtgacg

SEQ ID NO: 6585 - DNA, 101 bp, rice(Oryza sativa)
  misc_feature (71): n=t or c
cttcccgaacctattcgacgggcgattgggcaaccgggcaatcacaatggtggatcaaatctttccagatncgcctcccaagatgaccagccgccagccgc

SEQ ID NO: 6586 - DNA, 101 bp, rice(Oryza sativa)
  misc_feature (71): n=a or g
ggttcgtgacaatatggtatcagagcagtcaattcgtggggtttctggtgtggagatgaagtgggagagcnctggtggtcagaggaactgccaacaacttg

SEQ ID NO: 6587 - DNA, 101 bp, rice(Oryza sativa)
  misc_feature (71): n=a or g
ggtcagaagaccctgagacgtttctccactcaaatcatgtgtagcaatacacagtaaataaaatagtttcngtttgcgtgcgtcttccacgtaaaaaaatg

SEQ ID NO: 6588 - DNA, 101 bp, rice(Oryza sativa)
  misc_feature (71): n=a or g
cacctcttgggaatcatcttctagctcctcatcgctgaggtaatcctcggcaggatggggcaggatctgcnctgtcaccggtggggcgtttacgaaggagc

SEQ ID NO: 6589 - DNA, 101 bp, rice(Oryza sativa)
  misc_feature (71): n=a or g
gcatctatttaagtatatattggataattgttgcttttatatccttttattaatgtggaatcctggatttntaggtagaggtgtaacaggaccaactttcc

SEQ ID NO: 6590 - DNA, 101 bp, rice(Oryza sativa)
  misc_feature (71): n=t or c
gatacctagtatgtataactctttccaaattcagatatgtgaagagccgaaatgatggacagctaagggangctgcgaaggcaaaccagacatctgcctgt

SEQ ID NO: 6591 - DNA, 101 bp, rice(Oryza sativa)
  misc_feature (71): n=a or g
aattcccagtcaaaccattccttctacctctcctgacaccctcccatctggaccagatagccacttgcctncatggcccagccaagccaaggaccagccga

SEQ ID NO: 6592 - DNA, 101 bp, rice(Oryza sativa)
  misc_feature (71): n=a or g
gcccgtggagagtagagggatccggtggtggagctgggagaagccgagaagggataattcgggattcgagnaactgcggcgcgggaatcggcaaaccgccc

SEQ ID NO: 6593 - DNA, 101 bp, rice(Oryza sativa)
  misc_feature (71): n=a or g
tccaagcttcagggcgccattctcctcaatgagcgtgtacccatcggaagggaacatcccaagcagcagcncggcctgagcagcggcacttccagcaagcg

SEQ ID NO: 6594 - DNA, 101 bp, rice(Oryza sativa)
  misc_feature (71): n=t or c
tctactacctcatgctcatgtactccatttacacactccccatgttcccatgagcatctctactactagcnttttagctttttagagtagtagaggtgtcg

SEQ ID NO: 6595 - DNA, 101 bp, rice(Oryza sativa)
  misc_feature (71): n=a or c
acacaggctagcatcagctcatagtcaatgtttgccgtaatccgacacgggcattgaaacgatcgagatgnaccttgagaatgttgggctcattcacgttg

SEQ ID NO: 6596 - DNA, 101 bp, rice(Oryza sativa)
  misc_feature (71): n=t or c
ttggagttctagaggagtgccgaagatgtcggcactctcgtcgatcttgtacctcgatgaatgttttttanataagtaagtattcatgactttctttggca

SEQ ID NO: 6597 - DNA, 101 bp, rice(Oryza sativa)
  misc_feature (71): n=a or g
cgtgttgatgacacagctgcttcctgttataattagtggtattctccctgacaatgttcgagcaacaatancaaagctatgtgctttcatgaacgcaattt

SEQ ID NO: 6598 - DNA, 101 bp, rice(Oryza sativa)
  misc_feature (71): n=t or c
gacagaaatcattgaatcaaacggctctgatcacccgaagtctccccctcagccttacctcccgcacccanccccgtcagccgaaaatcacgcctctcaga

SEQ ID NO: 6599 - DNA, 101 bp, rice(Oryza sativa)
  misc_feature (71): n=a or g
gacgaggccgtggacgcggtggtagtagagcgagaacacggcgcacgactgcacccacagcacggccgacnggatgccggcggcggcggcgacgtcgaccg

SEQ ID NO: 6600 - DNA, 101 bp, rice(Oryza sativa)
  misc_feature (71): n=t or c
atgatggcagcatccacctacttctggtccactgctatgaatgccttcttattctcacaaggactgatgancgcaactctgctagatgttaccatgattac

SEQ ID NO: 6601 - DNA, 101 bp, rice(Oryza sativa)
  misc_feature (71): n=a or g
gcttcttctgtcctgcatttgcacatgctgtgcatactatgaaagaaggagaggaagcagtactaattgtnaaaccaaaatgtaagcaacaatttaccaaa

SEQ ID NO: 6602 - DNA, 101 bp, rice(Oryza sativa)
  misc_feature (71): n=a or g
ttcataacatgacaatgtcatggctcttctgaccctactttgataggaagaagcagacgcctcatttacancgacccgacgagaagattggtgagagatat

SEQ ID NO: 6603 - DNA, 101 bp, rice(Oryza sativa)
  misc_feature (71): n=a or g
tatctccttccagtttggattacaggtcatcgtgatgaagtagtctggtctcccaaaatgttggacaaganccattgcattaagaaaccgctgttgcatgt

SEQ ID NO: 6604 - DNA, 101 bp, rice(Oryza sativa)
  misc_feature (71): n=t or c
tttgacgaggtcaaccatggaagcagagctgacgatactggatacaactactattgaggcagaagggctgngtgatctattgatggatctgcctgttgttg

SEQ ID NO: 6605 - DNA, 101 bp, rice(Oryza sativa)
  misc_feature (71): n=t or g
cacataagtagttttcggcactcacatgagctcctcgccatgcttgcctcgccggcgcttcgtctttcttncgccgccggcgccggagacggaggtgacag

SEQ ID NO: 6606 - DNA, 101 bp, rice(Oryza sativa)
  misc_feature (71): n=a or g
gtttttgatgggaaaattggttgttttccacttgtcacttatagacatgctgttagaagtagtgggaatcntcttcgtggagaagaagtaatcaagccaat

SEQ ID NO: 6607 - DNA, 101 bp, rice(Oryza sativa)
  misc_feature (71): n=t or c
tccatcttcgccgcggtgccgctgctacaacggacagtgtatggcctcctttgcaggaagttcgatggcgnctgcgtctacaagattaaagtagcgccgtc

SEQ ID NO: 6608 - DNA, 101 bp, rice(Oryza sativa)
  misc_feature (71): n=a or g
acacaaatgcaaaaaaaaaaaggaacagacacacgttaacaaaatcagaaaaacacttaccactataagancaaaagaataccacaatggcaactgcaagt

SEQ ID NO: 6609 - DNA, 101 bp, rice(Oryza sativa)
  misc_feature (71): n=a or g
aagattaagtcaaaactttaataactaataaggacccggcgcaacggcgcgagttgggaaggccgaaggcnggtaggcccaagccggggcgcggggcggag

SEQ ID NO: 6610 - DNA, 101 bp, rice(Oryza sativa)
  misc_feature (71): n=a or c
taagcaaagcagagcaaactgtactccctgaagcatctaaccacctgtttctttgaatactccctccgtcnaaaaaaaaaaaaaggcaaaccctaaattta

SEQ ID NO: 6611 - DNA, 101 bp, rice(Oryza sativa)
  misc_feature (71): n=a or g
gggcttgttcaagaagggatcaagctcaagatcaagccatcaccaagacgagtcgagcacacactcctccnctggtgtatccatggaggaggtggacgcta

SEQ ID NO: 6612 - DNA, 101 bp, rice(Oryza sativa)
  misc_feature (71): n=t or c
ggatgcaggtcggtcatctgtagtaccttatgtatatgtatagtactgctcactcttgtactatagaggcncttgacgtggcaccgggctgggggcacttg

SEQ ID NO: 6613 - DNA, 101 bp, rice(Oryza sativa)
  misc_feature (71): n=a or g
ccaataacgaattcagcccaccacggaatttgcaccactttattcttctaaaaaattttggcccgctactnaatttggcctgctaatttgtcatcaatgaa

SEQ ID NO: 6614 - DNA, 101 bp, rice(Oryza sativa)
  misc_feature (71): n=t or c
gggtgctctcatatgagatgttaacagaagatacaagcacgtgtgccaaattttagaaatgtggtaactgngccaaatttgcaaagctaagatcatatggg

SEQ ID NO: 6615 - DNA, 101 bp, rice(Oryza sativa)
  misc_feature (71): n=t or g
tctttaggttttgctattataccatctttaaaatgagttttgaaaaaaatatcaatctcaagcccgcgccngattttgtcattttctcattttcactaatt

SEQ ID NO: 6616 - DNA, 101 bp, rice(Oryza sativa)
  misc_feature (71): n=t or c
ttgatgcggcaaaagatggagaagcgcgacagcgagaagatgaagaagcgcagtggctgactgggggtgangacaaggcctcctcatgcaacggttccaag

SEQ ID NO: 6617 - DNA, 101 bp, rice(Oryza sativa)
  misc_feature (71): n=t or g
catgacactgaacaaccagattagttagttagtttatctggagcaaagcaaacgacatgaagaaggcaagntttttttttgttcttgtcagtaaaaaaaat

SEQ ID NO: 6618 - DNA, 101 bp, rice(Oryza sativa)
  misc_feature (71): n=t or c
taaagaaggggatttagccaataagaacttacctcaacgtattcggttgatggtgcaccagatgggctggnggaagacgacattggtgcgggcggagatct

SEQ ID NO: 6619 - DNA, 101 bp, rice(Oryza sativa)
  misc_feature (71): n=t or c
ggccagtctaagaagggaaggggctccaatggacaggaggagggaacaacagccagttgggaggaaccctngccgttgaccaggacaatgaccacactgct

SEQ ID NO: 6620 - DNA, 101 bp, rice(Oryza sativa)
  misc_feature (71): n=a or c
tatactaccaatatacacatgttccatgcatggatgcatatatccactttagtatcacagaaactttagtntcacagaagctgtggttgcagcgcccagcc

SEQ ID NO: 6621 - DNA, 101 bp, rice(Oryza sativa)
  misc_feature (71): n=a or g
gcgtcggcgtcgtcgtctcggtcggcgagatccagttactacagcagcagcatgtcaagcaacgcgtcggntggccctcataatcatcggtacgcccctta

SEQ ID NO: 6622 - DNA, 101 bp, rice(Oryza sativa)
  misc_feature (71): n=a or c
gcaagacgagaggaagactctcccggtgtacaagctcaaggacgacctgctcaaggccatcgacgagcacnaggtcctgatcgtcgtcggcgagaccggct

SEQ ID NO: 6623 - DNA, 101 bp, rice(Oryza sativa)
  misc_feature (71): n=a or g
actcgtggttatgtaactctgtcaatctaggatcacatactagctcgtgcctaaaattatggccgtgcgcnttctttcttcatgtaatgaccaaaagtcac

SEQ ID NO: 6624 - DNA, 101 bp, rice(Oryza sativa)
  misc_feature (71): n=t or c
tgaaaaatagccttcttaatttccttttcagtgaaatcctgagttaaagcctcattctccaaaagagaganctgaggaatatcagcaactctactctcatc

SEQ ID NO: 6625 - DNA, 101 bp, rice(Oryza sativa)
  misc_feature (71): n=a or g
gttcttccgtctcattgtcggccataaaaacgctaaaaaagagaggagtgtagtcgtcttcatagttgtcnccaaagacttcatcaaggtcgtcgtaatcg

SEQ ID NO: 6626 - DNA, 101 bp, rice(Oryza sativa)
  misc_feature (71): n=a or g
gtcttgtacggtgatttggtatctggtgatctggtagtatcgttttgaggagatggataatgtatgtttgnacctcctgcctcctgatgcacgttttcttg

SEQ ID NO: 6627 - DNA, 101 bp, rice(Oryza sativa)
  misc_feature (71): n=t or c
tcagtaaaaccaagccccccaaagtccttaggaaaagccatgtcttcccatttgaccatgtgatatttacntttcaatttgttaccagcccagtaatacct

SEQ ID NO: 6628 - DNA, 101 bp, rice(Oryza sativa)
  misc_feature (71): n=t or c
agatctatacttcctttccttgccgatctattttgagaattgtaatttcccctacatgcaatctgaaaccnggttgtgctgtactgctgaaaagtaattct

SEQ ID NO: 6629 - DNA, 101 bp, rice(Oryza sativa)
  misc_feature (71): n=t or c
cagtgtcaccgctgccatggatttggccatgtgcagaaggttttccctagtcaacgtgcatacattgctanggaagatggctacataagcacctccgacgt

SEQ ID NO: 6630 - DNA, 101 bp, rice(Oryza sativa)
  misc_feature (71): n=t or g
ttcctcagtaggatgagcaatggtgtggtagaggtcatcgaggagcaaggtcgaggtggcgtggtagaganggaggcgagcacggtggagcgtcgatggcg

SEQ ID NO: 6631 - DNA, 101 bp, rice(Oryza sativa)
  misc_feature (71): n=a or g
gtctacttccactacttcaacatatctattggtggaggcgctggtggaggtggcggcaaggacactggagnaggtgagaacgtcaacatcaacggaggcaa

SEQ ID NO: 6632 - DNA, 101 bp, rice(Oryza sativa)
  misc_feature (71): n=a or c
gaagtggagtatgtgcgtcaacttcatcttgacatcaccttcgataaatcagttcaagcatgcaattcacnttaactttagggcgaccaacaacacagctg

SEQ ID NO: 6633 - DNA, 101 bp, rice(Oryza sativa)
  misc_feature (71): n=t or c
tgggccacgtaatccttaatagcatccagtggcctacctttcaacatggcagctatgctttcatgagtggnaagatatgtctgcaaatgaagtcgaactat

SEQ ID NO: 6634 - DNA, 101 bp, rice(Oryza sativa)
  misc_feature (71): n=a or g
actgcaggcgctcgcgttcaacggcaacgggagcgtccatggcgttcttgatcctggtgtcgaggaggagnaggaggcgggtgacggcggcggcggcggga

SEQ ID NO: 6635 - DNA, 101 bp, rice(Oryza sativa)
  misc_feature (71): n=a or g
cccaccaccgtatccgtatcctccaccgtgatgatatccacctccccacttctgatcctcgacccctggcntccctgaaggcttcacattcttcccctcag

SEQ ID NO: 6636 - DNA, 101 bp, rice(Oryza sativa)
  misc_feature (71): n=t or c
ccaaaaactcctcccatgcagacttcttcttcctcccctgcttcttctgcttcacgctttcaccatttcanccctcacgccttgctctctctctcttccct

SEQ ID NO: 6637 - DNA, 101 bp, rice(Oryza sativa)
  misc_feature (71): n=t or g
agtattctattgccataagggatgtcacactactattcttgctgtgtatgtggatgatatgattatcacangggatgattctatagagatagcaagattga

SEQ ID NO: 6638 - DNA, 101 bp, rice(Oryza sativa)
  misc_feature (71): n=a or c
aggagcggaggccggcagccacactggatgctagtattgacaacgaaacggttgggatggccgactattgntgtcatctgggtgcccacttctctctgccg

SEQ ID NO: 6639 - DNA, 101 bp, rice(Oryza sativa)
  misc_feature (71): n=t or c
ctccgtcttcattccccctctcttatcttcccgccgatgaactccgacgagctgcaccaagatgccgtcgncaggggagctggaggggagcagcggttgcg

SEQ ID NO: 6640 - DNA, 101 bp, rice(Oryza sativa)
  misc_feature (71): n=t or c
atcttcccctattgccatataactccattccagattcaagcatgtataaatcccctgatgtctgtatcatnggctatttgtgtccttttaattctatagga

SEQ ID NO: 6641 - DNA, 101 bp, rice(Oryza sativa)
  misc_feature (71): n=a or g
cacacgacatggtggatcaaggattatccactggttagttcatgccatcgaaataatactcgaccgacggnggaaagaccgcccacatgactttttattaa

SEQ ID NO: 6642 - DNA, 101 bp, rice(Oryza sativa)
  misc_feature (71): n=t or c
aaggtggaggccgccaccggcagcaaccctaccccgtcaccattggcccctcttccacgcactcctacagnaatggcaccaaatgcgatgccccctacgaa

SEQ ID NO: 6643 - DNA, 101 bp, rice(Oryza sativa)
  misc_feature (71): n=t or c
atgctactgtattattaattatatgtctaaacaacctgctttcgtcctaatgcaggccaaaccatagtgangaaaaatgatattgctgctactccaaagtt

SEQ ID NO: 6644 - DNA, 101 bp, rice(Oryza sativa)
  misc_feature (71): n=a or c
cgacggcgcggacgtcctcctcatggatctcgcggtctgcgaccccttctcagggcgctacgccatcctcnccgaaataccgcaagacctaatcgaccccc

SEQ ID NO: 6645 - DNA, 101 bp, rice(Oryza sativa)
  misc_feature (71): n=t or g
ggcatcaccacttcggagaaaaaactacggacaacacctataacctcttgcttcaaaactccccaattgcnttgaaagaatctagccggaaaaccaccggg

SEQ ID NO: 6646 - DNA, 101 bp, rice(Oryza sativa)
  misc_feature (71): n=t or g
gaaaccaacatctcttgcacctgtttctcaatttcagtttttaactcagggttgtacctgtatggccttangttcactggttgtgctccttccatcaaagg

SEQ ID NO: 6647 - DNA, 101 bp, rice(Oryza sativa)
  misc_feature (71): n=t or c
gatttgcatgtacctgttcgtccaccacgacttgaagctgctcaccaggaactgaacctcgccagcgaagnggtgtgcggtgatgaacgccgggatgagca

SEQ ID NO: 6648 - DNA, 101 bp, rice(Oryza sativa)
  misc_feature (71): n=t or g
tttaggtcagtgagacaaaggggattgagagtgagagaaaggggatcgagatgcgtcagctcttgctcatngtggcgccctagatcgatctcgtcggcatc

SEQ ID NO: 6649 - DNA, 101 bp, rice(Oryza sativa)
  misc_feature (71): n=t or c
cttggattgggtttttttggacggagggggtaggtgtttatataaactggcaagatcgatggaggcggcgngttgggcggtccaccggcctaaaccggatc

SEQ ID NO: 6650 - DNA, 101 bp, rice(Oryza sativa)
  misc_feature (71): n=a or g
acccaaaatgcctttcccctgatatggagtcttgttgaaagtcttgtagctctctttaaatgtctgcttcnctggtgccttcttgttcatttcccccaaaa

SEQ ID NO: 6651 - DNA, 101 bp, rice(Oryza sativa)
  misc_feature (71): n=a or g
tataggtatggctcatcccatatatgacggtgactttcgtacttcaaatttcgttgattttcccctggtgntatgtatttggataccatgtaattcactat

SEQ ID NO: 6652 - DNA, 101 bp, rice(Oryza sativa)
  misc_feature (71): n=t or c
gtgtgtagggctccatcgcagggaagacgtctctggaggtcgtggtggagaaaacgaggtggcgtgtgggnctccatccccaacctcgtctctaccatagc

SEQ ID NO: 6653 - DNA, 101 bp, rice(Oryza sativa)
  misc_feature (71): n=t or c
gaagacataagaaagaggatacctctgcccctgcctcttctgccaccaccacggcctcttccacgattagnggggaaagattctaaatttccatgaaggaa

SEQ ID NO: 6654 - DNA, 101 bp, rice(Oryza sativa)
  misc_feature (71): n=t or c
tccgtgtccctcgcgccatctcccaagctcgacgacgatcccaccaccaggtccatcacgatcaccctccngccgtcctccctcgccggcaccgcctccct

SEQ ID NO: 6655 - DNA, 101 bp, rice(Oryza sativa)
  misc_feature (71): n=a or g
cgccgggaagatggataggatacaggtgttggtgaggctgaggccgctgagcgagaaggaggttgctaggngggagccagcggagtgggagtgcatcaatg

SEQ ID NO: 6656 - DNA, 101 bp, rice(Oryza sativa)
  misc_feature (71): n=t or c
tgtgtcgaccttacattctgcaggttgcatgaggcaggcctcctaccattgtctaggctagtcgaggtggncgcaaacgacaccgacccaataaagctgtg

SEQ ID NO: 6657 - DNA, 101 bp, rice(Oryza sativa)
  misc_feature (71): n=t or g
ttcccagctccggcggaatcttgccggtgaacaagttgttctgcacttggaaggatatgagctcgggccanctcgtgaacaacgccggtgggatctcaccg

SEQ ID NO: 6658 - DNA, 101 bp, rice(Oryza sativa)
  misc_feature (71): n=t or g
ttggaaattattaaactgtaattgtgatgtattaccatatggaccaagatcctcaccttgcaccccctggnaaccatcacctttatctcctgagccctctg

SEQ ID NO: 6659 - DNA, 101 bp, rice(Oryza sativa)
  misc_feature (71): n=t or c
atcaccgcactggtcattcttgacatacgctgacatcaggccattccaagagacggcgttcctctcgctgncagcctcattgaacaccctcctcgcatcat

SEQ ID NO: 6660 - DNA, 101 bp, rice(Oryza sativa)
  misc_feature (71): n=a or g
ctctcccttatcctcatgcccactacctctcttcccctcacgctggcgtctctccttctcttccccgggcnttctcctcttccccggccagcgcttctcct

SEQ ID NO: 6661 - DNA, 101 bp, rice(Oryza sativa)
  misc_feature (71): n=a or c
atcgtctcctccatagtcctttccctgcctccaatgatcagcaacagagcaatgcttttgctcccttttgntacacagttacacttgacatcatcccccta

SEQ ID NO: 6662 - DNA, 101 bp, rice(Oryza sativa)
  misc_feature (71): n=t or c
agcaaccttcggtttcctgatcggcgcgatcgctttgcgccgtcatcggagagctttcgttgcgtctgacntggcctcgaaggggatggagtggtagaacc

SEQ ID NO: 6663 - DNA, 101 bp, rice(Oryza sativa)
  misc_feature (71): n=t or c
aatctgtacagtacgaaattgagtacatgaaaggaaaagtattcccaattaacactggagttgtacatacngcgctgtctgtgcaaacaacaagcccataa

SEQ ID NO: 6664 - DNA, 101 bp, rice(Oryza sativa)
  misc_feature (71): n=a or g
gccgccattttctctaaatccggccaccaccgccactccaaatccccaaatctggagtctcatcgcctccncgctgagcgcccaagctgctctttgggcca

SEQ ID NO: 6665 - DNA, 101 bp, rice(Oryza sativa)
  misc_feature (71): n=t or c
tgatgatccactaaattgttagtaattgaaacaagaaatactagtggttttcttggatgtgtagtgatgcnaacttggaaaatttgacatcagtatgttct

SEQ ID NO: 6666 - DNA, 101 bp, rice(Oryza sativa)
  misc_feature (71): n=a or g
attaggccaaccgatgaagctgttcgtggtctcagccgtgctcgattaatcacggatgcttccccgatcgntcaacccggcgtttggattatcgcacgctt

SEQ ID NO: 6667 - DNA, 101 bp, rice(Oryza sativa)
  misc_feature (71): n=a or g
atttccccaatggaggtacgcgtcctccttctgctcgaagttgtcaccatcatcgtcgtcttcggcggccncgacgacgaggaagcaagtggggaagcggg

SEQ ID NO: 6668 - DNA, 101 bp, rice(Oryza sativa)
  misc_feature (71): n=t or c
taaccatagaaaccataccccaagacgagctttccaagatcagacgccattgccgccaccctaaggtcatngccggcgaggccgtacatcactgacgtgat

SEQ ID NO: 6669 - DNA, 101 bp, rice(Oryza sativa)
  misc_feature (71): n=t or c
agaccctatacagtcttctcaaaaaaaaaaaaaacctatacagagttcggtgggacccacggcatgtattntggggcgccagcagaaagtgatacgagcgg

SEQ ID NO: 6670 - DNA, 101 bp, rice(Oryza sativa)
  misc_feature (71): n=a or g
aggaataagatagattttggcatgcctggttatcaagggtcttggaccccatgtgcttggatgttccgtgngagtggcattttcgatggcgccacgaaata

SEQ ID NO: 6671 - DNA, 101 bp, rice(Oryza sativa)
  misc_feature (71): n=a or g
cgcatctgttggacagacgaacgtgaagtccagggggtagaagaacagaaccacatattttttccccaatntactcagacagcttgacctgacctgcatat

SEQ ID NO: 6672 - DNA, 101 bp, rice(Oryza sativa)
  misc_feature (71): n=t or c
agaggaagagttagggatgtggacagcgccgaagatgttggaggttgctgaccaagccctctctggtccgnattgtcaagagctccccgaccacacctgtc

SEQ ID NO: 6673 - DNA, 101 bp, rice(Oryza sativa)
  misc_feature (71): n=t or c
gtttttcttttgttattctttctagtggttggcttctctctgttgtcacggtattacatatgttgtattantccctccgtttcacaatgtaagtcattcta

SEQ ID NO: 6674 - DNA, 101 bp, rice(Oryza sativa)
  misc_feature (71): n=a or g
ccatcaggaagtgcccagtcaaagtggtaaaggaggttcgctaatgtgagctcaagtgtggtggtcgcgancaacgctccagggcattgcctgcatccagc

SEQ ID NO: 6675 - DNA, 101 bp, rice(Oryza sativa)
  misc_feature (71): n=a or g
tccaactctcgatcgcgagctgttgttgttttggtggaagaatcggtccgtgcgtgatttgatccatggcngtgtcgtcgtcgtcgctgctgctccgccgc

SEQ ID NO: 6676 - DNA, 101 bp, rice(Oryza sativa)
  misc_feature (71): n=a or g
ttttgcccatataaagggaaattaggatacttttttctagttatatatatgcactaataattctagctctnaagatcaggagcataaggggtggatgcaac

SEQ ID NO: 6677 - DNA, 101 bp, rice(Oryza sativa)
  misc_feature (71): n=t or c
ccaacatctccggcactcctccggaactccctggaagaatgccgaaatctccggcactcctctgaaactcngaagagaactccgacatttggggcactcct

SEQ ID NO: 6678 - DNA, 101 bp, rice(Oryza sativa)
  misc_feature (71): n=a or g
tctgtaatttttagattacctttcctggttgtggtcatcgccatctcatcactaaaagaattcatcttgtngtaattttcagtctgggagcacagcatgtt

SEQ ID NO: 6679 - DNA, 101 bp, rice(Oryza sativa)
  misc_feature (71): n=a or c
aagggtggtttgccgccggcgccggcaccggagcgtcgtcggatggtgaggtagaggaagacgagagaggnggagaaaaccgcccatagcaaccatagctc

SEQ ID NO: 6680 - DNA, 101 bp, rice(Oryza sativa)
  misc_feature (71): n=t or c
cttactccctcctcagcagcccctacacaaaactcctcttctgcacctacacagacctcctcttttgcccntacacaaaacaaaagtaacaaaatgaaggc

SEQ ID NO: 6681 - DNA, 101 bp, rice(Oryza sativa)
  misc_feature (71): n=t or c
gcagccccagaaccaccaaagggttccaacaagtcccggaagaaaaaatcgagatgacgacgaatccaaantatcacagttcacaaaatcaaagataccct

SEQ ID NO: 6682 - DNA, 101 bp, rice(Oryza sativa)
  misc_feature (71): n=a or g
cttcccctaaaaatatttttgacgctttgaggaggaggatactaaaagaaaagaatatgtatcgccaagcnaaacaagcaatatgacaataaaaaagcagg

SEQ ID NO: 6683 - DNA, 101 bp, rice(Oryza sativa)
  misc_feature (71): n=a or g
ttggttgccttcattaggcctggcttgtatctcgcatacagctaggggttgttggggctagagcatctccnacagcctccttatcccactctccaagttaa

SEQ ID NO: 6684 - DNA, 101 bp, rice(Oryza sativa)
  misc_feature (71): n=a or g
cggacggaagttcacgaaccgtcctcgctttcacctatcgcgccattgatgcgaacaaaagggattatatncacactcatggtcgactcacctttctgggc

SEQ ID NO: 6685 - DNA, 101 bp, rice(Oryza sativa)
  misc_feature (71): n=a or c
gtcaatgtcgaaaaagagataaaaaaagaacgcctggtgcagtgcggatcaaatcagcgaccttaaaattnccaatttgatgtacacaggctacaacgttt

SEQ ID NO: 6686 - DNA, 101 bp, rice(Oryza sativa)
  misc_feature (71): n=a or g
aagcctattctcatgtttacaattgaacgaccaaacgacctggcacgctaagaagagagcgttggcgtcangggatgggcaagacgccaaagggcggtctc

SEQ ID NO: 6687 - DNA, 101 bp, rice(Oryza sativa)
  misc_feature (71): n=a or c
gatgtcctactgctgcttcgagtcgttcaaagtgctggccaagaactacctgggcgtggagcagcacgagntgttcggcgagatacggcagcttttggagg

SEQ ID NO: 6688 - DNA, 101 bp, rice(Oryza sativa)
  misc_feature (71): n=t or c
cgcccagatgaaagagatgtgagccgcctccaccttcttcttcgcccctcttggtgtagcgctagatccgntggcgggccgtcgatggtttggtctcccgc

SEQ ID NO: 6689 - DNA, 101 bp, rice(Oryza sativa)
  misc_feature (71): n=a or g
ttcaataaggttatctatcttggaaccgaaatcctccacaaattgccccccagccgaacttgctaatttgntatcatttgttctatgcgtttcttcggctt

SEQ ID NO: 6690 - DNA, 101 bp, rice(Oryza sativa)
  misc_feature (71): n=t or c
gaaacgatatcaccaagtactttgtgagcagtggctttgcatttgtccatgcaaactccatcgctgatatngtggctgttgaggctgtccccctggaccag

SEQ ID NO: 6691 - DNA, 101 bp, rice(Oryza sativa)
  misc_feature (71): n=a or g
ttaggccctttcaaatcatggaggttatggagaataaccacgatgagtcgggcgaggttggttttgtgatnaaggacctttataatttctttactcggtac

SEQ ID NO: 6692 - DNA, 101 bp, rice(Oryza sativa)
  misc_feature (71): n=t or c
gccggcgtcctcgtcacttgacgacgacgatccatcggttcctgtctcctcgtcggcggccatgggggatncaccgctctggccgcggcgcatacggtact

SEQ ID NO: 6693 - DNA, 101 bp, rice(Oryza sativa)
  misc_feature (71): n=t or c
cctcaaattgatccatccatgactgcatcatatcatctggtttaccaggtctttgcatcaccaaggacttngagttactctcatcacaactgtcagaattg

SEQ ID NO: 6694 - DNA, 101 bp, rice(Oryza sativa)
  misc_feature (71): n=a or g
caaaaagaaaccaaaaaaatccagctcatcgtataaaatactcccaactgcctcgcttcccttcccctctngcttctactagtactcgttctgcacacacg

SEQ ID NO: 6695 - DNA, 101 bp, rice(Oryza sativa)
  misc_feature (71): n=a or g
agccggcagatagtttgccagcgcgttatcgtctgcatccgcagtatagaggattgtggagtagacttgcngaaattcttctgggtctgtgcttccatcgt

SEQ ID NO: 6696 - DNA, 101 bp, rice(Oryza sativa)
  misc_feature (71): n=a or g
attatcggcatcctttccgagagggttgtttgcttgagtttcaacttcagggatctcttggtttggttctntccccgactggtttccagtcgggggctcct

SEQ ID NO: 6697 - DNA, 101 bp, rice(Oryza sativa)
  misc_feature (71): n=t or c
ggtcacaaaagtatgtggagtacgtgtcttttcctcttagcaggtgacgggtacctagtacgtatactccnttcgtctcagaaaaaaaggcaaaccctgaa

SEQ ID NO: 6698 - DNA, 101 bp, rice(Oryza sativa)
  misc_feature (71): n=a or g
acagcaaattaagtcgatccgaacaaaagaataaaggagatgaaaaccaaagtaccaacctaaggaagtcntcgccacgtccgccttcacagacaggcttt

SEQ ID NO: 6699 - DNA, 101 bp, rice(Oryza sativa)
  misc_feature (71): n=a or g
taaagcaggagcaggtttaatacctccttcctcctgctccatggtctcctggctgggaagggccccatccncacgaagcttcttcaatgtagcttcatcgg

SEQ ID NO: 6700 - DNA, 101 bp, rice(Oryza sativa)
  misc_feature (71): n=t or c
attttccaataattgcctatattcttgaaagccgcccgcttgagcctgccctcgtcggctgcaggatagcngaagctctccttgaactttagccaagtagt

SEQ ID NO: 6701 - DNA, 101 bp, rice(Oryza sativa)
  misc_feature (71): n=t or c
tgagcgatgattgttttcctgctgagtactgaattttcttttcttgcaacgccgcggtcgtcaggctccangcccggcctgccatgccatcccgtcgaaac

SEQ ID NO: 6702 - DNA, 101 bp, rice(Oryza sativa)
  misc_feature (71): n=t or c
tttaatttgttttctggccttcatgcatatgttgcccattgctgctgccttggcttgcgttagccggacanatacgtgaacatctgtacgtataggtgatt

SEQ ID NO: 6703 - DNA, 101 bp, rice(Oryza sativa)
  misc_feature (71): n=t or c
atcatgcgcacacacaaagttgatactgtgccaaggtttcctcccccctgcctgattaataaaggaatatntgtaatggcaaatacaagtgacagctttga

SEQ ID NO: 6704 - DNA, 101 bp, rice(Oryza sativa)
  misc_feature (71): n=t or c
cctcaccggcgagcagcgcgccggcctcgccagcatcctcagagcctgtccgtgatcgaattaccacacgnatagtagtacacatttttacaagttttttt

SEQ ID NO: 6705 - DNA, 101 bp, rice(Oryza sativa)
  misc_feature (71): n=a or g
aacgatcaccctcgagcgacgtcgagctcaagccacattgacaaggagactgctccgacggttgtcctggnccttagggatggcgaggacaaggttcatga

SEQ ID NO: 6706 - DNA, 101 bp, rice(Oryza sativa)
  misc_feature (71): n=t or c
tgaatacccattatcttctccaggaggaagacctttctaggatgtacaggctcttctccaaaattaaccgnggtctagaacctattgctaacatgtttaaa

SEQ ID NO: 6707 - DNA, 101 bp, rice(Oryza sativa)
  misc_feature (71): n=t or c
agctttgatcgaatggatgctattcttttggatgacatggatcaacaacaaagcagaaaattggtaataantacattaagtggggatcacttgtataggta

SEQ ID NO: 6708 - DNA, 101 bp, rice(Oryza sativa)
  misc_feature (71): n=a or c
ccaatttgttttggtcaatctcctacttttgtgaactatattaaggctgctcataaccctagatttgtttntgtctctagacaaactactaccatagattt

SEQ ID NO: 6709 - DNA, 101 bp, rice(Oryza sativa)
  misc_feature (71): n=a or g
ggtttctcattcctaccattatttcctcatatattgccaatgcgattcttttgggaggagaagaaagcatngtgtatgatcaaatctatctatctattata

SEQ ID NO: 6710 - DNA, 101 bp, rice(Oryza sativa)
  misc_feature (71): n=t or g
acgagtacatcatcgtggggtcggcgaacgtgaaccagcgatccatggacggcggcagggacacggagatngcgatgggcgcgtaccagccgcggcacctg

SEQ ID NO: 6711 - DNA, 101 bp, rice(Oryza sativa)
  misc_feature (71): n=t or c
ctgcttgcggcatgattcccccagcggaacagcatgaagcaaaacggctcaaaacctgccgactcaaaatncacggcgctcacgtcacgagttccgacggt

SEQ ID NO: 6712 - DNA, 101 bp, rice(Oryza sativa)
  misc_feature (71): n=a or g
cccaaaagatacaacttctaagagtgttcacagtagaaggatgtgacgttcagccccatagccaagaactnaatattcggcgccgcattgacagtacgcgg

SEQ ID NO: 6713 - DNA, 101 bp, rice(Oryza sativa)
  misc_feature (71): n=a or g
gggcagcttcgagcgagctcgagttagacaccatgggtggcaagttcacagggcaccgatggtcctcatcnctgagccaacgccgcccctccacagcaggc

SEQ ID NO: 6714 - DNA, 101 bp, rice(Oryza sativa)
  misc_feature (71): n=t or c
tacaactattcagaggtgcgtgaatgcttttggtgtttgcgtttttcctttgaaaaagtccgaataccccnctcaactttagatagaaatccatatagcac

SEQ ID NO: 6715 - DNA, 101 bp, rice(Oryza sativa)
  misc_feature (71): n=a or g
cggcagcgcggaaagggctcagcggcgcaaggaaggaggcagcggcaacaaagcagggaaaggggcatcgntggttcttgacggtagagccgcaggacacg

SEQ ID NO: 6716 - DNA, 101 bp, rice(Oryza sativa)
  misc_feature (71): n=t or g
tcctagccttggtccgtagagttctgacacggtagacagcgtaaaactggtgtgaaaaatggtgttccatngtgaccttttgtctccatgaccatgatgag

SEQ ID NO: 6717 - DNA, 101 bp, rice(Oryza sativa)
  misc_feature (71): n=a or g
gcgcgcaccttccggaacaggagttcgttcggctagtccgacgcgcggatcgctcctgagctcgggttccngcgcccggccggcaatgtgccccttctgct

SEQ ID NO: 6718 - DNA, 101 bp, rice(Oryza sativa)
  misc_feature (71): n=t or c
ggagtcaatctcttgccatcgccaatcacgttaccaccattaggaggacttggaggtggaggttgaaattnattgtggactggatccgggcctgtaggagt

SEQ ID NO: 6719 - DNA, 101 bp, rice(Oryza sativa)
  misc_feature (71): n=a or c
agaagatcgggccatgagagagagagcgtcatcaatttctctcattccaaatattccaagctgccaagagnaaaagttccatgaagcaatgatagggaaaa

SEQ ID NO: 6720 - DNA, 101 bp, rice(Oryza sativa)
  misc_feature (71): n=a or g
caccgtgtcggccatcgtcctgacggcgacggtggggtgccaccttctcaagatcagcggctactcgcagncaaggctggtcgataatggcgaacgcgtcg

SEQ ID NO: 6721 - DNA, 101 bp, rice(Oryza sativa)
  misc_feature (71): n=t or c
gaacctatgatcatttctagtaaaagaaatgggggttttgagtcttgctcaaaagaaaaaagatatgacanattctattatcatgaatctacagtaaccac

SEQ ID NO: 6722 - DNA, 101 bp, rice(Oryza sativa)
  misc_feature (71): n=t or c
ccggtgagcaaagacaaactacaagaggtgtggttgactgtttactgatcctaggcacagaatggacttgngcagtggctgtccataccccacacagcatc

SEQ ID NO: 6723 - DNA, 101 bp, rice(Oryza sativa)
  misc_feature (71): n=t or c
ctcttcatgtgtggtactaatcctacgaaaactacatgatggatcatacgcaacctctacaactaggatangttattacacatacatcttccatgtcgata

SEQ ID NO: 6724 - DNA, 101 bp, rice(Oryza sativa)
  misc_feature (71): n=t or g
tgccaccgacattgtcgtagctcccatgccagatccgccatcgctgaggtcatccacgccgccagatccancctgtcattgtggtcccagcgccggatcca

SEQ ID NO: 6725 - DNA, 101 bp, rice(Oryza sativa)
  misc_feature (71): n=t or c
ctagggtttggtgcgctcccgattgttgcggccatgaggatacgggagctgcgggatggcgccgggggatnggaggaggcggaggaggacgagcgggagga

SEQ ID NO: 6726 - DNA, 101 bp, rice(Oryza sativa)
  misc_feature (71): n=t or c
gttttctgtagtgtgaacttggagttcacttcagtgagctcaactaaatcctcggtggccatgtcatcgtnatcatcattgatcatttgttcattgccttc

SEQ ID NO: 6727 - DNA, 101 bp, rice(Oryza sativa)
  misc_feature (71): n=a or g
aagggaacagcaaataaaattatttagtaaaccgcctcacattgtatataggagtgctagctgactcggtngccttcagtttgtcaagtattcgatagaaa

SEQ ID NO: 6728 - DNA, 101 bp, rice(Oryza sativa)
  misc_feature (71): n=a or g
aaatttctgaaaattcatgaactgaaccactagttatcggcagattcaacagattgaacgcctgcgcgaantggaaatcgcaatctagcaaaatagccata

SEQ ID NO: 6729 - DNA, 101 bp, rice(Oryza sativa)
  misc_feature (71): n=a or g
tcatgggtgcttgaacaaatgccaacccagagcttgacctcaggtacatactcaaccttgccaatgaaggntagcatccattttcccaggtgactccacgt

SEQ ID NO: 6730 - DNA, 101 bp, rice(Oryza sativa)
  misc_feature (71): n=t or c
tgaggtaccaatttaaactaaccattggtttaacaggggtatgattaggctaacaaaaattagttctcttncacgtcgccgtcgcccatcgagcgatgccc

SEQ ID NO: 6731 - DNA, 101 bp, rice(Oryza sativa)
  misc_feature (71): n=t or g
cagtcagggaagtgctccccctgatttgggcacatctctcatccttctcataccgatgccatgcacaagcntctcaaaaacactagttggcaaagacttag

SEQ ID NO: 6732 - DNA, 101 bp, rice(Oryza sativa)
  misc_feature (71): n=t or g
gtttgttgatatacctcttgtgtgtaacttgatgttgtagctaattgatggttgatgttgatgataccaantgtgtaacttgatgttgtagctgctgttgt

SEQ ID NO: 6733 - DNA, 101 bp, rice(Oryza sativa)
  misc_feature (71): n=a or g
gtcgtcggagacctctggaaccgctgtcgaggaaaatcaatctcttccaccggactcccaggcatctgccncccctagggcagccaccgtcaacgggatcc

SEQ ID NO: 6734 - DNA, 101 bp, rice(Oryza sativa)
  misc_feature (71): n=a or c
gcaggccggccgatgatcaatacccgattaccgatggctcgccatcgacgacgttgagatagatatgatcngctaggcgctagctattggcaggaattcag

SEQ ID NO: 6735 - DNA, 101 bp, rice(Oryza sativa)
  misc_feature (71): n=t or g
cctcaaatagcagagggcgggggattcggcgcgctccgtagaacgagtgagaaggatacagtggcgctgcngctcgcccttgggctccatgaggccgcacc

SEQ ID NO: 6736 - DNA, 101 bp, rice(Oryza sativa)
  misc_feature (71): n=t or c
cacgcgccgacggcggtgaacgactccgggtacagcaggtcggtgccgttggtcgtgttcgccgacatggngaatgtcgtcagatcgccggtggagcactc

SEQ ID NO: 6737 - DNA, 101 bp, rice(Oryza sativa)
  misc_feature (71): n=t or c
ctaggcgctaggtgtagcactagccttgctgctcgcgtgtgcctagtgtcggccgtccgcagattcccagngccgccatctgatggcatccccgcgctcct

SEQ ID NO: 6738 - DNA, 101 bp, rice(Oryza sativa)
  misc_feature (71): n=a or g
ctctgcgtgaatgcatgaagaagatctaaatggcaaaacccacctcgcagtggatctgatcaaccaactcntatccctgtggaacgcaacacagggcatcc

SEQ ID NO: 6739 - DNA, 101 bp, rice(Oryza sativa)
  misc_feature (71): n=t or g
ctcacgaatgagtaatgcctcttgcctcctctcaagggttgcatactgatcatcaattctcccaagcaacncactcaagtgtggtagagactccttggtta

SEQ ID NO: 6740 - DNA, 101 bp, rice(Oryza sativa)
  misc_feature (71): n=t or c
ttaagtaactttttttgcggggatcattaagtaactttacaggtcatgtatgctaaaagggttgtagtganctgagtagtaccccaaggttctgagttcaa

SEQ ID NO: 6741 - DNA, 101 bp, rice(Oryza sativa)
  misc_feature (71): n=t or c
ggggagccccaggtcggcgcgcgcgctctcgtcggcggagaactggtacttcatcgacaccgtccggtagntggcgaggcgctggttccggcggtccagcc

SEQ ID NO: 6742 - DNA, 101 bp, rice(Oryza sativa)
  misc_feature (71): n=t or c
caaatttatataaaacagtgcaagcgagttctcaaaagaaaaaaaaggtgcaagcggcatgggcctccatnacaacaggcccacctattatctaaaggccc

SEQ ID NO: 6743 - DNA, 101 bp, rice(Oryza sativa)
  misc_feature (71): n=a or g
gcatagaagtttgggccatgaccctgagatctcaagccatttccagcacataggacttgttcagattgtanccaaaataaatcttatcaaatttgtattta

SEQ ID NO: 6744 - DNA, 101 bp, rice(Oryza sativa)
  misc_feature (71): n=t or g
ccaccacgccacgcttttcacccatcgctactcttcgtcccccctagcaagaacccctgaggcggaatccnccgccgcggcctcctacctcgtcgcctccg

SEQ ID NO: 6745 - DNA, 101 bp, rice(Oryza sativa)
  misc_feature (71): n=t or c
agacggacgagcagatcataattcagatgtcattttcttgttgtaatcaccgcttacaccacaaccacacnccggccatgacgtgtcactttccaaagtca

SEQ ID NO: 6746 - DNA, 101 bp, rice(Oryza sativa)
  misc_feature (71): n=a or c
gccggccagcgggtagaagcgggccagtgcgcgagcgaacgacgagacaaggtgttcgacgacgtgctcanctccgccgggaggcttgggcaggacgacgc

SEQ ID NO: 6747 - DNA, 101 bp, rice(Oryza sativa)
  misc_feature (71): n=t or g
ggttaccatctgcagatacgtgcagatttattagaaaacctcctgtattttgatatgactatctgctgagntggatctttagtaagaaagaatccatgttg

SEQ ID NO: 6748 - DNA, 101 bp, rice(Oryza sativa)
  misc_feature (71): n=t or c
gcagtagccgtgcaactccttgcatgcagggcccatcttcactaacacgtcatctctgaccaatggcatgnctaatgtgaattctgtcggaggcttaggat

SEQ ID NO: 6749 - DNA, 101 bp, rice(Oryza sativa)
  misc_feature (71): n=a or c
ctacaatacctacaaatatcctagagatgagcgtaggaaatatctttggatatgtttgggagagtttttancagctgcagcttcttccataaacagaaact

SEQ ID NO: 6750 - DNA, 101 bp, rice(Oryza sativa)
  misc_feature (71): n=t or c
cctcctcctgcccctacttcatcgcctgttagaatgtcagggcctcctcccccacctcctccacctgcacnaaactcgtgtcccagtagacctgcaccacc

SEQ ID NO: 6751 - DNA, 101 bp, rice(Oryza sativa)
  misc_feature (71): n=t or c
ttcatcatgaactccacgccggcgagaggtagcatgcagcagcaggccgacctgtgcttcgggttctcgtngacatcatccgcgctcaccgctgtctcccc

SEQ ID NO: 6752 - DNA, 101 bp, rice(Oryza sativa)
  misc_feature (71): n=a or g
aaatggtggcatgaaagaatcctccaatggtcttgcacacatggcctgtactgaatcatttttatataggnatgatgcatagaggtgctgatactgctgac

SEQ ID NO: 6753 - DNA, 101 bp, rice(Oryza sativa)
  misc_feature (71): n=t or c
cctcatcatcacctttccacaccaaagtcggagctcctatccccgccattggagtcggagctcccgtcgcnggagcagagaggtgcagggccgcggggcga

SEQ ID NO: 6754 - DNA, 101 bp, rice(Oryza sativa)
  misc_feature (71): n=t or c
tagagcatgtactccgacagggtctcgctgatggacatcaagccgttggtgtcgtgcatccgaggcccttnccgctctcggtgacagcataggtcagtggc

SEQ ID NO: 6755 - DNA, 101 bp, rice(Oryza sativa)
  misc_feature (71): n=t or c
tatagttctcacgcctttatcctgggtgtaaccatatctagctcactcgctcgtggctatatcaacaatancctattatctaccacctagaacgatgtcga

SEQ ID NO: 6756 - DNA, 101 bp, rice(Oryza sativa)
  misc_feature (71): n=t or g
ttggacatatatttgaggtggccaaagtagacttgttccaaaaatttataggctcataatttacgcctgtnttgggccaaatccaggccttacaaagcagg

SEQ ID NO: 6757 - DNA, 101 bp, rice(Oryza sativa)
  misc_feature (71): n=a or c
agcaggatggttgaatctttaaataaaggagaaatgaaataaacatactcttccacatcctttttgttggngaccaggtccatctttgaaagaatgttgat

SEQ ID NO: 6758 - DNA, 101 bp, rice(Oryza sativa)
  misc_feature (71): n=t or g
ataggagaagaagaaccttcatgcatcttgcagtgtgacgcataaaaactaaattaaactcctaccacacncatgctgaatggagctcatatatatggact

SEQ ID NO: 6759 - DNA, 101 bp, rice(Oryza sativa)
  misc_feature (71): n=a or g
cgatgcatcgctcaagctcatcagctccctctccctcacctccatcctctcctcatcgaggaacctggccnccgaccgtcttctctctctaggcgtgacgc

SEQ ID NO: 6760 - DNA, 101 bp, rice(Oryza sativa)
  misc_feature (71): n=t or g
ttgcaggttcctgaagaccggcgccaagcaggagccggatttgcggtaaattgtgcacggcgacgacgcgntcgccgctcctcgtcgcctggttgagcgcc

SEQ ID NO: 6761 - DNA, 101 bp, rice(Oryza sativa)
  misc_feature (71): n=t or c
tctgtaattaccactacgcgcgtatgtacacgtcgaccggcagggacggcatgggatgcagccaagcaggngcgcctggatccatgcccgaatgccgcatt

SEQ ID NO: 6762 - DNA, 101 bp, rice(Oryza sativa)
  misc_feature (71): n=a or g
ttattccatctatactatgctgttatgaacaacagtgcagtgaacaatatatacatgtcgaacttcaccanctcaactattatactcacttcgttacaaaa

SEQ ID NO: 6763 - DNA, 101 bp, rice(Oryza sativa)
  misc_feature (71): n=t or c
tctgcttcctcttcggctgccatctccactcctgcttcactctcctttcgtcttgcaaccttttcctttgngaccttcttcagtggcattcgctctcagtg

SEQ ID NO: 6764 - DNA, 101 bp, rice(Oryza sativa)
  misc_feature (71): n=t or c
ggccggagctgcatgacctcacccccccgcgccgccgattcctcctgttgcgtcgccgcattgatcttcangagttggcgctggcaacggcgagttcgcag

SEQ ID NO: 6765 - DNA, 101 bp, rice(Oryza sativa)
  misc_feature (71): n=a or g
gtgcgtggcgctggatgttggagtgctgctgcgccgtccactgatgacgctgagaaacggcctcggtggcngtggcaattacgtgagtagtggccgccgga

SEQ ID NO: 6766 - DNA, 101 bp, rice(Oryza sativa)
  misc_feature (71): n=a or g
ttccttgtggtgaagatcttcttcgatcatgcggaggcgaaggccatacccatctagtcgctctaaggcanacttcttggcacttagatgcgcggcaaggc

SEQ ID NO: 6767 - DNA, 101 bp, rice(Oryza sativa)
  misc_feature (71): n=t or c
aaacttgacgcggggatgcacggcttcaccgtcagcgagaccggattcggctaccacgagttcatcggcgnggaggtcctggagaagctggggtacgtcag

SEQ ID NO: 6768 - DNA, 101 bp, rice(Oryza sativa)
  misc_feature (71): n=t or g
ccgccgccagcccccacgccgccagttgccgccggatctcgccggaaatgatgcgaggatgggaggagganaagtttaggggtagttcggcatttctatgt

SEQ ID NO: 6769 - DNA, 101 bp, rice(Oryza sativa)
  misc_feature (71): n=t or g
gctcacattgagctcaacaatggaggccaagggagtggtggtgatcacccttgtggtcacacttgcggcgnttgcgagggcggcccgcccagaagaaacca

SEQ ID NO: 6770 - DNA, 101 bp, rice(Oryza sativa)
  misc_feature (71): n=a or c
agaggtccacccaggcgacggtgccaccctcgccgccgaccgtgatggtcttccctgtctcgtggtacagnctgtcgacagaggcaggtatagggataaac

SEQ ID NO: 6771 - DNA, 101 bp, rice(Oryza sativa)
  misc_feature (71): n=t or c
aggctctcgacggcgacggcgacggccgcgagcatccacccatataggccgtgcaagaactccgccgccanttgcagccatggcgcggaggcttccatcgc

SEQ ID NO: 6772 - DNA, 101 bp, rice(Oryza sativa)
  misc_feature (71): n=t or c
ttcattgcctggctcgtgaatcgtgattttgtcctgctggcctcctctggggttgatgggaacagctccangtaccttgtcccaatggtcatcttgtcctt

SEQ ID NO: 6773 - DNA, 101 bp, rice(Oryza sativa)
  misc_feature (71): n=a or g
tcagccccagcttctccctgatctgcttctcttcctcctttttaatctccttcttcttctcatcctttttnatcttcttcttcttcttcttctccactgcg

SEQ ID NO: 6774 - DNA, 101 bp, rice(Oryza sativa)
  misc_feature (71): n=t or c
gagtggaagatcaccatctccatggatcttccacctctcgctgtccggagacctgctcccactgaccatgnagccgatgaggtgcttcccggccattggcc

SEQ ID NO: 6775 - DNA, 101 bp, rice(Oryza sativa)
  misc_feature (71): n=a or g
ctctatctcctttctctcttctcatctctctctatattctctctcctcatctatctcagaggcgcacgggncggcgtcggtcgcggcggagatagcgagga

SEQ ID NO: 6776 - DNA, 101 bp, rice(Oryza sativa)
  misc_feature (71): n=t or g
atcgatcgccatgccgcctcaggagttgcatggcgatgatcatggccgccaccaccaccaccagacacccnctggcagcggcgggggcggcgccggtgacg

SEQ ID NO: 6777 - DNA, 101 bp, rice(Oryza sativa)
  misc_feature (71): n=a or g
aattattacgatttaaaagggaattatgatgtcatcgacgacatcatcgcagccatggcactggacaacanctccgccggcgatagagagctcgggcggct

SEQ ID NO: 6778 - DNA, 101 bp, rice(Oryza sativa)
  misc_feature (71): n=a or g
gtagggcgatatgacgctgcgcgaggaggccacattgaaggtcttgaaggtggtcgcgaccctgggcaagnccatctccaccggggcgatcgccgccgtgg

SEQ ID NO: 6779 - DNA, 101 bp, rice(Oryza sativa)
  misc_feature (71): n=a or g
cgcgctgctgctggcggcgagggactcggactacgtgcgcaaggtgtacggcggctacctggaggtgttcntccgggcgttcggcgacgatggcgatgtcg

SEQ ID NO: 6780 - DNA, 101 bp, rice(Oryza sativa)
  misc_feature (71): n=a or g
tttttacctgtggcagtgggacgccgttgagaacaagtccaccgtcctcacgtacgccggcggcgccatcntcgccctctggctgtcgtccgtcatcgtcg

SEQ ID NO: 6781 - DNA, 101 bp, rice(Oryza sativa)
  misc_feature (71): n=t or c
cagatggacgtgatagtgtggagcggagggatcgggagggcggtgtacacggattacctcgtcgtcacggngggctccggccagatggatctgctggtggc

SEQ ID NO: 6782 - DNA, 101 bp, rice(Oryza sativa)
  misc_feature (71): n=t or c
tcaggcggctccacctcgccacccgacgtcgcctccttgacctctccatcggccctcgttgtatgcaggcngctgtgtgcaccaagggtcgtctcctcacc

SEQ ID NO: 6783 - DNA, 101 bp, rice(Oryza sativa)
  misc_feature (71): n=t or c
taactccttgtaatcgttttactcgtagccgatcacttataaatatcgtttttgcagaaaaagaagactgntgtgagaaagaaatcggcaacaacacttaa

SEQ ID NO: 6784 - DNA, 101 bp, rice(Oryza sativa)
  misc_feature (71): n=t or c
cttccaaatctcccaggagagtaggattagaatcgatttgacccccttccttttctccttagccgttgccngaactgtttggacccaccagtcctccagga

SEQ ID NO: 6785 - DNA, 101 bp, rice(Oryza sativa)
  misc_feature (71): n=a or c
cttgggcttgaatctgaactagcacttgagcttgaccttggacttgatgactgtggacttggaggatgatnttccacttcatgagtaccttgcatatgtgg

SEQ ID NO: 6786 - DNA, 101 bp, rice(Oryza sativa)
  misc_feature (71): n=t or c
gccgttgcctctgccgcagcctaacccaaacaacccgcaacctctgccgcagccagaccctaacgcgccancactacctctgccgcagccagacccaaacg

SEQ ID NO: 6787 - DNA, 101 bp, rice(Oryza sativa)
  misc_feature (71): n=a or g
cgcagcgaccgccgacgacattgccgggattactacccggcttgccgttcccgctgttcccgttcctgatnttcccgatccctggctcgccggccggcgcc

SEQ ID NO: 6788 - DNA, 101 bp, rice(Oryza sativa)
  misc_feature (71): n=t or c
ggggttgacgaccaccggcaccagcatggacgccgtcccggtgcacaggaagtagtccttgccgaacttcntgtacatctcccccgggctgcacaggtaca

SEQ ID NO: 6789 - DNA, 101 bp, rice(Oryza sativa)
  misc_feature (71): n=t or c
ggccatcaaggacgaggacgcggcgatggcgttcgtcaagcagctcaggtcattaggcaaccaggaccacncggtgcacgtaccaaagcaggtggacgagc

SEQ ID NO: 6790 - DNA, 101 bp, rice(Oryza sativa)
  misc_feature (71): n=t or c
ctcactgaacctgacattgtcgacgacggcgatgtcggtgacatccaccgtgcactccatctgccaatccncccatgaaccaactggtatcggcatgctcc

SEQ ID NO: 6791 - DNA, 101 bp, rice(Oryza sativa)
  misc_feature (71): n=a or c
tgtagatgtctcgtgctagctgctagatgtgctatgtgtaggacagtaggagtacaactctgaacatgctntgctaattcgatctaggcctgcctagttct

SEQ ID NO: 6792 - DNA, 101 bp, rice(Oryza sativa)
  misc_feature (71): n=t or c
agttcctttcctaatgcagtgatgccactttttggaatgattgttttgctactttatttgtctatcactcnacctgtctagttcagtacaaaatgaaattt

SEQ ID NO: 6793 - DNA, 101 bp, rice(Oryza sativa)
  misc_feature (71): n=a or g
gacccattggagaaagacgttgcccgtatatacactgcagtcgtgttcaagacaatccgtgcacagatacngctaattgcaggacttgaagtcatcagtgg

SEQ ID NO: 6794 - DNA, 101 bp, rice(Oryza sativa)
  misc_feature (71): n=a or g
aggtctagttccatcgatggagcacacacgtcgctggtgcctcggtccttagtcgttgccgccatccttcnagcacctagcgaggagcttcagatctagag

SEQ ID NO: 6795 - DNA, 101 bp, rice(Oryza sativa)
  misc_feature (71): n=a or g
ctgtatgctgaacatagcacaagacaacaaatacagcaggctaggagcaccctcagcaacctgagcatccnaacccgatctgtctatgccattgatctccc

SEQ ID NO: 6796 - DNA, 101 bp, rice(Oryza sativa)
  misc_feature (71): n=t or c
gtcactgttagccctagattttggaccactgtcatcccaaatcgtattagttctttggtcatgatgtgtanctgcatttagattgatatgtaaccattaga

SEQ ID NO: 6797 - DNA, 101 bp, rice(Oryza sativa)
  misc_feature (71): n=t or c
catgacgcattgcaatttgagttggaagccttggaggatgatcttcgagagtacggagtgtacgccgaagntgtcaatgttgtctttgatgtagaggagtt

SEQ ID NO: 6798 - DNA, 101 bp, rice(Oryza sativa)
  misc_feature (71): n=t or c
ttttttaatacaacataataattgtttatgggacaccgattctaatgcaaacaactcattcattttcaacnaattagattttttttcaaaaaaaaggggca

SEQ ID NO: 6799 - DNA, 101 bp, rice(Oryza sativa)
  misc_feature (71): n=t or c
tttaactttgcttgcataagtgttagccgactcataacttgactaattctctcttttgactcgcagacaanagaatcctcccctcctcaccagagcaatag

SEQ ID NO: 6800 - DNA, 101 bp, rice(Oryza sativa)
  misc_feature (71): n=t or g
ggcggcgtcgctgtactcctcgctctctctcccactacacctgccttacacctactacgcggcggcggcgncggcgtcggctccggcgacggcgacgcctc

SEQ ID NO: 6801 - DNA, 101 bp, rice(Oryza sativa)
  misc_feature (71): n=a or g
cgacttgacggactgggtaaggatgctagcaagggaggagcgcgtttcggagtgctacgacaggcggatcntggaagctcatggctcaggtggcgccccaa

SEQ ID NO: 6802 - DNA, 101 bp, rice(Oryza sativa)
  misc_feature (71): n=a or g
gaggatggatgggagtggaatgtcggggagaagggagaagagaggggcgggttgcgtgcttggctttggcngcgcttatataggtaccgggtgagctgatg

SEQ ID NO: 6803 - DNA, 101 bp, rice(Oryza sativa)
  misc_feature (71): n=a or c
atatacaaccccagcgcatgcatgtgcgtgctcgcctgctcgcttttgttattttagagggacgtgacatntgtgactatcaatctggacatgagactatc

SEQ ID NO: 6804 - DNA, 101 bp, rice(Oryza sativa)
  misc_feature (71): n=a or g
cagaggcttgcccaacggatccacatgccctttatatcgccagactcaagagacagctctccacctgctancggaatatagatacacaagaagaatttgga

SEQ ID NO: 6805 - DNA, 101 bp, rice(Oryza sativa)
  misc_feature (71): n=a or g
cttgaaagcagctcgcactcaccggtccaggggaccgagtcatactatccccaaaaacccaccacctgctntcaagtactcctcttaggagggtataccaa

SEQ ID NO: 6806 - DNA, 101 bp, rice(Oryza sativa)
  misc_feature (71): n=t or c
taacttcgattacttggcacttacaggtgtttgctgctgcatggaagtactatctggtggactcggggtanccaaaccggattggttacctggcgccctac

SEQ ID NO: 6807 - DNA, 101 bp, rice(Oryza sativa)
  misc_feature (71): n=t or g
aaagaaaaaactcattttaaatttttgttaaaaatcggtttgctactttagtactccatccggttttcagnagatcacacttttgacttttagacatatgt

SEQ ID NO: 6808 - DNA, 101 bp, rice(Oryza sativa)
  misc_feature (71): n=t or c
cattgcagatgaggggaaacaggaggaggagtccaagattcgggcggaggaggccagccaccgcaaatggngccccgaccacttcgtcgacgacgatgacg

SEQ ID NO: 6809 - DNA, 101 bp, rice(Oryza sativa)
  misc_feature (71): n=t or c
gtcatcattatttgtctgatgttgccactcatttctttcaagaatttctatccaacgttcctgtgaaatgngatacttcaataatcgaccaacacttttgg

SEQ ID NO: 6810 - DNA, 101 bp, rice(Oryza sativa)
  misc_feature (71): n=a or g
atcagttgggaacacacacgtcggccgtctcgtctcgcgccattttttttgatgggctcgaggggcggcgncgccgacgcgtgggagacggcgagcgcgcg

SEQ ID NO: 6811 - DNA, 101 bp, rice(Oryza sativa)
  misc_feature (71): n=a or g
actcaaccatggatcatgccatggtaaaggacgataacctaaggtcatctcagctttgtaccatggaattnccgctctccaaggtgatactggtggagagc

SEQ ID NO: 6812 - DNA, 101 bp, rice(Oryza sativa)
  misc_feature (71): n=a or g
aggatggaacccccaaattgattatagttactcacaagcgtactagtgctctatactgctgaactgaaagnaactaggactccctccgtccctaaatattt

SEQ ID NO: 6813 - DNA, 101 bp, rice(Oryza sativa)
  misc_feature (71): n=a or g
acatgaaatgcatttcattcttgtatgaacatcatcttttaacataaacaagctgagaaatcacctttgcnatcttaacaagttgatcatggttgtcatga

SEQ ID NO: 6814 - DNA, 101 bp, rice(Oryza sativa)
  misc_feature (71): n=t or c
aatattggtaagtcttgcaaatatatgtgcattcctgtcattttttacccaagattcaaattcaagtttgnggaatttcggcttgggcaagcctttggtga

SEQ ID NO: 6815 - DNA, 101 bp, rice(Oryza sativa)
  misc_feature (71): n=a or g
gttgtctgctatcgtgcattgcagacgtatgggattttcttggacagttgggccaacaaattaccatcggntctttcaacatgaaaatctgaacaagggcc

SEQ ID NO: 6816 - DNA, 101 bp, rice(Oryza sativa)
  misc_feature (71): n=a or c
ttcatgttacagtactgtactttgaaaatgcctgctgtttagttattccttataactttcctaatttcagnaatgatggtactataacataccaagcacaa

SEQ ID NO: 6817 - DNA, 101 bp, rice(Oryza sativa)
  misc_feature (71): n=a or c
tatgtgtcaggtttagtagatgcgattagccaggcagcagcagcaggtggtggtggctgcgacgatggagnatgacgtgcaccaccaccggcagatgatgc

SEQ ID NO: 6818 - DNA, 101 bp, rice(Oryza sativa)
  misc_feature (71): n=a or g
gtgtataatcagaatgggagagcgtttttggaatttacaatggaaaagatcggcagaggttagggtccacnggcaccctgagagaataaggataatatctc

SEQ ID NO: 6819 - DNA, 101 bp, rice(Oryza sativa)
  misc_feature (71): n=a or g
ctccacatcatgtgcctccaagaagcggatcacctcgagcgacgaggtgcctgtcaaggagataccccttngcggtgacccgtccaagaccgccaaggttg

SEQ ID NO: 6820 - DNA, 101 bp, rice(Oryza sativa)
  misc_feature (71): n=a or c
ttacatcaggaaatttgtattggtgtttttcgatgatattttgatatacagtaacaacaaagaggaacatntgggacatattaggttggtgatgcaagctt

SEQ ID NO: 6821 - DNA, 101 bp, rice(Oryza sativa)
  misc_feature (71): n=a or g
aagatgtttgagaaaagttcatgggttcattctcatctaatccgtaaaggattcatggagaagtacaaatnttggagcaagcatggagagcaagagtcacc

SEQ ID NO: 6822 - DNA, 101 bp, rice(Oryza sativa)
  misc_feature (71): n=a or g
aaagcaataacccgcaaaaggaagacaaaaggcggatattaagtgatatctcccaaagttccaaactcctncagggttacagcccctgctttgatccatgc

SEQ ID NO: 6823 - DNA, 101 bp, rice(Oryza sativa)
  misc_feature (71): n=a or g
gtcaactagtgcctaaccctatttagcgccaacgaccgtttgagatagagcaaaatgaagggggccttaangaatgtgagatggtaagaaggcgagagcag

SEQ ID NO: 6824 - DNA, 101 bp, rice(Oryza sativa)
  misc_feature (71): n=a or c
cgagtacctccccgctgcaatgggccgatgatgacaccctctccagatattgactctaggccgatgataantctgagcttatcaaattttggcgttaacag

SEQ ID NO: 6825 - DNA, 101 bp, rice(Oryza sativa)
  misc_feature (71): n=a or c
acttccagttcctcggggtcagcttgtagaacctccccgtactggtagggccgctgctgccagacgcaggnagcatctccgccgaccgccgtcatgccctg

SEQ ID NO: 6826 - DNA, 101 bp, rice(Oryza sativa)
  misc_feature (71): n=t or c
cccattatacttttggcctatctatcaaatacatggtaaatttacacgtgtcaacatgggttttatccacngggccacgggccatgacccaggtggcccgt

SEQ ID NO: 6827 - DNA, 101 bp, rice(Oryza sativa)
  misc_feature (71): n=a or g
tagaaccggcgacgacggcgccgaagagatcctcgacttcgtctcctccctcgctggcgatccttcccccnactgcgcggccatggaattctcctgctcct

SEQ ID NO: 6828 - DNA, 101 bp, rice(Oryza sativa)
  misc_feature (71): n=t or g
cagcgcgtcgaagatgcccacggcgaactccttcgagtcctccatccctgcaccaatgccggcgccgtacnccgtgtcatcgcgtgatcgcgcccgcgcgc

SEQ ID NO: 6829 - DNA, 101 bp, rice(Oryza sativa)
  misc_feature (71): n=a or g
gctgggcgatgtcctcaagaagatcaacgatctggttgaagagatgaacaagtttggcctgatggagcacncagaggcgccacagcttccttatcggctaa

SEQ ID NO: 6830 - DNA, 101 bp, rice(Oryza sativa)
  misc_feature (71): n=a or c
ccgcgccatgaacccgggcctcgtctacgacctcgccgccgtcgactacctcaacttcctctgctccctcngctacaacgccaccgtcatggccatgttcg

SEQ ID NO: 6831 - DNA, 101 bp, rice(Oryza sativa)
  misc_feature (71): n=a or g
aaggaaatttactaggatagcaggagcagttggttgtatttcttccttaatatggtgacttcccatagccnatggagttcggtcacttgatgattgttgta

SEQ ID NO: 6832 - DNA, 101 bp, rice(Oryza sativa)
  misc_feature (71): n=a or g
gtgaagatggagatggagatgcggggggaagagggggaaaggggaggggtaggggtagaggtagaggtatnggcagtggcataggtcgtggaaatggtcaa

SEQ ID NO: 6833 - DNA, 101 bp, rice(Oryza sativa)
  misc_feature (71): n=a or g
tcgccgttctgctgccgcttgacaccaatgacaaacttcaccgaggagtagccagtggagtaggacggccnccatggatcccacctctggccgagcctgtc

SEQ ID NO: 6834 - DNA, 101 bp, rice(Oryza sativa)
  misc_feature (71): n=t or c
aaagggtgcatttatgggtgcacgcgtgtgaagaaagagactccggtagcgacaaatatcatgctaatctngtagctgatgattaccgcgcacagttggcc

SEQ ID NO: 6835 - DNA, 101 bp, rice(Oryza sativa)
  misc_feature (71): n=t or c
cgtggactccggcgtcaccttctacgggatggaggggatcggcaggagcttcgaggaggagctcctcaagnccttcgacaggcagctcatcgccttccgcg

SEQ ID NO: 6836 - DNA, 101 bp, rice(Oryza sativa)
  misc_feature (71): n=a or g
ggtatactccgagacgtcgtcctccaccgacgcacacagctccgtcattgcggccatcatcccgcattcanatccagtaggcctcttccccaactcgttgg

SEQ ID NO: 6837 - DNA, 101 bp, rice(Oryza sativa)
  misc_feature (71): n=a or g
gctagagtggcgggataatactgcgtgacaaagtgatttggcccaaatttaaaaaatacttttcggaaatntctattaataaaattttaaaaaataaaaag

SEQ ID NO: 6838 - DNA, 101 bp, rice(Oryza sativa)
  misc_feature (71): n=a or g
gaagtcgtctacagactctccttccttcatgcggatcagctcgaactccttgcgtagggactgcgccttcncctcgcgcacacgctcaacgcccatgcgca

SEQ ID NO: 6839 - DNA, 101 bp, rice(Oryza sativa)
  misc_feature (71): n=a or g
gtcgtcgtcgccgcaccggacgacgatgtggccgccgatcgggaggaggaggaggaacagaagaagaggangcggaggaaggagaagaagaagaggaggag

SEQ ID NO: 6840 - DNA, 101 bp, rice(Oryza sativa)
  misc_feature (71): n=t or c
tgtcaaagagttaacttagtataagcattaagtggtagcgtggagcagtataagtgcaactacgaatatangatgtttaagactaagttaatactttctca

SEQ ID NO: 6841 - DNA, 101 bp, rice(Oryza sativa)
  misc_feature (71): n=t or g
ggtgtgtccagggagtgcaccgatgagatacgagaggctgccgcgtcggtcatgttcgccgccggttggtncagcgaattgccggagttgctgttcgcgcg

SEQ ID NO: 6842 - DNA, 101 bp, rice(Oryza sativa)
  misc_feature (71): n=a or g
taggtatctgggagagaggaagcagtttggggcgccattggcggcgttccagctaaaccaggagaagctcntgtggctcctcggctggcgtctctacgagc

SEQ ID NO: 6843 - DNA, 101 bp, rice(Oryza sativa)
  misc_feature (71): n=a or c
gcgtaaatgccgtagagctccccgttggcgcatagcgtttccgggagcggaccggagaggttgttgttggngataccgatgctgctgagcggtgagtgctt

SEQ ID NO: 6844 - DNA, 101 bp, rice(Oryza sativa)
  misc_feature (71): n=t or c
gtggaggggcttaaatacaaaattctcatcaacgtagatggccacatcaccgtcagagctacatcatctanatttgaaatcttgggtgataaaccaagatt

SEQ ID NO: 6845 - DNA, 101 bp, rice(Oryza sativa)
  misc_feature (71): n=a or g
ggtgaggccggcatcagaggcgtcagggagaggatgtcatggcaccggctaggcggcagggatagggttcntggcgacatgcagcaaggacgggaaagacg

SEQ ID NO: 6846 - DNA, 101 bp, rice(Oryza sativa)
  misc_feature (71): n=a or g
tgggttcagcggcgcaagcgcggcacagatgttggggaaaaaggcaggcgaggcgaggtgtcatgcgcctncagcctggacagcgttagcgtggggccgtg

SEQ ID NO: 6847 - DNA, 101 bp, rice(Oryza sativa)
  misc_feature (71): n=a or g
gggccggagattgcgatagccaatttaattttaagcgcaccaaatgaactcaagtctgaagatcccacctntcatagacacactatgttttgaagtccgtg

SEQ ID NO: 6848 - DNA, 101 bp, rice(Oryza sativa)
  misc_feature (71): n=t or g
ggagagtcattttggctggccaaccatgggccccaccactcctaccatctctctctttgcccaaatagcanaggaccatggcagcggtggtgttgcagtag

SEQ ID NO: 6849 - DNA, 101 bp, rice(Oryza sativa)
  misc_feature (71): n=t or c
aaataaaacagatcatgatgacagcgcaaacgctgcagtctatcaggagggtgctcagggctttctgtagnagcaacccaatctctagcatttggcctaag

SEQ ID NO: 6850 - DNA, 101 bp, rice(Oryza sativa)
  misc_feature (71): n=t or g
ttactactattcacaactgtgagattaattatggtgtgtgtgttttggataatttaacaggcaatcgcganaaagtgtcacacctttggagattaccaagt

SEQ ID NO: 6851 - DNA, 101 bp, rice(Oryza sativa)
  misc_feature (71): n=a or g
tcaacaagtaaaagctcatatgggaagatggaggagatggagaaagggcaacctcttggaggagtttactnttgcgccgtttggaacaaaggaattcgtga

SEQ ID NO: 6852 - DNA, 101 bp, rice(Oryza sativa)
  misc_feature (71): n=t or c
gcccctttacctgcatcagatgtggccttttgaacgatacatgtccattctaaaaagctacgtatggaacngcgcccacccagagggatccatgatagagg

SEQ ID NO: 6853 - DNA, 101 bp, rice(Oryza sativa)
  misc_feature (71): n=t or c
ggacccaggtacattgccagggctgagtccgctgccttcatgtcttccttgtcgaggccgaacagctgcgngagggcatcaatggcgtcttgcggcagagg

SEQ ID NO: 6854 - DNA, 101 bp, rice(Oryza sativa)
  misc_feature (71): n=a or g
gatgcaagtcgacgacgccgatcccacaaagtttgtcctgctagggggcgatctaggcgaagaggaagctnaggatatcctgaaggtgctcaagaagaaca

SEQ ID NO: 6855 - DNA, 101 bp, rice(Oryza sativa)
  misc_feature (71): n=a or g
gtgatctcgaaggaaaaatgcgcgatgcttatcggatgcacttacgttgatagcatcatcacgttcggccncccccttttcacaaaggggcgtggggatgt

SEQ ID NO: 6856 - DNA, 101 bp, rice(Oryza sativa)
  misc_feature (71): n=t or c
gccttcgcattgctcgttgtcctccaccaatccaccaattgccagcctttgccttgctggctgcaccctcngccagatccaccgtcgccatggacactgct

SEQ ID NO: 6857 - DNA, 101 bp, rice(Oryza sativa)
  misc_feature (71): n=t or c
aacattcgagaacccttatcggaattgctagattagggggaaaactttcaattttagaccattagatttgntttaagattcgtgctagcaaataggagaaa

SEQ ID NO: 6858 - DNA, 101 bp, rice(Oryza sativa)
  misc_feature (71): n=t or c
agaggggtggatccggcgatggcatggcaaagaggaggcggcagggaggttgagcgcagccacatgagganggatgatgaggacattactcctttggatac

SEQ ID NO: 6859 - DNA, 101 bp, rice(Oryza sativa)
  misc_feature (71): n=a or c
acgtctatctctggacatctttgggctcagccatcagctagcttgggcttttttgggtccttgtgttttgngagtctccctctctctctcacgtgccaaac

SEQ ID NO: 6860 - DNA, 101 bp, rice(Oryza sativa)
  misc_feature (71): n=a or g
gccgcaccacgtgcgagtcagcgcctgggacaagcgcaacctctccgaggaccagttcaagtacgcctgcnccgacgcgttcgcgtccagggaggtcggcc

SEQ ID NO: 6861 - DNA, 101 bp, rice(Oryza sativa)
  misc_feature (71): n=t or c
gccgcctcccgtcggtcactctcgtgcactggaaagagatgggggaagagaagggaaagaggaagaggagntgaggctgttgtcgatggctgtggtggaga

SEQ ID NO: 6862 - DNA, 101 bp, rice(Oryza sativa)
  misc_feature (71): n=a or g
aggccgatggaacaccatcgccgtgagaccgatcctcgacttcaccgccaacgtgctggacgatgacgacnacttcctcttccacgctgcggaggagccgg

SEQ ID NO: 6863 - DNA, 101 bp, rice(Oryza sativa)
  misc_feature (71): n=t or c
tacgacgggtgcaagcgggagcgtgcgttggcggtcatgtacaaccgcgtggcctccgtcctagcgaaccntggcgtggcgcgtcggcggttgaccagcgc

SEQ ID NO: 6864 - DNA, 101 bp, rice(Oryza sativa)
  misc_feature (71): n=a or g
ttgtaatttttcctttttattaatactactttatcgttttttttctcgttttaggcatcaacatggtagtncgtacataagtgggccagacaggcgtaagc

SEQ ID NO: 6865 - DNA, 101 bp, rice(Oryza sativa)
  misc_feature (71): n=a or g
tgaaaacactttccccggtctaaaccctacaggaccagctagcgtgctgccatgtcccccgccgtaggccntggcaacccgccgtcgcggtcagcctcctc

SEQ ID NO: 6866 - DNA, 101 bp, rice(Oryza sativa)
  misc_feature (71): n=a or g
aaaaactaaaaaaataaaaaaaaaacaacattgtatttcaccttgtatttagaacaacatcgtttgttgangaaatttagaacaacattgatctatgttgt

SEQ ID NO: 6867 - DNA, 101 bp, rice(Oryza sativa)
  misc_feature (71): n=t or c
ggtttaaatgggtccttatccgcttccagggattggaccaccatgggggttttcaacggatgacatttatncatattgaacttaccaaggaccctcttggt

SEQ ID NO: 6868 - DNA, 101 bp, rice(Oryza sativa)
  misc_feature (71): n=t or c
gcggagatgacggctatcagcgtgacgtagtccggctcgacaccgtccagaagcatggcgcggaagcagtngatggcctcgtcgtggcgcccgttcttgac

SEQ ID NO: 6869 - DNA, 101 bp, rice(Oryza sativa)
  misc_feature (71): n=t or c
tgcacgacgcagcctcgctgcagcagcttcttgatgaggcacgtcgcgatgtagccgctggctcctgtgangcacaccctgctgctgctgctgctcgtcat

SEQ ID NO: 6870 - DNA, 101 bp, rice(Oryza sativa)
  misc_feature (71): n=a or g
actagtgaatttccgggcgtgacaactgtgaactcatacaatctatagcatgttgaaaacgcagtcttggntatatccccggtcttaattttcaattggtg

SEQ ID NO: 6871 - DNA, 101 bp, rice(Oryza sativa)
  misc_feature (71): n=a or g
acaaatcaccaaaaacttccttagcagtgcgaaagtttcctccctcacaaagagaagaaattataattctntaagattctaaatgtggcaaataaccactt

SEQ ID NO: 6872 - DNA, 101 bp, rice(Oryza sativa)
  misc_feature (71): n=t or c
gttcccaaagccggcagcctcctccttaccgccggtggcctcaccctcccttgttgtttcatcctcctcgncgtagggcaacacgaggaggtcgtccacgg

SEQ ID NO: 6873 - DNA, 101 bp, rice(Oryza sativa)
  misc_feature (71): n=t or c
gtcggtggcgcgggctcccctggggccagcttgaggacgccggagccagtggcgatgaagtcgagactgcngaaggagaacctggttcctggagcatagcg

SEQ ID NO: 6874 - DNA, 101 bp, rice(Oryza sativa)
  misc_feature (71): n=a or c
tcgtgtgcatctaattcctgggctaagctcgtaacaaaatcatgaaggttaaaaggatgcaatatagtganccaggcatactgctcaaacatgctagtgat

SEQ ID NO: 6875 - DNA, 101 bp, rice(Oryza sativa)
  misc_feature (71): n=a or g
cacttatggcagaattagttagttactacatagtctgctactcaataaatggaaagtatctactccctccntttcacaatgtaagtcattctagcattttc

SEQ ID NO: 6876 - DNA, 101 bp, rice(Oryza sativa)
  misc_feature (71): n=a or c
cgcacaacctcccaccgcaacgtcatctcgttgccgatgttgacgtcgacggagacgccgtggtggcgagncaggaaaccctggttccctcgcaggtagcg

SEQ ID NO: 6877 - DNA, 101 bp, rice(Oryza sativa)
  misc_feature (71): n=a or g
tgcacctgagacggttgaggcaatcttttgccttaaagactggatggaagatgatgcaaggatgcaatgcngaccagaggattcagagattgccgatgcag

SEQ ID NO: 6878 - DNA, 101 bp, rice(Oryza sativa)
  misc_feature (71): n=t or c
atgcctggtatggagccggcaagaggcgacggtggctggcgatggggaatccgggaggtggaggagttggncactagagagtggcgacggtggatggcaca

SEQ ID NO: 6879 - DNA, 101 bp, rice(Oryza sativa)
  misc_feature (71): n=t or c
cgtcaacaggcggtcccttcggccagtcctcatcgggaagggaaggccccggaagtggagatgacagtgtntgatatgacactgactgtcccacactttgt

SEQ ID NO: 6880 - DNA, 101 bp, rice(Oryza sativa)
  misc_feature (71): n=t or c
aaagtctatcccaagatatagaggctcgcctgttccatcaaagctcttcttctggcctcccggattttttngcctaagcatcataacccttactcttgatg

SEQ ID NO: 6881 - DNA, 101 bp, rice(Oryza sativa)
  misc_feature (71): n=a or g
tccgcaacgtgatacactggtgcaaaaaggctctgagcatgatctccaacttttaaatttaactttagatnttaattaagtctgaagtgaagtgtgaagta

SEQ ID NO: 6882 - DNA, 101 bp, rice(Oryza sativa)
  misc_feature (71): n=t or c
cctctcgtcccagcccgcgcggctttgctcacgatgatgcacagggcggagaagccccggtcggagacgangcgcgcaccgagcttcacgccctccaccac

SEQ ID NO: 6883 - DNA, 101 bp, rice(Oryza sativa)
  misc_feature (71): n=t or c
atatgcaacacgcagaggataaattataggagcatgcaacacgcagacgctgattcattcagcaccaaatnaatcattgataataatcctatttgtgggca

SEQ ID NO: 6884 - DNA, 101 bp, rice(Oryza sativa)
  misc_feature (71): n=t or c
ccatggagccgccgatctaaccgggtcgatgccatcggtctgaccgctgatatctcgccgattggaccacngcacctgagaaaacacaaatcgaaaagtgg

SEQ ID NO: 6885 - DNA, 101 bp, rice(Oryza sativa)
  misc_feature (71): n=t or c
agtggctgtgggggagtcggagttggaaggccgaccaggcgaggaggaggaggtgtcctcgcctgtggttnctcaaggggagaggaagcaggagactgctg

SEQ ID NO: 6886 - DNA, 101 bp, rice(Oryza sativa)
  misc_feature (71): n=t or g
ttcctcacctgcaaaaccacacacaccccacagatcaaaagcagaagcagagcaaacctcacacaaaagcntgcccaaccaaaagcgagtttctaccaggc

SEQ ID NO: 6887 - DNA, 101 bp, rice(Oryza sativa)
  misc_feature (71): n=a or g
aacaattgttggtaaggcttatcgataggggtttttctggcccacggcagtatccgatgccgagaaagttntgcgaacatgtgaaggttgtcaattctttg

SEQ ID NO: 6888 - DNA, 101 bp, rice(Oryza sativa)
  misc_feature (71): n=a or c
ggtcaccccccaccccccacctccctatataacctcccctccatcgcgaaccctagcttccccttcgccgncgccgccgcctcctcgagagagagagagag

SEQ ID NO: 6889 - DNA, 101 bp, rice(Oryza sativa)
  misc_feature (71): n=t or c
cagtcgccacccccgagcctctgcccatcgcatcgatccccgccgtccctccacccattgcacctatccgngccgccaccgatgacgatctcgtccgcacc

SEQ ID NO: 6890 - DNA, 101 bp, rice(Oryza sativa)
  misc_feature (71): n=t or c
ggcttcaggctgccccagttctccggccccctcggtgtgccggggatgtagccgaactgatcgtcttcctnggctccggcggccggcgccaggagcaggag

SEQ ID NO: 6891 - DNA, 101 bp, rice(Oryza sativa)
  misc_feature (71): n=a or g
cattgccgaagatcatctgtgctttatgggtgatgatgatgactccgtggttgatcacttgaacaagacgnacacaacaatggtgatcaagctcatgagga

SEQ ID NO: 6892 - DNA, 101 bp, rice(Oryza sativa)
  misc_feature (71): n=a or g
gcaatggttttggcgtcagcgccgttgctgtggctggccagcaagagggtaaaggagagagagagaggagnagaagaaattaggggaagaagatggaaaac

SEQ ID NO: 6893 - DNA, 101 bp, rice(Oryza sativa)
  misc_feature (71): n=t or c
tacatggctgacctgaccgagcatccgtcgccgactgctcctcctcaagtgcaaacagctggcctgccggnggcggcttctccgggtcctgcctcgcctca

SEQ ID NO: 6894 - DNA, 101 bp, rice(Oryza sativa)
  misc_feature (71): n=t or c
ctatccgtccttcagtgttttactttgacctccttgtgggttcggtccattcctgatctaccccatgaagnaatgctccatccttggtctccttgtggatg

SEQ ID NO: 6895 - DNA, 101 bp, rice(Oryza sativa)
  misc_feature (71): n=t or c
gcttacttccttctgaatgttaccccaacgatgctcaagagagtttgcattcctatcagacttaaaatcanggttagcatggtagtgctctgcgatcctct

SEQ ID NO: 6896 - DNA, 101 bp, rice(Oryza sativa)
  misc_feature (71): n=a or c
tttggcggaaggtatctccccctctctctcactctccaacgccccccaaggtcgcgctctaattagggttncccgagaattctagacccccggggacatgc

SEQ ID NO: 6897 - DNA, 101 bp, rice(Oryza sativa)
  misc_feature (71): n=t or c
tcaggttggctccagtttaggcgggaaaggagtatatgcctctactctctagatgattaggtcgagatatnagtagctgctactacctgtgtatatatgtc

SEQ ID NO: 6898 - DNA, 101 bp, rice(Oryza sativa)
  misc_feature (71): n=t or c
gaggtcgtcgtcgttggcgctgctcgtcggccgaagcacccaggtggagatatggacgatgaagctgaccngccacgggatggccttgctccggatggcgt

SEQ ID NO: 6899 - DNA, 101 bp, rice(Oryza sativa)
  misc_feature (71): n=t or c
tcgctggcggtcgaggcaataagtcatctcttattggccaccggggcaccgatggccttcgctggccttcngtctccgttggcttgtcctgtcggcacacg

SEQ ID NO: 6900 - DNA, 101 bp, rice(Oryza sativa)
  misc_feature (71): n=a or g
tgatctatggaatgatgattttaagtgcactagctaccccaatctctttgctgtgactatgtataagtctnactcagtaaaggccatgtgttcaagacccc

SEQ ID NO: 6901 - DNA, 101 bp, rice(Oryza sativa)
  misc_feature (71): n=a or g
cgttgaaaccaaaatgtacgatgttgatattcgatatgatcccagataaattcataagtgcactgataccnttgtaacatttcactcaggaatattccaag

SEQ ID NO: 6902 - DNA, 101 bp, rice(Oryza sativa)
  misc_feature (71): n=t or g
acgaaggggtcgcggccgagcaagccgtagatgaaccacgacgtgccgcacaggaacacggccagcgacancaggaacggcatgtactccacgctcttcgt

SEQ ID NO: 6903 - DNA, 101 bp, rice(Oryza sativa)
  misc_feature (71): n=t or c
ttgcaagaaataaagaatctcattaggaattgttgagagaactcaccgtcctcatgacgtccacctcgttngccatgggccagacgtctcttcagcatcga

SEQ ID NO: 6904 - DNA, 101 bp, rice(Oryza sativa)
  misc_feature (71): n=a or g
cgtggacggcgacgacgacgacagcgagctcgacttctcgggctctggccggttcgcgctgtcactcgacnggctcaaggagagtcggtttcacatgtggg

SEQ ID NO: 6905 - DNA, 101 bp, rice(Oryza sativa)
  misc_feature (71): n=t or c
gccgttggcgtcctggtgcttccatcccctccgtgacaaccacctcccccaatgtcaccgcaaccagccgncgatctcgcctccactgccggtgacatatt

SEQ ID NO: 6906 - DNA, 101 bp, rice(Oryza sativa)
  misc_feature (71): n=a or g
ctcgcttaggaattttaccaggaaaatgaatttcccaaccctcactagcctggactatcagatccggagtnctcccatcagatctgagctctgataccttt

SEQ ID NO: 6907 - DNA, 101 bp, rice(Oryza sativa)
  misc_feature (71): n=a or g
aaaaaaaacatcttctgacattcggtcaaacgtgatatctaaaaaatttctttttcgtgaagtaaacagcnccatggtgacgggcagaggctagcgcggtg

SEQ ID NO: 6908 - DNA, 101 bp, rice(Oryza sativa)
  misc_feature (71): n=t or c
cgccgccgccgcggacctacaccttccgccacggccacgcggaaggcgtggaggacaatgacgttactctncaacgggaggcccgcgaccaaggaagcaga

SEQ ID NO: 6909 - DNA, 101 bp, rice(Oryza sativa)
  misc_feature (71): n=t or c
aacgaaaatttcgggcgagatatgagcttgccggtgggagggcaaaattaacgaaatttcaaaccctagcngcaggtgtcgccggtaatgagggtcctctt

SEQ ID NO: 6910 - DNA, 101 bp, rice(Oryza sativa)
  misc_feature (71): n=a or c
cgaccgcctgaggtagggacggatctggcagcgttgatgcatggcctctcccctctccagcgagctcctcnggcgcagataggagacgtgggccagcgagg

SEQ ID NO: 6911 - DNA, 101 bp, rice(Oryza sativa)
  misc_feature (71): n=t or g
accgccgccatccacgctctggcaacccaggcccttcgccgataagacattacactggacatgcctagaanaacaggaaaaaaacctgacaaaactacaac

SEQ ID NO: 6912 - DNA, 101 bp, rice(Oryza sativa)
  misc_feature (71): n=t or g
aatggacttgttttgtgtccagaactcgagtttgtgtcagtttactatttaacttaattgcaattgggccngtatattacatagatggaataattccattt

SEQ ID NO: 6913 - DNA, 101 bp, rice(Oryza sativa)
  misc_feature (71): n=a or g
agattcggcctgtccattagcttgagcataataaggcgacaaattcagcaatttaattctaaaagattcgncaaactcactaaattgatgtgacatgaaag

SEQ ID NO: 6914 - DNA, 101 bp, rice(Oryza sativa)
  misc_feature (71): n=a or g
agggattaaaaaaagactaaagattattaattgcactgtaaaaagaacatgttacctctaaaacaatgcanagagagagaggatagggttgtgagtggggg

SEQ ID NO: 6915 - DNA, 101 bp, rice(Oryza sativa)
  misc_feature (71): n=t or c
aatcctagctgatccacgacggcgttcacgcttagtctcatccccccggtacttgttcttgccctccctgntgcaacaaatttccctgtatgctgccctgc

SEQ ID NO: 6916 - DNA, 101 bp, rice(Oryza sativa)
  misc_feature (71): n=t or c
acgatgactaggacaatgacaaccagatctggaggagacggggtgcaccgacgaccaggggcgcaggagangacgaccggatttggaggaggcggggcggc

SEQ ID NO: 6917 - DNA, 101 bp, rice(Oryza sativa)
  misc_feature (71): n=a or g
tttgatgtcagcgaagtgacgtgcggctgacgtctttttgatttcttagcggcgacggaaggacgttggcngcggcagaggaaggtacggcacggcgtcag

SEQ ID NO: 6918 - DNA, 101 bp, rice(Oryza sativa)
  misc_feature (71): n=t or c
ggaaaaacagtatgcatttcaagtaacgaatatcttgcctagcagatccacatatgatgatatgcaaacancatgttctatttaattatcgtaacatcaac

SEQ ID NO: 6919 - DNA, 101 bp, rice(Oryza sativa)
  misc_feature (71): n=a or c
atcgaccaccttaataccagtttgaaagatggataatttcgtatctaactcgataaaggcgggcgcagatntatgaatagggaatgttgcactagtatcta

SEQ ID NO: 6920 - DNA, 101 bp, rice(Oryza sativa)
  misc_feature (71): n=t or c
gccatgcagagcgcggtgacgccgtcggtgcgcttgacgtggaacacgtggagatcctgcgtgtaggagangttgcaatcgccgccgccgccgccatcgcc

SEQ ID NO: 6921 - DNA, 101 bp, rice(Oryza sativa)
  misc_feature (71): n=t or c
tcgccgccggatgaccgctggtgctcgcggacagagtccttgcccccagaagcgccggctcaccaatcaanacgccatgtccatgcttgatgtcggcgacg

SEQ ID NO: 6922 - DNA, 101 bp, rice(Oryza sativa)
  misc_feature (71): n=a or c
gccagactccatcttatcctcgtgcaccatccgcgcctagctcgggatgtcaccactgtgcatctccatcnggtcctggaatgacgccttcctggtgagca

SEQ ID NO: 6923 - DNA, 101 bp, rice(Oryza sativa)
  misc_feature (71): n=t or c
tcgacttcttcatcatcaacgagatatagcgacttcttcaagcattgcatctaaggtacatgataatgatnttgcaagggtagaatctaatttgccagttt

SEQ ID NO: 6924 - DNA, 101 bp, rice(Oryza sativa)
  misc_feature (71): n=t or c
atacaattgtaagaatatattctatcaaaaaccaaatttacggtggtatattgtccaaagataggatgganattttaataagtcaatgtaagtgaacatgt

SEQ ID NO: 6925 - DNA, 101 bp, rice(Oryza sativa)
  misc_feature (71): n=a or g
ggcaggcctcgggcgacgtggataggggaggcggctggcatctggcggacgcgcaagaagaaggatggccngccgcaggcagcgtggataggggtggcggg

SEQ ID NO: 6926 - DNA, 101 bp, rice(Oryza sativa)
  misc_feature (71): n=t or c
ttgttacaattaatcttacaatttgcaggtgtgaggatgaggggaatcagatggtgaagccgtacaagttntcgaaccagaggctcagggatttgggtttg

SEQ ID NO: 6927 - DNA, 101 bp, rice(Oryza sativa)
  misc_feature (71): n=t or c
aggtgcagccgtatttggcaccaatggagctggggtcgtcgacgtgaactgtccagtgaggatgatgtctngacgatgccaaagtatgaactggtgaaccg

SEQ ID NO: 6928 - DNA, 101 bp, rice(Oryza sativa)
  misc_feature (71): n=a or g
atagagatagatagagagatacagttatacgggtagatcgacgctggtgtagctattgctaacattattgnccagagcattagctagcgagcccaataaat

SEQ ID NO: 6929 - DNA, 101 bp, rice(Oryza sativa)
  misc_feature (71): n=t or c
acaaataagagcatcagaatgatatgtttactggttgaataacaatgtatgaaagattttaaataccatgntttttcatccctgagagacaaataaactac

SEQ ID NO: 6930 - DNA, 101 bp, rice(Oryza sativa)
  misc_feature (71): n=t or c
ccggtgagccgcccaggaggatgtccccaccacttgtggcagccgctgcatccgccactttgttcgtcggncacaaaaacctgcatgggagagagagagga

SEQ ID NO: 6931 - DNA, 101 bp, rice(Oryza sativa)
  misc_feature (71): n=t or c
cgtcgctggggatagtaaggtggagaaggaggaggcggtggcacttggccggggaggaaaaggggaggganggcggtggaactgggccggggaggattgga

SEQ ID NO: 6932 - DNA, 101 bp, rice(Oryza sativa)
  misc_feature (71): n=a or g
aattctcgatcgcatatcggaaaatacctcctttgccgggtagtgtgttgagccccgtccagaggcatttntgtcaggaaggaaggaaccttcttttgccg

SEQ ID NO: 6933 - DNA, 101 bp, rice(Oryza sativa)
  misc_feature (71): n=a or g
tggctggttgtcactcggctgatcctcggcagttggcttggtttcttttaagttcatttccctgctggtcnggttagagtcttttccagaaggatctatat

SEQ ID NO: 6934 - DNA, 101 bp, rice(Oryza sativa)
  misc_feature (71): n=t or c
agaatgtgtgcttaaattgctcctaggtgtactaatatcaatgtccatcaactaatggggtgtttagattnaggggtcaaaagttctagcgtgtcacattg

SEQ ID NO: 6935 - DNA, 101 bp, rice(Oryza sativa)
  misc_feature (71): n=t or c
tctccttgtggtacgtatttggagaccatgtaattgacgatgttggcataccatgggtcggagttgcgtantgccatcagcatgtcgtcttgtaggaaata

SEQ ID NO: 6936 - DNA, 101 bp, rice(Oryza sativa)
  misc_feature (71): n=a or g
caccggcgacgagctttgttgtggcgcgtggacagtggaggacctgctcaatgtgaaagacgtggccgctngcgacgagcttcgacatgaggcatggacgt

SEQ ID NO: 6937 - DNA, 101 bp, rice(Oryza sativa)
  misc_feature (71): n=t or c
ctcctttacgctaaaatttcactacataccttgcatatagtatattagaattgcttttggtttggcagtanattatttctaatgatgtactgactcttgtt

SEQ ID NO: 6938 - DNA, 101 bp, rice(Oryza sativa)
  misc_feature (71): n=a or c
aatggcatggcgttgcaatgtgctggaccggaaattactctcgccagtcgcctctgatgatccatcgaccnctcattcagatatatttttttttgtaataa

SEQ ID NO: 6939 - DNA, 101 bp, rice(Oryza sativa)
  misc_feature (71): n=t or c
aagccgccccccaccttggcgaacgcatcgatgccgccgggctgcctctcctgggctctactactgctgcngccgccgccaccgccggtgccaccgaagaa

SEQ ID NO: 6940 - DNA, 101 bp, rice(Oryza sativa)
  misc_feature (71): n=t or c
ggcggcgaaggaggagaagatggatgcggcggctgcatcgtgctgctcatctaccatgtctaccagcagcngtcgttcgcgagggtcggggacgacaagca

SEQ ID NO: 6941 - DNA, 101 bp, rice(Oryza sativa)
  misc_feature (71): n=t or c
cctatgcacttggtaccctcagtggagtagattggcctgtcagttcctgtggctttccagaacccagctgntgtcacccggttcggcctcacgctgttgcg

SEQ ID NO: 6942 - DNA, 101 bp, rice(Oryza sativa)
  misc_feature (71): n=t or c
agtggccatcaggtgaagtacctttgtataccattccatagccaccttctcctagcttctcactgaaagancccgtcatatcctttagttgtgagtacttg

SEQ ID NO: 6943 - DNA, 101 bp, rice(Oryza sativa)
  misc_feature (71): n=t or c
gcttagctcccagtgtaggagtttggcatgtgcatatgtggatgcatatataagtgactggcgcgtacggngactgctgcacgcgagttgccacggttttc

SEQ ID NO: 6944 - DNA, 101 bp, rice(Oryza sativa)
  misc_feature (71): n=a or g
actttgcaagactaaacaggttgtacagatgctgatgggctacatgattcatcagatcaaaaaagaaaganagagaaaggaatagatggaaaaatggctgg

SEQ ID NO: 6945 - DNA, 101 bp, rice(Oryza sativa)
  misc_feature (71): n=t or g
caccttctttttttttgctagctgctcacggattaaaaagcaaccctacataacttacaactccggcaaantaaaagtcgatctctctagcaacgcacaaa

SEQ ID NO: 6946 - DNA, 101 bp, rice(Oryza sativa)
  misc_feature (71): n=t or c
agagagaagaaggcgccgtggatgaaaaggatgtgggtcccactatttttacttttgtccgactgacttgngggccccatgtttttgtttttattttaaag

SEQ ID NO: 6947 - DNA, 101 bp, rice(Oryza sativa)
  misc_feature (71): n=t or c
ggccaaaggggagggtcccatgcacctcccactagttgcctccaccatactctgtttttccttcgaatttntttgcagtttatactttggcgttttttatt

SEQ ID NO: 6948 - DNA, 101 bp, rice(Oryza sativa)
  misc_feature (71): n=t or c
cctcctgttttcagaaataaaagaatggattcagcagagatcacatacggtgtactccctccgacaaaccntgatttccgtgtccaacgtttgaccgtccg

SEQ ID NO: 6949 - DNA, 101 bp, rice(Oryza sativa)
  misc_feature (71): n=a or c
taacgctgttgcctgtatccaggagatgctaaagatcgcaacagcacgcaatgccatatatatgctgctgngcaataatagtaactcgatcggtgcaatcc

SEQ ID NO: 6950 - DNA, 101 bp, rice(Oryza sativa)
  misc_feature (71): n=a or g
gactggagtacatctgaatcaagcttcctgcaactattcagattctacggaatttaagctcagcataaatncctgcctttgagaatcgcactgtgtgccta

SEQ ID NO: 6951 - DNA, 101 bp, rice(Oryza sativa)
  misc_feature (71): n=a or g
catacgcgttcagagccgccttctgcctgaacctctccggcaggtcggggttggccaggaacaatctcccntacgacaccaggtcggcgtagccgtcgccg

SEQ ID NO: 6952 - DNA, 101 bp, rice(Oryza sativa)
  misc_feature (71): n=t or c
gtgggacaagctcgagtccatcgcctacccgctgctgctcacccaccgcaccaggacactcgagaggttcnggatgtccgtcaacgtcgcccgcgggatgg

SEQ ID NO: 6953 - DNA, 101 bp, rice(Oryza sativa)
  misc_feature (71): n=t or g
gaggtcggagaaggccgctcggcaacccgccatatggtttgacacaccggagtccatgatccagctgcgcnggtcgcggtctgcttcatgatctaacccag

SEQ ID NO: 6954 - DNA, 101 bp, rice(Oryza sativa)
  misc_feature (71): n=t or g
tgatcttcatcccgaagctgatcaagagcaaggagcacctggcgttcctggagaaggaccaggacgggctngcgtcgctcgccgtgatcgggcgcggcggc

SEQ ID NO: 6955 - DNA, 101 bp, rice(Oryza sativa)
  misc_feature (71): n=t or c
aaaagccatccattccgttgtatcaaaccgagcctagcagtgtttgaggaaaaagaaatgagaagatattnaaaacgagataaacaattagcacatgatat

SEQ ID NO: 6956 - DNA, 101 bp, rice(Oryza sativa)
  misc_feature (71): n=t or c
aggtacaatttgccaccgtcacttgcctcctcatcatcactgtaggagtcgaccgtcgacagccactcgangagctcctccagggccatggtcttcacgtc

SEQ ID NO: 6957 - DNA, 101 bp, rice(Oryza sativa)
  misc_feature (71): n=t or g
cctcactggcttcctcctctccctcgccttcctctacgccatccgcgtcgccatcctccacgccaagtacnccccggcaatcgtcaggggccccgtctcct

SEQ ID NO: 6958 - DNA, 101 bp, rice(Oryza sativa)
  misc_feature (71): n=t or g
gagcttggcgaagtccggcattgcgagtactagggctgtagtgaccgcggtcttgagggccgcaaacgccnccgccgccgcatcatcccaagagaagccgt

SEQ ID NO: 6959 - DNA, 101 bp, rice(Oryza sativa)
  misc_feature (71): n=t or c
gcgatggcgacagcagcatgcagaaggcctgcagtgatgctcatggcgttcgccatggcggctgcggtgangatgagctccgtgccgccggcgtcggggac

SEQ ID NO: 6960 - DNA, 101 bp, rice(Oryza sativa)
  misc_feature (71): n=a or g
cgcactcacgatgtctgctgcggtcaaattgcctgcagccattgataaacaaaatcgacaggttcttgtcntataggagtattattgtaacttctttttct

SEQ ID NO: 6961 - DNA, 101 bp, rice(Oryza sativa)
  misc_feature (71): n=a or g
ttatccgaaattgaggtctctctcatcttctccatgccaaactccctccttcccctctcctccccgtgccntcctgctgttggagctcaccggcaaggtac

SEQ ID NO: 6962 - DNA, 101 bp, rice(Oryza sativa)
  misc_feature (71): n=t or c
tcaactacccctaactcacctctcacatctctctctctccctcccatcacactcactcccacgggctcgangacggccggcggccggttggcggcgaggtc

SEQ ID NO: 6963 - DNA, 101 bp, rice(Oryza sativa)
  misc_feature (71): n=t or c
cttcgtcacgtctaacccagataacaagtttttctccaaagtgctcaataagggtgatgtgttcgtattcnctgtggggctcatccacttccaatttaacc

SEQ ID NO: 6964 - DNA, 101 bp, rice(Oryza sativa)
  misc_feature (71): n=a or g
ccgagcatcccttataacgcaagctggttcgatcagaaaacgcttatcaacttatgcgtggacttatgccngttcattcatcgtgacatctgtaaccatct

SEQ ID NO: 6965 - DNA, 101 bp, rice(Oryza sativa)
  misc_feature (71): n=t or c
aagaggggatagaaatttcgaaatgacgagaatgccccctctactcatttccttcttcgcgatgcagctgngggagaggatggcgaggacaagctgggaga

SEQ ID NO: 6966 - DNA, 101 bp, rice(Oryza sativa)
  misc_feature (71): n=t or c
gacagcttcgactgatggctctcactcgtttttttgcttgtacggatttgtctttgcgagtaaccgatccntgtggaaatcgtggtcgcgtcctcctctgc

SEQ ID NO: 6967 - DNA, 101 bp, rice(Oryza sativa)
  misc_feature (71): n=t or c
aacttcgatccggtttaccaacggacggggaagtgttcctccttgggcttgctccaccggaaatgcgcggngttgatccactctgggttgacgagcaactt

SEQ ID NO: 6968 - DNA, 101 bp, rice(Oryza sativa)
  misc_feature (71): n=t or c
gatgatgccttcaaattcatcatcaagaatggtggcctcaccaccgagtccaactacccatacgcagcagnagacgacaagttcaagagtgtatccaacag

SEQ ID NO: 6969 - DNA, 101 bp, rice(Oryza sativa)
  misc_feature (71): n=t or c
gagctcgccggcgtcgggaggaggagctctgctggcgagtgaagaagagcccgctggtgtgggaaggagcngccagcgttggggaggagctccgtcgacgc

SEQ ID NO: 6970 - DNA, 101 bp, rice(Oryza sativa)
  misc_feature (71): n=a or g
ataagtgtataatataaacgccatgtcatgtggaacaagattaacaaaagctttgatggatggagcaaatnagaggagcccctaaccgtggtctaacatca

SEQ ID NO: 6971 - DNA, 101 bp, rice(Oryza sativa)
  misc_feature (71): n=t or c
ggcgccgtcgggcatggggatcgtggagacgtggatgcgggagaagcccatccgcaccttcctcgcccagntctccacccgccgggcggcggcgggggccg

SEQ ID NO: 6972 - DNA, 101 bp, rice(Oryza sativa)
  misc_feature (71): n=a or g
agaccagccacctatgcttttggttctgaagtcaaactgatttttgctgttcatgctcatgggattagccnatgaggttacatctaaaccggtgatcatgg

SEQ ID NO: 6973 - DNA, 101 bp, rice(Oryza sativa)
  misc_feature (71): n=a or g
ttcctatcgcaagaaacataccgaaaacatagcccaatacacatatcaagtctcaatgtgtactacctccntcccataataaattcatttttagtccctct

SEQ ID NO: 6974 - DNA, 101 bp, rice(Oryza sativa)
  misc_feature (71): n=a or g
gcttgaatatgttggtagtggcgccaagctcgagtatgtccgtggcagccatgaagtggtcatcagtgagngcacgaatggcatcggtggtggcgtcgagc

SEQ ID NO: 6975 - DNA, 101 bp, rice(Oryza sativa)
  misc_feature (71): n=t or c
ttttattacatacataatatgctgtaataatccgtttatagtaatctaaatctgcgttcgtttctcttgtnggatgaaattttggatactcgtggaacgct

SEQ ID NO: 6976 - DNA, 101 bp, rice(Oryza sativa)
  misc_feature (71): n=t or c
ggccaccagccggggctcgtacagcttcctacaactgctgttgtcgtcgggacgggagccgacagggacanggaatggcgcgcggctggggacggggatgg

SEQ ID NO: 6977 - DNA, 101 bp, rice(Oryza sativa)
  misc_feature (71): n=a or g
tgcaaacgtgcttgtggaatggtggtggatgtcttccggtgggaagctatcgaccagggtttaaatcctcntcccaccaagaaatttcggtcctttgttcc

SEQ ID NO: 6978 - DNA, 101 bp, rice(Oryza sativa)
  misc_feature (71): n=a or g
ggaggcgaggctagaactggctgacgctattgacgccaagaacctggcgctcagccacgccgatgacgccntcagagccggcgaggcgaacgccgcccagg

SEQ ID NO: 6979 - DNA, 101 bp, rice(Oryza sativa)
  misc_feature (71): n=t or c
ctcaatcacacacaagcgataaaattacgccaaaaaatgattcagccaaaaaatccatccgatggctttgntggatcttgctatgaggatgaagagcacgg

SEQ ID NO: 6980 - DNA, 101 bp, rice(Oryza sativa)
  misc_feature (71): n=t or c
cagaatagcatgtaccccatgaagcatatgaatattccactaggaggaactgttcttaccaaatctatcantggcacaatttacggtctatcaggattcag

SEQ ID NO: 6981 - DNA, 101 bp, rice(Oryza sativa)
  misc_feature (71): n=t or g
cggcgagctccgacgtggggctccaacacggtggcatgcgttgcggcgctggaaggagaggattgtgaganaagagatataactgacatgtgggtccaagg

SEQ ID NO: 6982 - DNA, 101 bp, rice(Oryza sativa)
  misc_feature (71): n=a or g
cgtcgcctccctcggctccgcaaggacgaggagaacctgggccatcccttcccatcgccagaaactcactngacgtccgttttcccgtgcgccggtgagcc

SEQ ID NO: 6983 - DNA, 101 bp, rice(Oryza sativa)
  misc_feature (71): n=t or c
actccatgctattgagctttcccagttcaacgatttgcttaaaaggtagagataatttactccatgctatngagctttcccagtttaacgatttgccatcg

SEQ ID NO: 6984 - DNA, 101 bp, rice(Oryza sativa)
  misc_feature (71): n=a or c
aatcccttatctcaaggttggtagctaggcttcctttggattctggatgcaagtattattacgtcgtgagntatctttgcctctcccatttataaggaatg

SEQ ID NO: 6985 - DNA, 101 bp, rice(Oryza sativa)
  misc_feature (71): n=t or c
gaccgtagcaacgccaaaccacaccacatcaccagcgatctcctctccccacccccccccttcaccccgangggcatcgcagcgatctcctcttccccggc

SEQ ID NO: 6986 - DNA, 101 bp, rice(Oryza sativa)
  misc_feature (71): n=t or c
gtcttttgttccagtggacaagatcgccgtccatttccatgacacatacggccaagcccttgccaacatantggtctctctccaagtaagcaaccacactt

SEQ ID NO: 6987 - DNA, 101 bp, rice(Oryza sativa)
  misc_feature (71): n=t or g
tcatggatcatctgtggcgccaccgctgtcatcctcaccccgacctacgtcttcaccgccggcatcctcanagggcttcgccagcccaccgacatcgccgc

SEQ ID NO: 6988 - DNA, 101 bp, rice(Oryza sativa)
  misc_feature (71): n=t or c
acacattggaacagtgcactcaacgtatcataatcacaatcatgggtagtttctatagatatgtcacaccntaaaaatcctaaatatataaattgttgttt

SEQ ID NO: 6989 - DNA, 101 bp, rice(Oryza sativa)
  misc_feature (71): n=a or g
cgaaagggtagcgcaactggaggcggagctcgaagtcgcccgtgaggaccttcagaagatgatggaactcntggccggcaacgagatgcagcgccaaggtc

SEQ ID NO: 6990 - DNA, 101 bp, rice(Oryza sativa)
  misc_feature (71): n=a or g
tattgcaggtggagtccaagaggaagcggttgctgggatagcaattgtttttgaagacggcaggtctggtncagactcgtcgagtggcttgtggtgaagct

SEQ ID NO: 6991 - DNA, 101 bp, rice(Oryza sativa)
  misc_feature (71): n=a or g
cgacggggcagagggccgattggaggcgaatcgggtggctggctgaatcgaagcggtggtggtgcttgggnagcgcacctggctaggtggagatgggactg

SEQ ID NO: 6992 - DNA, 101 bp, rice(Oryza sativa)
  misc_feature (71): n=a or c
agcaacggcgatggagggatttggtggagaactcagtaggttggcagaggggggaccagcggcgagcgagngcggcagaaggcacaacagcggcgagaaag

SEQ ID NO: 6993 - DNA, 101 bp, rice(Oryza sativa)
  misc_feature (71): n=t or c
gctgccggcgcagcgtcgagcccctcaacgacatcctctgtgtatgccaccttcccttccttcaggtaccnggcaatctgctcctcgatctggtagtacat

SEQ ID NO: 6994 - DNA, 101 bp, rice(Oryza sativa)
  misc_feature (71): n=a or g
cacgatcgtcgatcagcgaggtcaaaccaaagatgcctgaaagccactaccaaaagtgttttttgcatgcncattgcgtaaaaacaacgtcctccgatccc

SEQ ID NO: 6995 - DNA, 101 bp, rice(Oryza sativa)
  misc_feature (71): n=t or c
gccacgttgtcgatccccatcacaggctcgatctcggtctctgtcacggccatggtcacgatcccggccanggctgcggtcatggtcacggccgccgcgtt

SEQ ID NO: 6996 - DNA, 101 bp, rice(Oryza sativa)
  misc_feature (71): n=a or g
taagcactcctcttttcttcatcaatgtccttccaaagatccctattcacaaagttatgaagtaaataagnagagaaactaatgcacgcacagaagagaga

SEQ ID NO: 6997 - DNA, 101 bp, rice(Oryza sativa)
  misc_feature (71): n=t or c
gagtttgtcggcatttgtgcaaagcggcaaacaggatggttgaagctgcgtatagggagacttacgtttangatacgagtagcttgcccgagtgccttttt

SEQ ID NO: 6998 - DNA, 101 bp, rice(Oryza sativa)
  misc_feature (71): n=a or c
cgcgaagggcgggagctgcaaccacgggctcttgcccctctcgcctgtctctccaccgtcgtctccgctanctagagcaccgcgcctcgctgccgtggcca

SEQ ID NO: 6999 - DNA, 101 bp, rice(Oryza sativa)
  misc_feature (71): n=a or c
ccgcctcccttctcaagcggcggcgacggcaacgacatgggaggcggcggtgacaacgatgtagagatacngctctgctcccctgatcaccacgacacagt

SEQ ID NO: 7000 - DNA, 101 bp, rice(Oryza sativa)
  misc_feature (71): n=t or c
attagtgcaaggagaggtgacgtggtgcagcgatggaggtgaggctgctagaaccagaaggagcggggtgnggcatgaaggcgaggtgaggcaatgtagtg

SEQ ID NO: 7001 - DNA, 101 bp, rice(Oryza sativa)
  misc_feature (71): n=a or g
gtgtttgaatgtctgtggaccacaaacaccatactaactcaagggactgaagacaacatccgctggaagtngacagaatcaggggaatactctgccaaatc

SEQ ID NO: 7002 - DNA, 101 bp, rice(Oryza sativa)
  misc_feature (71): n=t or c
atgttctgttatgcagatcagcgttgcgctctttcaaacgacgtgtggcatatgctaatgcaaacttcgancgtatcctttaacaattaactgcttcgctg

SEQ ID NO: 7003 - DNA, 101 bp, rice(Oryza sativa)
  misc_feature (71): n=a or g
caggatggatggtgccgtcttaccagtctcgtctcgtcaaccgccgccgtccagcgaccactcaccgacgnaggaggagcttccgagggcgacggcggcgg

SEQ ID NO: 7004 - DNA, 101 bp, rice(Oryza sativa)
  misc_feature (71): n=a or g
gtgcgcacgggagccaaatcctcgcccgtgagcacctccttctcgtgctctagtacctccaccattggacngaccatggagtctgtcatcggcatcatcat

SEQ ID NO: 7005 - DNA, 101 bp, rice(Oryza sativa)
  misc_feature (71): n=t or g
atgttttattaaatataccgcattaatagttcatctttttgttgtttctttgtgaatatcttgtagaaaangaatcacatctacatgaccaataagactaa

SEQ ID NO: 7006 - DNA, 101 bp, rice(Oryza sativa)
  misc_feature (71): n=a or g
ggccgaaagtttgtgaatcatagcgattgggtcgtgagagacaacgtccccatcagcataatgtactggcntcgaacaaggtcccgcggggatgaagatag

SEQ ID NO: 7007 - DNA, 101 bp, rice(Oryza sativa)
  misc_feature (71): n=a or c
atatctccatttttcaaatataggttgcacatgcctaacctccattgcaacaagccatatcatttggatgntctgtggtgcgatacctgatgctgcacagt

SEQ ID NO: 7008 - DNA, 101 bp, rice(Oryza sativa)
  misc_feature (71): n=t or c
tttgcctgctatttaaggcccgtgaaaatcatcaatttttgtagatggattttcatctatgtgtaaaaatngattttcgcaagtgtccaccctaagagccc

SEQ ID NO: 7009 - DNA, 101 bp, rice(Oryza sativa)
  misc_feature (71): n=a or g
gcatgtagtgtttaagaaagggtgaagctattttttctaactccacaactccagcttcatatcagattggnagccttcggccttagctagatattatgcta

SEQ ID NO: 7010 - DNA, 101 bp, rice(Oryza sativa)
  misc_feature (71): n=t or g
gcgcaggggatggtagctccggtcaaattaatgtcgacaagcctacaagattgctctatgtcatcccgccngtcgctggtcatcgtcctgcttgttatcgt

SEQ ID NO: 7011 - DNA, 101 bp, rice(Oryza sativa)
  misc_feature (71): n=a or c
cacgccacgccacgacacaacgatctccctctcggcctcctgtgtcgccccgtcggtatgaactccgagcngccgccgagcatggcgtcgtcgttgatgga

SEQ ID NO: 7012 - DNA, 101 bp, rice(Oryza sativa)
  misc_feature (71): n=t or c
atgcctttcctcctccggcgcccaaccctacaacgactgccacatattcgtgccgctgtcatcgaccaatnggagcacagagccggcgccgtctccttctt

SEQ ID NO: 7013 - DNA, 101 bp, rice(Oryza sativa)
  misc_feature (71): n=t or c
gcatcccctcaccaccacacctgcctccttggctcctccactgtccatgtctccgtcatcgctgcctcccngtccaggccacgctgcatccctcatcagat

SEQ ID NO: 7014 - DNA, 101 bp, rice(Oryza sativa)
  misc_feature (71): n=t or c
atataggcgaggagagacagattcggaagtcaagaggacatgagtagtgttcaaactggaagtgacatttngacattaactaccttgttagcatctctaaa

SEQ ID NO: 7015 - DNA, 101 bp, rice(Oryza sativa)
  misc_feature (71): n=a or g
cggcgttctcgccatggcgatggagctcgtcgggaggcaatggcagtcgaaggacgcagccagggggatgntgcagtcaactggcttgatatgagagaact

SEQ ID NO: 7016 - DNA, 101 bp, rice(Oryza sativa)
  misc_feature (71): n=t or g
tctcccgagccgcccaagtgaccgtggcttcggagacgacaacattgccatcctgagctgcggcaacgacnactcctcctcctcctcctacgctgtggccg

SEQ ID NO: 7017 - DNA, 101 bp, rice(Oryza sativa)
  misc_feature (71): n=t or c
ttgctggtagctttcggcacaggcaaaaacagacgcgaagagaaaataatgtttgacgttgtcgacatccngtacaactacaatgccatcttcggctgtgc

SEQ ID NO: 7018 - DNA, 101 bp, rice(Oryza sativa)
  misc_feature (71): n=a or g
gcagaggccgaggcggcgacgtgggatgaagaggctgaggcggcggcgactgcgggatactaaggtggcgncgatggaggtgtgggatgcggaggcggccg

SEQ ID NO: 7019 - DNA, 101 bp, rice(Oryza sativa)
  misc_feature (71): n=a or g
cgccaagcgaccaagcaatgaccaccacttatctcttcctgtcccttccacaagaaccccctacagcgacnttcaatgtctttgatgacccatcgtgggag

SEQ ID NO: 7020 - DNA, 101 bp, rice(Oryza sativa)
  misc_feature (71): n=t or c
gcctttttgtatagatcgttgccgatcatacagtagatcttgacttgtctggataacttctcggcttctgnatcatcctcgggcaactcgtcgctacttag

SEQ ID NO: 7021 - DNA, 101 bp, rice(Oryza sativa)
  misc_feature (71): n=a or c
gtatacattagactcaagtcaaatataccatttatctcgttaagatgatgcttcgagacgagaataaatantatatcataatgacaatgggtatataaatg

SEQ ID NO: 7022 - DNA, 101 bp, rice(Oryza sativa)
  misc_feature (71): n=t or c
ggtaaggtgccccgcctcatcgtccttcacatcactatcagctccccgccacctgatccgctcctatcggncatcaccgcctaacccgccgctccattttg

SEQ ID NO: 7023 - DNA, 101 bp, rice(Oryza sativa)
  misc_feature (71): n=a or c
atgagtctgctcactacacccacagcataggacagatccggccgtgtatgcaacaagtaacgcagacaacntatcactcgcctgaattgtgtggcatcaac

SEQ ID NO: 7024 - DNA, 101 bp, rice(Oryza sativa)
  misc_feature (71): n=a or c
actagctgtgccgttttatatcaggagcaatgaaccaagtcactaggaacctggcttctgagtgggccagngatggcgtcagagtcaattgcgttgcacca

SEQ ID NO: 7025 - DNA, 101 bp, rice(Oryza sativa)
  misc_feature (71): n=t or g
atggcgatatttcttttgcttctaaagatcaattctttttggtcatcattacacctataatcaacgggccngccgggctagctagtgaatctcagtgatgg

SEQ ID NO: 7026 - DNA, 101 bp, rice(Oryza sativa)
  misc_feature (71): n=a or c
cgccgtagtacctctccagcgactgcacggcgaacttgcccgccttccgcgccttcttcgagacctccttnttctccggcttcccgcccacccccttctcc

SEQ ID NO: 7027 - DNA, 101 bp, rice(Oryza sativa)
  misc_feature (71): n=t or c
gcggagacggcggggaggtcgacgagcgatgaccggaagtggaagcccctggcctggtcgatgagcgaggnggggtggttcgcggcgcggtggaagttgga

SEQ ID NO: 7028 - DNA, 101 bp, rice(Oryza sativa)
  misc_feature (71): n=t or c
actggctacatcattttttttttgcacttatcctgatcatttgcatattatgtgcctgtttactttgatgncattttcaaccttaccaaattttggtaaag

SEQ ID NO: 7029 - DNA, 101 bp, rice(Oryza sativa)
  misc_feature (71): n=a or g
tcctcaagctctctccccctctctctctcccacgtctggccattagtgccatcgtccgatctccctcaccngagctttgcaagccaaacccttgcgccacc

SEQ ID NO: 7030 - DNA, 101 bp, rice(Oryza sativa)
  misc_feature (71): n=a or g
caacctaattggttgagttgttacgcacttgttcgtacaccatccatctaactgttagtgatataccctanaggcaatcatagagatgattgtatcacata

SEQ ID NO: 7031 - DNA, 101 bp, rice(Oryza sativa)
  misc_feature (71): n=t or c
ttgattcgaaggtagtagctatttcctctatcccataaaataaatcggtatgtgatacatcctctatctanaattcaagtattaggacgtaaacatccact

SEQ ID NO: 7032 - DNA, 101 bp, rice(Oryza sativa)
  misc_feature (71): n=t or g
gcggcggcggcgaactcccgcagcatctcgacgttgatggcgatctggaggcccccgatggccgagaagangagcagcgggaagaggacgatgcagcagtt

SEQ ID NO: 7033 - DNA, 101 bp, rice(Oryza sativa)
  misc_feature (71): n=a or g
atgtatatgatgggaagctgaaggtctagctcgccggcgcatggagaaggaggcacttggggagatagagntcaaccttaccggctgggaggctgaggtga

SEQ ID NO: 7034 - DNA, 101 bp, rice(Oryza sativa)
  misc_feature (71): n=a or g
tacctcggggggctcatagagcggcatgtccgtggagatgctggaggagtaggagatggcgtccgacgacnacgacaaccgcacatacgccacggcccact

SEQ ID NO: 7035 - DNA, 101 bp, rice(Oryza sativa)
  misc_feature (71): n=a or g
cgtggcgtcggctggcgacgatggtgcaaggaggacggtcggatctggctcctctaggtccagatctggcncatccttagtcggggtcgggtggtgtggag

SEQ ID NO: 7036 - DNA, 101 bp, rice(Oryza sativa)
  misc_feature (71): n=a or g
gagagagaagcggcggaggatcacgcgagaggaaatattcccgacctccggatgtcggggtcctttccctngggtttccccgcggattgggccgaaaaatc

SEQ ID NO: 7037 - DNA, 101 bp, rice(Oryza sativa)
  misc_feature (71): n=t or g
tggtttgtaactgggacgcactggaggtgatggagttctttgaggagcaggaatttcaggtggaggagttngcacccttgtttcactaagatttttagccg

SEQ ID NO: 7038 - DNA, 101 bp, rice(Oryza sativa)
  misc_feature (71): n=a or g
aaaaatattacagtatgccaaacaacattagtacggagttcttatgtcaatctattcattattatatactntattacattattaattaaagagaagaccaa

SEQ ID NO: 7039 - DNA, 101 bp, rice(Oryza sativa)
  misc_feature (71): n=t or c
cttttgggggtgaaactgaaagctcaaatccttcgcggcgcatattctcaatcaagattcctggaagttangcagatcatcaaatgctatagttggcagga

SEQ ID NO: 7040 - DNA, 101 bp, rice(Oryza sativa)
  misc_feature (71): n=a or g
ggctcatgcagccagcagtatgcttcatccctaggctcaccataaatacagtggaacaaagataaaaattnggcccacaaagatagataaaataataatat

SEQ ID NO: 7041 - DNA, 101 bp, rice(Oryza sativa)
  misc_feature (71): n=t or c
aatgaacctccagtacaccatttactagttgatgatgaagacagaaatgaaacatacttccctataaatcngactgacactagcatggagattcctgctat

SEQ ID NO: 7042 - DNA, 101 bp, rice(Oryza sativa)
  misc_feature (71): n=t or c
tgaggaagacatctggctttccatattttcgaactaaagccattgcatctaggtatcggcgcaatttatcncgaggccctccgataaatgatgaagcaagg

SEQ ID NO: 7043 - DNA, 101 bp, rice(Oryza sativa)
  misc_feature (71): n=t or c
agcggcatgcacgggattaactagaaccacatatgccctcgttggctaggagtacaaacaggaaaatgtcnctgccatatatagccactggctaatattgc

SEQ ID NO: 7044 - DNA, 101 bp, rice(Oryza sativa)
  misc_feature (71): n=a or g
ctggtgtctgagatgtgcctacatagagcgaagatcgacgcggtagtgcggatggagtgtgagcggatgcncgacgggctggagcaggcgcggagaggcag

SEQ ID NO: 7045 - DNA, 101 bp, rice(Oryza sativa)
  misc_feature (71): n=t or c
ggcttttgcatttgcattcgcgttagcaccaattccagccttcgctccgataccagcgccaactttagcangtcccgagataccaactccagcatctatac

SEQ ID NO: 7046 - DNA, 101 bp, rice(Oryza sativa)
  misc_feature (71): n=t or c
agtttccaagttagtattgagaccgattttagctaacatgacgcttacatagctaattttacttagtccgngtctcatgtagtgttgacgtggcactggaa

SEQ ID NO: 7047 - DNA, 101 bp, rice(Oryza sativa)
  misc_feature (71): n=t or c
cgacgaagatcagcttcccgtcgtggaaggcgacgctctctatcctggaggtggagtagttcggcctcggnggcgtcatgaggctccacgacgcgtcccct

SEQ ID NO: 7048 - DNA, 101 bp, rice(Oryza sativa)
  misc_feature (71): n=a or c
cgttagaacatgtttactttcggtgatgattctcgttagaattgaaacattgttgtttagcgagaatatgntgtaaataataattccaatatatagaaaca

SEQ ID NO: 7049 - DNA, 101 bp, rice(Oryza sativa)
  misc_feature (71): n=t or g
tgcagatcttaaagcagatcaaaattcaacagaaacgaatattgccttgtttactcaaaatcgaaggttcncaaacccaaatttgtagtataggatagggt

SEQ ID NO: 7050 - DNA, 101 bp, rice(Oryza sativa)
  misc_feature (71): n=a or g
cactacaatactatccaaacttccaaactcagcaaaaagaaacaaagacaatggagacgaagcacacgtcngggatcacaaacaagcttacccgttgagca

SEQ ID NO: 7051 - DNA, 101 bp, rice(Oryza sativa)
  misc_feature (71): n=t or c
aactcctccttccaccactccctcatcttggtcgcctctggtttcttgtcgccgccgccgccagcattgcngttgcagtcggcgtccttcttgtcctccgg

SEQ ID NO: 7052 - DNA, 101 bp, rice(Oryza sativa)
  misc_feature (71): n=a or g
tgcgtacactgtaaaaatcagaaaagttggaaggatccatctgtaatcgaacaacacttggtaacgcatgnatttgttgcacgctacacaaactggtcaca

SEQ ID NO: 7053 - DNA, 101 bp, rice(Oryza sativa)
  misc_feature (71): n=a or g
ggctgtgtgagagaagatggttgggctgttttcatttgagcgtgctgcatttttctgatccaacggctganacgttatcatatccattgatccaatggctg

SEQ ID NO: 7054 - DNA, 101 bp, rice(Oryza sativa)
  misc_feature (71): n=a or g
gtgtcttgaatgcttgattttttgagctgtacttgacattatctttttttttcctaacaacagtacttcantgtgatccaagtataaaagattctgaagag

SEQ ID NO: 7055 - DNA, 101 bp, rice(Oryza sativa)
  misc_feature (71): n=t or c
gagcaccaatgtgctctagtgcttgtgcacactcagcactcaggatggtgtaagcccaaatcccagtggancgcgggtgtgaggtccgtatgtgcccatat

SEQ ID NO: 7056 - DNA, 101 bp, rice(Oryza sativa)
  misc_feature (71): n=t or c
ggttcaattcgggcacgatttgcagaaatccaagccctgatcccagacgatttggcaaacaccattactcnagcagtattccttgagcaacaccaatttga

SEQ ID NO: 7057 - DNA, 101 bp, rice(Oryza sativa)
  misc_feature (71): n=t or c
ctagcttagcgtcattgcattaagctcctccggtagctgcaggctctacagccacataagaccggtagctncatgctcctccggtagctcccgagtaggga

SEQ ID NO: 7058 - DNA, 101 bp, rice(Oryza sativa)
  misc_feature (71): n=t or g
ctgtggctgtggctgccaccggcagaggaggccaaccgcccagattcccctgagtgcccggtcttcagctncagcctctgcagcagcagcggcagcagcag

SEQ ID NO: 7059 - DNA, 101 bp, rice(Oryza sativa)
  misc_feature (71): n=t or c
gcctctcccttcttctttctcccattccttcccctcttcctcttttctcgcattggcaggaagcaagcggnggcagcaagcggggaggggacggcggtggt

SEQ ID NO: 7060 - DNA, 101 bp, rice(Oryza sativa)
  misc_feature (71): n=a or g
gccatggtggacgagggcgcggcggcggcgacaaaggatgagggtggagtttgtcggcagccatgcggacnagggcagcagaggtggcgacagacgaggac

SEQ ID NO: 7061 - DNA, 101 bp, rice(Oryza sativa)
  misc_feature (71): n=a or g
gccgtcgtggtcgtcgtcgttggtgtcgtggttgctggtgttgttgtcggcgaggaccatgtcgagcgtgncgcggcactcggcgaggaggccgcagtagt

SEQ ID NO: 7062 - DNA, 101 bp, rice(Oryza sativa)
  misc_feature (71): n=t or c
cagagtggataggcttacacttgctgatccgaggacggagtgggcgggcttgctttcccatgcaccggcangccgctgcctatgcgccgccactcgtgctc

SEQ ID NO: 7063 - DNA, 101 bp, rice(Oryza sativa)
  misc_feature (71): n=a or g
gctgatcttggtgaaggcgtggacgaggaagatctcaatgaggcgaggctggcggcagcgacggcgttgcnggatggcactccggtgaggttggatgcgct

SEQ ID NO: 7064 - DNA, 101 bp, rice(Oryza sativa)
  misc_feature (71): n=t or c
ctcaactaattaagatttcactgcatcaacgatatatccatgaaattagttcatccaaagacatattcaantatcaattgctataaggaaacacaataaca

SEQ ID NO: 7065 - DNA, 101 bp, rice(Oryza sativa)
  misc_feature (71): n=t or c
atatctctttaagcgtgtgttatgaggacacattcgtggatatataagtatagtgttacgtgtgtagtggnatgtgtctatcatgtaatcggaaaaaaaat

SEQ ID NO: 7066 - DNA, 101 bp, rice(Oryza sativa)
  misc_feature (71): n=a or g
ggccactggatgccctagctttgtggaaagcaccctgactgttgggtctttgatgaagaggtagaggtagnacgagcacgtagatgaggaccgtcctcttc

SEQ ID NO: 7067 - DNA, 101 bp, rice(Oryza sativa)
  misc_feature (71): n=t or c
tatgagtgatcggctatgaataggataactgcaaaaggtaattaaggagagatgtttacccttgagaagtnagccggtgcaacaggagttgggggagtttg

SEQ ID NO: 7068 - DNA, 101 bp, rice(Oryza sativa)
  misc_feature (71): n=a or g
gcgaggaggccgctcgaacgaagaccaacaccaccataatcgtcacagccaccgcgaccgcgacaatcacnaacagcggacaccagacgatgctggtcgag

SEQ ID NO: 7069 - DNA, 101 bp, rice(Oryza sativa)
  misc_feature (71): n=a or g
ctcttcttctctcttgttttcttgtgtgccgaaagcgactttgaggagggcttgacccaaaacctgcactncttcgccttcgaatcccttgagcgaagttg

SEQ ID NO: 7070 - DNA, 101 bp, rice(Oryza sativa)
  misc_feature (71): n=t or c
gtgacgaacgccatcgccgcgttctcatccttgatggccggcagctggacggggaattccggtggcccgancggcctcgcggtgacgctgtccgtgtactc

SEQ ID NO: 7071 - DNA, 101 bp, rice(Oryza sativa)
  misc_feature (71): n=a or g
caaaccttacgtcatcaggggcggcgcgttgtcgtcggagaagagctcggtagaagatcgacgcggcgganctcagcgcgaaggaggcaggtgaacgtggc

SEQ ID NO: 7072 - DNA, 101 bp, rice(Oryza sativa)
  misc_feature (71): n=a or c
agatgcttatatcatccgtacgtaaaaacaaaaatccggaaaaaaaaatttcaaaacaaatgaaaaacctngaatccggcggcggcgctgctgcctcctcg

SEQ ID NO: 7073 - DNA, 101 bp, rice(Oryza sativa)
  misc_feature (71): n=a or g
ggactccgttgccccctccttctccgatggtgtcaagggcaggagcaagcacttaccatacccaccgccgngagttcgcactccccgaatgcaaaaagggt

SEQ ID NO: 7074 - DNA, 101 bp, rice(Oryza sativa)
  misc_feature (71): n=t or c
gttttcaaaaaaagagttaaaatgtaaaagatcgagttgtactaatagtttagagtctcaaatatagtttnctgtagatttaataattataatatttggaa

SEQ ID NO: 7075 - DNA, 101 bp, rice(Oryza sativa)
  misc_feature (71): n=t or g
ttggtaatggttgtacagatttcgagtatccaagatatgctgatcttattaacttgctgaaactggtgtcngatgatggttatcttacttctcaaacatgt

SEQ ID NO: 7076 - DNA, 101 bp, rice(Oryza sativa)
  misc_feature (71): n=t or c
gcgagagaagcatcgtgatgagtcggcgccatggctgtagctatgctctccgagtctcggttccctccccngacgataatgatgggtctaggtgaggattc

SEQ ID NO: 7077 - DNA, 101 bp, rice(Oryza sativa)
  misc_feature (71): n=a or g
ttggtcaaatctgtaacattcttgatagccaatttgagtttggctttttgttcttcgatagacattggganatcggctaactttttctgttccatatctag

SEQ ID NO: 7078 - DNA, 101 bp, rice(Oryza sativa)
  misc_feature (71): n=t or c
cgttgccgcgccgcctcctccatcaaatccggtgcatccattgctacccttccgaaattgattgcaaaaanggattcctctcgatctcctctatctaatcc

SEQ ID NO: 7079 - DNA, 101 bp, rice(Oryza sativa)
  misc_feature (71): n=a or g
attcccctgcagcagcaggctctccaatgcagggcagcgtgacagcacgccatggatggcgtcctcggagntagcgacgctgcacagcgtgagctgcttga

SEQ ID NO: 7080 - DNA, 101 bp, rice(Oryza sativa)
  misc_feature (71): n=t or g
gttcttgctgcagtccgtgcagatggacaggtcgttcagcctgatccagtcgtcgctgtcgtcgtcggcgncggcgaacggcaccggcggcggcggcgcga

SEQ ID NO: 7081 - DNA, 101 bp, rice(Oryza sativa)
  misc_feature (71): n=t or c
actctgcccattgataggctgctggtgatcacaagctacacaacacatcacacaagcaataggcatctctntcttctttctctttctcctccttgcttcat

SEQ ID NO: 7082 - DNA, 101 bp, rice(Oryza sativa)
  misc_feature (71): n=a or c
tctacctggtgatcttgtcgctgcgcccgcagcatgtatttatagatcgagttgaagggtgggtttagttnacgttaaaattaaaagtttagttgaaattg

SEQ ID NO: 7083 - DNA, 101 bp, rice(Oryza sativa)
  misc_feature (71): n=t or c
ggcgttccctacccgtttcttgtatcttgattttcagctcattgttttgagctaaaagctcattaaatgtnctctgcaaaacaatactacatcagtaattt

SEQ ID NO: 7084 - DNA, 101 bp, rice(Oryza sativa)
  misc_feature (71): n=t or g
ggcggaactcggaggcgacgaactcgcggaagtgcttcttggagtccccccgccgacgtgcttctgcaccnccttgagcacccgccggtagacggccgccg

SEQ ID NO: 7085 - DNA, 101 bp, rice(Oryza sativa)
  misc_feature (71): n=a or c
ggagtgagtaattgagattttctttaattaaatatttaatagcgacgtagctatacaggctgttactactnggtagatgctggtaaggcagaagatgccat

SEQ ID NO: 7086 - DNA, 101 bp, rice(Oryza sativa)
  misc_feature (71): n=t or c
cctagaatctccagttgtttttctttcagaagaaagggatcgtcgaatttaaccctaaaacctaattacangatagcacttacaaagttattgctaataaa

SEQ ID NO: 7087 - DNA, 101 bp, rice(Oryza sativa)
  misc_feature (71): n=t or c
tggaacaccggtggaaccttgtggtagactctcccaacaacccccgcatcacactgcataccctggtgatnttggtctcctgggaaagaaatctggtgtga

SEQ ID NO: 7088 - DNA, 101 bp, rice(Oryza sativa)
  misc_feature (71): n=a or c
ctctttcgtccttgagtgtgtagtcggaacgacttaacctcacatcatatcatcttactcaggattcggangcgtcactaccacctcagcgaaagcagagg

SEQ ID NO: 7089 - DNA, 101 bp, rice(Oryza sativa)
  misc_feature (71): n=a or c
agagttggaagcttaattagctcagtttacagcaagcgaagtacgagggtgtggggcccgcttgctctctngctagcggtggggcctacgcgtcagcgtgg

SEQ ID NO: 7090 - DNA, 101 bp, rice(Oryza sativa)
  misc_feature (71): n=t or c
gctaaccttcttccttctcttccaccacatttttccccacccatacatctctcttcttcctcatgtactgntgcctcctccccacgccctctacctcggac

SEQ ID NO: 7091 - DNA, 101 bp, rice(Oryza sativa)
  misc_feature (71): n=a or g
cccaccgggaggagatttcgccgtccttcttctggaacgcctcgttccttcgtgccccgcatccggagacnacaggtcgtcgtgccgagccgcagcgacat

SEQ ID NO: 7092 - DNA, 101 bp, rice(Oryza sativa)
  misc_feature (71): n=a or g
aacacacatggagatgaaaaatccattggcagtagggctgttggctctgctggtggcagccatggcggtgncggcggcggcgcacgacgacgacgacgtgc

SEQ ID NO: 7093 - DNA, 101 bp, rice(Oryza sativa)
  misc_feature (71): n=t or c
tcggtggcctcctcgagctcctcgtaggcgaagtggtgggtctgcaggtagtggaagctgccggactccangaacttgtcgctgctgcctttcgaccgcgg

SEQ ID NO: 7094 - DNA, 101 bp, rice(Oryza sativa)
  misc_feature (71): n=t or g
cgagagcggcctttagggttagatctcccacgtaccatcttgcctcctggtaagaggaggagatcagcganactgcaaccggttggtggcggcgctgatgt

SEQ ID NO: 7095 - DNA, 101 bp, rice(Oryza sativa)
  misc_feature (71): n=t or c
ctccttggacggggcctacccattgatgcttccttctctaggaagttcttcataaaggcaatgaggctgtncatcttaggcagcttcacttcgacctctta

SEQ ID NO: 7096 - DNA, 101 bp, rice(Oryza sativa)
  misc_feature (71): n=a or c
aatgatcttcaccccaaagcaagctacggcaacatggtatttttgtgtgtcagcccctgtcagttagttgnttttgaatttaaatcctcatgttttcttta

SEQ ID NO: 7097 - DNA, 101 bp, rice(Oryza sativa)
  misc_feature (71): n=t or c
ttccagttcctgattcttcccccgaggagactacactaatgaccatatcactccatgcttgcaatggaacnatatcactccatgcttgcaatagaactgat

SEQ ID NO: 7098 - DNA, 101 bp, rice(Oryza sativa)
  misc_feature (71): n=t or c
tgggtgcacgtcggcgagttgcaggagaagacgccggacgacgacgacttggtggggtcgtagaggacgtncttttgcgggtagcacggcggcgtggggca

SEQ ID NO: 7099 - DNA, 101 bp, rice(Oryza sativa)
  misc_feature (71): n=a or g
acagctcgtggagtagctcttcatccaccggatacaccagatggctcaccatgatacaaagaactcactcngtatcggaagccatggtgagtggctctgat

SEQ ID NO: 7100 - DNA, 101 bp, rice(Oryza sativa)
  misc_feature (71): n=t or g
tgccgcgcacttaagcatgaagaaatctgccttagagaggctagatgggtaccgcctccgccttcggaagnccgaagaagaccttcgccacaaggaagacg

SEQ ID NO: 7101 - DNA, 101 bp, rice(Oryza sativa)
  misc_feature (71): n=a or c
cccctgaaccattggcacgcggataccaccaacgcggctgacatgacacgtgggcccatgcgcatgtgggncccacatgtcagtggcgtaagcgtgtgggc

SEQ ID NO: 7102 - DNA, 101 bp, rice(Oryza sativa)
  misc_feature (71): n=a or c
gtgtcattaactggcggaggcggcttcaccaaaagaagaaaaaaacagttactctaaacagttgtgtgatnaagaaagcaaacatataaacagcggtagtt

SEQ ID NO: 7103 - DNA, 101 bp, rice(Oryza sativa)
  misc_feature (71): n=t or c
gtcacatttggtccagcatggtgtggttgctctcttaccaacaattgaggattgatcaattggcccagagntaaaagttgcgcagcaaacgtgggagccga

SEQ ID NO: 7104 - DNA, 101 bp, rice(Oryza sativa)
  misc_feature (71): n=t or g
cgacagcgcccactgcgtgttgctggacccgagcaggcgggtggagttggttcgcgctatcaacggcgagngcggcggcttgggcagcttcgtcgtcgtcc

SEQ ID NO: 7105 - DNA, 101 bp, rice(Oryza sativa)
  misc_feature (71): n=t or c
gcagaatgctgagccagagctgcaattggaggaattccctgatgaaccaactccctgcagcttgaaattgnttcccaaatttcccataattggccccgaaa

SEQ ID NO: 7106 - DNA, 101 bp, rice(Oryza sativa)
  misc_feature (71): n=a or c
gtttaagcatcaaccaaacatcaccttggtagggattagaggttttctcccaaaaataaaatattggatcntcgtgagaatcaactaagttcccctcccaa

SEQ ID NO: 7107 - DNA, 101 bp, rice(Oryza sativa)
  misc_feature (71): n=a or c
gagttcgagggtgtaaaatggacttctcacagaaggaaaatacggggaagttaagaaaaacgtgtgggaanattaagaaaaacaatagggaagcagagaaa

SEQ ID NO: 7108 - DNA, 101 bp, rice(Oryza sativa)
  misc_feature (71): n=a or g
aagcagtaacatacagttcttggcgaggacgtaggagagactggccatcctgaagtcctcggcgatggcgnaggccgtgtcgtgcttgaacgacgtgaacc

SEQ ID NO: 7109 - DNA, 101 bp, rice(Oryza sativa)
  misc_feature (71): n=a or g
ctctccatgcttcacccaacatgtgtagccatccatgaatcctcgtatcagatgagcgtgtacgtccactntgctatcaagcataatcttatttttgcaaa

SEQ ID NO: 7110 - DNA, 101 bp, rice(Oryza sativa)
  misc_feature (71): n=t or c
gacgggatgaacatgtcctgcaggaggccgtaatcctgcgccatgaagtgctgcatccggagaggagtagnagcagcagcagcgctccccgtcgccggcgg

SEQ ID NO: 7111 - DNA, 101 bp, rice(Oryza sativa)
  misc_feature (71): n=t or c
ggcaactgtaacttctcctacaatcagaaacttcccaaacagttcaactttttgtttaatttttgagaaantgtagctgtagattcataaaatgaactaga

SEQ ID NO: 7112 - DNA, 101 bp, rice(Oryza sativa)
  misc_feature (71): n=a or g
ctttgcaagccaaacagcacatgttggagctttgtattcagcatttcttgcgatgcatttagcagctggcnttccagctatactgtcggcacttgctttga

SEQ ID NO: 7113 - DNA, 101 bp, rice(Oryza sativa)
  misc_feature (71): n=a or g
ctgtcaatgcatttccttttatgcgtgcatctggacaaaatcctataaaagcatttagtgatatatctatnttgagggagacaacagcagacgagagtttc

SEQ ID NO: 7114 - DNA, 101 bp, rice(Oryza sativa)
  misc_feature (71): n=a or c
ttcaagccgccggcgtacgcgcccaaggtcgacgccgacgagcagcccaagtccaaggaatggctcgacgngcgggagcccgacgagctggaggatctcga

SEQ ID NO: 7115 - DNA, 101 bp, rice(Oryza sativa)
  misc_feature (71): n=a or g
ttcaacagacaaacagagattttcttggaccaacaagactccatttaaggggtgaaagcaaaaggacacgntcatgggccgtcagtggcagagaccggatg

SEQ ID NO: 7116 - DNA, 101 bp, rice(Oryza sativa)
  misc_feature (71): n=t or c
gcgtttatcctcttccatgatgctctcgcctctcgtttttgcatcgtcaaagccccaggcggcacggcgcngtcaggagatcggcgatgcccaaggcggcg

SEQ ID NO: 7117 - DNA, 101 bp, rice(Oryza sativa)
  misc_feature (71): n=t or c
ctcgtgtttctttgttacgagtgttaaataagcagtgcaatggctcttgtatttttgactttttgtctctngagaggacatcccctcattttagacattcg

SEQ ID NO: 7118 - DNA, 101 bp, rice(Oryza sativa)
  misc_feature (71): n=a or g
gccactgccttagtcatcttccgaggctcgtcacactcatcagcgaagtgtccaaacttgccacacctgcngcactcaatcttcgacttgtcgaacttgct

SEQ ID NO: 7119 - DNA, 101 bp, rice(Oryza sativa)
  misc_feature (71): n=t or c
gccgccggcaccatcgctcacatgctcgctgtggttcttgcggccacgcacaagctcaaggagaaccgtcntgaagcagtaaatgtcggtgcagtgcttgt

SEQ ID NO: 7120 - DNA, 101 bp, rice(Oryza sativa)
  misc_feature (71): n=a or g
ttccccaaatgtttgacggtagttaaccaacgaaaaaaacagagatagtattttttgctcatccatgtcanaaaaacgaagccaatatctatactacatta

SEQ ID NO: 7121 - DNA, 101 bp, rice(Oryza sativa)
  misc_feature (71): n=a or g
tatgcagtacacgggatgttgtactttttccctctctacgacgataaccatactcacagaataaggcgtgncagtaatatacaggaataattcttcattga

SEQ ID NO: 7122 - DNA, 101 bp, rice(Oryza sativa)
  misc_feature (71): n=a or g
actaattttctggaggcttatattgtcgatcaccaacgtaaccccttaaactggccacaggctagaacatnctccctccgtttcataatataaggaatttt

SEQ ID NO: 7123 - DNA, 101 bp, rice(Oryza sativa)
  misc_feature (71): n=a or c
tcagacatgtaaaattttcaggccaggtgcatgctcatgtcaccaaccaaacaggtccttatgcaagcatnttcagagtggtaggatcagctgtagcgagt

SEQ ID NO: 7124 - DNA, 101 bp, rice(Oryza sativa)
  misc_feature (71): n=t or c
acggagggagacgacaaccaaagtgacgccaaccacaacgttcccatcgacagcaccgccaacacaggcgnggcgaagggagacgacggctgccgtagcac

SEQ ID NO: 7125 - DNA, 101 bp, rice(Oryza sativa)
  misc_feature (71): n=a or g
cggagacgtcggagtcgtgtacggcgtggtgggcgtcgtcattggggtcgaaggatacggcgtggttggcntcggggttgacggatacggcgtggtcggcg

SEQ ID NO: 7126 - DNA, 101 bp, rice(Oryza sativa)
  misc_feature (71): n=a or g
ctgcgacaaggccagcgacgtcctcgtcttcaagacctgcgccgagatggaaggcccctacatcgaatacntcgccacgcaatacgacaagcccattctcg

SEQ ID NO: 7127 - DNA, 101 bp, rice(Oryza sativa)
  misc_feature (71): n=t or c
cgggagcccgggatcgagagtggcatggtcaccgtgcgcgaccgtgacgactggatcaacagcgtcaccgnggggctcagcactggcgcgctcttccgcgc

SEQ ID NO: 7128 - DNA, 101 bp, rice(Oryza sativa)
  misc_feature (71): n=t or c
tgtatgacagagaaactgggcgttcacgaggatttggttttgtaacaatggcgacacaggaagaattggangacgctattgcagccctcgatggacaggta

SEQ ID NO: 7129 - DNA, 101 bp, rice(Oryza sativa)
  misc_feature (71): n=t or c
caatttcattctcactcctttcaccctggaaatcatgatcagcgtcacctttcatagtcttcaggacaaangcctttgctttctttcgttgtgaactgaat

SEQ ID NO: 7130 - DNA, 101 bp, rice(Oryza sativa)
  misc_feature (71): n=t or c
aaagctaaaaatagactaaatttactaaaatagtgggtcttagcaaggccaaaacaggataatttatgtgnggttggtaatttggtataatggactataca

SEQ ID NO: 7131 - DNA, 101 bp, rice(Oryza sativa)
  misc_feature (71): n=a or g
acttgttggatcgatgtttccgcggagagcctcgggcaagatgtcgatcttgaggaacggcggtagtagcngcccgaggaacttggtcgtctcgccggaca

SEQ ID NO: 7132 - DNA, 101 bp, rice(Oryza sativa)
  misc_feature (71): n=a or g
tttatttatttatttatttatttttgcatatttgatgtttttattcatctaattgacacattggcaaaccngcaaatgataaattgttatagaccatgtaa

SEQ ID NO: 7133 - DNA, 101 bp, rice(Oryza sativa)
  misc_feature (71): n=t or c
aaactcagattattaccaagcagatgatgttctttggacccgtcacaaagaagtcttcgacttataccacngcgacgccctcgacgcctctatcctcagcg

SEQ ID NO: 7134 - DNA, 101 bp, rice(Oryza sativa)
  misc_feature (71): n=a or g
aatcggttgaatgacctgttgccttaatggtgtctgctgaattggttgtagaacctgccgtcttggtgacntctgctgaattggctgcacgacctgttgga

SEQ ID NO: 7135 - DNA, 101 bp, rice(Oryza sativa)
  misc_feature (71): n=a or g
atgaactgctccaggtttgtcttcatctcggcgtggctgccatcggccggcagcttcccctggaggacaanctgcataatgcaagattaattaattgtata

SEQ ID NO: 7136 - DNA, 101 bp, rice(Oryza sativa)
  misc_feature (71): n=t or c
ggagcacagggaggcaagggcaagaaggaagccaagccacccgcaatgacaagccgtatggccagcaggancagacatgctacaagtgtggcatttggggc

SEQ ID NO: 7137 - DNA, 101 bp, rice(Oryza sativa)
  misc_feature (71): n=t or c
gtcaaccttgaagcccaagccgaagctgacatgggggctatgtgtcagaacatggccaagttgcaagacangcttcgccaaatgcatgagctacagcaagc

SEQ ID NO: 7138 - DNA, 101 bp, rice(Oryza sativa)
  misc_feature (71): n=t or c
acaattttgctttcatcaggggctgagaaacatatcagggtcagctcggagagtgctacaaggatgcgcgngccacgattgttctcaacgagctccttggc

SEQ ID NO: 7139 - DNA, 101 bp, rice(Oryza sativa)
  misc_feature (71): n=a or g
aagatgcgaaagcgtaccagaaactgtagccatggttgtgagttgccatatcttgagaaatcgtctatgancgtgataaaatatcgttgaccattccagga

SEQ ID NO: 7140 - DNA, 101 bp, rice(Oryza sativa)
  misc_feature (71): n=a or g
ggatcccatgaagtcaattttgaaccttgcaaggccaaagtccccaacatgagctatcatatcgtcatccngaagaatgttgctaggcttcagatcacaat

SEQ ID NO: 7141 - DNA, 101 bp, rice(Oryza sativa)
  misc_feature (71): n=a or g
ctgtacttatatttttttaattgtgatacttgttattggatggttaattgaggctgaattaatggtggttnttttctttttttttccccaaatctgtacca

SEQ ID NO: 7142 - DNA, 101 bp, rice(Oryza sativa)
  misc_feature (71): n=a or g
tggaggagggaaaggaagcacttccgtcgccttccttcaagcagtgcgaaatccgatggcctgccccggcnatgacgaggagggagggatggggcagggct

SEQ ID NO: 7143 - DNA, 101 bp, rice(Oryza sativa)
  misc_feature (71): n=t or c
gagtgaccgtcatttccacagaccttacatgtcatgtgagagcccagggccttaacagtaccctgcttggngtatttctcactgttgtctagtctcttttt

SEQ ID NO: 7144 - DNA, 101 bp, rice(Oryza sativa)
  misc_feature (71): n=t or c
accacactattagaaaacattttttttttacaaacgggccaaaatgatttttccagatggccatccacccngcctgcacttcaagacctatgaaaatacat

SEQ ID NO: 7145 - DNA, 101 bp, rice(Oryza sativa)
  misc_feature (71): n=a or g
ttgctgagtaggatgccacgtcagcaaaccagatatccatactgccatgggaccgaaattgcatggttttntaaagtttaagggtgaacatttctggtttt

SEQ ID NO: 7146 - DNA, 101 bp, rice(Oryza sativa)
  misc_feature (71): n=a or g
ttcataatttttactaggctataaaaaagcagcgtacggatgagagttcctaattggatataaatacaatnaaaataaaaaaaatctcatagacttttaat

SEQ ID NO: 7147 - DNA, 101 bp, rice(Oryza sativa)
  misc_feature (71): n=t or c
gtgaatgacgccgtcgacgatccgccgatctccatcgcgcgagtggccatctgtttcgccaacgccatccnctccctgatctgcttcccttgctctgactc

SEQ ID NO: 7148 - DNA, 101 bp, rice(Oryza sativa)
  misc_feature (71): n=t or c
caaccacgagccgagcctttgctcctcctccggcacctagtactacatgtaggagttaggggcagaatttncatggcccggggcagggttcccaccatcgg

SEQ ID NO: 7149 - DNA, 101 bp, rice(Oryza sativa)
  misc_feature (71): n=a or g
ggcaaaagcctgtccctcgaccaatgccccagagctaaccaacttcaccaactcgccgtcgtctatgaganaaatccccaaataggcggtggtgtcgtcgt

SEQ ID NO: 7150 - DNA, 101 bp, rice(Oryza sativa)
  misc_feature (71): n=a or g
gtacctgccggcatcggccgcctcaccagcctgaactatcttgacctgtcgacgacattttttgtagaggngttggacgacgagtacagcatcacgtacta

SEQ ID NO: 7151 - DNA, 101 bp, rice(Oryza sativa)
  misc_feature (71): n=t or c
taaattcgatcaacaaaataacagaattttttttgtcgtacaagtattattcattaccgatgttaccaatnattttttatatttttataactattcaagtc

SEQ ID NO: 7152 - DNA, 101 bp, rice(Oryza sativa)
  misc_feature (71): n=t or g
taattaagctaaggatgatgaagaggttctactcgtcgatcgggcagggggtggaggcgctgcaccggagnctggcggtcggcgaagtggggttcatgtcg

SEQ ID NO: 7153 - DNA, 101 bp, rice(Oryza sativa)
  misc_feature (71): n=a or c
gaatgggtttctaatatagtcttagttatcgacaagaatgataaacttagggtttgcattgattttcggantttaaataaggctacccctaaggatgatta

SEQ ID NO: 7154 - DNA, 101 bp, rice(Oryza sativa)
  misc_feature (71): n=t or c
gtggcagcgaaggggacaagaggagtgacagtggaggaggcagatctggcgcagtagttctcatgacgttntagacctcgacctcgacagtgacgggctga

SEQ ID NO: 7155 - DNA, 101 bp, rice(Oryza sativa)
  misc_feature (71): n=t or c
cggagacaacgctcggcggcatctgcgagtggcagcactggcatgaggagacagaggcggactcatggcgnggcaccgagctccgaaacggtgggaaggcg

SEQ ID NO: 7156 - DNA, 101 bp, rice(Oryza sativa)
  misc_feature (71): n=t or c
ctgcaacagctgccagccctgagcaatctctgtgctaaccccgcgcctccaacctgggtctgggttagttntcaactttttcatcacatcaaaacttttta

SEQ ID NO: 7157 - DNA, 101 bp, rice(Oryza sativa)
  misc_feature (71): n=t or g
tttgatcaactacgatttacattgaactattcattggttttctctttttttttctaattgacaggtcgtgnaggttcacaacgaacaggatacaagaaatt

SEQ ID NO: 7158 - DNA, 101 bp, rice(Oryza sativa)
  misc_feature (71): n=t or c
agagggtgcaccggatctggcgtctcctaccagatctggttggagaaccgatggcaacggcgaccacgacngcagctgtcggcgtgcgaggcggcgagatg

SEQ ID NO: 7159 - DNA, 101 bp, rice(Oryza sativa)
  misc_feature (71): n=t or c
ctaaaccatcccctgcacttgtttgcagggttcgacatttcggactgaattttgaaaattttggttatttnggaccctccgatacaatattattttggccg

SEQ ID NO: 7160 - DNA, 101 bp, rice(Oryza sativa)
  misc_feature (71): n=a or g
tgggagcagctcggatctggggaggtaatgatcgcacgggggcaactgggcaaaggacggatcgccctccncggcttggctgtcatctggttattctggcc

SEQ ID NO: 7161 - DNA, 101 bp, rice(Oryza sativa)
  misc_feature (71): n=t or c
atctcatatctacgtttcaaacgacagtgtatgtagacaaactttcatataagctttgtagtttatcaccnttttatttaaatttaattagagtggcaaac

SEQ ID NO: 7162 - DNA, 101 bp, rice(Oryza sativa)
  misc_feature (71): n=a or c
gggtcgaccagaacgtctccaactacctcaacgacggcgtcaagatcaggtctcactcactcactcactcnctgaagattcttcagttcactctcaagcag

SEQ ID NO: 7163 - DNA, 101 bp, rice(Oryza sativa)
  misc_feature (71): n=t or g
atcatattactgtatactagtaatgaaatatttgagtcaacaaaagccagatatctggctcatggtaaaanaaaagtatacccagtatagatcttactcac

SEQ ID NO: 7164 - DNA, 101 bp, rice(Oryza sativa)
  misc_feature (71): n=t or c
aaatcgtattgaaattgcacatgagcgtgggtggttattttgtttcattgttgtgtttcgacaattaaaanttgtgcatctaataaaaaagactaaaacta

SEQ ID NO: 7165 - DNA, 101 bp, rice(Oryza sativa)
  misc_feature (71): n=a or c
acgccatgaagaagcctcgcgtccgtgtcgcgccggattcctcagcttcggaggatgacaccgacgaggancatggccatgacgaaggcgacggcggcgag

SEQ ID NO: 7166 - DNA, 101 bp, rice(Oryza sativa)
  misc_feature (71): n=a or c
tcggatgggcgtcgagcggcggagcttgcaccagagttcggcggctctagcttgcggtggaagaaggggancaacgttccgatgcagggaaggggctcaag

SEQ ID NO: 7167 - DNA, 101 bp, rice(Oryza sativa)
  misc_feature (71): n=t or c
gatgtgcaggcagcgcggggccatccatgccgctctcctgaggtgattcgtcggcttttgctgatccgcgngcgcgaagtaccattgcgcgaggatagtgt

SEQ ID NO: 7168 - DNA, 101 bp, rice(Oryza sativa)
  misc_feature (71): n=t or c
aacggattcgtggcggagccagcggttactctgtcagggggagccacggtcctctcgacgttcaccttccnagacatatgtcctcttgcgacggcgacttt

SEQ ID NO: 7169 - DNA, 101 bp, rice(Oryza sativa)
  misc_feature (71): n=a or g
tttttttttccaaaaacacccagcatcataagtggctagggcagtggacttgcaaagcagcaagtcaaggnttcgattctctattcgcgcatgcacaatta

SEQ ID NO: 7170 - DNA, 101 bp, rice(Oryza sativa)
  misc_feature (71): n=t or c
tgtaaaataagtagtatgatcatttctttgcttagtggacaaagattaccttatatatatatctcgttaangcatgtttgataaggaaaagatttctttgc

SEQ ID NO: 7171 - DNA, 101 bp, rice(Oryza sativa)
  misc_feature (71): n=t or c
ccgagccggccaaccgcctcgaccagttcccccctcagtctctgcggcagcagctgccctcttgcactcgngcatgcccggtacagcggcaggtacgcgat

SEQ ID NO: 7172 - DNA, 101 bp, rice(Oryza sativa)
  misc_feature (71): n=a or g
atgcacatgctcttagcctccgtgggtgtcttggcgtcgagctttgtcgtgttggtgcctccgtcctcccncagagtgtcgtgcatgaacgccatgccgtc

SEQ ID NO: 7173 - DNA, 101 bp, rice(Oryza sativa)
  misc_feature (71): n=a or c
gcatcatggtcggggaagcatgggtgccgcgagtgcggcggcaagatgaggatgttgatgaagcccctcanggcggcaggctgcgctggcgggagaggggg

SEQ ID NO: 7174 - DNA, 101 bp, rice(Oryza sativa)
  misc_feature (71): n=t or c
aggttaagtcattccgactacgcactcaaggataaaagagaagcttaccgctgggcttgtcggcttctggngggtcccgagcacggaggagaactttctcc

SEQ ID NO: 7175 - DNA, 101 bp, rice(Oryza sativa)
  misc_feature (71): n=a or g
ctcctccatggcagctgcggcggctgcgtttgtggcggcgggcagcgtttgatgatcctcgacctggacgnccttgcaccgtttcttgaacggcagcgacg

SEQ ID NO: 7176 - DNA, 101 bp, rice(Oryza sativa)
  misc_feature (71): n=a or c
tcagcaaacgcacacgccggtcacaccggactcggaattcgtctattaggggctgtttgtttttcaggganttaggcctgtttaattcagcttaagattat

SEQ ID NO: 7177 - DNA, 101 bp, rice(Oryza sativa)
  misc_feature (71): n=t or c
aggcttggctgataggccacgcgatgcttgaatgaccggtatggcaaggcgggtgcgcctgtgagctgacngcctaccaggcggcgtgcgcctgtgccatc

SEQ ID NO: 7178 - DNA, 101 bp, rice(Oryza sativa)
  misc_feature (71): n=a or g
ccgtgtacaataacatccctatcaatagaggctttcaggcaaaatggcacgaggggaagagggatgcagcntgcatgactctcacttctcagagtatggtg

SEQ ID NO: 7179 - DNA, 101 bp, rice(Oryza sativa)
  misc_feature (71): n=t or c
taaagaaaaagaaatctgtgaagccttcttcttctgatgatgatgatgatgttgaagtggaagatgttgangaagaaattggtgaagaaaatgctgaagaa

SEQ ID NO: 7180 - DNA, 101 bp, rice(Oryza sativa)
  misc_feature (71): n=a or c
gaattgacacatcatttcagcagttaataccaggacatgtcacaaaattgtctaacaaaatgcagttaagntttgattttataaagcgattccttgctagt

SEQ ID NO: 7181 - DNA, 101 bp, rice(Oryza sativa)
  misc_feature (71): n=a or g
atttagagtttggcatgacagactgggtcatcctgggttgggtatgatgaggagaatcatcaataattctnctggccacaatgttgaaaccaaagacttcc

SEQ ID NO: 7182 - DNA, 101 bp, rice(Oryza sativa)
  misc_feature (71): n=t or c
atttcagctacattcagcagctgagagaaggtgtgcacaacttctttgttacttttattgaagttttgcgngataggcctcctggtcatgagtgggagctt

SEQ ID NO: 7183 - DNA, 101 bp, rice(Oryza sativa)
  misc_feature (71): n=t or c
ctgttccttctactgtactgatgttcgttgaagcactctttactggttggtaattttttttatcatggcgnaggaaaaacaatggaaaaggcaagaggaag

SEQ ID NO: 7184 - DNA, 101 bp, rice(Oryza sativa)
  misc_feature (71): n=a or g
gtacgatgcctccgctggcggcggcgctgtggctgtgagcgcgtatgagcagaggatccgtcgtaatgccnccgtgctcgagaaggtcgccgtttcggtgc

SEQ ID NO: 7185 - DNA, 101 bp, rice(Oryza sativa)
  misc_feature (71): n=t or c
ttcgaggtctgtccagcaggctgtggatactccctcatcagtaatcgagggttcatcggctgaggcgccgnggtagccgatgcagcaggtaagggtgttga

SEQ ID NO: 7186 - DNA, 101 bp, rice(Oryza sativa)
  misc_feature (71): n=t or c
aaagatactttccatgagggcaagtgcgaagttgcagctgttggtaagcttttttttttttgtttatgtgnttttgctttgaatattcaaagtcacattta

SEQ ID NO: 7187 - DNA, 101 bp, rice(Oryza sativa)
  misc_feature (71): n=a or g
caggatgtccacggaaggattcgccgagctgacgaggaagtgccctctcctagaggagatcgtcctcagcngcggcggccatcgccgtcccccgctgccgc

SEQ ID NO: 7188 - DNA, 101 bp, rice(Oryza sativa)
  misc_feature (71): n=t or g
caatggtcagcacagtacagttgatgatgccgatgatggtaatgtcagcgtagatgttagtaattttgcanatttggaagagatgttgcgtcatgctgaac

SEQ ID NO: 7189 - DNA, 101 bp, rice(Oryza sativa)
  misc_feature (71): n=a or c
tgcgcatgcaatatccggattttagaagggcccttacgcacaacatcgcctcagggaggacactgttcggnagggccttttcgcaaaaaacccacccccat

SEQ ID NO: 7190 - DNA, 101 bp, rice(Oryza sativa)
  misc_feature (71): n=a or g
tgtgaagccgtccggaccaggcgctttgtcgctgggagactgtttaagtgccacgtgaacctcctcttccntgatggggccactaattacggagctgtcga

SEQ ID NO: 7191 - DNA, 101 bp, rice(Oryza sativa)
  misc_feature (71): n=t or c
tccgtcttgactatccccgagccttgagcagcgctgctgtttgtggctgcactcgtgccaacatcggcggnagtcgttggcggtgtagcaagaccactagt

SEQ ID NO: 7192 - DNA, 101 bp, rice(Oryza sativa)
  misc_feature (71): n=t or c
cttttggcacgcccggtgagactgattagaagtcagaaaacaaccttcctcatggccgagaagctgccgcngtcgccatcctcggctagtccaggttctgt

SEQ ID NO: 7193 - DNA, 101 bp, rice(Oryza sativa)
  misc_feature (71): n=t or c
cggttcttcttcgacttgggaggggactcggggagatcgtcctcctgcgccgcatcatctccttgcggagntggcacctcgttcgacggcgacccggcggc

SEQ ID NO: 7194 - DNA, 101 bp, rice(Oryza sativa)
  misc_feature (71): n=a or g
acagggcctcttgtagatcggagcggttcttggtgccagatcaacccggaactcgatctccctcttcggtngcatggtagtgaggtcctcggggaacactt

SEQ ID NO: 7195 - DNA, 101 bp, rice(Oryza sativa)
  misc_feature (71): n=t or c
aaaatcacaatgaaatgaagcacacggaagcagatcctctgacatgcagttgggtcattgacatgtgggtnccactttgctatggcccacatgtcagtgac

SEQ ID NO: 7196 - DNA, 101 bp, rice(Oryza sativa)
  misc_feature (71): n=t or c
cacctgatgctgtcgcttaaagcccggaacacagccttggaccagtcaatagcagcgaccctgtcgaggtnggatgcgaccccgacatcgcccttgggcac

SEQ ID NO: 7197 - DNA, 101 bp, rice(Oryza sativa)
  misc_feature (71): n=t or c
tgttttggccgaagtctgtagctcatagaatttttggccaatgacaaataatgtcgggtcccaaaactaangattcggaaaccgacatgtttagactgtat

SEQ ID NO: 7198 - DNA, 101 bp, rice(Oryza sativa)
  misc_feature (71): n=t or c
taaagatggtttcttcagcagtggatgaaataaattcactcgagtttaaaccctatttttgatataggtgnttgtatttacgactaattattatctcaatg

SEQ ID NO: 7199 - DNA, 101 bp, rice(Oryza sativa)
  misc_feature (71): n=t or c
gacgacctcgccggcctccccacccgtcttctccgtcatgttcggcgagttgtccaggcacgggtgcttcnctgtcgacggcgccggcgacggggacactt

SEQ ID NO: 7200 - DNA, 101 bp, rice(Oryza sativa)
  misc_feature (71): n=a or g
ggagtcggggaggattgaaggcggcgcgcggcggcagaggagagatgagggcaacgataaaaactatggcnagctggcgcccttgacagctcttgcggggc

SEQ ID NO: 7201 - DNA, 101 bp, rice(Oryza sativa)
  misc_feature (71): n=t or g
gagcgcggtggtgtgcaccaccatggtgtccgggtacgcgcaaaacgggatgcacgaggacgccatgcggncgttcgaggagatggtcggcgacgggatcg

SEQ ID NO: 7202 - DNA, 101 bp, rice(Oryza sativa)
  misc_feature (71): n=t or c
atacccgataacatgaaggcggctctaacactattatcgtccaaaggcttgagatgatacatcctctcagnacttctcgataacacgatggcagctctacc

SEQ ID NO: 7203 - DNA, 101 bp, rice(Oryza sativa)
  misc_feature (71): n=a or g
atatgttgaacagaaggagtaattgttaggaggagttgctacttgctggttttcttttggcaagtccaatnctgctactctgtggcaatggctctgctgga

SEQ ID NO: 7204 - DNA, 101 bp, rice(Oryza sativa)
  misc_feature (71): n=t or c
aattgtttctagaattattgctaatatcctatcatcctttgctctttttacaatgatgcctccccgcactngccatggtcgtcgtgcgcccactccggatc

SEQ ID NO: 7205 - DNA, 101 bp, rice(Oryza sativa)
  misc_feature (71): n=t or c
caacatcctagcgccatgtagtttggcgatctccagaaaccatcaaaacaccactcaccactacaacacanaagaaatcatatgcatttagatctattact

SEQ ID NO: 7206 - DNA, 101 bp, rice(Oryza sativa)
  misc_feature (71): n=a or c
aggatttttttttcctacttaattttctaattataagcatatgcatgcaatatacagctttccattacaanttgagctgcgccaacctgccaaaatgcacg

SEQ ID NO: 7207 - DNA, 101 bp, rice(Oryza sativa)
  misc_feature (71): n=t or g
ctcgctgagggctctcaacctcgtcggcaacccggtgcagacaaacatcggcgacgacgcgctccgcaagncggcgtcgggcctcctgtcgcggctcgagt

SEQ ID NO: 7208 - DNA, 101 bp, rice(Oryza sativa)
  misc_feature (71): n=t or c
aattgtaaaaggaaatacaggaatattccctctgtactcataaaatcgttttgcacagcgacgtggtctcnaaaacataattttgacttttggtttctata

SEQ ID NO: 7209 - DNA, 101 bp, rice(Oryza sativa)
  misc_feature (71): n=a or g
tgaccaaacatatatactctagatgtatatatagtagccaaactatttgagataaggatatacttacttgncaatgcataatttgctctactagttactct

SEQ ID NO: 7210 - DNA, 101 bp, rice(Oryza sativa)
  misc_feature (71): n=t or c
accaaaaaattggtagggtaacaatctaaataggccctttgtgatctatagagccatggacgaaaagagtngaagatgaccaggtagatagtgatgagaga

SEQ ID NO: 7211 - DNA, 101 bp, rice(Oryza sativa)
  misc_feature (71): n=t or c
gacaggatttgatttgaacatgccactagatgaatttggtgtagttgatttagatttttttacaaaaccangctggtaatcttgatctcagtttgttcttt

SEQ ID NO: 7212 - DNA, 101 bp, rice(Oryza sativa)
  misc_feature (71): n=t or c
gccggaaaccctcggcgagtggtgagggtactggagtcggtgttaccggctccagtgttcctttgggcagnagcgccgttgtcgcggcgtcgtcctccatg

SEQ ID NO: 7213 - DNA, 101 bp, rice(Oryza sativa)
  misc_feature (71): n=a or g
caaaggcctagcccaatacaatagcaaaggcctaagcccaagacaacagcaaaagcaaaacactagtcctngctcgatcactcctagtcctagcggcgacc

SEQ ID NO: 7214 - DNA, 101 bp, rice(Oryza sativa)
  misc_feature (71): n=a or g
taaatctgtacaggattactatggtgagctacaaaaggtatttatgcgatgtagcatagtggaaggaaccnaggattccatttgtcgcttttacatgggat

SEQ ID NO: 7215 - DNA, 101 bp, rice(Oryza sativa)
  misc_feature (71): n=t or c
tctccaagtcgtggctgaagggccgtgacttgttgctctctcgagcgtcaccggcgccgccgatatggacntgatggctgtcctcaggagctccgcctcgt

SEQ ID NO: 7216 - DNA, 101 bp, rice(Oryza sativa)
  misc_feature (71): n=a or g
ctccagccgcctaacggaacggaagaaggcgagccggtcaaggatgggggaatcgagttgggggacaaacncggaggtcatgggagccttgaagaagatgg

SEQ ID NO: 7217 - DNA, 101 bp, rice(Oryza sativa)
  misc_feature (71): n=a or g
cacccaaccgacgcttatccgttgccttcgcccctccgatcgatccattgctgaatgcctgaaccttagtngtggcactggcaacattgtgtctctttttg

SEQ ID NO: 7218 - DNA, 101 bp, rice(Oryza sativa)
  misc_feature (71): n=t or c
gcgagggcattataccatagacgcgctcggagatctcgagcagccgatccggcgtcttcttcaggaagaanttgcggaagagcgccatccttcccctcctc

SEQ ID NO: 7219 - DNA, 101 bp, rice(Oryza sativa)
  misc_feature (71): n=t or c
tcgggagttgtccactaagactattgctcattagtctaagtacttggagagatgaactgtttgccaaggantctggtatgcttcctgtgagagcattattg

SEQ ID NO: 7220 - DNA, 101 bp, rice(Oryza sativa)
  misc_feature (71): n=a or g
gatgtcggtaatattggtatattggaaacggaaccatcggaacagggtctaccgatattggacggaagtcnaaaattcatgttgaaaacaatggagtgtgg

SEQ ID NO: 7221 - DNA, 101 bp, rice(Oryza sativa)
  misc_feature (71): n=t or c
atcttgctttccatgaggcaggattttctttggtcattacacctgttttccccatcagcttttcttctttnttcatatctccaagaatcctttcacatgct

SEQ ID NO: 7222 - DNA, 101 bp, rice(Oryza sativa)
  misc_feature (71): n=t or g
tctacaccgttataataatgtagatccttcatggttactgatgtaggtttcttctctctctgttttttttnggagatatctgttttgtgttaatgtggtga

SEQ ID NO: 7223 - DNA, 101 bp, rice(Oryza sativa)
  misc_feature (71): n=a or g
gcaccgcgtcgacgcccacgtctccgtctacaccgagaccggcggcctcctcgtcaccgacgaggagaagnccgatccgcagcgctacaccgactgcatcc

SEQ ID NO: 7224 - DNA, 101 bp, rice(Oryza sativa)
  misc_feature (71): n=a or g
cgactgcgcagacggtcagcggtccagcatctgttaattgcgaccaaccacaagaagaagcagcatcgagncggagcgagcgacttccaaattggggtgga

SEQ ID NO: 7225 - DNA, 101 bp, rice(Oryza sativa)
  misc_feature (71): n=a or g
ggagctcagcttaattatgccacaactgaaaaagagctcctggccgtggtgtttgccattgataaattcangtcttatttagtgggagctaaggtaatagt

SEQ ID NO: 7226 - DNA, 101 bp, rice(Oryza sativa)
  misc_feature (71): n=a or c
gaaagggggagatagtccacctccattcggaattagaccagaagcaaattcaatgttcttgccactgttantttgatggggaggggaggactctgttgtct

SEQ ID NO: 7227 - DNA, 101 bp, rice(Oryza sativa)
  misc_feature (71): n=t or c
aagcggttggcggtggtggtgtcccgtcttcccagctagctgagcaaaccactcttcgtggagcccctccnctcctatggccagatcttgtcttggccatg

SEQ ID NO: 7228 - DNA, 101 bp, rice(Oryza sativa)
  misc_feature (71): n=a or g
gacccgcatacataaaaatgatttttcatataatgatttttcatatacgggcattttaagaggtccacatnaaaaaaaaagagtttattttttcatgcggc

SEQ ID NO: 7229 - DNA, 101 bp, rice(Oryza sativa)
  misc_feature (71): n=t or c
tacacagtcccgaagctccccttgccgatgcagtacgcgtcgttgaagtgctctatcgccgccaggatgtngccaaaggagaacgtcatgtccttgctcca

SEQ ID NO: 7230 - DNA, 101 bp, rice(Oryza sativa)
  misc_feature (71): n=t or c
ccaccctcacaacagaaaccaattagtttaactaaattgatgtgttggatgattccaattgagctcacttnggccctaaattgcttctctccttggcatgc

SEQ ID NO: 7231 - DNA, 101 bp, rice(Oryza sativa)
  misc_feature (71): n=a or g
ggccatatcgacgatgggtacatatcattgtttaggtgacaaaacaccggcgcgtacgaagcccccgtcgnatggcagccaaataaaaaactaaaattaaa

SEQ ID NO: 7232 - DNA, 101 bp, rice(Oryza sativa)
  misc_feature (71): n=a or c
gtgtaaacgtcgagaggaaatcttcttaagaactgtgaaatacaactacatgataatataatcaagatgtnatggggtaattacagtaaaactaacattta

SEQ ID NO: 7233 - DNA, 101 bp, rice(Oryza sativa)
  misc_feature (71): n=t or c
gtgttcttggtgatcgatgatgcaggcgtggcgaagttcgatccggcgacggggaagcagttcaagtcgcnggcgaagacgctgtcgtacacgaactactt

SEQ ID NO: 7234 - DNA, 101 bp, rice(Oryza sativa)
  misc_feature (71): n=t or c
acaacttcatcttcttcgtgtgaactataccccaactcctcacgattgctggattgccccgctgcgctctncgtggggactcttccttgacatgcttgaac

SEQ ID NO: 7235 - DNA, 101 bp, rice(Oryza sativa)
  misc_feature (71): n=t or c
tagaaaaataccattaatattcacgatatcggttggatgccactgtaattttaggaaattggatccatgcnactccgtcgtgttttccatccgctccccgt

SEQ ID NO: 7236 - DNA, 101 bp, rice(Oryza sativa)
  misc_feature (71): n=t or g
cctctccgcccattcctcccttgcctttgccgcaacccgacctgcccccgccgctttttcacgtccttcgncttctccccttcctcatcggcactcggcag

SEQ ID NO: 7237 - DNA, 101 bp, rice(Oryza sativa)
  misc_feature (71): n=t or g
gcttcggtgcacttgaagcacttgatgcgaggaatgtccttcttgctcaacttatttcctttcttccaagngcaatctctaacatgatgtcccactttctt

SEQ ID NO: 7238 - DNA, 101 bp, rice(Oryza sativa)
  misc_feature (71): n=a or g
attcgtagcctgcccgccatgctgtggctgatcccttgttaacaaccaagggttcactagctgtcctagcntcatagctagtgtagcaggcaaaggagtcg

SEQ ID NO: 7239 - DNA, 101 bp, rice(Oryza sativa)
  misc_feature (71): n=t or c
ctcctcatgagcatgctctagcgcttgcacctggtacacaaggtgaacaccatggacaaggtgtttgtccnggtcagaagccttgacaaccgctccctctt

SEQ ID NO: 7240 - DNA, 101 bp, rice(Oryza sativa)
  misc_feature (71): n=t or c
gtgaagcgtcatttaacgcccccaccaattgtaagggcagccggccaatgtcaagaagatgaagtaaagtngtcggagccctcgatccataagctcgccgt

SEQ ID NO: 7241 - DNA, 101 bp, rice(Oryza sativa)
  misc_feature (71): n=t or g
gagcaaaagggcctggcgtcaggttagttaaagcaagaaagtcaatgctcagtgtattattcgggaattgntttggaaagccttggtagtagtgcactcaa

SEQ ID NO: 7242 - DNA, 101 bp, rice(Oryza sativa)
  misc_feature (71): n=a or g
gaggaggtgatcgggaggatgcggttcccggtgcggctgctcaacgtgacgaagctgaccaacttccgcanggacggccacccgtcggtgtacggcaaggc

SEQ ID NO: 7243 - DNA, 101 bp, rice(Oryza sativa)
  misc_feature (71): n=t or g
tcctacatctccgtcggacgtcgggctggagtacgcaggcatgacgacgacgacgatcacgtccagcgtcngtgccggtcctccgccgtcgaggtccacca

SEQ ID NO: 7244 - DNA, 101 bp, rice(Oryza sativa)
  misc_feature (71): n=a or g
taacaaaattttgttcaaaaaagtttgtacataaagttcgttcgtgtgtagaaggctcttctgacgtaaantcagagggacgtgggtcactgacgtgtggg

SEQ ID NO: 7245 - DNA, 101 bp, rice(Oryza sativa)
  misc_feature (71): n=t or c
cagaccgccggtggcgtcttgcgatctttgccatcctccctcgacctcgcgctgaagcagcaatcgatgtnctcgatgacgaggatggtgcggttgggcat

SEQ ID NO: 7246 - DNA, 101 bp, rice(Oryza sativa)
  misc_feature (71): n=a or g
cgagcccgtggtggacgtggacgtcgttgtgactgtgctgtcactcggagtcggctggtcgctggacgacnctgctgttgctgctgccaccgtcgcagccg

SEQ ID NO: 7247 - DNA, 101 bp, rice(Oryza sativa)
  misc_feature (71): n=a or g
cgacaacggcgcacggccgctgtcctcatcggaggagctctcgaagtcgtcgtcgtcgtcgcggcggatgncaaagccggcggagctccggcggcggtgct

SEQ ID NO: 7248 - DNA, 101 bp, rice(Oryza sativa)
  misc_feature (71): n=t or c
aaaataggtttcaattatttgacatccaaccccacttttattcacttagatggtcccatatgtcatcctgncaattaaagcaattggacaataaaaaaaat

SEQ ID NO: 7249 - DNA, 101 bp, rice(Oryza sativa)
  misc_feature (71): n=t or g
ctaattaattagtataaatgaagcagcgaaatagtatttaatttgcccctggaattagtcggtaaccatgngaaactgttccaaccgttacattgcggagt

SEQ ID NO: 7250 - DNA, 101 bp, rice(Oryza sativa)
  misc_feature (71): n=t or g
accttcacaataacagtatcaatttgtgtaccctgtttcacaaataagttgtatttttcttgagcaaaatngtgatcactagatgttcctccaacatgttt

SEQ ID NO: 7251 - DNA, 101 bp, rice(Oryza sativa)
  misc_feature (71): n=t or c
agacgaagatgaaggggggaagattgagagggaggtggcagcgagggggttcctggcgacgaggatggtgngggaggtgcgcgtggtggaggcggaggcgg

SEQ ID NO: 7252 - DNA, 101 bp, rice(Oryza sativa)
  misc_feature (71): n=a or g
ggcttcgaggtgtttggttgagcatcggaccggatttttggccttccactagcctgaccagcctgccgacngggtgagcggtgttgagcgatcggaggatc

SEQ ID NO: 7253 - DNA, 101 bp, rice(Oryza sativa)
  misc_feature (71): n=a or c
agccctccctcaatggtcgagaagacgatagcagatgccacctcctcacagtattcttccttgtagctatntgcctgagaaggcgccgggatagtacgaaa

SEQ ID NO: 7254 - DNA, 101 bp, rice(Oryza sativa)
  misc_feature (71): n=t or c
ttagcaactgacatctgaacatatggttgtaatttcaaataaaccatatccccaacattgaaaactctttntgaacgatgcttatcagcctggtatttcat

SEQ ID NO: 7255 - DNA, 101 bp, rice(Oryza sativa)
  misc_feature (71): n=t or c
gtccctgcccagaggaattttcttctctttgcatctagaatgcccaaggcttccttagagatcttaagagnagtgagcaaatagataggttgcgcagtcag

SEQ ID NO: 7256 - DNA, 101 bp, rice(Oryza sativa)
  misc_feature (71): n=t or c
gcatctgcatctgcatcaatatccgctggatttctaaaagattataccatatcttcgtttcggacagactnggagcggatcggataatatccgatccgttt

SEQ ID NO: 7257 - DNA, 101 bp, rice(Oryza sativa)
  misc_feature (71): n=a or g
gcgggaagcaactgccacgacgaccgcttcaaagcaatcagtgggcactaccgcacgccggactacggccncagcatcgcctaccggttctccacagcgag

SEQ ID NO: 7258 - DNA, 101 bp, rice(Oryza sativa)
  misc_feature (71): n=a or g
gaactatttcaagaacatttgcatcttagtcattcatgtaacgtaactcattctcatgattatattttgcncttttttagtcgtcgcattcatttggtgtt

SEQ ID NO: 7259 - DNA, 101 bp, rice(Oryza sativa)
  misc_feature (71): n=t or c
aaagcatcgatgttaaacttttttgcatattgatgttaaacaggacatttacaaacatggatgaactcatngatgattataagactggtgctttgcatcct

SEQ ID NO: 7260 - DNA, 101 bp, rice(Oryza sativa)
  misc_feature (71): n=a or g
ctagtcagcctctcctctctccttctctccctccggtccagcgtggcgccatcatgatggtggaggaggtngagcagcggcgacgaataaggagaagcagc

SEQ ID NO: 7261 - DNA, 101 bp, rice(Oryza sativa)
  misc_feature (71): n=t or c
tcttaattctgatgcatgatccaagctgcagagcaggcaggcaggcaagcaagcatcttattccaaattcnaagggcatgttcactttgatgccaaaaaaa

SEQ ID NO: 7262 - DNA, 101 bp, rice(Oryza sativa)
  misc_feature (71): n=t or c
ccatccacgtaagacggggtagctaattaacgtacgattgattaattactactctgttctaaaatataagnatttttagcatagtgtgaagtcaaacattt

SEQ ID NO: 7263 - DNA, 101 bp, rice(Oryza sativa)
  misc_feature (71): n=t or c
tgccattgtacaataaaatttatttcccttcagaagaaaatgcaatacttacttttgacatttaggctttntacagtctttaatatacgactttaaccata

SEQ ID NO: 7264 - DNA, 101 bp, rice(Oryza sativa)
  misc_feature (71): n=t or g
ggtaaaccccgtctccgtaatcgatcggccgtcaacacctgtttagtgccactaaccacaggaaatagcgncatcagggctgcgctaacgatccccagata

SEQ ID NO: 7265 - DNA, 101 bp, rice(Oryza sativa)
  misc_feature (71): n=t or c
taattttacatcaacaaagttaattatcaatcctgtaaatttaaaatggaacatatcttgtgcacacgagntttcatgcacacttcgtaaatatcaaatat

SEQ ID NO: 7266 - DNA, 101 bp, rice(Oryza sativa)
  misc_feature (71): n=t or c
gaggagaaggccggcgagctcgcagccatatccttcgccatggggatccggcatcgccaccgcgatgatcngccgctgacactcgcgaagaaggggaggtg

SEQ ID NO: 7267 - DNA, 101 bp, rice(Oryza sativa)
  misc_feature (71): n=a or g
ctaaaattatttatttaatattgttgaagtatattttaaacaaacataacagtaggaatgaaaacggatcnaatacggtcggaaactagctctatcatatt

SEQ ID NO: 7268 - DNA, 101 bp, rice(Oryza sativa)
  misc_feature (71): n=t or c
gtccttttcagcttcacgctgcaagtcaccctcctctcgcttgcttggatccgtcggcacagcatcgccancatgccaaagctggtcctatgggtggcgta

SEQ ID NO: 7269 - DNA, 101 bp, rice(Oryza sativa)
  misc_feature (71): n=a or g
catgttgaagaaactcggcgggatctctccgatgaggctgttctacgacaaggctaacatgcggagcgccnggaggcgtgacaagccgtcggggatggaac

SEQ ID NO: 7270 - DNA, 101 bp, rice(Oryza sativa)
  misc_feature (71): n=t or c
tatgccatataaaccggaagtggatttttgtccctcaaagagacatcctcttgtttctgtgcatgtcgttnacaaagatataaaaaaataaaaaaaattgt

SEQ ID NO: 7271 - DNA, 101 bp, rice(Oryza sativa)
  misc_feature (71): n=a or c
tgcaaagtttggtagcaaggagagactgcctgatagtgcaagtagctcgagcaggccggtctgggacaatntgtggaaactggaaagtccacccaagataa

SEQ ID NO: 7272 - DNA, 101 bp, rice(Oryza sativa)
  misc_feature (71): n=t or c
ttggctttccgagctgagaggtctgttacaaatcgagcttgaatttccttttgctttccatgcacattctntgctttggctgtaaacctcctcacaattaa

SEQ ID NO: 7273 - DNA, 101 bp, rice(Oryza sativa)
  misc_feature (71): n=a or g
tacgaatatatccagatttatagtatgaaatattggaccggttcggctgccattcccgcggcagcgctacngctgcaacgtttgtattatgcggcttgcag

SEQ ID NO: 7274 - DNA, 101 bp, rice(Oryza sativa)
  misc_feature (71): n=a or g
atagtgcctcgggatcctttttgcacggtttgtgatacttgagaggtagagatttctggtactgcacactngggaccttagactgactcgatgtaaagttg

SEQ ID NO: 7275 - DNA, 101 bp, rice(Oryza sativa)
  misc_feature (71): n=t or c
taatcaggtgatcacaaatagcactcctgtactaaactactcccccgtctactcgacgttcgtactccccnatttcaggttatatcaagtttgtaaaaaaa

SEQ ID NO: 7276 - DNA, 101 bp, rice(Oryza sativa)
  misc_feature (71): n=t or g
gtcgaggactatatatatatacatgtacatggctggagttgtcgtggaatggacgctggtgatggaagaanaatccatttggtagggaaggaatttttgca

SEQ ID NO: 7277 - DNA, 101 bp, rice(Oryza sativa)
  misc_feature (71): n=a or g
gattcttaaaacgaaaaataattctggcccattccatctcaaaactattgttgcaaatgtgcaatgatcantattggcacgatgactgtgtttatttcctt

SEQ ID NO: 7278 - DNA, 101 bp, rice(Oryza sativa)
  misc_feature (71): n=t or c
gaaatgtccaagggtcttctagctagcttcataagttggtggtctagttgacctgagtttaaagtctcacnctttctatttatttgatattaggtattttc

SEQ ID NO: 7279 - DNA, 101 bp, rice(Oryza sativa)
  misc_feature (71): n=a or g
cccggcggcgtatattcccccccgtggcgcgctcccatggcttcctactgctactacggcaacacctccanccctaaccctaaccctaaccctagccctgc

SEQ ID NO: 7280 - DNA, 101 bp, rice(Oryza sativa)
  misc_feature (71): n=a or g
gttagtcaataccttgtcaaacatgatgaagtcaatggtcgatggtacaatagctgagtaccaagctgcangcccagtttatttgcaaggaggtgtatttc

SEQ ID NO: 7281 - DNA, 101 bp, rice(Oryza sativa)
  misc_feature (71): n=t or g
attactttaattatttacagcaattaattaactattactaagcttgtggttgctttatttttttcgatgtncattttaagacttgtttatgtgcgtttgtc

SEQ ID NO: 7282 - DNA, 101 bp, rice(Oryza sativa)
  misc_feature (71): n=t or c
tatgaaaacaaatgaaccatttacacaggcgggcgataacccgcctatgaaaaagcttttcagccaacaangtaaggccagtcaccaaaggattctgcccg

SEQ ID NO: 7283 - DNA, 101 bp, rice(Oryza sativa)
  misc_feature (71): n=a or g
aagtaattaagaacaaatagacacctaaattcgagtcacttaacgagcttaacaacaagggggtgaagatncatagccactcctccctaaaatggcaagta

SEQ ID NO: 7284 - DNA, 101 bp, rice(Oryza sativa)
  misc_feature (71): n=a or g
ttattaggggaggctaacaaagagcttcatcatttctcttacaagtatttaattcagaagaaaccactacnccagatcctcacacctctgacgggatacct

SEQ ID NO: 7285 - DNA, 101 bp, rice(Oryza sativa)
  misc_feature (71): n=a or c
ttctcttctctttcttttctttttcttttttcttcttctcttttctatcatctttcctttcgtctcctctnttctcttcttcagcgagactgagaggctag

SEQ ID NO: 7286 - DNA, 101 bp, rice(Oryza sativa)
  misc_feature (71): n=a or g
ctcaccggcgagctgccgaacttgtcggcgaagctggcggcgctcgacaccctcgacgtcgcgaacaattncttgtccgggaggttcccggcgtgggtcgg

SEQ ID NO: 7287 - DNA, 101 bp, rice(Oryza sativa)
  misc_feature (71): n=a or g
gggagctactgcacaagtatttaaaacttatccacaaatgtcaacacctgacaatcagctaaggcagcacnccgcaaatcaagttgtcccagagcatttgg

SEQ ID NO: 7288 - DNA, 101 bp, rice(Oryza sativa)
  misc_feature (71): n=t or c
tattagcaggtgaagaatgttaacacctacctctctgaagtcgaagaggaagaggatcctgaggtagcaanagccgagtgggcgaggaataaaagagtggt

SEQ ID NO: 7289 - DNA, 101 bp, rice(Oryza sativa)
  misc_feature (71): n=t or c
atgacgccaggacagccggtgaaccctcggttgttaacaagggatctgccacagcatggcgggaaggctangaatcggctaacccaagatcaagttgctgc

SEQ ID NO: 7290 - DNA, 101 bp, rice(Oryza sativa)
  misc_feature (71): n=t or g
tgaacttgctattagtagggttgtttcaagaaaagataaacatagcatatttaccacttctccaaaagggntaatatatatgttgcgtttacacaagtatc

SEQ ID NO: 7291 - DNA, 101 bp, rice(Oryza sativa)
  misc_feature (71): n=t or c
ttgtcggggttggcactggagagcggaacaatcttggttgcgccatctggcttcggcatcttgttggtttngctcactttcttgggtggctcagctgtggc

SEQ ID NO: 7292 - DNA, 101 bp, rice(Oryza sativa)
  misc_feature (71): n=a or g
aattgctcctcttcctctcttctcttcttccttacctctgtcttctttctctcttctccggcgagccatangacccgcgagcggcgggcaaccaatgggcg

SEQ ID NO: 7293 - DNA, 101 bp, rice(Oryza sativa)
  misc_feature (71): n=t or c
cctcttctccactccacacacgcacacgcacaagccaagcagcaagcagcggcgccgatgagaggaggagnagctgggcccaccgccggcgagccgccggg

SEQ ID NO: 7294 - DNA, 101 bp, rice(Oryza sativa)
  misc_feature (71): n=t or c
gaaaaataacctgtacctttcagaatcatggccccggcgtcgatcacggtcatcagaacgttcacgatcgnggtgttcccttctttcgcttctatcgcggt

SEQ ID NO: 7295 - DNA, 101 bp, rice(Oryza sativa)
  misc_feature (71): n=t or g
cacccgtcatgacatgccacggcgcggccggcgctggcaatggcagtcgactattcccaacaagtcgcagntgcagcggcggcgtggcggccacccttgga

SEQ ID NO: 7296 - DNA, 101 bp, rice(Oryza sativa)
  misc_feature (71): n=t or c
ggcgtgtcgtaatgtcgacgtagcgacgaggggagacatctgaccggagtgctttgcccctatcagataangatccttctcctgtaccgataggaagacaa

SEQ ID NO: 7297 - DNA, 101 bp, rice(Oryza sativa)
  misc_feature (71): n=a or g
tgtctaaaagagacattgccgatgataggtctcattgccaatttctttatgcgagtatccatggatatacnaggagatgcatttttcatatgcttcttctt

SEQ ID NO: 7298 - DNA, 101 bp, rice(Oryza sativa)
  misc_feature (71): n=t or c
tttgcatagtatatatcactaattcttttgttgcaaagtgaaacaaagcggggatgggtaaggatcgatgnatggcccgattgacggcaaaatttgatcga

SEQ ID NO: 7299 - DNA, 101 bp, rice(Oryza sativa)
  misc_feature (71): n=a or g
tccatgccggcggccggcagcaggagagctaccatgggggattattgaggacgtcggggcgagggatgggnaagagggcggcggcagaggggactttcttg

SEQ ID NO: 7300 - DNA, 101 bp, rice(Oryza sativa)
  misc_feature (71): n=a or g
tctaatcaaactttgcaaattaaggaacaaaattaaccaaaccgaacaaacatcggtatacgcagtacacnctcactggcgacgaacagtgcggagcgcca

SEQ ID NO: 7301 - DNA, 101 bp, rice(Oryza sativa)
  misc_feature (71): n=t or c
ctgctagttcaatccacaacaaaagcacagcagtatgaatggcgctttggtcctgcaaacatgaaatggtnatgcttatgttggacgatataatgcacata

SEQ ID NO: 7302 - DNA, 101 bp, rice(Oryza sativa)
  misc_feature (71): n=a or g
tatactaatatatggtctgcaaccctccaagaaaccatctatgcaaggcttaagggcacaaaaaaattctntggaagtgcacatggccatcaacctccttg

SEQ ID NO: 7303 - DNA, 101 bp, rice(Oryza sativa)
  misc_feature (71): n=t or c
ccgcaccgacgacgacgagaggaaggggtcaagggaaaagcggcggagtgagtgagtgacagtgtagccancttgttgggccacgtcgcaggccgtttcgg

SEQ ID NO: 7304 - DNA, 101 bp, rice(Oryza sativa)
  misc_feature (71): n=t or c
atataccaagaaaaaaaaattgcaaatatagtagcgaggttctccgctcaccggcagggccggccctggcnctatgcagccgaggcgaccgccgggggccc

SEQ ID NO: 7305 - DNA, 101 bp, rice(Oryza sativa)
  misc_feature (71): n=t or c
tcgggagctgcgacaggatgtccaccagaacgtccgtcggaaaatcgacgacgcccacgttctccattgcnggggctttcctcggcggcatcgttgtcctt

SEQ ID NO: 7306 - DNA, 101 bp, rice(Oryza sativa)
  misc_feature (71): n=t or g
cgccgccactggatccgctcgctggagcaacgatgccatcgcctccattggatctgccacaagaaaatctngttggtggagagggagaaggaccactagat

SEQ ID NO: 7307 - DNA, 101 bp, rice(Oryza sativa)
  misc_feature (71): n=a or g
attcaacaaacatcacatttgtgaggcatctagtcaaatatttttttaaaaacttcaaaatcatgtgcatngaaaatatgagttttcagatactgacagtt

SEQ ID NO: 7308 - DNA, 101 bp, rice(Oryza sativa)
  misc_feature (71): n=a or c
gatatgtaaaagatcactttgcaaagcaatggagcaaatattgcttggtgcatgaattcctgaaaaactgncatattataaaatcaatcagatagagtaaa

SEQ ID NO: 7309 - DNA, 101 bp, rice(Oryza sativa)
  misc_feature (71): n=a or g
tcttgcttctttggcttccattcactgatcccttgtctatatcttgtttgaaggatgcctccccgcaagcnaacttcccgcaaatccaagcgccaaaggga

SEQ ID NO: 7310 - DNA, 101 bp, rice(Oryza sativa)
  misc_feature (71): n=t or g
aaccaaccaaaagtaaacttgtaacaaggggcaggtcacatctacatatactcccaaaacaactattgagntgtaaagttttagcgtgtcacatcgggtat

SEQ ID NO: 7311 - DNA, 101 bp, rice(Oryza sativa)
  misc_feature (71): n=a or g
cagggcctactcagtcggttccactgcatgcacctacatatggcaccaacccatggaaagcacaatccatngattacggtggtacgcacaaccatcactct

SEQ ID NO: 7312 - DNA, 101 bp, rice(Oryza sativa)
  misc_feature (71): n=a or g
gcgcccaccacctgctcgacggaacgtcccttccgggtggctcgttcctcctgttctgagtctgatcagtnatcagtttctactggtttattttgtttatt

SEQ ID NO: 7313 - DNA, 101 bp, rice(Oryza sativa)
  misc_feature (71): n=t or c
ccacccacgccgccacctacaccaacaccgccaccctcgccacctcctacaccgacaccgccaccactganggtggctgtactatgtttgtcgccgcagcc

SEQ ID NO: 7314 - DNA, 101 bp, rice(Oryza sativa)
  misc_feature (71): n=t or c
actgaggaggctattgcacattatgtatcttctgttcgggaacaaattgattcccaacaagctgatgttgncgattgacaggtgttctctgcctagtcggt

SEQ ID NO: 7315 - DNA, 101 bp, rice(Oryza sativa)
  misc_feature (71): n=t or c
gcataggcaagtcacaacgtgacataccatgcatctcgggcgtccagaatgaatccaacggagatggcgtntgagccggcacgcaggcaaaaagaatctcc

SEQ ID NO: 7316 - DNA, 101 bp, rice(Oryza sativa)
  misc_feature (71): n=a or g
ctatgacgatagtcccggcgcgccatggaggtttcgaggggagtgctccaaaacccacgagatggtggccnatgtgacgcagcccaaggagcccagtactg

SEQ ID NO: 7317 - DNA, 101 bp, rice(Oryza sativa)
  misc_feature (71): n=t or c
tgggctgcaggccgagcggaggaaggtgacggactaggcggggctgaaaagaaatgatttaatgggctttngaattaaaaccaaggaagatgtaaaattta

SEQ ID NO: 7318 - DNA, 101 bp, rice(Oryza sativa)
  misc_feature (71): n=t or c
actgcggtcttctcgccttggccaccttagtttcatctccagtaggcattggtatctcatgcgactccacnttaatggtaattacctccgaagttcttgcc

SEQ ID NO: 7319 - DNA, 101 bp, rice(Oryza sativa)
  misc_feature (71): n=t or c
gttttggtttgccaagctcctaactgctactcataccacatatctttttctttactttacaatagttaatntattcgtttatactcttaaatagtatagta

SEQ ID NO: 7320 - DNA, 101 bp, rice(Oryza sativa)
  misc_feature (71): n=a or g
ccaaccatctcctttgcttgccggctgtgtcattgttgatgtttgattcgatgattcaataatgtttgatntttgattcagtgatttaaacttgttgatga

SEQ ID NO: 7321 - DNA, 101 bp, rice(Oryza sativa)
  misc_feature (71): n=t or c
acattcatcccacatccacacccgtgtccgccacggtcgttgtcctcatccactacgaccgccgttgtcgnccgcggccgtccggccatcctcgcctgtgg

SEQ ID NO: 7322 - DNA, 101 bp, rice(Oryza sativa)
  misc_feature (71): n=t or c
cggcgccatcccgccacgctgacggagtagcggacgtgtggagcggtggcagtagcaagagagacggcgcngacggcgcgtgaagcgagccatctcccgca

SEQ ID NO: 7323 - DNA, 101 bp, rice(Oryza sativa)
  misc_feature (71): n=a or g
tccggaacagaaacgcctcaccccgtccacctaaccgtacgtaacggcgacctacagccgccactgacaantgggtcccagagcacggtgcgccccacacg

SEQ ID NO: 7324 - DNA, 101 bp, rice(Oryza sativa)
  misc_feature (71): n=t or c
catgtcaagaaacacaatgtaatttgttaccagtactaattgctatagcacaagctgcagagaacaatgtnaggtaaattataaacctcaactttgagcaa

SEQ ID NO: 7325 - DNA, 101 bp, rice(Oryza sativa)
  misc_feature (71): n=a or g
gaacgacggcgacggcgacctgcacggcgagcagagcaagctggtcgcgatctccgacgaggcgccaaacntcgacagggcgctcgccaccagccgcccgg

SEQ ID NO: 7326 - DNA, 101 bp, rice(Oryza sativa)
  misc_feature (71): n=t or c
ttcgggttccgctccgtcgccttcctcctcgcgcatagccacgcccacaaggtcgctgcctacctcttcanagtgctcgtcatcgagccgtccgaccgggg

SEQ ID NO: 7327 - DNA, 101 bp, rice(Oryza sativa)
  misc_feature (71): n=t or c
ggcggcctccacagatccggcgtggcagactcaaaggttgaggatggccggagggatgccggcgttgaggntggcatgcaggaaaaggtggtgcaagcgtg

SEQ ID NO: 7328 - DNA, 101 bp, rice(Oryza sativa)
  misc_feature (71): n=a or g
ctcgaacaattcaaggaggagtacttggttttggttactttcaagtttgctcgagctatgaacaatgtcangtagaggagaagaggtggtccaaaccgttg

SEQ ID NO: 7329 - DNA, 101 bp, rice(Oryza sativa)
  misc_feature (71): n=t or c
tcataagtaaattagttctcggtccagaataaattccagtgtcttattgtatctatatataactttcatantgtacttgtcattctcggcctggattaaat

SEQ ID NO: 7330 - DNA, 101 bp, rice(Oryza sativa)
  misc_feature (71): n=a or g
aaatcctgatcaaagcattaaactccttagccccagtatccctccccagcttcccaaagaattcaagcgcnggctctgctccaagcttatcggcacacttc

SEQ ID NO: 7331 - DNA, 101 bp, rice(Oryza sativa)
  misc_feature (71): n=t or c
taactaccatcatacaaaggacagaaaaagattctcgttttttttaagagaagccaagttattgctttcgnttgaaccaggcgagcaagcaagcaaagccg

SEQ ID NO: 7332 - DNA, 101 bp, rice(Oryza sativa)
  misc_feature (71): n=t or c
aactgtacaatactcgtatacagtgttgtggaaaacggtatacgggtatcagacaaagggtaccgccaaangattaatcggaatttggcggaaatataacg

SEQ ID NO: 7333 - DNA, 101 bp, rice(Oryza sativa)
  misc_feature (71): n=t or c
aaagtgtatctgcgcccacaacttaaaaagttaacttaactatggacgtgtacatgttcatgttcatagtnaagagttgctttttttttttacgaaaattt

SEQ ID NO: 7334 - DNA, 101 bp, rice(Oryza sativa)
  misc_feature (71): n=a or g
ccctgccctgtgctcacgagttgcgccgctccctccagccaaccgaaggcaccatcgagtctcgcgtccancggcctgcatcgcgctccgctccctccatc

SEQ ID NO: 7335 - DNA, 101 bp, rice(Oryza sativa)
  misc_feature (71): n=a or g
ttgcaccagttttaatagttcggggagtcgtcctatctggtttgcgattgagggtcacagattagattcgngtcacttttaagggaatcaaagtgaactta

SEQ ID NO: 7336 - DNA, 101 bp, rice(Oryza sativa)
  misc_feature (71): n=t or c
tgagaaccttggttggcgcgaagtcgaacttcttggcgccgagctcgaggagcatgtccagcgtctgaggnaggagcacgagcttcccggcggtgttccct

SEQ ID NO: 7337 - DNA, 101 bp, rice(Oryza sativa)
  misc_feature (71): n=t or c
taacaaattttcattttcttgaaaagaggcaacaaatgagcagcattaaacaagagctcacatttccactnctgcatgtcggacaatatatggtttttggg

SEQ ID NO: 7338 - DNA, 101 bp, rice(Oryza sativa)
  misc_feature (71): n=a or c
ccaaattctaacttttaaaatttatctcaggatataacaatttcgacaaccactattttatctcaccaatnaatttaatttctttatttattttctcatct

SEQ ID NO: 7339 - DNA, 101 bp, rice(Oryza sativa)
  misc_feature (71): n=a or g
tggcggctgaaggcaatgcacgagcaagtgggaacaatggcggctctcagggcagtggtagcacgagcaantggcgggagcaagcggcggtaccagcggag

SEQ ID NO: 7340 - DNA, 101 bp, rice(Oryza sativa)
  misc_feature (71): n=a or g
catctctggccataacaggagcgggcggttcgagctgtcctgctgctccttcgtggacatggtcagagccngcgccatggccaccgcggtcacctacgtct

SEQ ID NO: 7341 - DNA, 101 bp, rice(Oryza sativa)
  misc_feature (71): n=a or g
gtcgctgcaattgagcgttcgttgacgtcaagcttcaattgtgccgccggtgagccggggagagagagagnggggggggggggggtcgcgccgtgatcggc

SEQ ID NO: 7342 - DNA, 101 bp, rice(Oryza sativa)
  misc_feature (71): n=a or g
gcggcggcgaagagcatcgccatggccaaggccacgatctggaagcgcgccattggagtagagtgagaganctagctggtgctagggtttgggaggagagt

SEQ ID NO: 7343 - DNA, 101 bp, rice(Oryza sativa)
  misc_feature (71): n=t or c
gtactatgaggtaccaggtaccaattaaatctgaccgttggtttaggaggggtaggatcgggctaaaaaanccatcggtgaggaacgacaccgtcgctgcg

SEQ ID NO: 7344 - DNA, 101 bp, rice(Oryza sativa)
  misc_feature (71): n=t or g
tttcattgtaaggctatatatgccatttgatcagattaatgaatcaagcaagaaagttatcacaattcctnttcgttccaccacggctccggggcggcgag

SEQ ID NO: 7345 - DNA, 101 bp, rice(Oryza sativa)
  misc_feature (71): n=t or c
ctacagagaaggacaagggaaactaagcctcttgcttttattgacatagatgacagctcaaaatattacancattgaacagtgtccttttgtacagactgt

SEQ ID NO: 7346 - DNA, 101 bp, rice(Oryza sativa)
  misc_feature (71): n=a or g
aacttggtcaacctgtcacattagcggaaaccgcctcccaaaccgttgaggccttgttcagttatgtccgnattcaatccgagccgggaataacaagtata

SEQ ID NO: 7347 - DNA, 101 bp, rice(Oryza sativa)
  misc_feature (71): n=a or g
gcccaatggctcggccgagccgctaaaatcctttgggccgcgcccaagcgcctgagaaagtctgaaattcncccctccttctttctttttcaaaaagggtt

SEQ ID NO: 7348 - DNA, 101 bp, rice(Oryza sativa)
  misc_feature (71): n=a or g
atgactgctgctgctgttgctgatcagaggctgccggagactgcttctgctgagaggaatgcgtgggacangtggagaccggcgacgtggccggcgacatg

SEQ ID NO: 7349 - DNA, 101 bp, rice(Oryza sativa)
  misc_feature (71): n=t or c
ttcaaccaaattctaaactttgggccaatctaaacacagcctaaaaacaaatttaacaatatagtaactcnaactcctagctccccgttgttacatcatct

SEQ ID NO: 7350 - DNA, 101 bp, rice(Oryza sativa)
  misc_feature (71): n=a or g
ggctcgatggtgtagccgccaccgccacccaactcctcttcgttggtcgcctcccttctcctcatcagtcncgtggcttggaggtttggacagagatggga

SEQ ID NO: 7351 - DNA, 101 bp, rice(Oryza sativa)
  misc_feature (71): n=a or c
cttctcttttttctcaagctgggtgcttagaaaaaaataaatagtaaatgcaagtaaagcaatgaaatagntatacaatattagatggtatttcagtaaaa

SEQ ID NO: 7352 - DNA, 101 bp, rice(Oryza sativa)
  misc_feature (71): n=a or c
caagccgaaaatctcgcaaattttgagctgttttcttcttttcctttcgcttcttgctttcctcctcctcntcgatcgatcgatctcttggtgatggtgat

SEQ ID NO: 7353 - DNA, 101 bp, rice(Oryza sativa)
  misc_feature (71): n=a or g
tgcatccatgcatcgattttttgttactccttcccgtctcaaaatatatatactttggtggtgttcttttntcctaaagatgaagattaagttttttacgc

SEQ ID NO: 7354 - DNA, 101 bp, rice(Oryza sativa)
  misc_feature (71): n=a or c
tccctgcaattaagctcccattacttaattactagctatgtggtgaaattatacatcagcaatgcaagcanaataaataaataaatatatatatatatata

SEQ ID NO: 7355 - DNA, 101 bp, rice(Oryza sativa)
  misc_feature (71): n=t or c
ttggaagtgccttaaaagaaaattcaccaccctaacattgttttttttaatttagatggatgttataatgnacattagtacatgaaatatgtgcatgcaca

SEQ ID NO: 7356 - DNA, 101 bp, rice(Oryza sativa)
  misc_feature (71): n=a or c
acgtgtcaatcgacatggcaatttagtcaggaaaagtataaaaagaaaatacagggcccaactgtcagttnggaggcattcttctcctctctctctgatct

SEQ ID NO: 7357 - DNA, 101 bp, rice(Oryza sativa)
  misc_feature (71): n=t or c
cacaatgtataagtaccactttagaggcttaagacctcctcctattgctacattgtggttgtgcgtagagnttcaactcctaaacctagctccgctcccat

SEQ ID NO: 7358 - DNA, 101 bp, rice(Oryza sativa)
  misc_feature (71): n=t or c
ccaacattcatcccctcccattccagcttctcccaccagtccttctcgcagtccacgattgggcgaccgtngatggcggggatgcgcttgagagcccagca

SEQ ID NO: 7359 - DNA, 101 bp, rice(Oryza sativa)
  misc_feature (71): n=t or c
ggtggggattagacgaatccgttccgattaaaaattttactcatagtcccatattacttcctccgttttanaatttaagtcattcctagtattttttaaaa

SEQ ID NO: 7360 - DNA, 101 bp, rice(Oryza sativa)
  misc_feature (71): n=a or g
aaaagattgttactaggatgacggcctcatcagattgttcggcttcatcgacgttattccacgattagcantagcatcagcttcctttcttcagcaggtct

SEQ ID NO: 7361 - DNA, 101 bp, rice(Oryza sativa)
  misc_feature (71): n=a or g
agagtattcagtcaagagacatcgcaatcttcggtgtaaagcatatatactttcatgtcacatccaaactnaggagaaaatgcgacagtaaaattgtttca

SEQ ID NO: 7362 - DNA, 101 bp, rice(Oryza sativa)
  misc_feature (71): n=t or c
atacttgactgcgactacgtggctaattaattccacatttcaactaccgctaatattagtaccttaacttntgtaaatatttaagcatctttaattcaaca

SEQ ID NO: 7363 - DNA, 101 bp, rice(Oryza sativa)
  misc_feature (71): n=a or g
tacctgctcttattaggtgagctaaacaactgcacatcaaaaggtgttcaaaattttaatcactagtatanatttaaaaaataagtttatttatttataac

SEQ ID NO: 7364 - DNA, 101 bp, rice(Oryza sativa)
  misc_feature (71): n=a or g
ttcaactcgatccccccacccgagacgggagccagttggaaggaggtcaaagccgcttcaagaaacacccnctctctcctcgccggcgaggaggaggagga

SEQ ID NO: 7365 - DNA, 101 bp, rice(Oryza sativa)
  misc_feature (71): n=a or g
cttgagagagaggagggagagagaggatagagggagaggagatagagagaagaggtagtgatgatgacgtntgggtccacatgggcccatcattttttatt

SEQ ID NO: 7366 - DNA, 101 bp, rice(Oryza sativa)
  misc_feature (71): n=a or g
ccctattggttacacatgttctacaactgaaattattatatgttccttttactgattcagagatgctcttnttcatattctttttttttaataatggaaat

SEQ ID NO: 7367 - DNA, 101 bp, rice(Oryza sativa)
  misc_feature (71): n=t or g
tatatattctctatgtgcaaattttagcacaaatttactataagtaaaggtagagatttccaaatgcaaantttttttttgcaaaaaaacaaaaaactaga

SEQ ID NO: 7368 - DNA, 101 bp, rice(Oryza sativa)
  misc_feature (71): n=a or g
tcgccgtctggggcaatctcagtaacgatgtgccttccctcaagcttcatcgcgggacctcttttcccacntggcctcttctgtccggccgacggttgact

SEQ ID NO: 7369 - DNA, 101 bp, rice(Oryza sativa)
  misc_feature (71): n=t or c
aaaacctttgttgactattcccaaattcaacttttccaattcctgacataactcccaaggtagatgtcgtncttctgacatattacagtagcttttcctgc

SEQ ID NO: 7370 - DNA, 101 bp, rice(Oryza sativa)
  misc_feature (71): n=a or c
agcttaatatcgatttttctctctcgttttccctctcctcttcatgtcaacaatttaccttattttccccnaaaaaaaacaaattaccttattaacaactg

SEQ ID NO: 7371 - DNA, 101 bp, rice(Oryza sativa)
  misc_feature (71): n=a or c
cctctcgttcttctcgacttctcgtgcagcctagctcaccactagcttcgagatgatgatgtggtggcctntctgatccgcccagggacacgtgcccctcc

SEQ ID NO: 7372 - DNA, 101 bp, rice(Oryza sativa)
  misc_feature (71): n=a or g
ctacctaggtgcctagcagcagctagaccccaagaaaaaagattgctccctctggttttcaatgtttgacnctgtttacgatagaatatttgaccattcat

SEQ ID NO: 7373 - DNA, 101 bp, rice(Oryza sativa)
  misc_feature (71): n=a or g
cggtgtagctgttgccatgtcggttttggcgcggattgggcaatagcctatccgcaccttttttacaaagntagtaattcctccatcctagaatataacta

SEQ ID NO: 7374 - DNA, 101 bp, rice(Oryza sativa)
  misc_feature (71): n=t or c
tcaccactacgctcaaggccatgccgccacatgcatccaagccgcctaagccggcgtgccattgttgcgcnttgagggcaggccactgctacgcgttgggc

SEQ ID NO: 7375 - DNA, 101 bp, rice(Oryza sativa)
  misc_feature (71): n=a or g
acttatattatgggccggggggagtatatctattaacatataccatcctcattctttaatatataacgctntgactttttataaacgtttaaccatttaaa

SEQ ID NO: 7376 - DNA, 101 bp, rice(Oryza sativa)
  misc_feature (71): n=t or c
tttgttttcccgaaataactatgtctttcttcaaatgagatgggtctgtcacatagaaacttgagcgaccngatcggcaagcacccatgggtcatccttgt

SEQ ID NO: 7377 - DNA, 101 bp, rice(Oryza sativa)
  misc_feature (71): n=t or c
agttgaagatcttgttgttgtggcgtttccagatgttccaaacggcggcgagtaagatggtgcgccagatncgtggggtgagagcattgtcagggggaggg

SEQ ID NO: 7378 - DNA, 101 bp, rice(Oryza sativa)
  misc_feature (71): n=a or g
cataatcacatctgtactagtgaatgggtagccccgtcctctagtggtgacgacaagagcggtaacgggcncccaggagcaacccttggtgagctcatcca

SEQ ID NO: 7379 - DNA, 101 bp, rice(Oryza sativa)
  misc_feature (71): n=t or c
cgggattaagtcttggattttccgaaggaaacacgcaatcctccttcagtcccacgacccctagcccacgngctccgcctccgcctcacctctcgatcgat

SEQ ID NO: 7380 - DNA, 101 bp, rice(Oryza sativa)
  misc_feature (71): n=t or c
attgcaggccatgtgaattaaattagtgggatcattttgaagttttttctccaagcaagctttatttctanatttccatatagaccatatcacggcagcta

SEQ ID NO: 7381 - DNA, 101 bp, rice(Oryza sativa)
  misc_feature (71): n=t or c
attggcgccatccccctaaccccttggtggaaggtaagtcactaatatgaagagggatgatgttggcgctnaggaccaatttgtttttttaaatgaaatac

SEQ ID NO: 7382 - DNA, 101 bp, rice(Oryza sativa)
  misc_feature (71): n=t or c
ttctctgaaaacaataccattctactgaaaatcgtcgaaaaaacactcataaattcagaaaaaattaacantgattaaatcagtgcagaacactttaaaat

SEQ ID NO: 7383 - DNA, 101 bp, rice(Oryza sativa)
  misc_feature (71): n=t or c
ccttccgtgtgttcagtccaaagctagctaacgactgactgaggctgtgtttgtaaccccatgttcccganctctcttcatcgttttccgtatacacgttt

SEQ ID NO: 7384 - DNA, 101 bp, rice(Oryza sativa)
  misc_feature (71): n=t or c
ctgatcgatatgagtgcattttgtgctttatttgattttaagaagaggaagtcaatgacttgggagtcaangtggcactatccatgctaaaattttacaaa

SEQ ID NO: 7385 - DNA, 101 bp, rice(Oryza sativa)
  misc_feature (71): n=t or c
aattgtggttccggtttatattaatcattacaactttctggacacgcaatatgagttagtaatgggtttgncatttggtgctgcataaatagctttagtga

SEQ ID NO: 7386 - DNA, 101 bp, rice(Oryza sativa)
  misc_feature (71): n=a or g
tggtgtccatagtattaaataagctgccacctaagatgaaaaaaatgatatggtaaagtgaataaatgagnaaagagaaggaaaccatattttgcatgaga

SEQ ID NO: 7387 - DNA, 101 bp, rice(Oryza sativa)
  misc_feature (71): n=a or g
ccttctggccttccgtctaaaaaaattaatcgttccttatctgcatggactatgtatcttctactatagcnattttttttgtacagtttgactttttgttt

SEQ ID NO: 7388 - DNA, 101 bp, rice(Oryza sativa)
  misc_feature (71): n=a or g
ataattccgtgggcttaataaagacaggacgaatttagtcgctaccaatgggaaaaggaataagttcaccngaggttcctcaacttaacaacgagattatc

SEQ ID NO: 7389 - DNA, 101 bp, rice(Oryza sativa)
  misc_feature (71): n=t or c
aggaactcttgcttgccttagccgattgcctctattatacgataggtttgaaccttctggaacattgctanacccaggacagtcttcaaaagatggcagcc

SEQ ID NO: 7390 - DNA, 101 bp, rice(Oryza sativa)
  misc_feature (71): n=t or c
aactatgttgtccattcctgaggtcaaaaggtagctggaacaaaattgtcacaaatctcaagcctccactngacatggatgtgagcttatctttctcccca

SEQ ID NO: 7391 - DNA, 101 bp, rice(Oryza sativa)
  misc_feature (71): n=a or c
cattctttgtctgcatggctgccttgcgctgtgcttctttgaccaaactccaagccaaaaacaaacgcacncagcacactagtgtataatactagtagtaa

SEQ ID NO: 7392 - DNA, 101 bp, rice(Oryza sativa)
  misc_feature (71): n=a or g
gcactatatcccccttatcctgaggtgagccaagctcaacaagggggagccaacgctggtgagcttcttcnaactcccaaatctgttcaccattttcatta

SEQ ID NO: 7393 - DNA, 101 bp, rice(Oryza sativa)
  misc_feature (71): n=t or c
ttttaattaaccttttctctttttgccgcattaggttgtttctttttttttactaaagctagacaacctgnacgttaaatttttaaccttcaaataaaatt

SEQ ID NO: 7394 - DNA, 101 bp, rice(Oryza sativa)
  misc_feature (71): n=a or g
catgctctgatgaatgaagctgccattaatggtgtttacataccgtgatgcccatgttggagagcttgtcncggatgaatgcgcgggcctcgctgtagcag

SEQ ID NO: 7395 - DNA, 101 bp, rice(Oryza sativa)
  misc_feature (71): n=a or c
tcctcatgaagcacattaactcaacccgacaacgtatgctgtaacatattgtcggatccggcctaatcggntaacctcgtccgactcgaactctaccgact

SEQ ID NO: 7396 - DNA, 101 bp, rice(Oryza sativa)
  misc_feature (71): n=t or c
gtagaggatatagggccctaaggatcatgtcacaaaatccctgccccacattgtgcccgctgctaaattgngtccatgcaaaccaccatgttctccctcct

SEQ ID NO: 7397 - DNA, 101 bp, rice(Oryza sativa)
  misc_feature (71): n=t or g
aaatcaagagacagtaaatccataattttttttcattattgtaagaaagataatcatgatatttatcagcnttataagttgaaaaggaagaaagaaagatc

SEQ ID NO: 7398 - DNA, 101 bp, rice(Oryza sativa)
  misc_feature (71): n=a or g
ttaagggatcatatatagagagaaacttcacagtactcaagaaaatatgcaaaaaccttagtatctcgatntacaatatgttaaagtatcaaattttacac

SEQ ID NO: 7399 - DNA, 101 bp, rice(Oryza sativa)
  misc_feature (71): n=a or g
ggatagcattaaatttggatcaaaggaattatttgaagggtgagatacactttgtgataaaattggacganaaaagaaaatacgaaataaacatggatggt

SEQ ID NO: 7400 - DNA, 101 bp, rice(Oryza sativa)
  misc_feature (71): n=a or g
ggggatgtggagggcggcgcgatgaggatggatggggatgtgggttggagcgggtgacctctaaggttcantggtgtattggacttattgagcctcctgta

SEQ ID NO: 7401 - DNA, 101 bp, rice(Oryza sativa)
  misc_feature (71): n=a or g
ttactaaagaaccatatattgaaccaagattatgtgtctaaataatgtgcatttaacaagatcatagatgnaccgtttatatatttactatatgttagttt

SEQ ID NO: 7402 - DNA, 101 bp, rice(Oryza sativa)
  misc_feature (71): n=t or c
tgagatggcgccatggctgctggcggaagctttgttttctagtagtattttctgtttttatccttttttanttttagaagtaatgtttgattgtgatggga

SEQ ID NO: 7403 - DNA, 101 bp, rice(Oryza sativa)
  misc_feature (71): n=t or g
gatatattcaagttatttccctataacaatttccaattttcaaacgattgttggtaaggatttctatattngacattccatttttttctgtgcaaggtggt

SEQ ID NO: 7404 - DNA, 101 bp, rice(Oryza sativa)
  misc_feature (71): n=a or g
aagcaaaacttgatgaattggaggctggtccaagctccacacaagccaacatagatcggctgaatgctcgnaagatagaactcctagccgagttggagcaa

SEQ ID NO: 7405 - DNA, 101 bp, rice(Oryza sativa)
  misc_feature (71): n=a or g
attggggagctccatagaaatttaaacgggtaaatctacgtgaaaaaagaatcaattcgaacagatatacncatcgagaaccctagaaaaaaagaaaaaaa

SEQ ID NO: 7406 - DNA, 101 bp, rice(Oryza sativa)
  misc_feature (71): n=a or g
tttgtttataagatgatcaaagttaacagattttatggaccttgtaatcgttttctttaatgaaaatgggngagggctctgcctcctctttctcaaaaaaa

SEQ ID NO: 7407 - DNA, 101 bp, rice(Oryza sativa)
  misc_feature (71): n=t or c
attacatccaactgcatatttttttatggattgtttgctgagatatatgtaggcatatgtgacccaaaccngagttggtgcattgcgaaaccagaggttgg

SEQ ID NO: 7408 - DNA, 101 bp, rice(Oryza sativa)
  misc_feature (71): n=a or g
taattatactattaatataatcataatcatgatattatactattgctaataatctactccctccaatttcntcatcaggttataagacgttaagcatagtt

SEQ ID NO: 7409 - DNA, 101 bp, rice(Oryza sativa)
  misc_feature (71): n=a or g
aaccttttcaggtcaatgttactgctgaccacaggattatatatggtgctgatttggcagcattcctgcanacatttgcgaagatcattgaggatcctgag

SEQ ID NO: 7410 - DNA, 101 bp, rice(Oryza sativa)
  misc_feature (71): n=t or g
atttattaaaaaaaactaaaagaacatatcgcccagctttatactcaatgaatcaagtaattaattacacnagttaattaataaattgagtagtaattaat

SEQ ID NO: 7411 - DNA, 101 bp, rice(Oryza sativa)
  misc_feature (71): n=t or c
aataaaaataaaaaggtaccatgacatttgccagctagcatcaccaataattttcttggatacctttattntgttgatacacagctctagccttggcctta

SEQ ID NO: 7412 - DNA, 101 bp, rice(Oryza sativa)
  misc_feature (71): n=a or g
ttgcaaaagcgcagaaaatacataggaataaccgttttattggaccttagaaaaaccgtagaattcagatnagaaagataaactcgaagaatttttttcaa

SEQ ID NO: 7413 - DNA, 101 bp, rice(Oryza sativa)
  misc_feature (71): n=t or c
ccttctccttcaccatgtggaccagtggcccgatcaccatgctggtcaccagttcacccattgtagagctnacacacaaatatcaatgaaatggagaggga

SEQ ID NO: 7414 - DNA, 101 bp, rice(Oryza sativa)
  misc_feature (71): n=a or c
ggtgctccaggccctcgcggcggcgaatcgaggaggaggccgagaagaatgaagaggaaggcagggccgcngcggcttcaccaccaatgcttcttcttctt

SEQ ID NO: 7415 - DNA, 101 bp, rice(Oryza sativa)
  misc_feature (71): n=t or c
aaaagtcccccgagtctctccaacccgtgtacgtacgtacgcgggcgattaaattagcggcgtggttaatnaatcctaatcgcatgattatccctaattaa

SEQ ID NO: 7416 - DNA, 101 bp, rice(Oryza sativa)
  misc_feature (71): n=a or g
cgcttgtccaatcatataccttcgttaatcctgattgggttactaagcatgtgtttagtttcgggactagnatgggatgggatgaaaccatccctaatttt

SEQ ID NO: 7417 - DNA, 101 bp, rice(Oryza sativa)
  misc_feature (71): n=a or g
atccgatgtcatcgtgttcgtgcttgccgggcggtgagatcagaatccggcgtgttttatagcctcgcgcnctagatgcgctctctcccgcgcaggcccca

SEQ ID NO: 7418 - DNA, 101 bp, rice(Oryza sativa)
  misc_feature (71): n=t or c
tgatgtttgtctgaagttatctatttggcatagtaaattatttggtctattcctgagattccatctgttcnttttttaacctaatatccatcaagcttatg

SEQ ID NO: 7419 - DNA, 101 bp, rice(Oryza sativa)
  misc_feature (71): n=t or c
tcaggtaccccttgcattgaccgtgcccttatctctttcgtctttttttttctccacctcactatttaggnctggtttagttctcaactttttcttcaaac

SEQ ID NO: 7420 - DNA, 101 bp, rice(Oryza sativa)
  misc_feature (71): n=t or c
ttgttttgttatttgaaaaaataaaaacaaataagtggtaaaaaatcattggagtgctaaaaaatcaacanagaacttctcccccttttgaaaagaaagaa

SEQ ID NO: 7421 - DNA, 101 bp, rice(Oryza sativa)
  misc_feature (71): n=a or g
gaatatatttttccaaaagccaacgaaattaaaacctgactcaaacagaaatgacgtaccaaagtactatnaaaatattttcaatttttataatagtagag

SEQ ID NO: 7422 - DNA, 101 bp, rice(Oryza sativa)
  misc_feature (71): n=a or g
gtatgttcaaccattaaagcgcgtgcatgcttgtgtgctacttcttccgtccgaaaaaaaatctaattctnggtttgaatctcgacataataaagtttttt

SEQ ID NO: 7423 - DNA, 101 bp, rice(Oryza sativa)
  misc_feature (71): n=t or c
gcaccttttccactgaatgtatgtacctatactatcatcactagtggagtaattattcattatcagttgcnaactgtgcatgttgacgccatatcagggtt

SEQ ID NO: 7424 - DNA, 101 bp, rice(Oryza sativa)
  misc_feature (71): n=t or c
ccctggacgcatgagaggcgttggttccgttccatggaaggaagggttcccggatgatacacacatgtatngggcccgttcaagaagacccacgagagaag

SEQ ID NO: 7425 - DNA, 101 bp, rice(Oryza sativa)
  misc_feature (71): n=a or g
tgacgcgggtgcattgcacaacccgaacgacattttgcgatatgcatacgttccgtacgggcacgtgaacntggtcttactttgatcatcaggatggatgg

SEQ ID NO: 7426 - DNA, 101 bp, rice(Oryza sativa)
  misc_feature (71): n=t or c
tctttggccgtttctttgtttgttcttctctctttctttttagctgtgtaatcacaaacaacacacattgnaagcttataaattaagtcttgaggtatttt

SEQ ID NO: 7427 - DNA, 101 bp, rice(Oryza sativa)
  misc_feature (71): n=t or c
catcctcgaacggtggcgacgacgatggttccttcctcctttctcccaatctttgtctctccctgcaggcngctgacgccgccccgtcgagcgcgagtgat

SEQ ID NO: 7428 - DNA, 101 bp, rice(Oryza sativa)
  misc_feature (71): n=a or g
caccccccgagagcacactgcctttctcttgatgtggctcgagaagtttttgttctgtggatcaagctgcngccttaccaccaactggcagttcttagctg

SEQ ID NO: 7429 - DNA, 101 bp, rice(Oryza sativa)
  misc_feature (71): n=t or g
ttttcgaacgtgggatgacctggtctgcgcgtatgacatgtggggccacgggtgacgtgtgggtaggtgangaggaggaggaggaggaggggggctggttc

SEQ ID NO: 7430 - DNA, 101 bp, rice(Oryza sativa)
  misc_feature (71): n=a or g
tgattagtgattactatgaaacagcttcgtgctgttgcattttttgtgctacttggccacatatttcagantttgtcgacttggaaattgcactatgagta

SEQ ID NO: 7431 - DNA, 101 bp, rice(Oryza sativa)
  misc_feature (71): n=a or g
aggatttaaaccttagtagattggagtcacgtccatagttccattcacttccttatatatatatagttccntcatcttaataaagctgcttccccgaattc

SEQ ID NO: 7432 - DNA, 101 bp, rice(Oryza sativa)
  misc_feature (71): n=a or g
aaatcaagacggctgataaccgcaacaatagagcggttaccgttgatgttctaaaccttggtaaccatgtntattcttctttttacataattcacatcgat

SEQ ID NO: 7433 - DNA, 101 bp, rice(Oryza sativa)
  misc_feature (71): n=a or g
tgctcacattaccgttaagcctactcttcatatctcctaacatgctactcctacaaaccaccaaaccgccnagggaaggcgttgctcttgctactgcttct

SEQ ID NO: 7434 - DNA, 101 bp, rice(Oryza sativa)
  misc_feature (71): n=a or g
ttctgtgtatcggctgccatatcctgagtggtttaatagggtgtcattgccacaccgatacaaggttccanatttcttcccgttttcagggcaagatgata

SEQ ID NO: 7435 - DNA, 101 bp, rice(Oryza sativa)
  misc_feature (71): n=a or g
tatactgcatacttgaaaattcagtatataatccttaaccgatcgatttaatacacactggatacttgaanaatcagtacatactctttaaccgatcgatt

SEQ ID NO: 7436 - DNA, 101 bp, rice(Oryza sativa)
  misc_feature (71): n=t or g
tcccccctttggcattaatcacccaaaaatgaaaaagggtagaaaataggaaattacaaaagcccaaaaanaaataaagactcacaaggccaaataatatt

SEQ ID NO: 7437 - DNA, 101 bp, rice(Oryza sativa)
  misc_feature (71): n=a or g
tccagcgtcagttaattaggcaaatctcatcgaagtgtatggagtagagagggcatggatgcagccaggangatggagaagatcctgatgccgtcttgggc

SEQ ID NO: 7438 - DNA, 101 bp, rice(Oryza sativa)
  misc_feature (71): n=a or c
agatgaaggtgaacgtgttgtccaattgaaatccataaaaaagaatgtaatcacaattgtcaccttcatgnggatcaccagacttgactccttgtaatctt

SEQ ID NO: 7439 - DNA, 101 bp, rice(Oryza sativa)
  misc_feature (71): n=a or g
gctgttctgtgactcatatcatgaacccaaagtttcagaagaattatacttctatcaatgttcgttctgcnacagccgttgcacctggtggccgcatggat

SEQ ID NO: 7440 - DNA, 101 bp, rice(Oryza sativa)
  misc_feature (71): n=t or c
atcaattttgcatgtgtgttgttttgtactaggttcgtataaactagacaagctattgtattaaaacgagnaatttacaagttgttatacctatttacact

SEQ ID NO: 7441 - DNA, 101 bp, rice(Oryza sativa)
  misc_feature (71): n=a or g
cccatctagattttaatttgttcagttgtatatttgtgtatccaatgctgtctaatactattcatggatgnaaactcaacgagatcgatttgatagcagtt

SEQ ID NO: 7442 - DNA, 101 bp, rice(Oryza sativa)
  misc_feature (71): n=t or c
ttggcccacgccatgaaccccggcacgttgtggacgtagaagccgccggtgaggaggtaggcgagcatgangacggtgacgagcgtggaggcgcgcttggc

SEQ ID NO: 7443 - DNA, 101 bp, rice(Oryza sativa)
  misc_feature (71): n=a or g
ttgcagacgaccttcccggacacgatcaccgtcgacaccagctcttcgccgtaccccgcaatgcgaacganctccgccggcgagaagtaggcctccatggg

SEQ ID NO: 7444 - DNA, 101 bp, rice(Oryza sativa)
  misc_feature (71): n=t or c
gagggcggtgaactcgaacgggatgccaagctcggcagcgaagcgtgtgaggtggagctcgagtgtgtggntggaccccgacgacaacaatgcggtcacct

SEQ ID NO: 7445 - DNA, 101 bp, rice(Oryza sativa)
  misc_feature (71): n=t or c
ttcctttgtgaacaccaagcttgcacgtacaccttgtaaagcctgttgtaaaacttcatcatccagcattnttgatcatttggatcttaatttctcgctga

SEQ ID NO: 7446 - DNA, 101 bp, rice(Oryza sativa)
  misc_feature (71): n=t or c
atgagaaaaactagataaggcgttcatcatcgagaaattcttctgtgtttgtccacaaagattttcgctcnagctagttgaagtgcgcgtgttgctgtaat

SEQ ID NO: 7447 - DNA, 101 bp, rice(Oryza sativa)
  misc_feature (71): n=a or g
caaactctaacaaactccaccttagcgaatatgccacgacgacctgaatttgttacttgttcgaacctccntgtacccggacttgagttggttcctttttc

SEQ ID NO: 7448 - DNA, 101 bp, rice(Oryza sativa)
  misc_feature (71): n=t or c
tgtgcgtgtgccacgtgcacgatgagatgggattagtgagaggggcagggtgggtgccgcagctcctgcangccactaccgtcactcccttcttgcgctgc

SEQ ID NO: 7449 - DNA, 101 bp, rice(Oryza sativa)
  misc_feature (71): n=a or g
tttgcttagattcgtcacgtcctatcctaggttgggttatttcgggacaaaaagaatactatttcagcatntgtagaactcgacaaaactttaacaatata

SEQ ID NO: 7450 - DNA, 101 bp, rice(Oryza sativa)
  misc_feature (71): n=t or c
ttgtgatcgttgatccaactggcatgataaggtattgcttcacaaatgataggattgtttttgttacaaanaagaatgaaagtaagtccatctcttcgtct

SEQ ID NO: 7451 - DNA, 101 bp, rice(Oryza sativa)
  misc_feature (71): n=a or g
cccaatctcagtcacagccaagcccaagcttaggagtgaactccaacatcttagcaccaacaagcaggtcncttagttactactccctccgtcctaaaatg

SEQ ID NO: 7452 - DNA, 101 bp, rice(Oryza sativa)
  misc_feature (71): n=a or c
tctctagatagtagcgtgtgttggatgtgcatgcatgtgtgggtgcgtgggtagtggcagtgggtataacngtgcagtgtggagtgtgttcgtatacgtcc

SEQ ID NO: 7453 - DNA, 101 bp, rice(Oryza sativa)
  misc_feature (71): n=t or c
gctttgtagagtctgattatacattttctttttcgggggattatacattgagatttactctgataaaaaanaaaaatatctcaagctaccggcatctcacg

SEQ ID NO: 7454 - DNA, 101 bp, rice(Oryza sativa)
  misc_feature (71): n=t or g
agtagcttataacccttttgtagtgagaaaatgtgactcttccttcccctattttccaatccatgaaaaangagttattagaattagaatcgcccttcaag

SEQ ID NO: 7455 - DNA, 101 bp, rice(Oryza sativa)
  misc_feature (71): n=t or c
aattagtgcacatttggagagtaaatttgctctctgaaataatcacaatcacaaaaagcaaaataaaatgnatcgaatccttgtccttattacaaactgaa

SEQ ID NO: 7456 - DNA, 101 bp, rice(Oryza sativa)
  misc_feature (71): n=t or c
tgaaaaaagctaatggtgttatctattaaaaaaataaaagtaatactaaattactaattgacaggctcctncatatatattaatatatgataatgttgcaa

SEQ ID NO: 7457 - DNA, 101 bp, rice(Oryza sativa)
  misc_feature (71): n=t or c
catcccttagccagaaagcccctattgtccttcgccgttagagcatctccaagagagtggctatctcactntttaagttaaaatttgacaatattggatga

SEQ ID NO: 7458 - DNA, 101 bp, rice(Oryza sativa)
  misc_feature (71): n=t or g
gaggagttcaaggggaggaggagcaggaggatttggacgcgccgacgcggagaaagggaaaagggatgcgngaaaggtgttactctgggaggaggataagg

SEQ ID NO: 7459 - DNA, 101 bp, rice(Oryza sativa)
  misc_feature (71): n=a or g
aagaggaccaattgcactgagaaaaatgaagaccaaagtatcaatcaatccagtgaacatcttctaaaaanggcatcgaagatgataactcggtaaacaca

SEQ ID NO: 7460 - DNA, 101 bp, rice(Oryza sativa)
  misc_feature (71): n=a or g
gtggattggtagagcgacacagccgggacggtgatggagtggttgagtggagcacgactggaacggtgagntggagtggccgagggggtggggggccgggc

SEQ ID NO: 7461 - DNA, 101 bp, rice(Oryza sativa)
  misc_feature (71): n=t or c
aggccgggaatggacggcggccaacggaggccggaaggtgggtggtgggaggcagagagagatgtggcagntgcaatggctagaaggcccatcgccgtcgt

SEQ ID NO: 7462 - DNA, 101 bp, rice(Oryza sativa)
  misc_feature (71): n=t or c
tagactaatcgtcttccctatcgatcggtaagtgactaggctgtgttccttactgggttggaacccacttnctccgcgcgaaaaacggaacagtttattag

SEQ ID NO: 7463 - DNA, 101 bp, rice(Oryza sativa)
  misc_feature (71): n=a or g
gggtatagtaccgccacatatatatatactgttcgcatgcatgcatgcatgcatgatttttcatgcttgcncgcggcgatgctcgttttgatgcatgctcg

SEQ ID NO: 7464 - DNA, 101 bp, rice(Oryza sativa)
  misc_feature (71): n=a or c
cccaaacacgcatccgccgcctataaatcccacccgcatcgagcctatcaagcccaaaaaaccacaaaccnaacgaagaaggaaaaaaaaaggaggaaaag

SEQ ID NO: 7465 - DNA, 101 bp, rice(Oryza sativa)
  misc_feature (71): n=a or g
aacacagatattgatgagtgcctacacccggagttgtacacgtgctttggtgactgccggaacttgccggnttcctatgaatgcgggtgtcccaaggggtc

SEQ ID NO: 7466 - DNA, 101 bp, rice(Oryza sativa)
  misc_feature (71): n=a or g
atgtcgggctgcggttgtgctgatcgttgggtcatgccgtgccgaggaagagtcccaggtacaatccaacngccgggttgggccgtgctgtgtttgggttg

SEQ ID NO: 7467 - DNA, 101 bp, rice(Oryza sativa)
  misc_feature (71): n=a or g
agctgttgtcgttctcggtgtatgaaccgtggagacaggacgcaatcgacaataccatgtgaaacccaacngtcatgagtgaatttaaactgaagtctgaa

SEQ ID NO: 7468 - DNA, 101 bp, rice(Oryza sativa)
  misc_feature (71): n=a or g
acatagaaagagagaaaggagataaaaaggcaaacacaaaggaaataaatattggtagagtaacaaacaanccaagctaaagtcttctcctctcgtcctta

SEQ ID NO: 7469 - DNA, 101 bp, rice(Oryza sativa)
  misc_feature (71): n=a or g
acttagtccttgccgtgtttggcagattccgagaacgcgttggccaatcgagatcgtcaagtccagtactnggagacgaagttcgaagtggccgaactcga

SEQ ID NO: 7470 - DNA, 101 bp, rice(Oryza sativa)
  misc_feature (71): n=a or g
aatatgttgaaacaaagaaagtattaaaaaattgtgaatgtgttgggaacgattttttaaagaagaaattntgagcatgttggaaatgatattttttttga

SEQ ID NO: 7471 - DNA, 101 bp, rice(Oryza sativa)
  misc_feature (71): n=a or g
gtggtcaagaagatagttcctgaaataattgttcaaaagaatcagctcgaggggcaagcatatcaatatcngccagaagaacttcgtcaatatgggcatga

SEQ ID NO: 7472 - DNA, 101 bp, rice(Oryza sativa)
  misc_feature (71): n=t or c
tgacctaatctccaactaaactccctatcaagttccacctctctaccaaacaagacattgggttaaaaatnaaattttcatcttaatctcaacattaattt

SEQ ID NO: 7473 - DNA, 101 bp, rice(Oryza sativa)
  misc_feature (71): n=t or c
ggtgccgcagcaaacgatacattgaacaaatcgagataaaaaaaagtcgattatacatgggaaaagtacancaaaggtccctcaacttgtcatcgagttac

SEQ ID NO: 7474 - DNA, 101 bp, rice(Oryza sativa)
  misc_feature (71): n=t or c
atagcacgcacacaaagaagtgaaaaagaaataggatgctaagaaagagatccccaaatccaataaccggnaaattaaactttcaattcccagccgcatgc

SEQ ID NO: 7475 - DNA, 101 bp, rice(Oryza sativa)
  misc_feature (71): n=t or c
ttgcagctcttgggtttgttgtcctcctaagcattggactagctagtgctgcaagagtagaaagatactcnagttccgaaggttcaggcacaggaaatgga

SEQ ID NO: 7476 - DNA, 101 bp, rice(Oryza sativa)
  misc_feature (71): n=a or g
gaggggaagaaggcggcggcggcggctcagaccggagatggaatggaacggaaggagcggagaatggaggntgtgtttcgtaattttgacttgttacgagg

SEQ ID NO: 7477 - DNA, 101 bp, rice(Oryza sativa)
  misc_feature (71): n=a or g
tatcgtcggcctcgccgtccttggtggtgatcaccgcccggatgatcgacaggctgttctcccggaacacncgcgtgatctccgacaggagccccgccctg

SEQ ID NO: 7478 - DNA, 101 bp, rice(Oryza sativa)
  misc_feature (71): n=a or g
agacagagacagggatggagggatgctttttttaacggagatctaaccatctaaaataataggtccaccgntttaaataaaaatttatggtcagatttttc

SEQ ID NO: 7479 - DNA, 101 bp, rice(Oryza sativa)
  misc_feature (71): n=t or c
agctaaccaacatcttgtttccaacttcacactgtggagggaattaggcatggtgggcatcagggattttngcaaagccgccgaaagaatgaatgccccaa

SEQ ID NO: 7480 - DNA, 101 bp, rice(Oryza sativa)
  misc_feature (71): n=t or c
catcagtaagagtactagcagtaggctactaggttttctaacttctttttattggttaagattgtcagttngtcgcttttaaattattgtggcaataacaa

SEQ ID NO: 7481 - DNA, 101 bp, rice(Oryza sativa)
  misc_feature (71): n=a or g
gcctgaatctgtggcaactaacctcattctccggcgttaggtctagcccgccaccagggtcatcgcgatcncccctcctcgccagatctgcgctaggcacc

SEQ ID NO: 7482 - DNA, 101 bp, rice(Oryza sativa)
  misc_feature (71): n=t or c
gcggcgttcaattacattcccgctactgtatatgcacacgttcttcaatataaaatctgctctagggcccngtttagttcacaccaaacttcccccaaact

SEQ ID NO: 7483 - DNA, 101 bp, rice(Oryza sativa)
  misc_feature (71): n=a or g
aaatgccgagtaatctgttccccttgcaggccctgttctttcagattcagcatacgatccatcagagcaantgcttgagcagcttcctctcctattggaag

SEQ ID NO: 7484 - DNA, 101 bp, rice(Oryza sativa)
  misc_feature (71): n=a or c
gtaatagatacagaattcaaacaattttgctccaaacaattaaatatgggtaaaaaaaaaggttttcactngcatgtgttacataagttctaggaatgaag

SEQ ID NO: 7485 - DNA, 101 bp, rice(Oryza sativa)
  misc_feature (71): n=a or g
aagaacaagagaaaataagaggggttgattggtggcaagtgtactgagactagtgttagtttaattttatngatggatgatgtggataaaattagtggtgt

SEQ ID NO: 7486 - DNA, 101 bp, rice(Oryza sativa)
  misc_feature (71): n=a or g
ccaattttactaaatatatacgagacgtgtctatatgacatgtgggcccaaaaattttaaatatcacgatntccgaatatattcaatattggactcgtttt

SEQ ID NO: 7487 - DNA, 101 bp, rice(Oryza sativa)
  misc_feature (71): n=t or c
ttttagtgaaacatgttcgatctacttaggcgcctcaattttcttttttttttgtcgatcttttttttcgntggtttataggagccgagcgagacagcctg

SEQ ID NO: 7488 - DNA, 101 bp, rice(Oryza sativa)
  misc_feature (71): n=a or c
ggtgctctgatttagcttgtagcttgctgccttgaactgatccaatggctctgaccgcaacatattactgntggagttacttccgcttcatttgacctcgt

SEQ ID NO: 7489 - DNA, 101 bp, rice(Oryza sativa)
  misc_feature (71): n=t or c
gtatagaaaattcttctccaagcaaccccacttacaccgtgttaagatcctaaatttttcttcaaacttcnaattttttctatcatatcaaacttttctac

SEQ ID NO: 7490 - DNA, 101 bp, rice(Oryza sativa)
  misc_feature (71): n=t or c
taaaaaaagtataactttgcctactcatcattaatgttttattcctaccaaaaccatatgttgatcttcangataaaccttatacatatgctgcttgtatc

SEQ ID NO: 7491 - DNA, 101 bp, rice(Oryza sativa)
  misc_feature (71): n=a or g
tcctgtcaccgcggactccgaggaaggaaaacggtggtggttactgggggcgtgtggatgggggcgcgggnttcgaggagcggaggtttgaggagaggagg

SEQ ID NO: 7492 - DNA, 101 bp, rice(Oryza sativa)
  misc_feature (71): n=a or g
ggcggctgggagcaccggcaaaaccggcggcacgggaagcagtggcaatggtacgtacagtacttgctacntcttaaaatataaaaacatttagcattcaa

SEQ ID NO: 7493 - DNA, 101 bp, rice(Oryza sativa)
  misc_feature (71): n=a or c
caaaataaataatttataaataaaaaacttctatgtactttctcgtaacgatctaaaagtaaacttaaaantaaatcaggatgagaataccctgtgaccaa

SEQ ID NO: 7494 - DNA, 101 bp, rice(Oryza sativa)
  misc_feature (71): n=a or g
aagcatccaaccagctcctctcccaccggattggtcgtgagatgtgaacacccaaaaccctagagacagcngcggcggcggtatttcggacgtgcgcgtgg

SEQ ID NO: 7495 - DNA, 101 bp, rice(Oryza sativa)
  misc_feature (71): n=t or c
gccgagtatcaagctacaggaccagtctacttaccaggaggagtcttctcgaattatcggccattagtcancaataatcaaccagttgtccagtcgatccc

SEQ ID NO: 7496 - DNA, 101 bp, rice(Oryza sativa)
  misc_feature (71): n=a or g
attggacacagcgaacaggggctgctggagacgaaatcatggagatggacatatgtggctagctctagcangttgctgcctagggcacgagacagcgtagt

SEQ ID NO: 7497 - DNA, 101 bp, rice(Oryza sativa)
  misc_feature (71): n=a or g
tgaccatgacactgttccagagattccaatatatctatcatgctggcaggtaagtacactcaggtatgtgnaagataaaacaaggttcaccaaacctttac

SEQ ID NO: 7498 - DNA, 101 bp, rice(Oryza sativa)
  misc_feature (71): n=a or c
cgagcgaaagcaagcgagacctggtgtagaagttggtggagaggtcgacgaacggctgcgtggtgccgccnagcgcctcgaagacgttcccatcgtcgatg

SEQ ID NO: 7499 - DNA, 101 bp, rice(Oryza sativa)
  misc_feature (71): n=a or c
tgttagccacgtattactatctagttcttattcattgtgaattaattatcacacagaatatttcgtcaganaaaatcaaatatgcagaagaaaaagttata

SEQ ID NO: 7500 - DNA, 101 bp, rice(Oryza sativa)
  misc_feature (71): n=a or c
gctagctgacacccttctccctgctggtcgtcgtctgtcactgtcgagcttctacccgccacgcgcctctnccgccgaccgccgcaagcctgtccaattgt

SEQ ID NO: 7501 - DNA, 101 bp, rice(Oryza sativa)
  misc_feature (71): n=t or c
cgggcgtcccgagccgcgctgcaccgcatgtaggcgttcaccagcgacgtcgccacgaacatgtcggcgcnggcgcccgtcttcgccatgtgcccgtgcac

SEQ ID NO: 7502 - DNA, 101 bp, rice(Oryza sativa)
  misc_feature (71): n=t or c
tagcatcatctagcaacatgtttaacactaaggtgaatagagtaatatacctagagaatgctccagagaangagatattgctattgttgttgttgcctccg

SEQ ID NO: 7503 - DNA, 101 bp, rice(Oryza sativa)
  misc_feature (71): n=t or c
tagtcagaagctgtgatgaatagtacagtactttcatttctttgatgaaaaaaaaatgcagggttggttgncatgcccatggcgatggagcacgtatgata

SEQ ID NO: 7504 - DNA, 101 bp, rice(Oryza sativa)
  misc_feature (71): n=a or g
tcatgcaaggacacgaagctatagataggcaaaggatagagaggtttcgtcggtgaataacagtgtgtacngaaagcttaactttaatcctaatgaggtac

SEQ ID NO: 7505 - DNA, 101 bp, rice(Oryza sativa)
  misc_feature (71): n=t or g
aaggctccctgaattggttctggttaggctatcagaaattggggttttctgtacgaaaccttccatctgtntactcatattccatagcttttaattgcact

SEQ ID NO: 7506 - DNA, 101 bp, rice(Oryza sativa)
  misc_feature (71): n=t or c
ggaaaaactaatgatgttgggccacattttgtctactctcagctaggcttgggattagtccggttgactcnctcgaatatgagtgtaatctgatttgtatc

SEQ ID NO: 7507 - DNA, 101 bp, rice(Oryza sativa)
  misc_feature (71): n=t or c
tttggtcataattcggcatattttaatccaaaatatttttttgacccaaaaacagtgagggaggcccccanggtatgattttaaaaaataaccaaaattat

SEQ ID NO: 7508 - DNA, 101 bp, rice(Oryza sativa)
  misc_feature (71): n=t or g
tggacgtttcggactttgcctttcccttttcatttttctaatcgagagattaatcctaatgatattgtttnattaattaatggcttaatttggaacacaca

SEQ ID NO: 7509 - DNA, 101 bp, rice(Oryza sativa)
  misc_feature (71): n=a or g
tgcgttcccttgtctactcaggatgccggcttcattcctctaagtttcatcccatttggtgcagcggatcntcgggaacgcggacctcaccatcgttgctc

SEQ ID NO: 7510 - DNA, 101 bp, rice(Oryza sativa)
  misc_feature (71): n=t or c
atcctattttgggtatccttttcctcgatttataaatcatctaatcttcgagaattcatatcttgcaaacngtgactccgattgattccattcaacttccg

SEQ ID NO: 7511 - DNA, 101 bp, rice(Oryza sativa)
  misc_feature (71): n=a or g
aacatagcattgaggacagcacgaggaaaattgaaaagtaagaaaaaaacatacttatgattgtgtcttcngatgcatcagtttattatgcttatatctta

SEQ ID NO: 7512 - DNA, 101 bp, rice(Oryza sativa)
  misc_feature (71): n=t or g
actaaaaatgtttactcccatgatcaatcacaccatcaactcccttctttaaacttccattcctcttctcntctcttgcaaaacaggccgtgggaatccac

SEQ ID NO: 7513 - DNA, 101 bp, rice(Oryza sativa)
  misc_feature (71): n=t or c
tggatcagctgcttgtttgataagtctctccttgttttgatgggcatgcatgggagaagttaattctgtancgaatgttagagcctagctttcctgtacgt

SEQ ID NO: 7514 - DNA, 101 bp, rice(Oryza sativa)
  misc_feature (71): n=t or c
tgtaaatcttcacatagcaagtattagaggttgttttgatctcttatcggttaaaaccggactcttgtgtnaaacaaaggcagaccttaacgatgactcat

SEQ ID NO: 7515 - DNA, 101 bp, rice(Oryza sativa)
  misc_feature (71): n=t or g
cggtacaagcttgagccaagcctttaaaactttcgagttttcagatagactcagttcgatcttgactatcnagcttgatttgtaagtagaaaaatatatat

SEQ ID NO: 7516 - DNA, 101 bp, rice(Oryza sativa)
  misc_feature (71): n=a or c
ttaagtatgttattatcataattttaataattctgatatacaaattagtaattatcgaattgcactcatantaagtcttaatttatattaaattttagttt

SEQ ID NO: 7517 - DNA, 101 bp, rice(Oryza sativa)
  misc_feature (71): n=a or g
aatgtgttttgggcagatgctgaatcgcgtattgactatgctgcttttggtggtattgtcattttcgatancacttattgtgcgaacaagtataatcttcc

SEQ ID NO: 7518 - DNA, 101 bp, rice(Oryza sativa)
  misc_feature (71): n=a or g
tgaggacgcgcgacggcggaagccgtgatcaggaggccagagacgatcgactcggccatggtggcagagcngagaagcgtggggagcagtggccggtggga

SEQ ID NO: 7519 - DNA, 101 bp, rice(Oryza sativa)
  misc_feature (71): n=t or c
atggccctcaataacagcccatccaattcatacaggtggatggcccgggattgaggtccaaacaaggcccnctatagatttcgttgtaaagactgtcaagc

SEQ ID NO: 7520 - DNA, 101 bp, rice(Oryza sativa)
  misc_feature (71): n=t or c
tggcttcagcgttagcacgctaaatcacccacccgtgtcgtcacacaccaccggtccgtcccttccccagncatccctctaagcctagaatcctaatccca

SEQ ID NO: 7521 - DNA, 101 bp, rice(Oryza sativa)
  misc_feature (71): n=a or g
tatggtacctgatattaacaatgattaggcccgatatcgataggtatctaacttgattgataggtatcatntatggtacctggtactaacaatgattagac

SEQ ID NO: 7522 - DNA, 101 bp, rice(Oryza sativa)
  misc_feature (71): n=t or c
tgcatacatcttccggagcatagcgagcccggcgattaaactcatgcaagtattcggtgacagagcgaganccctgagtgagctctctgaactccttcttc

SEQ ID NO: 7523 - DNA, 101 bp, rice(Oryza sativa)
  misc_feature (71): n=t or c
cgccgccactcctcatcccctaatcgccatcgccgttcctcctctctgcacaaggaaccacaagtcatcgntgatccgtaaaatatggagaggaagaggaa

SEQ ID NO: 7524 - DNA, 101 bp, rice(Oryza sativa)
  misc_feature (71): n=t or c
tagcgtcagggataaactgtttgagctagtagaaaagaccggcttagcatcagggacaaactgtttgagtnaagagacatggaaaactggatctcaggtaa

SEQ ID NO: 7525 - DNA, 101 bp, rice(Oryza sativa)
  misc_feature (71): n=t or c
ttttctgcagagaagacgcacgagagccgctgccgacaatgacggctcgtgcatttcacgccatgcttgcnggggacgcctccggcgccgatgggcggtgg

SEQ ID NO: 7526 - DNA, 101 bp, rice(Oryza sativa)
  misc_feature (71): n=t or g
gagactgacctcatgagtcatgacagacaggcatggccggctgggctgatcggaccagaagcccaaaaatnaagtcacgaagagttcagccaggagccaac

SEQ ID NO: 7527 - DNA, 101 bp, rice(Oryza sativa)
  misc_feature (71): n=a or g
ctttcttcaaacttccaatttttttcaggaactaaacacacaatctgtcccaaaataagcacaatcataantttctctattaaactttaatcatccgtctt

SEQ ID NO: 7528 - DNA, 101 bp, rice(Oryza sativa)
  misc_feature (71): n=t or c
tccctcataaatgtgtgaagacttgtggcgaccgtccttctcgtagagggagctccgaatcatgctctgangggacgggtcatacctacctccactccgcc

SEQ ID NO: 7529 - DNA, 101 bp, rice(Oryza sativa)
  misc_feature (71): n=a or g
agcgtgaaggagtccgatgcgtccggctgcagttttgttttaaaaattgtaatttgatttggaatttgagngatagtgtcctattaagaatagtagttata

SEQ ID NO: 7530 - DNA, 101 bp, rice(Oryza sativa)
  misc_feature (71): n=a or g
aatttagctaaggtaaaattcaatgtgggaattcactttgatatttattgtttaaaaaaaatcatgagctncaattaggagtctgtatttcatctcaagtt

SEQ ID NO: 7531 - DNA, 101 bp, rice(Oryza sativa)
  misc_feature (71): n=a or c
aatgagaatagacaaggctcaaccggtcaaaacattatgatcatttttttaaaatgttgtaaagtgaaaanttgtaaaaaaaaagtactccttttattaat

SEQ ID NO: 7532 - DNA, 101 bp, rice(Oryza sativa)
  misc_feature (71): n=t or c
gctatcgaggagacgacgcgagcggttgatcgcagaggcggtacgtaaaggaggccggcgacaagcagagnggcgttgagccgaccgagctgatccccgcg

SEQ ID NO: 7533 - DNA, 101 bp, rice(Oryza sativa)
  misc_feature (71): n=t or g
acaaagtaaatcttccaaagatttagtggattgtattgtttggtagaaacaaagttcttgtccatggtcangcttcctcctgggccatcaagctccaccgc

SEQ ID NO: 7534 - DNA, 101 bp, rice(Oryza sativa)
  misc_feature (71): n=t or c
tctcaaagtttcgaatgtttaaccaaattaaagggtatgttggtttgtcagtgatttatatgttagagaangttattttgctagttatggatttcgtagtc

SEQ ID NO: 7535 - DNA, 101 bp, rice(Oryza sativa)
  misc_feature (71): n=a or c
ccggccccgacgatggaacgctgacccacggctcgccgatcctgatcatcttgatcggccgctcgctggcngccgcctcctcgcaccgcgccctcttcctc

SEQ ID NO: 7536 - DNA, 101 bp, rice(Oryza sativa)
  misc_feature (71): n=a or g
ttgattgtctcttgaatatgcccggaagtcgtttcttcatagctacaacaaagagcaagaatacaagactnctcggacgggggttaaacaaatacccaccg

SEQ ID NO: 7537 - DNA, 101 bp, rice(Oryza sativa)
  misc_feature (71): n=t or c
gccgctcatatatctatgacatatgggcccaatagcaaatcctttagggatgaaaacgataggaaaacagnctcaaccattaccataaccatatttttctc

SEQ ID NO: 7538 - DNA, 101 bp, rice(Oryza sativa)
  misc_feature (71): n=a or g
atgataagaatagcgagagtgttgtaacctgtcttggtagatatgattaagacgtagaaaagcctctctgnacacatcatatagtgcagctcgcacggtat

SEQ ID NO: 7539 - DNA, 101 bp, rice(Oryza sativa)
  misc_feature (71): n=a or c
aaacacggtcgcatgaacaagagtcagaattccgatccaagaaaccaaggagaagaaattaaaaaaaaaancccaaaaatccccagccgaccatggcggcg

SEQ ID NO: 7540 - DNA, 101 bp, rice(Oryza sativa)
  misc_feature (71): n=t or c
gcttagcattaaattgtgtcctaaactcctaatacattgatgtccttgattcacatatttgcacaacagantgacgcagggcaagaaaccaagtgtctttt

SEQ ID NO: 7541 - DNA, 101 bp, rice(Oryza sativa)
  misc_feature (71): n=t or c
ggctcctagccctttttcacaatgctgcattatactaaaatgtatcaaattcagatatagctatcttgtcngcgctcagaagataaggctaacagttcacg

SEQ ID NO: 7542 - DNA, 101 bp, rice(Oryza sativa)
  misc_feature (71): n=t or c
tcattcaattagataacgttctacatgttaaaataaagatggcgcacgttagatcaaaatagaagtgctangacagttttacggtaaggcattagcagatc

SEQ ID NO: 7543 - DNA, 101 bp, rice(Oryza sativa)
  misc_feature (71): n=t or g
tgttgttcatggcgctactgttgcggaggggcttatttgcaaaattggtgcttgtgtggcatgccacgtcngcggtcagagccggtcaagtgaggtttgga

SEQ ID NO: 7544 - DNA, 101 bp, rice(Oryza sativa)
  misc_feature (71): n=t or c
aaccaaaggtatgttaaaccatttttccttcaagtgtataggacttgtgtagttcttatatacttgatganttctttttctttatgctcccacccaaacat

SEQ ID NO: 7545 - DNA, 101 bp, rice(Oryza sativa)
  misc_feature (71): n=t or c
tcttaggtaaaattttgctataggacatagtaaacataatctttgccacatgacaccaaataacatagganacttgataacaatccggcccaggtgaggtt

SEQ ID NO: 7546 - DNA, 101 bp, rice(Oryza sativa)
  misc_feature (71): n=a or c
acttcttgagggtgtgcgcctgcaggatgaagagcgaggcccaggcgagggtggcgatgatgacgaacagngagccgaggaaccactccctgcccgacggg

SEQ ID NO: 7547 - DNA, 101 bp, rice(Oryza sativa)
  misc_feature (71): n=t or c
atagaatattatagttcatcatttaaagcaataattgaaattattctgaacggtcaaatcaacacaagaantcttgaaatgtgaacaatgttttgataaga

SEQ ID NO: 7548 - DNA, 101 bp, rice(Oryza sativa)
  misc_feature (71): n=a or g
aaaggccttcatccttggaatgagctcattagagatataggtgtagaccggtgcaacctattctcatgcanatctggaggcatcctaaccagtagaaagga

SEQ ID NO: 7549 - DNA, 101 bp, rice(Oryza sativa)
  misc_feature (71): n=a or c
gtgtctcgtctggctcgtgtctcgtctgcccctctcttgtcctccttgctcttcttttttctggtcaggtnccaattctagcgacagcccaatttggactt

SEQ ID NO: 7550 - DNA, 101 bp, rice(Oryza sativa)
  misc_feature (71): n=t or g
gttcaattcattcatgagagcagcgaagcggcatgtttccttggactcgccaccgccacctcctccaatcncattctcctctccacctgctgcattactgc

SEQ ID NO: 7551 - DNA, 101 bp, rice(Oryza sativa)
  misc_feature (71): n=a or g
aaccgttgggtttttactcttttaggatgtataaacgttccaaacatcatacccatgagtacgttaacggncaaaaccttcacacatcgggtacgcgggtg

SEQ ID NO: 7552 - DNA, 101 bp, rice(Oryza sativa)
  misc_feature (71): n=t or g
atcttttgtctctcctgttactaacgttttgcagggagttcagttcattcaacgaaaggaggagaatggtntacttgagaaggaggatgaagcacctgcga

SEQ ID NO: 7553 - DNA, 101 bp, rice(Oryza sativa)
  misc_feature (71): n=t or c
tttttcccaatcaaacttttaaagtttgactcaatttataaaagaatacagcaacatctgtaacataaaanaagcgtattatcaaaatatttatatttaat

SEQ ID NO: 7554 - DNA, 101 bp, rice(Oryza sativa)
  misc_feature (71): n=t or c
ttttttatgatatgcaggtacaaattatgcctatagagataggcgtattttttgtagagatgagtgtacangcgttgaaagcgctaataatcgctaaaaat

SEQ ID NO: 7555 - DNA, 101 bp, rice(Oryza sativa)
  misc_feature (71): n=t or c
agttcctaattccgctcaacaacgctgccgcacgctaatcggtctcatctgcttatccggttatcgatccntctgtctatgtctagagttcaagcgcaggg

SEQ ID NO: 7556 - DNA, 101 bp, rice(Oryza sativa)
  misc_feature (71): n=t or g
taacttaccatcttgggcaattgaggaatggaatggtcgtgactcaagtcctccttaatcctcctgtcaanctcttggggtttttatatattttcgcaaag

SEQ ID NO: 7557 - DNA, 101 bp, rice(Oryza sativa)
  misc_feature (71): n=a or g
gtgaaatagttacaaccagatgtagttaagtatactaaagcattttttttgaattatgaaggaaaataganaataaaacaaatatatagctcctctcatca

SEQ ID NO: 7558 - DNA, 101 bp, rice(Oryza sativa)
  misc_feature (71): n=t or c
actaaattgcccttacatttttttagcatattcctataatacccttgaaaatacttgcagtatatactaanagtatattgtactgtaaaagttctcttaat

SEQ ID NO: 7559 - DNA, 101 bp, rice(Oryza sativa)
  misc_feature (71): n=a or g
ggggttttcgatgagaccgagggagggaggaagagaggaggggggttcgtgttggcgactccgcggagttngccggacgggcggagtcgagtcgctgagaa

SEQ ID NO: 7560 - DNA, 101 bp, rice(Oryza sativa)
  misc_feature (71): n=t or c
cagctttcttctcacctgcgcccatgccacgcatgcgtaccatacctctgtccatttcgcatccaaatttncatgaaaattgctatgcatgctactacttc

SEQ ID NO: 7561 - DNA, 101 bp, rice(Oryza sativa)
  misc_feature (71): n=a or g
tatgtaggcatagacttagctattatcattctcccatcgtcccattttaagtacaataatgagtttccgtncccaactttgatcgtccgtcttatttgaaa

SEQ ID NO: 7562 - DNA, 101 bp, rice(Oryza sativa)
  misc_feature (71): n=t or c
tgagggaaaatattaaccaaagaagatatttcataataacatgggttgattggatctatgtcattacaaanatatcattttagataaatgtcattaatatt

SEQ ID NO: 7563 - DNA, 101 bp, rice(Oryza sativa)
  misc_feature (71): n=t or c
attctgctctcgagatacatgcttcaaggtcactagccgaaattctttcatcaacttctggcacttcttantataaaccattaatgtatcattcttggact

SEQ ID NO: 7564 - DNA, 101 bp, rice(Oryza sativa)
  misc_feature (71): n=t or g
tgatgctgaatcaggattaaaaattatgtcagactcataagtagttgatagttcatctacaaaaggaaaangtcagttagtttaaaatatgtgatttatca

SEQ ID NO: 7565 - DNA, 101 bp, rice(Oryza sativa)
  misc_feature (71): n=a or g
caaacagcagaggaacctaactgaagaacacgcaactaaccatatgcatagcagcgatatgacgagcagcnaaaaatgaatatatatatcacggtaacgct

SEQ ID NO: 7566 - DNA, 101 bp, rice(Oryza sativa)
  misc_feature (71): n=a or g
aaaaaatatcaaaaaaataaaataaaaaaattccagggggggcgccatccactctggagcgctcttccctnccacctcagcatcggcccgccacgtcggta

SEQ ID NO: 7567 - DNA, 101 bp, rice(Oryza sativa)
  misc_feature (71): n=t or c
cataaaattttggtggctgtttttatggaaaccacggaaatccttcacaaggcggctcgggcgaaggcggngcaagacgggtctggaggaaactccagtgc

SEQ ID NO: 7568 - DNA, 101 bp, rice(Oryza sativa)
  misc_feature (71): n=a or g
actaatgctagcttctgtttcggagcctacagctagctgtgatcagcaggccggatttaattgtacaggcntgcttttcaaacttaaaggtgtgatttttg

SEQ ID NO: 7569 - DNA, 101 bp, rice(Oryza sativa)
  misc_feature (71): n=t or g
tccctatatgatggtacgttaaactacttcttttgttctaaattctgttctaaaatatatgaatttctganattcaaattcgttgaaggcaagctatgaga

SEQ ID NO: 7570 - DNA, 101 bp, rice(Oryza sativa)
  misc_feature (71): n=t or c
acccaattgctctcccctttgatgtatactaagtgtatatgtttaaagtttgggattcaaattttactctncaattgcttctcttctgatttctgaaattc

SEQ ID NO: 7571 - DNA, 101 bp, rice(Oryza sativa)
  misc_feature (71): n=a or g
atgagtaaattttgcaaaactacaaatatattgaccaaactgtcacaaaagtatagatttaaaacgcatcntaaaaatacagatttaacatcaaatttatc

SEQ ID NO: 7572 - DNA, 101 bp, rice(Oryza sativa)
  misc_feature (71): n=a or g
cggtcgtcgtcttcgtctgcgttcgccgtggctgccgacgctgtcacccttgtctatcaccaccattcgcntccaatgcggccatcaccgagcccttgtcc

SEQ ID NO: 7573 - DNA, 101 bp, rice(Oryza sativa)
  misc_feature (71): n=a or g
aacaattatttgctctatccgaaaagagagtggagctggctgaagtgctcttacaaactaaactagagatntgaagcgaagtttagacagttccacaactt

SEQ ID NO: 7574 - DNA, 101 bp, rice(Oryza sativa)
  misc_feature (71): n=t or c
ataaatatgaattaatcacgagtatccaaataaataacccggaactggaacagacacagagttggctagtnagaccatcgggctagccggtctgactgctc

SEQ ID NO: 7575 - DNA, 101 bp, rice(Oryza sativa)
  misc_feature (71): n=a or g
tccatgatggcatggatcctgctagctctaacccagacacctctaataaagacaaggatttcagctgactnatggaggagggcagcactccagagaaacca

SEQ ID NO: 7576 - DNA, 101 bp, rice(Oryza sativa)
  misc_feature (71): n=a or g
ttactgcacatccagtaattttagagtgccttcgaaagagagaagattggaatatttttcttctgtgcacntaaagcgggtgactcattagcgtatgatta

SEQ ID NO: 7577 - DNA, 101 bp, rice(Oryza sativa)
  misc_feature (71): n=t or c
ggagagggggaaagacggtgccaggggtcagctgaatcctggttcgaccgactgcccttgcggccattcanccccaacttccatgtggaggatggagattt

SEQ ID NO: 7578 - DNA, 101 bp, rice(Oryza sativa)
  misc_feature (71): n=t or c
tatcgtcgccgtcgaagggaaggaactccacagaggggactaagacccctacgatccgccgtgggatggcngcgtgcgcgacggtggaggcgcgtggccgc

SEQ ID NO: 7579 - DNA, 101 bp, rice(Oryza sativa)
  misc_feature (71): n=a or g
tggggtcaaacttgggcattaaacaagatggactttaaaacaactctgcaccacaaaaatctggttggcancgcaggctagtggccgcgcattttgctatc

SEQ ID NO: 7580 - DNA, 101 bp, rice(Oryza sativa)
  misc_feature (71): n=a or g
ccggggtgaacccctttttcgcgaagttggagatcagcgtggcgacgccggtcttggagtcggggagggtnttcgtggcgtccgcggccgaggagacgacg

SEQ ID NO: 7581 - DNA, 101 bp, rice(Oryza sativa)
  misc_feature (71): n=a or g
atgatacgtccctaacggactcaagttgatacacagtacattgggcctaaataaggtgacacaacaccgtngacagaaaaaggtctctgtagtaaaacgat

SEQ ID NO: 7582 - DNA, 101 bp, rice(Oryza sativa)
  misc_feature (71): n=t or c
tttctcttcccggtcgatctcattacgagtctcccctccccttcgcctaccacttctccctttctcttccnggtcgatctcattacgagtctattgccgca

SEQ ID NO: 7583 - DNA, 101 bp, rice(Oryza sativa)
  misc_feature (71): n=a or g
cgtacctccaacacagggtgggtctgcataaagtactacgtacctctccatcacattttagtgtaactttngatttctgtgttcaatatttgaccatttat

SEQ ID NO: 7584 - DNA, 101 bp, rice(Oryza sativa)
  misc_feature (71): n=a or g
caagccggtcagccaccccctccctccgtcttccttcccatgtgcacggtccacggagagcctaacggctncgcgtgggcctgccacccttcggtccaccc

SEQ ID NO: 7585 - DNA, 101 bp, rice(Oryza sativa)
  misc_feature (71): n=t or c
tttcaataggaggcttgggatgacgctggtctccgtctctttaagtatatacaggacgtactcacatatgngtgggtgtgtaattcgtgtgtggtggtgtg

SEQ ID NO: 7586 - DNA, 101 bp, rice(Oryza sativa)
  misc_feature (71): n=a or g
atgtcaactactcacaccaactttctatttttggtgagaagaaaaaaatagcatgaagctagaaaggtccncatgtgaataacaaatatatacgatcatta

SEQ ID NO: 7587 - DNA, 101 bp, rice(Oryza sativa)
  misc_feature (71): n=t or c
tgactacaaagatcaattatacactagatcatcatgatttgtgtcaaaggatgaattaaacactcacaganagccaaaccaacaacccattgtataagctg

SEQ ID NO: 7588 - DNA, 101 bp, rice(Oryza sativa)
  misc_feature (71): n=a or g
cttcttgggcggttgccgtttttaccatgtaaaaattttagagcctttcttctgcttgttctaacattatntttgttgcaattaaatttttaaaataagat

SEQ ID NO: 7589 - DNA, 101 bp, rice(Oryza sativa)
  misc_feature (71): n=a or g
ttcattactattccaatgcatttttcattgggagccactattactgtatctgaaaattgtatagtatttcngcataaaagaagtttaaaaaattgtaaatt

SEQ ID NO: 7590 - DNA, 101 bp, rice(Oryza sativa)
  misc_feature (71): n=a or g
ttgcacggcccactgcaaccaagaagagcaggtacaagaatatactataaatcagccataaacatatgtgnaggagataaaagagaagagagaagagaaac

SEQ ID NO: 7591 - DNA, 101 bp, rice(Oryza sativa)
  misc_feature (71): n=t or c
tcttcatcctcttcctcccgctcgccgtcgtcgtcaaggaggagcacaagaacgtgtcccacctcgagcgngctctccagcagccgccgtccatcgccgtt

SEQ ID NO: 7592 - DNA, 101 bp, rice(Oryza sativa)
  misc_feature (71): n=a or g
aattcgatggcgatcggttcgactagagtagatgcgccgaaccgaccgctcgatgaccttcggtctgagcngtgtagtagcttcggtctgaccgcctaaca

SEQ ID NO: 7593 - DNA, 101 bp, rice(Oryza sativa)
  misc_feature (71): n=a or c
ctgcgaaatataaaatgaatccgcatcattagaaaatgctaattgtataataaatttgagttagggctatntatctatctataaaaattcgaaataaaaat

SEQ ID NO: 7594 - DNA, 101 bp, rice(Oryza sativa)
  misc_feature (71): n=t or c
gcgttaaatatttagaaacggaggtagtacgagaacccaatgagtcccgaactttttactgcattttgggnaacagcaatgtttatgaccgagttaggcag

SEQ ID NO: 7595 - DNA, 101 bp, rice(Oryza sativa)
  misc_feature (71): n=a or g
tatggattgtaatttacttcctttgtcaaaaaaaaacgaatgtagaactggtgtggcacattctagtacancaaatctgaacatatgtatgtttagattcg

SEQ ID NO: 7596 - DNA, 101 bp, rice(Oryza sativa)
  misc_feature (71): n=t or c
cacccatgctcctgggtaaaaaaaactcctgtgccgcctgtcgagataccaccgtatatcttagtggctancaatccgtagactagaccgctacccatgct

SEQ ID NO: 7597 - DNA, 101 bp, rice(Oryza sativa)
  misc_feature (71): n=t or c
ggcggatctacggttgaagggccggtatcaggcgacaccaacaactttcaagcaaacctataaaaaattanttattcatatattataacaccatgatctaa

SEQ ID NO: 7598 - DNA, 101 bp, rice(Oryza sativa)
  misc_feature (71): n=t or g
gtcattcagctagaatgcatgcatatacatactatgttctatagcattggtagcagatgctagcatcttgnatcatacaattctaaggaaggtagataagg

SEQ ID NO: 7599 - DNA, 101 bp, rice(Oryza sativa)
  misc_feature (71): n=a or g
ctgtttcaaatattaagcacaatatgaaaatttctgtggattaaatgtgggggacatatgtactagaaatnattacttttgtagattttgaaatagcagct

SEQ ID NO: 7600 - DNA, 101 bp, rice(Oryza sativa)
  misc_feature (71): n=a or g
ggtacttaaacagtcatctagagccgttgaattaaaaaacgaatggttaagattgtgtgcagttgccattntacagttacaatatcaactgcatttgattt

SEQ ID NO: 7601 - DNA, 101 bp, rice(Oryza sativa)
  misc_feature (71): n=t or c
aataggagaacaagtaggtgacgatatggatatatatataggaccaatatatatatcatcaaactagatanacaattgtaatattcgccttgattacttac

SEQ ID NO: 7602 - DNA, 101 bp, rice(Oryza sativa)
  misc_feature (71): n=a or g
gagtcgatatggaggcgggaatcgaaggcgtcgtcaatggtgtggcgtcggcgaagtcgcgagccagagangagaggagggggcgcggtggcgtgatgcgg

SEQ ID NO: 7603 - DNA, 101 bp, rice(Oryza sativa)
  misc_feature (71): n=t or c
agatataggggcctgaccccctacgcctctctctccatcgactctcaatccttcacccgcgtccctggtcngaaccggaaaggggtcccacagtccttcgc

SEQ ID NO: 7604 - DNA, 101 bp, rice(Oryza sativa)
  misc_feature (71): n=a or g
tttgttcaagtattataacatttataacttcaatatgcaacatttataacttcaatatatcagtagcgttngggatttaaacattaaaatctatattttgc

SEQ ID NO: 7605 - DNA, 101 bp, rice(Oryza sativa)
  misc_feature (71): n=a or g
tatacaggttttgtattttcattttgaaatggaagttaagaaatacttcagattttgtttgcgattacatngaaataattcagatttttttattgtatttc

SEQ ID NO: 7606 - DNA, 101 bp, rice(Oryza sativa)
  misc_feature (71): n=a or g
agtaatatggcacaagcgaacagataggtaatcccgtaatcccatgtaagcaaaacatgcaattttatttncaaacggtaaagcatttataaagtaggctc

SEQ ID NO: 7607 - DNA, 101 bp, rice(Oryza sativa)
  misc_feature (71): n=a or g
gccctggcgcggtggtgctccagtgcggtgcggactctctgtcgggtgataggttgggttgcttcaacctntcaatcaggggccacgcggaatgcgtgaga

SEQ ID NO: 7608 - DNA, 101 bp, rice(Oryza sativa)
  misc_feature (71): n=t or c
taaaattatataaaacttgttcaatttgctattcttttcatcttcatttttttttgagaattccactctangaagcatccttgaaatgctttgatatctgt

SEQ ID NO: 7609 - DNA, 101 bp, rice(Oryza sativa)
  misc_feature (71): n=t or g
aaggttataaaggtgttctagaaaaaaaaaaacagaaagtaaatgcagaggaactgaaaatatatacaaanatacaacttcagagttcagacagaacctgt

SEQ ID NO: 7610 - DNA, 101 bp, rice(Oryza sativa)
  misc_feature (71): n=t or c
gatatatttgagagagacaaagtggacttgttgctttaaaaaaaaaagactaaccataccaaatgtagccnaacaactcaatcgcacgctgttagtgcttc

SEQ ID NO: 7611 - DNA, 101 bp, rice(Oryza sativa)
  misc_feature (71): n=a or c
aaaacaaatgtttcaatctgttaaaactagttgtttcatatgtggaagcgacagtttcaacgtgtatcttnatgatgttttataaaatcataaaattttta

SEQ ID NO: 7612 - DNA, 101 bp, rice(Oryza sativa)
  misc_feature (71): n=t or c
agtagagattagcttgattaaaaaataaaaaagtgttgaatgtttgttgtacgtataacatattaactatngcttaaataacatactatctatatcaatta

SEQ ID NO: 7613 - DNA, 101 bp, rice(Oryza sativa)
  misc_feature (71): n=a or g
ctaataaaaactaataaaatttcctcattgtagaaggatacctcaattattagtatttttctttttttaancgattccaagaaaacgggcattgtatgaaa

SEQ ID NO: 7614 - DNA, 101 bp, rice(Oryza sativa)
  misc_feature (71): n=t or g
accagttctgaccctgatacggtactgaccatgaatagaaggtggaagggcaatattgtattttcgcgtangtactagtttttgtccgattgaggtgaacc

SEQ ID NO: 7615 - DNA, 101 bp, rice(Oryza sativa)
  misc_feature (71): n=t or c
aaaccgttttgatgtagtgtttttgtttcctccttttcttatctactttctgcgttggtcagttctcagtncctctgaagcaaatggcacctcaaccaacc

SEQ ID NO: 7616 - DNA, 101 bp, rice(Oryza sativa)
  misc_feature (71): n=t or c
tctcctccgtctgcatggctacaatgtctcatcatgtaaaaaaacaaaaactcacattttcttccaaaagncaatgcatgctgctttgatgagtacttaat

SEQ ID NO: 7617 - DNA, 101 bp, rice(Oryza sativa)
  misc_feature (71): n=a or g
gaaggtagatactccatatctcactaacgtagtaacatataggattggatgttacatattctagttctatnaatttaagcatactcatatttaaattcgta

SEQ ID NO: 7618 - DNA, 101 bp, rice(Oryza sativa)
  misc_feature (71): n=t or c
acccttatagtcaacacatcaactgtattagggcaagtactacagtcatttaagtacaatcccctaaatgncacctaagcttaaatgatgatgtggaggag

SEQ ID NO: 7619 - DNA, 101 bp, rice(Oryza sativa)
  misc_feature (71): n=t or c
ctaccggcggctggctcgccggtcagaggccaccgtgtcactgtgcttctccaatctccgttatcgtgtgngcttggggtagctagacccgaaggccgacg

SEQ ID NO: 7620 - DNA, 101 bp, rice(Oryza sativa)
  misc_feature (71): n=t or g
tcaaccccaacaaggccaagaagcccctccctcccatctggtcggaggtgctccggttcttcacgaacccncacaagcccatgatcctcgcgctgtcgcgg

SEQ ID NO: 7621 - DNA, 101 bp, rice(Oryza sativa)
  misc_feature (71): n=a or g
gatgtttgagctaggtggtatattgatgtggtagcgagttcagttttgtcaaaatttcagttctgtagatnctgttcttccttccatgttcatgtggggat

SEQ ID NO: 7622 - DNA, 101 bp, rice(Oryza sativa)
  misc_feature (71): n=t or c
caatgtactcgcaaattatttgcttgctgcgttgaaaggatctgctcggtcttggttggttcacctcccgncctgctcaatctcttcatgcgaagacctat

SEQ ID NO: 7623 - DNA, 101 bp, rice(Oryza sativa)
  misc_feature (71): n=a or c
tgctacatgcttactccccctgtttaaaattataaagcatctccttattttccaaaaaaatcaacatttanattttttattagtaattaattgaaccaaaa

SEQ ID NO: 7624 - DNA, 101 bp, rice(Oryza sativa)
  misc_feature (71): n=a or g
agttaagaatactttattaaatatgggttcctagattttgaataatagggaataagttagattctgagaanataaatggttaggtaacttagcttttaaag

SEQ ID NO: 7625 - DNA, 101 bp, rice(Oryza sativa)
  misc_feature (71): n=a or g
tggtggtggctagctgtatccatgacgagcgagatgtgggcagtgcgagagacgacgttgtgggctgcggnaggcaacttttgaggtgagagacccgatga

SEQ ID NO: 7626 - DNA, 101 bp, rice(Oryza sativa)
  misc_feature (71): n=t or c
aacggaacgaatgacaataactttcgcagttgcagaattactttctaatcttgatctgggtacctcgatanttgttcattaatactaagacaagcatcaac

SEQ ID NO: 7627 - DNA, 101 bp, rice(Oryza sativa)
  misc_feature (71): n=a or g
agaacttagcgagaatgctcagtcttaggcgcccgatgtgagccaaaaatatcaggcgcccttccgcgtcntcccattccgcgtgcgctgcatcttctcct

SEQ ID NO: 7628 - DNA, 101 bp, rice(Oryza sativa)
  misc_feature (71): n=t or g
cgccgccgccgcgtacatgaaaccctagcggatctcctctccgtcgtggccatggcggagcaggggtggtngttctgttcctgcctctagtttctcctatc

SEQ ID NO: 7629 - DNA, 101 bp, rice(Oryza sativa)
  misc_feature (71): n=a or c
tttctctcatgcctttctttcagccatttgttactcatggtcctaatagtgacaccagaggcagattaganccccccccccccaccgcccccccccccccc

SEQ ID NO: 7630 - DNA, 101 bp, rice(Oryza sativa)
  misc_feature (71): n=a or g
tatggtgcaattaatatagaaaacatcattatattcatcagaacttggacacaaataataataccaaaatnattgttttggttgttttattttggttgatt

SEQ ID NO: 7631 - DNA, 101 bp, rice(Oryza sativa)
  misc_feature (71): n=t or c
tcccgctaggcgccacgacggaacgggcgctacacaccattttttaaataaaaaaatactgactggattgncatgtgtacgtcccataggataaaaccgct

SEQ ID NO: 7632 - DNA, 101 bp, rice(Oryza sativa)
  misc_feature (71): n=t or c
tgttgtcattttaatatatttgaataatgcattgataaaacatatatgatattatgagagatattagccgngcaatctacgcgggccagcggatagtaatt

SEQ ID NO: 7633 - DNA, 101 bp, rice(Oryza sativa)
  misc_feature (71): n=t or c
ccgaccggctgcgcctaaataagtctatattaggtcccttggggccgaatcaaaagaaaagaagttcggtntaggtccctgtttcagaagcatttacaatt

SEQ ID NO: 7634 - DNA, 101 bp, rice(Oryza sativa)
  misc_feature (71): n=t or c
ttcgatcacattttgtccgtacagaacatcttggttaaacgttttaatacaattagcatggtggcccgcgnagattgcgcggctagcatcattatattttc

SEQ ID NO: 7635 - DNA, 101 bp, rice(Oryza sativa)
  misc_feature (71): n=a or c
tataatagtagagattaagctgatttatttttaccgatctgtcctatataaaaatttagtccatataatanaattaatacttaagttatcaagtcatgata

SEQ ID NO: 7636 - DNA, 101 bp, rice(Oryza sativa)
  misc_feature (71): n=t or c
tccatctagaaagagcacaaccgccgagtctttaaccaagaaacgtgttcttggcccaaggtggcaactcnctggcgagaagccaagctaattcaatagcc

SEQ ID NO: 7637 - DNA, 101 bp, rice(Oryza sativa)
  misc_feature (71): n=t or c
tgtacccgacgccacgtcacccccttcggccactaccacgtcactcctacccaacaacacgccaccccgcngcgtctcaggaggaggaggaggcacggaag

SEQ ID NO: 7638 - DNA, 101 bp, rice(Oryza sativa)
  misc_feature (71): n=t or c
ggccttccagtctgggttattaaggccttttacaagaagtgtcgcgccttcctgtggacaggtacggactnggctcatggtgggcagtgtcgggtgtccta

SEQ ID NO: 7639 - DNA, 101 bp, rice(Oryza sativa)
  misc_feature (71): n=t or c
catatcaccgaacaactaatattaaaatagtatatgatttcagataaatactccctcaatttctcaatttnaggttataagacattttgaatttggtcaaa

SEQ ID NO: 7640 - DNA, 101 bp, rice(Oryza sativa)
  misc_feature (71): n=a or g
actctgtcaatcttattcataagggaatgccattgacaagcgcaagggcgttgctggtgtgctgcgtcacnctcgccacgccggcggcgacctccttcccg

SEQ ID NO: 7641 - DNA, 101 bp, rice(Oryza sativa)
  misc_feature (71): n=a or c
tttccataatatagatagtttcacatgtacataacataatctgtattaggaggaaatacatatcctaaaanaaatgtcttagattgccaatttctatccat

SEQ ID NO: 7642 - DNA, 101 bp, rice(Oryza sativa)
  misc_feature (71): n=t or g
agatagggaaattcttgattattcaacaccggatcgttattagctattagccacccaataattaaagaaancacctttagagtggattaccatattatagt

SEQ ID NO: 7643 - DNA, 101 bp, rice(Oryza sativa)
  misc_feature (71): n=t or c
gagacgacatcgtccaacgcgaaacctcaagcgagtggctcaggaaaaagggagttgaggaggctgggggngcgttcccctcgtgggggtcgcacctccct

SEQ ID NO: 7644 - DNA, 101 bp, rice(Oryza sativa)
  misc_feature (71): n=t or c
aaaaggaaaagagacgggagagagagagagagatcacggtgatggtcggagatgcggaggatagcgacggngagagggtgcggctgttcgtcggccaggtg

SEQ ID NO: 7645 - DNA, 101 bp, rice(Oryza sativa)
  misc_feature (71): n=a or g
catgtttattttttaaagtagcttcccaattaacatatttttaaagtgtaaaatggttttgagagatatcnaaatttacactaaaaatttacacacacaca

SEQ ID NO: 7646 - DNA, 101 bp, rice(Oryza sativa)
  misc_feature (71): n=t or c
cttttgaagtgatacacctgtttgtgacataatttggttaatagttatagtttcatccatgcacaccagantacatagattagctgttatgattcgtggag

SEQ ID NO: 7647 - DNA, 101 bp, rice(Oryza sativa)
  misc_feature (71): n=a or g
acccctcttgatgtttttactggcggttttagcatataaccaccagtgaaaattatagtgcgacaccatgnaaaaatatttttctactattgatatttggt

SEQ ID NO: 7648 - DNA, 101 bp, rice(Oryza sativa)
  misc_feature (71): n=a or g
gcgagctccaggagacggtgcagtacccggtggagcacccggagatgttcgacctgtttggcatgtcgccntcgcgcggcgtgctcttctacggcccgccg

SEQ ID NO: 7649 - DNA, 101 bp, rice(Oryza sativa)
  misc_feature (71): n=a or g
gcactagccagtggaggttgccgtgcagtcggatggagcgagctccgtgcatcttcagccgcgcatctgcntcttccagttgaggcaggggaacctcgcgc

SEQ ID NO: 7650 - DNA, 101 bp, rice(Oryza sativa)
  misc_feature (71): n=t or c
gtgcggggacgtggcaagggctctcaactcgtcacgttagatctgtagctagctccagctcggcctttgangccatacccccacagaggcactcgtgccta

SEQ ID NO: 7651 - DNA, 101 bp, rice(Oryza sativa)
  misc_feature (71): n=a or g
aagagtaaacaattattggatcatatttgtgaaccttcattacaaattgacaaaaagttgcatgactgttntctcgagattacgacatgtagatttcaaaa

SEQ ID NO: 7652 - DNA, 101 bp, rice(Oryza sativa)
  misc_feature (71): n=t or c
tttttttaataatggattataataaacccgacctctataccttgtgagggtgtacacagcctaaaagtcanaaacacgagtacataagactctcccgttac

SEQ ID NO: 7653 - DNA, 101 bp, rice(Oryza sativa)
  misc_feature (71): n=a or g
ttcacttaattgcaaatatctcttcgaactaataaacggtgtgttactgaagctgaatatgatttatcacntgaggagaaacatgataacaattcaaattt

SEQ ID NO: 7654 - DNA, 101 bp, rice(Oryza sativa)
  misc_feature (71): n=t or g
tcaaggacaaactgcatgaagtattgaggatacggatccgtatcatatacaccatccggtcataaatactnaatatttagaacaaaatttgacttgaaatt

SEQ ID NO: 7655 - DNA, 101 bp, rice(Oryza sativa)
  misc_feature (71): n=t or c
acattgttgacgccgatgggagagatcggcgtggcggagcagaccagtgagggaggcgacggagttatcgngacacggaggagatcggaggaggcgaggcg

SEQ ID NO: 7656 - DNA, 101 bp, rice(Oryza sativa)
  misc_feature (71): n=t or c
acaacacatcccccaacttacaaaaccagtgcaaactaggttcctaagtggttttcactccagttttgtcngacgtgacagctgactaagggtggatccta

SEQ ID NO: 7657 - DNA, 101 bp, rice(Oryza sativa)
  misc_feature (71): n=a or g
taatatttctccaatcacattgttgttttagattgattcaatatatccatcacggttttgtagatctatcngctaaatagggttttcttattatcttcaat

SEQ ID NO: 7658 - DNA, 101 bp, rice(Oryza sativa)
  misc_feature (71): n=t or c
ccaaataattatgaaaaaaaattaaaaaaataagatagattaatgtgtcgagggatgttcactgttcttgnattgtcttccaaatattgcattgtcttcca

SEQ ID NO: 7659 - DNA, 101 bp, rice(Oryza sativa)
  misc_feature (71): n=a or g
acaaacaagaccatatacagtggtctcttgctaaatctaacaaaacccgacataactaacttaattaacanatacaattgccttaaatgagctctatctct

SEQ ID NO: 7660 - DNA, 101 bp, rice(Oryza sativa)
  misc_feature (71): n=t or c
atacttttttctaccttcctttttcctatttttgtttggtcatgtttgtgttattactaattaattagccngagaaggtaaagtgcaatgtgcaaatgctg

SEQ ID NO: 7661 - DNA, 101 bp, rice(Oryza sativa)
  misc_feature (71): n=t or c
tccacgttcgggtgtgacgtattgcgtaaatgcaataactacgcttgcagactagcagggagtggtctctnggtagtacctaggtgcctggaactaagtcc

SEQ ID NO: 7662 - DNA, 101 bp, rice(Oryza sativa)
  misc_feature (71): n=a or c
tatcgttggagtaagagagtgaagcactaagggttgtttggttcgtgaccacatgttgccacactttgccncatctcaagttaggcagctttgactaagtt

SEQ ID NO: 7663 - DNA, 101 bp, rice(Oryza sativa)
  misc_feature (71): n=a or g
ggcgggagtggcgggggcgtttagggcgtgtggcgtggcccacgatgaattgatcggcagtcggcgaccgncgacggaggtcctcctgcacctctcacccg

SEQ ID NO: 7664 - DNA, 101 bp, rice(Oryza sativa)
  misc_feature (71): n=t or c
atgctggtgtttctacattcggaagttttgacaaattaacttttttactaaacttattctaaaaataaacngtacccgacacgttgtttctaactagtacc

SEQ ID NO: 7665 - DNA, 101 bp, rice(Oryza sativa)
  misc_feature (71): n=a or g
ataacgccaaaatttagtaagatttggattcggttaaagaaagataataatcagttaattaaaagcttatntagaagagaccgagtttcagaaggagtcac

SEQ ID NO: 7666 - DNA, 101 bp, rice(Oryza sativa)
  misc_feature (71): n=a or g
cgatttgaattgcaatttcgattttactatagttaaaacttcgtcatatgtaaatatatatagcatcattntaattacacggtaactttcatataatttaa

SEQ ID NO: 7667 - DNA, 101 bp, rice(Oryza sativa)
  misc_feature (71): n=a or g
tgagggggtgaatcctggtgtactccggctcctgggtaaaaccaatcacgaatgccatgcaggcgagctcngcgacaaaacctcccatgtcctgatcactg

SEQ ID NO: 7668 - DNA, 101 bp, rice(Oryza sativa)
  misc_feature (71): n=t or g
tgggttgggaatggcctcatagagcatatgtgaggggggcgtattcacgagatatgagtgtggtgttgcgngtgtagtagcatgtatatatatgtacatct

SEQ ID NO: 7669 - DNA, 101 bp, rice(Oryza sativa)
  misc_feature (71): n=t or c
ggtactgccagctgacgatctgaacttatctctttttaatgcaacaaattcttatcatgaatgtgttttgnagaccgcaagatcaaatcccaagctcagtt

SEQ ID NO: 7670 - DNA, 101 bp, rice(Oryza sativa)
  misc_feature (71): n=a or g
ggtaaaatagacattttcataaatcataagcattaaatgatcaactgtcaagtaacggaattggcatgtangggattaaaccgaaattcagtagtaatata

SEQ ID NO: 7671 - DNA, 101 bp, rice(Oryza sativa)
  misc_feature (71): n=t or c
gctcgtctccaatcctgcccaccccctccgcctcctcgtggtatgcttccatcccctcacctcgtcacctngtccgacgtatcttgtgctcccctattctc

SEQ ID NO: 7672 - DNA, 101 bp, rice(Oryza sativa)
  misc_feature (71): n=a or g
atcacctataaactccccaagtaaaaaaaaaatcatcagaaaacagctgcagcagcagcagccagcagcangagcgccatggacgacaggagccggaagcc

SEQ ID NO: 7673 - DNA, 101 bp, rice(Oryza sativa)
  misc_feature (71): n=t or c
taaaatataggattgcaaaaaaaaaaaaacaagaatagttgtttaattagacagcacgaaaaacaaaaganaaataagatagaaaaacttgaataaaattc

SEQ ID NO: 7674 - DNA, 101 bp, rice(Oryza sativa)
  misc_feature (71): n=t or c
aagaggaagagataaggtgagggttgaggagataaaacttattaactgatcccgtctcctcctcctcgatnttgcgcacgctttggcctctccgccgcgca

SEQ ID NO: 7675 - DNA, 101 bp, rice(Oryza sativa)
  misc_feature (71): n=a or g
gaggcagtgttgctaagtttaaaagtgtcaagaatccctctaataatagtttcttcctttgcccttggtcntgaattgtgctcaattcactcccctctctg

SEQ ID NO: 7676 - DNA, 101 bp, rice(Oryza sativa)
  misc_feature (71): n=a or g
atagcaacggcatcagaatggtgttaaagggaagaggagctggtgaagtcagttggtgtacacaatagccnaatatacatggttgggcaccttctggctag

SEQ ID NO: 7677 - DNA, 101 bp, rice(Oryza sativa)
  misc_feature (71): n=a or g
attatgatggcaatctcaggctgtacagtcttgataaggtagacagaacatggtcagtgacatggatggcntttcctcagctctgcaaagtacgcggtttg

SEQ ID NO: 7678 - DNA, 101 bp, rice(Oryza sativa)
  misc_feature (71): n=t or g
attttagttcacaaatactcatcacattcattttattccagcaagtatccacatatttaaaatcacatttnaagtgtagatggaataagcatttgcttatt

SEQ ID NO: 7679 - DNA, 101 bp, rice(Oryza sativa)
  misc_feature (71): n=t or c
ggcgtagctgtcgggctcgacctccccgctgctactgccaccaaactcgacccccacatcgctgcagccancacgcgtggattcgacctccccggctcccc

SEQ ID NO: 7680 - DNA, 101 bp, rice(Oryza sativa)
  misc_feature (71): n=t or c
acgagtacaatatgtaaatgaactgtacaaattactatcatatttatgcttatatgaaggagagaggatangagagagaaaaaaaacgggttacagattta

SEQ ID NO: 7681 - DNA, 101 bp, rice(Oryza sativa)
  misc_feature (71): n=a or g
tttttgggtatttaccaatcgtttaaagacacaagttgagtatagtttattcagtataatatacctaatanaatttaacatatcttagcataaccgggtat

SEQ ID NO: 7682 - DNA, 101 bp, rice(Oryza sativa)
  misc_feature (71): n=a or c
cgagatccctcggtggtttagatggcgttttaggctgatgtggcgcctccgtagatccttttgactaggtntttcttccatgtggcgcttacgtagcaatt

SEQ ID NO: 7683 - DNA, 101 bp, rice(Oryza sativa)
  misc_feature (71): n=t or c
gctcgactcgctcacgtcgactcccacgactagaactagaagcgcatggactggctccacggctcactcangttattttctctctgcttccctttccgctg

SEQ ID NO: 7684 - DNA, 101 bp, rice(Oryza sativa)
  misc_feature (71): n=a or c
aaattcactccatgcgatgtcttgaagcatattttgccttaaagaaaatatgaagtagtttcagactttcngtagttactggaaaaataacatctctagta

SEQ ID NO: 7685 - DNA, 101 bp, rice(Oryza sativa)
  misc_feature (71): n=t or c
taatccacattgggctgaaatgctctagccagtccatgcctaagatcacatcatatcccccaagctgaagnacctttagatctgaagtaaaactatgccct

SEQ ID NO: 7686 - DNA, 101 bp, rice(Oryza sativa)
  misc_feature (71): n=a or g
tcctatgacttatggaatatacggatatggtataccttcgagtatatgatatgtttccgtatatgataatnaaactaacaagagattatggaaattattct

SEQ ID NO: 7687 - DNA, 101 bp, rice(Oryza sativa)
  misc_feature (71): n=a or c
ataatttttttttaatttcattacagatcaactcattggatttgtcttatggtagttatttaaaaaatgtnattaatcaaaatgtttactactaatttata

SEQ ID NO: 7688 - DNA, 101 bp, rice(Oryza sativa)
  misc_feature (71): n=t or c
tgcttccaacgccacaacaccgtcacgtaggacaatgaccaattcaaaccagccacgtaagcaccacatcngccgaaaccgtcgtccaaactgcttttggg

SEQ ID NO: 7689 - DNA, 101 bp, rice(Oryza sativa)
  misc_feature (71): n=t or c
gcagactggatgtgcattgcatcggaaaattaaagaagaacattctcatttattttaaagcctctaaaacngtgtaagatcaagtttaataagaatggtac

SEQ ID NO: 7690 - DNA, 101 bp, rice(Oryza sativa)
  misc_feature (71): n=t or c
tatactagtaaaaatgacgtttagaacagcatttagcataccaagaagtgattaattatgggtatttttcnctgtctacccctattaaatatggttgcgcg

SEQ ID NO: 7691 - DNA, 101 bp, rice(Oryza sativa)
  misc_feature (71): n=a or c
atggccatacttttcataatgattttgcagcaaataacttcacacattttttagactaaatttttagtttntctctctctctctttccatgatgaataatt

SEQ ID NO: 7692 - DNA, 101 bp, rice(Oryza sativa)
  misc_feature (71): n=a or g
gacgagggagaagatgagaaagagtaagacatgtgggttctacttgatgactaaacaagtcaactttcacntaggataaaactgcttccaaaaccgatcgg

SEQ ID NO: 7693 - DNA, 101 bp, rice(Oryza sativa)
  misc_feature (71): n=a or g
cattcaccttgttcaccagaccattgatactcttcttgagagcatcccagctgagacgctggtactcgggnctcgacttgtcctctacctccctcatcatc

SEQ ID NO: 7694 - DNA, 101 bp, rice(Oryza sativa)
  misc_feature (71): n=a or g
cctcggaccctccaccacctccccctccactaccgccaccctcggcgctagcatatctagctacccttgcngcattggctagaccaacgctcagcagaaca

SEQ ID NO: 7695 - DNA, 101 bp, rice(Oryza sativa)
  misc_feature (71): n=t or c
ccatatggttttccgaaaaaaaaagtagggtacataaaatgttccatctttctagaaaagatgattcgttncagaaaggttccggaagaagttaaccgcaa

SEQ ID NO: 7696 - DNA, 101 bp, rice(Oryza sativa)
  misc_feature (71): n=t or c
gaggtcgaatgtactgatgcaaccttgaacgacgctgatgaagccaacacaattgctagggccaacggaangtaggacttaccccttcgccggagatcgaa

SEQ ID NO: 7697 - DNA, 101 bp, rice(Oryza sativa)
  misc_feature (71): n=t or g
ccggagcaggagcgccttggggtccagcagcgtcacggcgacgcggtaaaatagtagcagcggcgtggtcnacgaccggcgactcaggggtagaatcgtac

SEQ ID NO: 7698 - DNA, 101 bp, rice(Oryza sativa)
  misc_feature (71): n=a or g
atggattcaattagctatcttaatcaataataggactggctagagaggattccgatggattcaattacgangtttaatttaaaggtaaaactctatccaat

SEQ ID NO: 7699 - DNA, 101 bp, rice(Oryza sativa)
  misc_feature (71): n=t or c
caagagcgaagccatatgggcgaaagccgtgattgtgggtaacaccaccttcgtcaagtggagttctcganagaaggcggaacgagcgaagatgatgtggc

SEQ ID NO: 7700 - DNA, 101 bp, rice(Oryza sativa)
  misc_feature (71): n=a or c
agtgtcgtcttcaagcttggacagagcccctgcagccaagattgctattgggcgatcagtcgagtgactcnctctccgcgcgactggacacgtgtcgcgcg

SEQ ID NO: 7701 - DNA, 101 bp, rice(Oryza sativa)
  misc_feature (71): n=a or g
gaacgaagttccagtgaccgaattattgtgggccgttcgatcttcattagtctttctctatttaaccaacngaagaagaaaaaaagaaaggaaaaaaaagt

SEQ ID NO: 7702 - DNA, 101 bp, rice(Oryza sativa)
  misc_feature (71): n=a or g
attgaagatgagaagatggtggcgacgactcgtgtccctcgcttccctgtggacagatccatcggtgactnatgcgacagcctctctcagagagagtggcg

SEQ ID NO: 7703 - DNA, 101 bp, rice(Oryza sativa)
  misc_feature (71): n=a or g
attttttttcttttccttttatccggttggtcttttttctttttcattgttcttttactctttgcatatcncccaaatcatcatagatcgaatgaataaaa

SEQ ID NO: 7704 - DNA, 101 bp, rice(Oryza sativa)
  misc_feature (71): n=a or g
cacggccatggctaggattagggcaaagcgaaagcgaaccctacctgagagcggaggaggtggatgcggangagggcttggaggagccgggccccgtgcca

SEQ ID NO: 7705 - DNA, 101 bp, rice(Oryza sativa)
  misc_feature (71): n=a or g
gctctagggatgacacattcaaggtggccgtgcagcagggcaacacgtacctgctcagggtcatcaacacngggctcaccaacgacatgttcttcgccgtc

SEQ ID NO: 7706 - DNA, 101 bp, rice(Oryza sativa)
  misc_feature (71): n=t or g
aaaactaaccaaccggactaatggtgccgccatcttaccaaccgggacttaaaaatccatctttactcccngttattttagccgagactaaagatagataa

SEQ ID NO: 7707 - DNA, 101 bp, rice(Oryza sativa)
  misc_feature (71): n=t or c
tgggttttattttatagttcttagatgtcccgtcaaccgtcaccaccctactcttttatggcccatccatngcccttcctctttaatatcattgggatttt

SEQ ID NO: 7708 - DNA, 101 bp, rice(Oryza sativa)
  misc_feature (71): n=t or c
gagcttgtcaaggtgaagtctacacccttcgcctcacatggctggtcctacgaggtacccacgcggctttntggccttcgtcgtcttcgttccgtagcctt

SEQ ID NO: 7709 - DNA, 101 bp, rice(Oryza sativa)
  misc_feature (71): n=a or g
ccgcctctaaggtgccggttgggaaatctgacgccaaaggctggttcccaaccgacaccaatataccattntgtagcagtgtatacttgccaaaccgctag

SEQ ID NO: 7710 - DNA, 101 bp, rice(Oryza sativa)
  misc_feature (71): n=t or c
gcctttggtgtcctaaactacacaacttttgtactgtccatcggcagtgtcacatttttacagtgtctctnagacaattacacgatttttgagtatcctat

SEQ ID NO: 7711 - DNA, 101 bp, rice(Oryza sativa)
  misc_feature (71): n=t or g
actgcaagcctgcaagctgcagcaatcacgaattaatcgaggtgttaatcttggtttatgtcggtgattanttcccttggttaatgtgctctgcagctggg

SEQ ID NO: 7712 - DNA, 101 bp, rice(Oryza sativa)
  misc_feature (71): n=t or c
ttgactcccttaacttgtggtcgaatttgatttgtatccgtgaaccgcaatacaggatatcttgacccctnaataattattaaaacatatacaatttgact

SEQ ID NO: 7713 - DNA, 101 bp, rice(Oryza sativa)
  misc_feature (71): n=a or g
ataattttaagttttagtaggataggctaaatgtgttgtaaccaaaattccctatgcatcactaatatttngtaacaaaactaaatgcatccacatattta

SEQ ID NO: 7714 - DNA, 101 bp, rice(Oryza sativa)
  misc_feature (71): n=t or c
cgtctaagaaaatagatttttgcatgcgggtctattaagtagccgtatgtgaaaatggaggtcatttttgnagacgccgccaagggtcctcgtacagaaag

SEQ ID NO: 7715 - DNA, 101 bp, rice(Oryza sativa)
  misc_feature (71): n=t or c
gttcctgttctttgatcataacaacttcgccttcatatgttcggtaaagatgttccgttgaaaagtgtcanaccctgattttcgtcttaggatttataaat

SEQ ID NO: 7716 - DNA, 101 bp, rice(Oryza sativa)
  misc_feature (71): n=a or g
tgccatggtggtgatggcggtagtgatggagaaaaagaaaaaaaatggcgatgtgcggtggcaagaactcnaaactctaattgactagacactaagaccag

SEQ ID NO: 7717 - DNA, 101 bp, rice(Oryza sativa)
  misc_feature (71): n=a or g
gccagatttgacttagttaggcattcgtttggttagtggcacacttttggcaagattccttcaccatgatntgggtcccatgtcattggcacataaaagtg

SEQ ID NO: 7718 - DNA, 101 bp, rice(Oryza sativa)
  misc_feature (71): n=t or c
ttattacaaacataccctttttcagacaatgaaagtatataaactttcggcctcgatcgtaggatgcacanagccaaaacacacataaagtagtactgcga

SEQ ID NO: 7719 - DNA, 101 bp, rice(Oryza sativa)
  misc_feature (71): n=t or g
actttttctctctagcatctcctatcagacactgtttagtctacttctgctgagtttagtttcaaaatttnttttcaaactttcaacttttccatcacatg

SEQ ID NO: 7720 - DNA, 101 bp, rice(Oryza sativa)
  misc_feature (71): n=a or g
ccaaacgatagcaaaagtggtattaaaaaagtgaggatctatatatgaagtttgtgtatataagaaaattngtactcccttcattttctaatgtatatata

SEQ ID NO: 7721 - DNA, 101 bp, rice(Oryza sativa)
  misc_feature (71): n=t or c
gctgcttgctgcttgacgaagaacgacgatgacgacgcaaagaagaaaaaaaaaagaaacggtggccgccnccggagatcagaaccctcccaggggcgacg

SEQ ID NO: 7722 - DNA, 101 bp, rice(Oryza sativa)
  misc_feature (71): n=a or g
cgcctccatcgcgtgcgccgcagcgagcacaactctggccacctcttctccgccgcaggagcacagtcccncctccgtcccgaggagcccaccgccgccgg

SEQ ID NO: 7723 - DNA, 101 bp, rice(Oryza sativa)
  misc_feature (71): n=t or c
tcttttagccaagatcaaggaagaggccaaaacttaggctttagcaggagcgagaagttttaatagctggnttttttttaagttagctcggaccaaaggtc

SEQ ID NO: 7724 - DNA, 101 bp, rice(Oryza sativa)
  misc_feature (71): n=a or t
agaattagattaaatttcataaaactccacctgatccgaattactctaccaataagtaaaagaaaaagaantttggttccttgggcaaccgtgccctctgc

SEQ ID NO: 7725 - DNA, 101 bp, rice(Oryza sativa)
  misc_feature (71): n=a or t
agtctatttgtcacttcggtacgatccgtttatagacatcatctcaacagataagtcctttccacaaaatntgtcctaaacaaccatttgaaagatggtat

SEQ ID NO: 7726 - DNA, 101 bp, rice(Oryza sativa)
  misc_feature (71): n=c or g
tcatgaaaacatcaaacaaaagttgcatctccttaggaacaatttcctcggatccaatcccgacaaccacntcaataattatcacctttcccccagcatct

SEQ ID NO: 7727 - DNA, 101 bp, rice(Oryza sativa)
  misc_feature (71): n=c or g
aaacaccccggaaatcagaaacaaatacaaaacatcacctcccatccccgagtccgtcactccctccgccncctctctcccctccgcccccgccgacgccg

SEQ ID NO: 7728 - DNA, 101 bp, rice(Oryza sativa)
  misc_feature (71): n=c or g
ctatgattacactcagttttcttgcggctacaccgatttgaagatctcttgcagcttggacgggagtaagnagaccccttttatccaactcaacggagaga

SEQ ID NO: 7729 - DNA, 101 bp, rice(Oryza sativa)
  misc_feature (71): n=c or g
ggcggagcggagtatgtagcgactcgggcggcagcatgcgagattgggagaaggaggcggtgtcgcagtgnagcgcacgtgcaggcggctgctccacacgg

SEQ ID NO: 7730 - DNA, 101 bp, rice(Oryza sativa)
  misc_feature (71): n=c or g
ttggacatgctgaagttgttaccagagagatcaaggtgtttgagtgaggttaacctgaacaatgcagggtngacgctgtcagcttgcaggtggtggccgcc

SEQ ID NO: 7731 - DNA, 101 bp, rice(Oryza sativa)
  misc_feature (71): n=c or g
attacgtcggattcgtcttaaccttcctcggtctaaagaagtgaaaatttggtgggaaggaattggtgatngcttttgtggagttcaaagtgagtgcattt

SEQ ID NO: 7732 - DNA, 101 bp, rice(Oryza sativa)
  misc_feature (71): n=a or t
acattgtcactgacagaaaaaaaatagtgaaaaggacgatgcggaatctaagcgatcgcctaaactagccngaaagataagtttgttgctggaaaaaaaac

SEQ ID NO: 7733 - DNA, 101 bp, rice(Oryza sativa)
  misc_feature (71): n=c or g
tctccaaacctgccattccaagccatctctctctctctgtctctgtgattgatcaaacaagaagtgtgaantgtgggtgggtggaggaggcaagggggaag

SEQ ID NO: 7734 - DNA, 101 bp, rice(Oryza sativa)
  misc_feature (71): n=c or g
taactgtctatactttcatgatttctcctaaccgtttatactttcatgattgtgccctctgatacccttangaagatatccccaaggtctgatatttaatt

SEQ ID NO: 7735 - DNA, 101 bp, rice(Oryza sativa)
  misc_feature (71): n=a or t
caaactatcacacatccccaccagatcagaaggcattgcaacaagctgctggtaataatgatgagctttcnttgaagcagaatcaggcaacccgtgcagaa

SEQ ID NO: 7736 - DNA, 101 bp, rice(Oryza sativa)
  misc_feature (71): n=c or g
gggaaagtccaaaaagcaacgaacgagcacagccgtgttccatttcatatatgaactgtcaggatttggcntagtaccagacaagtgcatctcttccatag

SEQ ID NO: 7737 - DNA, 101 bp, rice(Oryza sativa)
  misc_feature (71): n=c or g
tattagaggcttagagcatcaccccctataatagggtgcttccattcaacgcccaagctagctactataanattcattttttttagaacaataacaatgtt

SEQ ID NO: 7738 - DNA, 101 bp, rice(Oryza sativa)
  misc_feature (71): n=a or t
gtaggttgaacttttgccttttggtaaaaatataattcatgagggcttcctctctccaactggtcaagcanaagagagttggaacagtcatcatccatcaa

SEQ ID NO: 7739 - DNA, 101 bp, rice(Oryza sativa)
  misc_feature (71): n=a or t
aaggattctcacagatgacttgatggtgaagtgaacagtgctaccaaccaaagccatggtgtttttttttnaaaaaaaaagaaaaacaaaaaaacaaaacc

SEQ ID NO: 7740 - DNA, 101 bp, rice(Oryza sativa)
  misc_feature (71): n=a or t
tatgctcaaaagcagttgctgcaacctgcaagcaaatgattatttgtagtttagttgcattgcagatctgncttaaccgtgcatagacttgattacttgaa

SEQ ID NO: 7741 - DNA, 101 bp, rice(Oryza sativa)
  misc_feature (71): n=c or g
gccgccacgccacgcctccgccctccccagcactcaagtgcgccaatcatccaccctaaaactaaaaagantgaaatacatggccggttcttaaacttatg

SEQ ID NO: 7742 - DNA, 101 bp, rice(Oryza sativa)
  misc_feature (71): n=a or t
aaagggataattggactaccacaatagaggataaatcacttttttttcctatttagattgccagtgcaatntatatggcctatttatttgttgtcattttt

SEQ ID NO: 7743 - DNA, 101 bp, rice(Oryza sativa)
  misc_feature (71): n=c or g
aacaaaacttacatacaactgaggtaccaaaacaacggagaaaatcatttgtactgctttgaattataaanctataataaataacagaacagaagtatagg

SEQ ID NO: 7744 - DNA, 101 bp, rice(Oryza sativa)
  misc_feature (71): n=a or t
tttaatttatactcatagctgcaagtgtgtagctactagctagagaaggctgtatgccatattgctaaaanatgccaactattgactaaaaatttataaat

SEQ ID NO: 7745 - DNA, 101 bp, rice(Oryza sativa)
  misc_feature (71): n=c or g
cgaccaccatgtttgaaaaactctcacaaggattgagaatctaggttataaaaggagaggacatgtcaggntccgcaatggcaataagaacttgaaataaa

SEQ ID NO: 7746 - DNA, 101 bp, rice(Oryza sativa)
  misc_feature (71): n=c or g
cgacgagacctccccaccgaccgtcgctattttcctgagagacatgcggttaaacatcgcgtacgccaagnccggcgaccgccattggaagctcctcgacg

SEQ ID NO: 7747 - DNA, 101 bp, rice(Oryza sativa)
  misc_feature (71): n=c or g
tggcggacccaaaaaaaaaaggttgggtgtgcacatacagttgtcgaggtagcatattgatcttggatcgngaatgatgtagcttttgatcttggtgataa

SEQ ID NO: 7748 - DNA, 101 bp, rice(Oryza sativa)
  misc_feature (71): n=a or t
gttgattgcatgttctaattaaaataggctcagaatgatcttgcagaagaccaagagtacccggttacaantttttttagaaccgtagttaggtgtgagaa

SEQ ID NO: 7749 - DNA, 101 bp, rice(Oryza sativa)
  misc_feature (71): n=a or t
gaaaaattcgactgtggttgcctggttggctccgttttgtgtcgaatactttttagatggttactccctanaagctccctaaccattgtatataccctaac

SEQ ID NO: 7750 - DNA, 101 bp, rice(Oryza sativa)
  misc_feature (71): n=a or t
agacgcacactgatctccggtgtgtgtgtgagagatcaaaaaagtaattaaaatgaaaacaaccaagatantttttcttaaagaaaaatacatatgtcaca

SEQ ID NO: 7751 - DNA, 101 bp, rice(Oryza sativa)
  misc_feature (71): n=a or t
accggcgtagtcccgaccttgccggagcatcacgtgcagtcaataacctcctatgtcaccgtggttcaacncaaagtttccgtgatccatccgactcaatt

SEQ ID NO: 7752 - DNA, 101 bp, rice(Oryza sativa)
  misc_feature (71): n=c or g
tggtggatcgaccgacccagctacgacccgtatcgccccacacctcaagacccccttgccctttatagtantcatgagccattaaaattaggtataacaag

SEQ ID NO: 7753 - DNA, 101 bp, rice(Oryza sativa)
  misc_feature (71): n=c or g
tttctctaatatctatataagtaaaatcccttttaattttgggggaatatgcaaaaagcagaagtaaaatncttattaacacatatagtaatcacatccag

SEQ ID NO: 7754 - DNA, 101 bp, rice(Oryza sativa)
  misc_feature (71): n=a or t
acaggtccgaacaaacctctctgaactgttgacgaccgaccaagtacacgcaatgacaccaaaaaaaaaanttatcaatggcctgtttcgtttggcccaga

SEQ ID NO: 7755 - DNA, 101 bp, rice(Oryza sativa)
  misc_feature (71): n=a or t
ggacggtccgtcctcccctctcgcgcacgacaacagaacaagagatggggacgagaaagaaagagaccaangacggactcacactctcgtatatcctccct

SEQ ID NO: 7756 - DNA, 101 bp, rice(Oryza sativa)
  misc_feature (71): n=a or t
aggaaagatattttgagcccagagcaagcaaccaatggcaggcgcacgcacacaccaaatgaggctaccancaaatggcctaatcaatcaaagaaaaagtc

SEQ ID NO: 7757 - DNA, 101 bp, rice(Oryza sativa)
  misc_feature (71): n=a or t
tgtaatagtcccatgatgtatcgaccgtctcctttggagtttggaacaaggaattttgcagaaattaaacnagtttttgtaaaattgctgcgttccaaaag

SEQ ID NO: 7758 - DNA, 101 bp, rice(Oryza sativa)
  misc_feature (71): n=c or g
atattagtgtctgaatatttaccggagtactaggcttacgtctaggtgggataagccaatagctcctcctnccgtcctctggcaaggtaaacccagctatt

SEQ ID NO: 7759 - DNA, 101 bp, rice(Oryza sativa)
  misc_feature (71): n=a or t
tttaatgttcatgatgtgccttactttttgtgcatatactcaatcggccccaggtgccacttttgtggaantttttttatgagtcgatggttggatgagga

SEQ ID NO: 7760 - DNA, 101 bp, rice(Oryza sativa)
  misc_feature (71): n=a or t
acgtacacaatacatctagctagtatttcaggtggtcaagaacttttctctaactcacatcaaaattcctngcattttcccttaatttttttgtcaactgt

SEQ ID NO: 7761 - DNA, 101 bp, rice(Oryza sativa)
  misc_feature (71): n=c or g
tgctgatccatcagtcgttgatctgattgctcgatggaggcatagtgagaaatgcttgactttaggtggtntgtactttgcctaatctttcctggatttct

SEQ ID NO: 7762 - DNA, 101 bp, rice(Oryza sativa)
  misc_feature (71): n=a or t
ccccctcttctagaacgcatccagaattcgtggactctgcgacccaactcacacggcgaagcacacagaantttttttcccaaatccatttattttcctct

SEQ ID NO: 7763 - DNA, 101 bp, rice(Oryza sativa)
  misc_feature (71): n=c or g
atttagctctaagttggtgtcatcttggtgaagatccactggggatgctcgcatcacacttgtcaaacctnacttatctaagactgaacaacatgcacagt

SEQ ID NO: 7764 - DNA, 101 bp, rice(Oryza sativa)
  misc_feature (71): n=a or t
attttgatatatcatgttacctgtaggttttgaggcctgatgattgatatatgatgatgtgcttatgagantttgtatgcttgttaacatacgagccagag

SEQ ID NO: 7765 - DNA, 101 bp, rice(Oryza sativa)
  misc_feature (71): n=c or g
acgaattgtgcaattcgatcctaacgacacaagctagcttgctagtatgaagagctccgatcgatacgccnagtaatcaacactataaatatgcgctacag

SEQ ID NO: 7766 - DNA, 101 bp, rice(Oryza sativa)
  misc_feature (71): n=a or t
agggttcagctgcagtgaaatgttttggaaagttccacgcaagcaggcagccggtcgcgagttctaaaganattttattctctttaaaaaaaatcaattta

SEQ ID NO: 7767 - DNA, 101 bp, rice(Oryza sativa)
  misc_feature (71): n=c or g
tcaccaaacttcctactatagtgtcaaacttcattctatagtgtcattgttaacataaaagagaaaaaaanggtattcgattgctaacatattatataatt

SEQ ID NO: 7768 - DNA, 101 bp, rice(Oryza sativa)
  misc_feature (71): n=a or t
agctgttgtttttgtttggaatcgtgttagatctagggttggagggtatggctgtgtggggttcgaggtcngatctgatgcgaaagtttagggttcttggt

SEQ ID NO: 7769 - DNA, 101 bp, rice(Oryza sativa)
  misc_feature (71): n=c or g
aatcaactttcaaaaccggacaaggagtctatttttggtggttttatttgcgatgacagtggttttgctantgtagactcctattacacattttcctgatg

SEQ ID NO: 7770 - DNA, 101 bp, rice(Oryza sativa)
  misc_feature (71): n=a or t
ggaggtcttgctgagatcatggtgttcacgggatttcttcggtctatgccaagatttggtgattttttttnaaaaaaaattccttttggactccgaactct

SEQ ID NO: 7771 - DNA, 101 bp, rice(Oryza sativa)
  misc_feature (71): n=a or t
tacatttatatatagcattatcgatataaactttagagtaaactaacgaagtgactaatacatctaaccangtctatctaaaaccggtggaattcgttgaa

SEQ ID NO: 7772 - DNA, 101 bp, rice(Oryza sativa)
  misc_feature (71): n=c or g
gctatactattaaacttgctctttcctcgcagtggataaatgacgccgccgtggctgctgatgctgcctcnaggggggagctcatggccattggatcaaga

SEQ ID NO: 7773 - DNA, 101 bp, rice(Oryza sativa)
  misc_feature (71): n=c or g
gtttttttagggaaagtgtcggtattttcttgtgttcttgttgataaaaatctgttcaatctgttcttgtnttcttgtagtagtgttttttctaggatttg

SEQ ID NO: 7774 - DNA, 101 bp, rice(Oryza sativa)
  misc_feature (71): n=a or t
ggtttgtgtggcatatattactgctgaaaactccctcccaagtaggcctacaacaataaaagaaagaagantagtctatgcttgccgatgacaatggtttg

SEQ ID NO: 7775 - DNA, 101 bp, rice(Oryza sativa)
  misc_feature (71): n=a or t
atatatatacacacacacacacacactaatgtttcacaattttcgcagcaccatccttccgcacacgtcangggttgtctcaattcgcttgatctggttag

SEQ ID NO: 7776 - DNA, 101 bp, rice(Oryza sativa)
  misc_feature (71): n=a or t
tttgtctgtgcgattgttcatccatcgggacatttttaactgaagtagtagtgaattgaaccattcatgtngacaagggaattttcaaaaacctggattgt

SEQ ID NO: 7777 - DNA, 101 bp, rice(Oryza sativa)
  misc_feature (71): n=a or t
attcaatcgaagccattcaccattaggagtttggccttgaatggttacacttacatcattgatgctactangttcctcatctgaaccgaagaactacatta

SEQ ID NO: 7778 - DNA, 101 bp, rice(Oryza sativa)
  misc_feature (71): n=a or t
taagctaattatgcattcaggagatttgggccgggacgactccatccatcttcgagttgtcgatgtctgtnatttggatatgcttcaaaattactaagaga

SEQ ID NO: 7779 - DNA, 101 bp, rice(Oryza sativa)
  misc_feature (71): n=c or g
attttacccgtagcaaagcacgggcatattgctagtaagcataaataaatacatatcaaatcagcaataancataataactacgtatcaaatgcaatcatc

SEQ ID NO: 7780 - DNA, 101 bp, rice(Oryza sativa)
  misc_feature (71): n=a or t
gctcattcgctgaaccagccgactgggaagaaagcgaccaatttgtactacttctgctgcaaatttttttnaaaaaacaagagattattaattttgatatt

SEQ ID NO: 7781 - DNA, 101 bp, rice(Oryza sativa)
  misc_feature (71): n=c or g
ggctgggtggaggacaaatcagcagcagcggcatagtagtaggagtaggtgcgtttcgctcgctgtttttnggagcaagttgcgggcgggcgcggcgccgt

SEQ ID NO: 7782 - DNA, 101 bp, rice(Oryza sativa)
  misc_feature (71): n=a or t
gaaaaaaaaattaggagctaaacaaggcctaatgtgcaaagctacagatggatcatggtcatattcagctngctttatgtcaggtggtcagatgcagtggt

SEQ ID NO: 7783 - DNA, 101 bp, rice(Oryza sativa)
  misc_feature (71): n=c or g
agtttatcaaataaaagcatgttgtgcccatgcagatcgatgcacaggttgatgactactacattcgtttnatattataagtcgttttgagtttttttaag

SEQ ID NO: 7784 - DNA, 101 bp, rice(Oryza sativa)
  misc_feature (71): n=a or t
ttagagaaaagttagggtttcgagtttggtcaagatttttgtaaatgctattgttgcactttatagatacngagaggtaataaagttttaatctactttga

SEQ ID NO: 7785 - DNA, 101 bp, rice(Oryza sativa)
  misc_feature (71): n=c or g
cgcccacacgactgccatctcagtggcaagattaacatttgcagaccgcacttggggctaaaaaacaacgngcatacaggcttacaaacacaattagcaag

SEQ ID NO: 7786 - DNA, 101 bp, rice(Oryza sativa)
  misc_feature (71): n=a or t
gccatcagcctattgatcatgttgggaaagaaaatgcacacacagttgcttattagtcgcgcgttccctgnacagaccaatcaggaagagagtcttgttgt

SEQ ID NO: 7787 - DNA, 101 bp, rice(Oryza sativa)
  misc_feature (71): n=c or g
aaagatcagatcttataggtgatttatttcacctaatacatacaaagccacacgtaaactaaactgtgaanaaacactcagcagtgacggtgagcagcggc

SEQ ID NO: 7788 - DNA, 101 bp, rice(Oryza sativa)
  misc_feature (71): n=c or g
tctgatagagtaatcaccaatcacattattcctattttttttccccacagggtttttcgaaggaattaaanaacaagttgatctcaagatggactcgatca

SEQ ID NO: 7789 - DNA, 101 bp, rice(Oryza sativa)
  misc_feature (71): n=c or g
tacatgatttacttgagagtttgatgacgatgtagaataatattagtatctttcggtcaaagttaaattgnttcaagtttgattaagtttgtagagaaaaa

SEQ ID NO: 7790 - DNA, 101 bp, rice(Oryza sativa)
  misc_feature (71): n=a or t
ctggttggcttagttattgtgattcgatcctaaacctaatctcctaaacaatatgtttcgtgcaaaaaaanttctttataaaaatatttctaaagcaatct

SEQ ID NO: 7791 - DNA, 101 bp, rice(Oryza sativa)
  misc_feature (71): n=a or t
agtttgatttcttttttgctaatcagccatttataatttgtataagccaaatgtgaagagctttttttttnaaaaaaaaacatagccacttatttacgaaa

SEQ ID NO: 7792 - DNA, 101 bp, rice(Oryza sativa)
  misc_feature (71): n=a or t
gtagtagtgagaggtcaaaagaaagtcagcggcaaaagggtcactcttgacctcctctagtgacggtgtgntgagatggcagtggcttggaggtagcccaa

SEQ ID NO: 7793 - DNA, 101 bp, rice(Oryza sativa)
  misc_feature (71): n=a or t
gagatgcggcgaacgaacaaaggcattttggtctcaaagccttgcacttttggagaaaagatacgagtaancaagtctgatcgaattgggtttgtagtttg

SEQ ID NO: 7794 - DNA, 101 bp, rice(Oryza sativa)
  misc_feature (71): n=a or t
acttgtgaggtgacagtataaattgatatgatctattggattagaaaaaatgaacgacctagattgattcnactacgagcacagaccagtataaagaaaac

SEQ ID NO: 7795 - DNA, 101 bp, rice(Oryza sativa)
  misc_feature (71): n=a or t
ccaaataaatttatttttatcaattccacacacataaaagaaattagaatattactattttatcaaacaanaatataactatctcttattttatctgcttt

SEQ ID NO: 7796 - DNA, 101 bp, rice(Oryza sativa)
  misc_feature (71): n=c or g
tcatttctggtaaaaaggaagccagcttgtttttgagaaacgttcaggggtattccggctagctacctgtntaggttagatgacctggtttcgaagtctta

SEQ ID NO: 7797 - DNA, 101 bp, rice(Oryza sativa)
  misc_feature (71): n=a or t
tgttacccgagtgcctaaacagtatgattttcgcaatgactttctacatatgaatttactaaagaaactantttatatctttttttaactttataataggt

SEQ ID NO: 7798 - DNA, 101 bp, rice(Oryza sativa)
  misc_feature (71): n=t or c
atcttattgatctttccatgctgtatacaattaaccagacatcgatgagtgtgggcaccgcgaaacttacnagtgctatggagagtgcattaatttccctg

SEQ ID NO: 7799 - DNA, 101 bp, rice(Oryza sativa)
  misc_feature (71): n=t or c
aagaatcggagcaaaccaacaaaaattggaaccgccaaaatccaatccggtcaagaatccaataagaacangacaacacagacgttgaggcaaggctgggc

SEQ ID NO: 7800 - DNA, 101 bp, rice(Oryza sativa)
  misc_feature (71): n=t or c
ttcgctttggttgctttgctttgcttcgctgtttgggtttgggctgcactactgtgccatgcaaattactncgagattctttacaaggggcttaatctcgc

SEQ ID NO: 7801 - DNA, 101 bp, rice(Oryza sativa)
  misc_feature (71): n=t or c
ttgtattacttgttacttcttggctagaaacttggaatctgtgccactgtgccataccattcaagtaatgnatagtttagtcctttctaatgtgcctcatt

SEQ ID NO: 7802 - DNA, 101 bp, rice(Oryza sativa)
  misc_feature (71): n=a or g
aagcaggaagtacatcaaagccaccatgaaactatgctgctatttgtacccgcattcaaattaaggcatcnaacaagaacaagggactttcctagattagt

SEQ ID NO: 7803 - DNA, 101 bp, rice(Oryza sativa)
  misc_feature (71): n=t or c
aagatacaggggatgccgctcatgatgcataggaatggaatagtcatggaggttagcaaagtacctcatcnagttttcatcaaaaccccaaagagtggcaa

SEQ ID NO: 7804 - DNA, 101 bp, rice(Oryza sativa)
  misc_feature (71): n=a or g
tccactccaatccaaagctgttcttagcttcactcttcagtgttccttccttctgtgagttcacttatatngtacagctgaacagagactgatagaagctt

SEQ ID NO: 7805 - DNA, 101 bp, rice(Oryza sativa)
  misc_feature (71): n=a or g
agacataagtgcatgtcctgccaacctgaagtggtgttaatgaaatttgcgggcgaaaaaaaaaggtacancagcataacatatcacatttcacatgctgt

SEQ ID NO: 7806 - DNA, 101 bp, rice(Oryza sativa)
  misc_feature (71): n=t or c
tagaattaataaacgtttgtcacaccatctctttgatcttcagatcgtcaaatcggtcactgaaaacttanaatttcgacgcagctggtgagcgaaagtga

SEQ ID NO: 7807 - DNA, 101 bp, rice(Oryza sativa)
  misc_feature (71): n=t or c
tacctcctggaattttcgccttcttgggatccaatccgcgaggagggaaagaaggcgggtttagatcgaantgggacggagggaggaggaggaggaggaac

SEQ ID NO: 7808 - DNA, 101 bp, rice(Oryza sativa)
  misc_feature (71): n=t or c
cgatggcaataatgataaggacaatgacgcgacagcaaaacgaggaggaaggcaaggacatggccgagaanaggtgcgctcagtgggacaaggacaagtag

SEQ ID NO: 7809 - DNA, 101 bp, rice(Oryza sativa)
  misc_feature (71): n=a or g
tttgtctgacagcaacttttcaaattgctcagctccaaacttccaatcagctgcactgcacagatgaaganagaaagatcaatgcatggaacagacaacca

SEQ ID NO: 7810 - DNA, 101 bp, rice(Oryza sativa)
  misc_feature (71): n=t or c
tcggctcagatcaacagtaatgaatgaaatcagacctttcttcacagacttttggtatgaggatcctacgncagatgtgcttcggttagaagatgaaaggt

SEQ ID NO: 7811 - DNA, 101 bp, rice(Oryza sativa)
  misc_feature (71): n=t or g
ttttcactgcatagtagctgatttatgctagatttatgagcgcgcagctgttcttgagttttggccctctngttcagctattcattcagaagctgtcaccg

SEQ ID NO: 7812 - DNA, 101 bp, rice(Oryza sativa)
  misc_feature (71): n=a or g
gggggggggggggggggatatcattacttaatgtgttaataactgtgaaccgtgtgcatggcaggtgtcangtggttaaggaatctgaagtagggttgata

SEQ ID NO: 7813 - DNA, 101 bp, rice(Oryza sativa)
  misc_feature (71): n=a or g
tcaatctggcgccattgcccatagaaatcggccgcccaatacaacagtaaccgaaacaacaacgaaggggnataaactccagaagcatctcattccttcat

SEQ ID NO: 7814 - DNA, 101 bp, rice(Oryza sativa)
  misc_feature (71): n=a or g
agctgcagttgatagcatttctgagttaataaaagtcacttttcgtaccagcatgggatggcttattagcntgcatgggcaagagctagaagcggcaatac

SEQ ID NO: 7815 - DNA, 101 bp, rice(Oryza sativa)
  misc_feature (71): n=t or g
ctgaagtctgaagtagtcttacttcttccaagcaatctgaagtctgaaccttagaatggatcagaaggatnagctgcagatgaaggagaatacattccagg

SEQ ID NO: 7816 - DNA, 101 bp, rice(Oryza sativa)
  misc_feature (71): n=t or g
tagaagatttgtggaagttgatttttaatccagtggacatggcataagattgcaggatgcctttaagatanaaaacttctctttgacatgccttcataatg

SEQ ID NO: 7817 - DNA, 101 bp, rice(Oryza sativa)
  misc_feature (71): n=a or g
gttgcaatgggaaaataaacattacaatattaagcgatgcttgctttactggcttcgcctcctaccagctnctttacccaaaggctacctttcggtgcaag

SEQ ID NO: 7818 - DNA, 101 bp, rice(Oryza sativa)
  misc_feature (71): n=t or c
ggtggtggtgtccgctgccccccgcaataaataagcctacctccatgttcccacccccctctctctctctnctccgtctcgcctcgtcacctcacctcggc

SEQ ID NO: 7819 - DNA, 101 bp, rice(Oryza sativa)
  misc_feature (71): n=t or c
gatcgagcgatttgcttctcctcctcttgttccatgacgagacgatgttgttgaacatcctggattgtgtncgatcactctctgaacaagctaccttcgtc

SEQ ID NO: 7820 - DNA, 101 bp, rice(Oryza sativa)
  misc_feature (71): n=t or g
attaggctagatattttcccaactacgaccagaggctgaagctttgcttttttgtttgcagataacagtanatggtgaagttgccactgatccagatatga

SEQ ID NO: 7821 - DNA, 101 bp, rice(Oryza sativa)
  misc_feature (71): n=a or g
ttgtctgcatatggggttccattcccttcttcatcactagcttgcattgtcggttctgacctctggctttncaagaaacaatcatctaggtcctctagctg

SEQ ID NO: 7822 - DNA, 101 bp, rice(Oryza sativa)
  misc_feature (71): n=a or g
tatttctgaattaactttttgctatttgttttccatatagcagtgcaaacaattcaagtccctccttgtcnacatctaccaataggagacgccaaaaaagt

SEQ ID NO: 7823 - DNA, 101 bp, rice(Oryza sativa)
  misc_feature (71): n=a or c
gcctgcaggacttccctataaaatgcacacacacgcaagttgttgctcggggcatcatcgatcgtacaatntcctgtcccggtccggccggcttagctgct

SEQ ID NO: 7824 - DNA, 101 bp, rice(Oryza sativa)
  misc_feature (71): n=a or c
tctgtcactggtgtgtaagtagagtgacagtgttgatgttcttccttgagataaacggcgatatccttttntcacttcctgagagagcacggcacgcttta

SEQ ID NO: 7825 - DNA, 101 bp, rice(Oryza sativa)
  misc_feature (71): n=t or c
caaattccattttattcgtcagtgtgttgaggaagaaaaggttcagattgatcacattggcacagatggtnagctagctgatttacccaccaagccacttg

SEQ ID NO: 7826 - DNA, 101 bp, rice(Oryza sativa)
  misc_feature (71): n=t or g
ccaagaaaattgaataaacgcatatcagcaagatgaaccatcacttacagacaacatgaatgtctccagtnaaggagaagcttcaaaaaaggaaatcagaa

SEQ ID NO: 7827 - DNA, 101 bp, rice(Oryza sativa)
  misc_feature (71): n=a or g
tgtgaatttgttgagtagatcattgggtgagtataacatcaatgagcatggctttcataaacgaagcactnggccagaggagtcagattctggtgaaaagg

SEQ ID NO: 7828 - DNA, 101 bp, rice(Oryza sativa)
  misc_feature (71): n=t or c
ggtgcgggttttcctcttcgaatgcctataaagattcggtgcttgactttttagtctttggccaccaatcnaatttgattcccaaaagctcgccttttgtc

SEQ ID NO: 7829 - DNA, 101 bp, rice(Oryza sativa)
  misc_feature (71): n=a or g
gcatgattatagtgactattttgggatctttcattctttgtgaggttgttaccttgggaaggtatgtatgnttactccaaaattaattccactggtttctg

SEQ ID NO: 7830 - DNA, 101 bp, rice(Oryza sativa)
  misc_feature (71): n=a or g
ctgataaggcttccataaacaccaccatttgagatggtaaaggtccctcctgccatattgttgatggactntgccccctcagttgccttctttgcaaggtt

SEQ ID NO: 7831 - DNA, 101 bp, rice(Oryza sativa)
  misc_feature (71): n=t or c
taccaggaataaaattaattagaattactgagctaatatcgaaacaaaagaggggtgtcatcggaacctgnaggacgatggggccatggaggtaggaaagc

SEQ ID NO: 7832 - DNA, 101 bp, rice(Oryza sativa)
  misc_feature (71): n=a or c
gtatactcttctattattcttggttatacaattccgctctcagactcagtatcacacagtttttactgcanaaaatcttggataatacagaggttaacgta

SEQ ID NO: 7833 - DNA, 101 bp, rice(Oryza sativa)
  misc_feature (71): n=t or c
ctcgccggagcttggtcctgctccgtcgctattcactggtggcattcttgtctccggccaagaacttgccncagtgaagaagaagactcctctcctgcaac

SEQ ID NO: 7834 - DNA, 101 bp, rice(Oryza sativa)
  misc_feature (71): n=a or c
caaagcaatcgtctcggtccagcaaaacagaccagcagttcacgattcctgcatggagagctgctccagcnctgcgacagaaaggagcacaaacacacaca

SEQ ID NO: 7835 - DNA, 101 bp, rice(Oryza sativa)
  misc_feature (71): n=t or c
ttgacaatcccctccccttggaatttggaaagtcgctggaaaacgagcacggagttcctccaaatcctccnaggtggcatcctctgctgcagtaccagacc

SEQ ID NO: 7836 - DNA, 101 bp, rice(Oryza sativa)
  misc_feature (71): n=a or g
acacattcatgctcatgttttaagcacataacaaaagatattcaaatacgctcacacggactaaaaagganaactgattgttgtgatgaataaaaatatga

SEQ ID NO: 7837 - DNA, 101 bp, rice(Oryza sativa)
  misc_feature (71): n=t or c
acaagtcaactgagcagccattggagcctgaaaatgatgcatctgtcgaggatgagaagccaccggaaatngaaagtgatgatgtgcatgataaaccatca

SEQ ID NO: 7838 - DNA, 101 bp, rice(Oryza sativa)
  misc_feature (71): n=t or c
gccttttcagtaatatcagttactatctctatcccctcgtgtgttgcttgtaggtttgtacaccctactgngatgagtgagcaaagaataagagaatatat

SEQ ID NO: 7839 - DNA, 101 bp, rice(Oryza sativa)
  misc_feature (71): n=a or g
gaagaatctgcaagtcaggtcggaaaatgtgcctctcttgtgcatctggagtttgcaacagcttcaagtcntgagagaacggcagttctttaagaactggg

SEQ ID NO: 7840 - DNA, 101 bp, rice(Oryza sativa)
  misc_feature (71): n=a or c
gtggcaaagtgtggcaaccaaccaaacaacccctaagccatgcttcttctcctagctatgctaacggttantggctactgttactactgcttgctatttta

SEQ ID NO: 7841 - DNA, 101 bp, rice(Oryza sativa)
  misc_feature (71): n=a or c
gctcctagtttgttcatgatcttgtagtcgctgaatccagcattagtgaagatctcacgccactcttgttnatccctttcccgtccagaggtcatcaccat

SEQ ID NO: 7842 - DNA, 101 bp, rice(Oryza sativa)
  misc_feature (71): n=t or c
tacaaataataaacaaacaaaataaaatgcaaaatttctgaagagcgagagccaagaggccaacagtgctntgcactccgcagtgttggactgcacaaagc

SEQ ID NO: 7843 - DNA, 101 bp, rice(Oryza sativa)
  misc_feature (71): n=t or c
ggatatccttgggctcttcaatgagcagatgaaggatacgaacacctctaggtcgccatcaacaagttcancaaagtggttcaaggtaattcggagcatta

SEQ ID NO: 7844 - DNA, 101 bp, rice(Oryza sativa)
  misc_feature (71): n=t or c
cctacctcctcaccttcttctttctccattctagctatcttagctagctagatatctctctgaaatctctncttgttgggttgagatgggtaggagtggtg

SEQ ID NO: 7845 - DNA, 101 bp, rice(Oryza sativa)
  misc_feature (71): n=a or g
gtcggttgtgggttacccacaaccaccggtgagacaaatcgtgcgggcttttggataaaccgcttaggctncgcccatggcgtggagtttaccccttccgt

SEQ ID NO: 7846 - DNA, 101 bp, rice(Oryza sativa)
  misc_feature (71): n=t or g
agtgtgctgctgctcctgatgcgagttggtttgatgctgatgtgtggagaaaatggatgtctgtttttgcngattttcctttatctccagacggaaagttg

SEQ ID NO: 7847 - DNA, 101 bp, rice(Oryza sativa)
  misc_feature (71): n=t or c
cccgcgtgcccgacccgaacaagggaagaagagaagaggagagtagtggcaaactaggctagtactcctgntgctcgccttgttgtttgcgttattgtttg

SEQ ID NO: 7848 - DNA, 101 bp, rice(Oryza sativa)
  misc_feature (71): n=a or g
tggttccatgtaaaaattcctgccaagttatcaggtatctataaaataggtgacgtatctcatctaatccnaatctgatttaggccttgggccttgtgatt

SEQ ID NO: 7849 - DNA, 101 bp, rice(Oryza sativa)
  misc_feature (71): n=t or c
atagtaggataggcacaaacagaagtttcttcttttcaagactgcacgaacaaaaagaagccgtcccgagntgtgttgtgccgtggccgttgccgggacgg

SEQ ID NO: 7850 - DNA, 101 bp, rice(Oryza sativa)
  misc_feature (71): n=a or g
atcaatcatctttgcagggagggtctgattgccattaatctggcatgcaacttcatggtacaaaaaatatngcctctaaaagatcgtgcccatcctgcctg

SEQ ID NO: 7851 - DNA, 101 bp, rice(Oryza sativa)
  misc_feature (71): n=t or g
agttattccaagctgcttgcctgcatacaaattctgaaagtcacttattattgtgcagatagtttccttgnaggtgattagactgcttgcccaaaaaacag

SEQ ID NO: 7852 - DNA, 101 bp, rice(Oryza sativa)
  misc_feature (71): n=t or c
acgatcaatcttttttctttatgacttttgcctaattggtcgcaggtgtggtggttctagggactggatgnaagcttttatagattgtagactcattctat

SEQ ID NO: 7853 - DNA, 101 bp, rice(Oryza sativa)
  misc_feature (71): n=t or c
aggccaatggatttgccgccacaagcttggtggcaactagatctaaccgtcacgagatcggcagtaacgangacgggtgctagcaagacttcatcatggac

SEQ ID NO: 7854 - DNA, 101 bp, rice(Oryza sativa)
  misc_feature (71): n=a or c
gagcaaaatcatcatcagcagaacaatgcagaaatcatatgggcgcatggaaattaccatttgcctactcncatcgtgtcaccagaacgcggcacattggc

SEQ ID NO: 7855 - DNA, 101 bp, rice(Oryza sativa)
  misc_feature (71): n=a or g
atgagagagctatttggttcatcaataatagaagggattgaagcctgacctttgttaataaaggcattctnagcctctttcctttccattgccatgtcttg

SEQ ID NO: 7856 - DNA, 101 bp, rice(Oryza sativa)
  misc_feature (71): n=t or c
atacctggagaatccagtgaggattttaccctaaaagtaccgagcactgtaagttcagtttcagttgcagntcttttccatcctctgtttacttatatata

SEQ ID NO: 7857 - DNA, 101 bp, rice(Oryza sativa)
  misc_feature (71): n=t or c
cacctaatcctcatctcgtataaataaattcatttacccccctcgggatccgagaaatttccctcctcttnccacttgtcaccgccgttcgccttcccaac

SEQ ID NO: 7858 - DNA, 101 bp, rice(Oryza sativa)
  misc_feature (71): n=a or g
actatgtacgggctgagattatgcatttggggccaggcatcttcatcatggcatatgcgtagtgggggatngccatgaatttggccatggctggtcatcca

SEQ ID NO: 7859 - DNA, 101 bp, rice(Oryza sativa)
  misc_feature (71): n=t or c
tcttcatgaaacttactttggtttgaaactaaaataaaacctgcttggaacttgtgttggtaaccatatantgtgcttgatcattttcctctccagaatat

SEQ ID NO: 7860 - DNA, 101 bp, rice(Oryza sativa)
  misc_feature (71): n=a or g
ctgacaaaacagaatgaaaatgctcattaattgatctgtatgtgagttacctgctataatttttgtcttcnagttcgatcctgcatataataagcaaaaaa

SEQ ID NO: 7861 - DNA, 101 bp, rice(Oryza sativa)
  misc_feature (71): n=a or c
cggcggaggaggaggaggaggagatcgaggtgaggagaggaggggaaagaaaattatggaggcgatgcggnagaggagagacggagctagctaggggtcgc

SEQ ID NO: 7862 - DNA, 101 bp, rice(Oryza sativa)
  misc_feature (71): n=t or c
gagaggcctagccacctggatggtttggctcgcgactcacgagcctaacgagctaactcaagcattcaaangaaccgagtcgagctggatttctagctcgt

SEQ ID NO: 7863 - DNA, 101 bp, rice(Oryza sativa)
  misc_feature (71): n=a or g
gcttgttctccattctgagattctcattacttcttactttcttactgatggtttgcagtttgcatatctgnagatgtgcccatatattgcttgatgatttt

SEQ ID NO: 7864 - DNA, 101 bp, rice(Oryza sativa)
  misc_feature (71): n=t or c
ggcagctgatggtcagcggctgacgaagacctccggtgtgcctctgagttggttgtgtgccaacttctccnagtgtctcaccgacgcggacgaggacacgg

SEQ ID NO: 7865 - DNA, 101 bp, rice(Oryza sativa)
  misc_feature (71): n=a or g
tcggctctagccgccaccatggctatagtggtctcccctctcttgccaaaccgcgtccctcctcactgctngggccagacctcaatgaggcgcgctagctc

SEQ ID NO: 7866 - DNA, 101 bp, rice(Oryza sativa)
  misc_feature (71): n=t or c
ctacttggagactaaggcaactcatggtatagaaggcacaccccgggaggggttcgggatcatcgaatcanagcatcaacacacccaccatagtctacgaa

SEQ ID NO: 7867 - DNA, 101 bp, rice(Oryza sativa)
  misc_feature (71): n=a or g
gctcttgttgataacaatacatggcgtttggtccctcgtcctcctggtgctaatatcgttacaggcaaatngattttcaagcataaatatcattccgatgg

SEQ ID NO: 7868 - DNA, 101 bp, rice(Oryza sativa)
  misc_feature (71): n=t or c
tcacagagctggaaacagctccgacctccgaaccgacccaatcacaaaccaaccagattcacccaaacgcngaaccaaacttcgcatccccgaatccccga

SEQ ID NO: 7869 - DNA, 101 bp, rice(Oryza sativa)
  misc_feature (71): n=t or c
gcgactctccacggcgctgaagagctaagccgccttctcttcccctcacgtccacccaagaggccatccanctctctctctctctctcttgaccctatctc

SEQ ID NO: 7870 - DNA, 101 bp, rice(Oryza sativa)
  misc_feature (71): n=t or c
gaatttaagtcacatgcattgtggatcaagtgtcttttggtattcctttgcccagtgggtagcccaggcgnagaaatttccaagacgcactatgagtgccc

SEQ ID NO: 7871 - DNA, 101 bp, rice(Oryza sativa)
  misc_feature (71): n=t or c
gatcgggatgggcaccccgcaggaccgtgcgcctacaccttatgagaatgataaggcgctgcacttcctgngacaccacctctgcgccacgctcaagaatg

SEQ ID NO: 7872 - DNA, 101 bp, rice(Oryza sativa)
  misc_feature (71): n=a or g
tctggtaataacaatcggtttaactcgcttccaagatcgtttaccttgtgtgtatgttaagttggcaatgntgtcagaagaatgcatcagaagttgccttc

SEQ ID NO: 7873 - DNA, 101 bp, rice(Oryza sativa)
  misc_feature (71): n=t or c
gatcaagctaattagttgtctgattaggaggcaaatcttcttattagttattgcaagtacatattacacanagaggaagatatagtgatggtgactagcta

SEQ ID NO: 7874 - DNA, 101 bp, rice(Oryza sativa)
  misc_feature (71): n=t or g
cgttgccgtttggtggctgtgtagtaggtgttgttggattgaacaacggctggtgcatcaggtcgatgcancagagcgatttgacaccagacatgccgacg

SEQ ID NO: 7875 - DNA, 101 bp, rice(Oryza sativa)
  misc_feature (71): n=t or c
tctgtaaaaagcagcattaagaccatctggcccaggggaagcatttttcctcatgcccttgatgatactcnaaatttcttcctcatctggaatctgccaat

SEQ ID NO: 7876 - DNA, 101 bp, rice(Oryza sativa)
  misc_feature (71): n=a or c
tttcccccattgcctcatactctctcccacactagtaataattctctcttaatgtaaggcatgtcacattnacttgtcctcccctcccagcaggcagagtg

SEQ ID NO: 7877 - DNA, 101 bp, rice(Oryza sativa)
  misc_feature (71): n=a or c
agagattacttcaacccccaaaaggaaaaacaaatcctcccaaaactcctgaaattcccacacccacgcanggaaagcagatgcctttcgaagccaaaaaa

SEQ ID NO: 7878 - DNA, 101 bp, rice(Oryza sativa)
  misc_feature (71): n=a or g
cctctcctctcctctctactttttcttggtggcctggccagcggatttgctggcatggaggtagggggctnccggactggctgcctggaagtcgggggtcg

SEQ ID NO: 7879 - DNA, 101 bp, rice(Oryza sativa)
  misc_feature (71): n=a or g
cctcacgcgaggtgattcgagaccctgggttgattgttgttatttgtgaccgctgatctggcttgttgtcngtatgtgtttgtgctcctctagatgatgca

SEQ ID NO: 7880 - DNA, 101 bp, rice(Oryza sativa)
  misc_feature (71): n=a or g
cgacaagatggcgcaacggaactgatggccatgtttaacgagctactccctccggttctatataataattnatgttttggataagattgatgtcaaacttt

SEQ ID NO: 7881 - DNA, 101 bp, rice(Oryza sativa)
  misc_feature (71): n=a or c
caaattaaattaacaaacaattttattcaaacacccaagggcactatgtcatcttcatcctcaacatactntatctcaatatcaccatcaccatcttgttc

SEQ ID NO: 7882 - DNA, 101 bp, rice(Oryza sativa)
  misc_feature (71): n=t or c
cacactttcccaaggctggtcaaggatttggcactcggtgccgctcagcctcgatcactcccagatccgangtgccggggagaacatcctcgatgatctct

SEQ ID NO: 7883 - DNA, 101 bp, rice(Oryza sativa)
  misc_feature (71): n=a or g
ttaagcaccactaaccagacgaagtaccggcatcgaggtggagtgagagatttccagatcggggcagactngaaccaggttctccctaggaacaacgcttg

SEQ ID NO: 7884 - DNA, 101 bp, rice(Oryza sativa)
  misc_feature (71): n=a or g
ggcctgctcaacacagactttcagcaccgtaggccaatatacgccctcgcgaaacacttttgaggcgaccnttcttgcagttggttctgtaaatattgata

SEQ ID NO: 7885 - DNA, 101 bp, rice(Oryza sativa)
  misc_feature (71): n=a or g
acggccttgccacctcgatcggtcctgaattttttccatgtcatcggggcttggtttggccttgaatgctncgctgggttcgccggaggggtagggtgaac

SEQ ID NO: 7886 - DNA, 101 bp, rice(Oryza sativa)
  misc_feature (71): n=a or g
tatttctattttattcctgtagaagcattggggattgtttgacttagagttttatatcacttctttcattngatatagctagtctacacatatttgctatg

SEQ ID NO: 7887 - DNA, 101 bp, rice(Oryza sativa)
  misc_feature (71): n=a or g
gaaggagccgaaaaactgcgagcgaccttacctttcatacctacctggattgatcctggtgatgaggactnccgccgtccttcctggtccccctcctcatc

SEQ ID NO: 7888 - DNA, 101 bp, rice(Oryza sativa)
  misc_feature (71): n=a or g
acacgcgcttggacacattgtaatactgcatccatctgagagcacccattcgacctaaagagttgttggtnctggttcgaaatgaagctttttagttgatt

SEQ ID NO: 7889 - DNA, 101 bp, rice(Oryza sativa)
  misc_feature (71): n=a or c
ccctcgatctcctccaagaaaccccttgaatgccgaatcaaatcgtgtggaatcaacgcggttttgagttnttattttacggcgaaccttaaccaatccac

SEQ ID NO: 7890 - DNA, 101 bp, rice(Oryza sativa)
  misc_feature (71): n=a or g
tctaatttatcaggaaagatagaatcttttacgcctttgctcaggttgaaagccgatcaggagtttgtctnggggcagagcagcaaaaagccttggataac

SEQ ID NO: 7891 - DNA, 101 bp, rice(Oryza sativa)
  misc_feature (71): n=a or g
gcgtgcgggtgcgctatccgtacgcaaaaatcatgatttttttgcagaccttgggtgcgtgcgggccgccntcggcacgtgaaaacctgttttcaccgcgc

SEQ ID NO: 7892 - DNA, 101 bp, rice(Oryza sativa)
  misc_feature (71): n=a or g
ccaagctccacatttcccatgaacactaatatttttcgccctaatcattatggatggcaaccctatatgantgcaccttcatcagagtttgtgccaggatc

SEQ ID NO: 7893 - DNA, 101 bp, rice(Oryza sativa)
  misc_feature (71): n=t or c
caatcattcgtcatcgatacccaagtatatatataggattaggatgcatctgggaattcgtcaattggttncaatttctctaaattccagtagcacgtagc

SEQ ID NO: 7894 - DNA, 101 bp, rice(Oryza sativa)
  misc_feature (71): n=t or c
tcaaggggctcaaggtgatggttctcaaggattacagggtgaggatcttaacctagatggcagtgcagcanagatacagtttaacaacttccaagatcgga

SEQ ID NO: 7895 - DNA, 101 bp, rice(Oryza sativa)
  misc_feature (71): n=t or c
tttttttaagcactaaaaggagtaatcagcatggcaaattcacaactaacataatcaattgacaaacaaancattcttcaagatcaggatgcacatcagtc

SEQ ID NO: 7896 - DNA, 101 bp, rice(Oryza sativa)
  misc_feature (71): n=a or c
ctaccatctgatctcccactacacataataaagttatggtacaaggtatataaattgaagttgtgcaatgntggactgattttcatttacacgctgaattt

SEQ ID NO: 7897 - DNA, 101 bp, rice(Oryza sativa)
  misc_feature (71): n=t or c
gcacttatgttttgggaaacaaggcgttcagattttggcgtgtcaatgtcacatcatgttgcaactgttgngctgatagttttatcttatgtgttcaggtc

SEQ ID NO: 7898 - DNA, 101 bp, rice(Oryza sativa)
  misc_feature (71): n=t or g
tgaagtagtaccaggtaactacatgtatatggcaccagagaggttatttttctctcggggattcatcacgncaaaggctgacgtctacagcttcggtcagc

SEQ ID NO: 7899 - DNA, 101 bp, rice(Oryza sativa)
  misc_feature (71): n=t or c
gctaagcatatccccattgaaggaggaagccataggcatgtgaagcccggctttctgctagatggatctcnagacctgctttgtaaaggtgcaatccatga

SEQ ID NO: 7900 - DNA, 101 bp, rice(Oryza sativa)
  misc_feature (71): n=a or g
tcacggaactccagggacgtgtttcaaaagctgaggctgcattgcgagataaggaggaagaaaacgaaatnctaaagcaacaattggatcaatatgagaag

SEQ ID NO: 7901 - DNA, 101 bp, rice(Oryza sativa)
  misc_feature (71): n=a or c
gtactaactggattaaaaaaaccttcaacattatgtacttaccccatggcagccttggaaaattatggggntagttccggacagcttctgttagcaccctc

SEQ ID NO: 7902 - DNA, 101 bp, rice(Oryza sativa)
  misc_feature (71): n=a or c
cacggctcatcggtggagccaaagccaagatgaggtctctgcggcagcgagcaccgcgccactgcagatgntgctgctgatcgagtgcatgcaggcaaggc

SEQ ID NO: 7903 - DNA, 101 bp, rice(Oryza sativa)
  misc_feature (71): n=a or g
atctcgttcttcaagatctctttgtatgctaacaagcaagccttcttacagagcttgccttcatatttcgntgcatcatggaccaaccttaggtactcaga

SEQ ID NO: 7904 - DNA, 101 bp, rice(Oryza sativa)
  misc_feature (71): n=a or g
gcacgcgcggcggtcagtttacaagcgccgtccaccgagagatcgagctccaagaatcggaattggtgggntgggtttaggaagctcgattcctcgccgcc

SEQ ID NO: 7905 - DNA, 101 bp, rice(Oryza sativa)
  misc_feature (71): n=a or c
ggtttcagatttaggcctaaacgcttggatggagtgacacaaaatagtggggttgtgctaactgcaaaaanatctagctacactaaagcaagtgacgctaa

SEQ ID NO: 7906 - DNA, 101 bp, rice(Oryza sativa)
  misc_feature (71): n=a or g
agactcgtcggcaaaaacaccaactaaggacaaaccctaactacaggaaacacctgacgacctaaaaacanatctaactatacaatactagtggaggggag

SEQ ID NO: 7907 - DNA, 101 bp, rice(Oryza sativa)
  misc_feature (71): n=t or c
gcggggaagcgaggtcggcacggattcgtcgtcgcgggagcaaacagcaacgagcaaacagtcgctgacangtggagcccacctgtcagggataataacat

SEQ ID NO: 7908 - DNA, 101 bp, rice(Oryza sativa)
  misc_feature (71): n=a or g
tcgtcagttcgtcacccaccgtcgcctcggggaaaccgcgccagtgagaaggcatcaagccgtcaagcacngccagctactagccatggtgacgacgcggg

SEQ ID NO: 7909 - DNA, 101 bp, rice(Oryza sativa)
  misc_feature (71): n=a or g
ccagagtggattagcatatttgacaatctcatacacctgcaactgtacatctcaggaatggagaagagtgncattaacatactcaaaggaatctccactct

SEQ ID NO: 7910 - DNA, 101 bp, rice(Oryza sativa)
  misc_feature (71): n=a or g
ttggtaaagaaataattccaattggaattcctctggtttaggattaaggacaatattggaggatttcttgnaccaataattcataaaagtaaaacgggttt

SEQ ID NO: 7911 - DNA, 101 bp, rice(Oryza sativa)
  misc_feature (71): n=t or c
aaccggtgtggctgattagcacactgtcccgggaagaatgtgtaaggctcattgataggatcagggtgctntgacccgatatcgtcaacttggttttgttc

SEQ ID NO: 7912 - DNA, 101 bp, rice(Oryza sativa)
  misc_feature (71): n=t or c
tccacaggctatcatgcaggatcgggctgctggagttgtaggcaatgcacaagtggacattagggtgatgnagcagcttaagtggcttgaaaagatggtct

SEQ ID NO: 7913 - DNA, 101 bp, rice(Oryza sativa)
  misc_feature (71): n=a or c
tctcttctaactcccttaatgtgcagcttaggtggttcaaggacttcatgaagtccaccttcagcactgangaaggcaattcccctgatcaatttcgttca

SEQ ID NO: 7914 - DNA, 101 bp, rice(Oryza sativa)
  misc_feature (71): n=a or g
ctttcctcccctgggtcaatcatttgggttcgggaacctcctgaagaccgccttggggtataccacattcngatggatcgtagtgggtcattccacatgta

SEQ ID NO: 7915 - DNA, 101 bp, rice(Oryza sativa)
  misc_feature (71): n=t or c
atttacaggatgcagcgtaatagaggccagtttacatcatcaaaatcgaaggctgaagaagcaacatccgncataactagttcggaaggttcgccaaattg

SEQ ID NO: 7916 - DNA, 101 bp, rice(Oryza sativa)
  misc_feature (71): n=t or c
tcgtgaggtgtggttcaacttgtataggaagagttgttgcacgttcatgtcaagagtttgtagggagctcngagtaccccgtggggatcccgaggaatcgg

SEQ ID NO: 7917 - DNA, 101 bp, rice(Oryza sativa)
  misc_feature (71): n=a or g
tttgtccatgcagatggggagttcgttcaagagtgccgtcttctcagacgacgtcgcggacaatctaaganaatgggccgacgaagctcggcggcgcacag

SEQ ID NO: 7918 - DNA, 101 bp, rice(Oryza sativa)
  misc_feature (71): n=a or g
tgcaaagaaatagtgaattgtgtacaacagtaagaagcctgaagatcgcatcaagaaccgacatggacctncctgtaggatgttgcaaaaagatgagggtg

SEQ ID NO: 7919 - DNA, 101 bp, rice(Oryza sativa)
  misc_feature (71): n=t or c
gtcttcattcttggcgccctgatgaaacactgcgatgacttccgaatccttaacgtgtgggatggtgttgngcttctctgtatacctcctgatgtagtcca

SEQ ID NO: 7920 - DNA, 101 bp, rice(Oryza sativa)
  misc_feature (71): n=a or c
tggacaatccataacatggaaagcttgtgtagataaacaagaccctctgcaacacctttgattatattcantcgctgaggccagtctaacaatgattttct

SEQ ID NO: 7921 - DNA, 101 bp, rice(Oryza sativa)
  misc_feature (71): n=a or g
tgcagctctcgagctaaagcttcatcaacaactagttgcgcttcataacttgcaactcctgatggtttccnttcacccaattcacatccatggctataact

SEQ ID NO: 7922 - DNA, 101 bp, rice(Oryza sativa)
  misc_feature (71): n=a or g
tgatgcaaatgaaaagaagagacaaccaactgcattaagcagttaagcactaatactaggctgcacaatancaacctgtttcaatgctttaaatgaaaaat

SEQ ID NO: 7923 - DNA, 101 bp, rice(Oryza sativa)
  misc_feature (71): n=a or g
tggttccgaagatagcaccgatgcatctgttccagacatcagcaagaatgagaagcagcaattccagcctntttctgcagctgtgaagccagtatctgagt

SEQ ID NO: 7924 - DNA, 101 bp, rice(Oryza sativa)
  misc_feature (71): n=a or g
gggttgggtccaaaaaggaatattcctgctatatgcggattggttccgcctgtgggaaaagtggtggaccnctctgtcccacatccggagtagcgcgtatc

SEQ ID NO: 7925 - DNA, 101 bp, rice(Oryza sativa)
  misc_feature (71): n=t or c
ttaagacttcccatgcatctgactaaaatcatacctgcctgacaaaatcccaaactgtaagggaacaattncttatcaaatgctggatattctttagcatg

SEQ ID NO: 7926 - DNA, 101 bp, rice(Oryza sativa)
  misc_feature (71): n=a or g
gttcctgaggcaaatatggacgtggttaggactaattcctgcaacgaggaagaattttcagtcatatctcngagctggttatagctgtatcatagtgcctg

SEQ ID NO: 7927 - DNA, 101 bp, rice(Oryza sativa)
  misc_feature (71): n=t or g
tcctttgaagcggaagttggagcagtgaaaaatggtcctggtggattaatatttactagcgatgaaattgncaaactaaagttgtggaaatggacagctga

SEQ ID NO: 7928 - DNA, 101 bp, rice(Oryza sativa)
  misc_feature (71): n=a or c
aggaagcaggcactaccatctgaacatcccctaacaagacggacaattcgagatgctacctccaatatggnagtattggtaggtgcacaagtaagtgtctt

SEQ ID NO: 7929 - DNA, 101 bp, rice(Oryza sativa)
  misc_feature (71): n=t or c
gcctcaagcagccgctgcggactcgtcgatgtgctcaatgaagatatggtgaccgagattctccttcgccncccaccggaggacccagccctgttcgcccg

SEQ ID NO: 7930 - DNA, 101 bp, rice(Oryza sativa)
  misc_feature (71): n=a or g
agaagctgcggggccgtgttgcggacaccccttaaatccgcaattgtggcacaaccatggtgcagtgttgntggcggaatgcagccacgagaccttcgcca

SEQ ID NO: 7931 - DNA, 101 bp, rice(Oryza sativa)
  misc_feature (71): n=a or g
ttcctgcctagctttagtaaaacggagacataccaaatctgtgaacgcttgccagctaagcccaaccaacntggaccttatggactgtaaccaaaatgcag

SEQ ID NO: 7932 - DNA, 101 bp, rice(Oryza sativa)
  misc_feature (71): n=a or g
ccggatcgatcgggagatgacgacggcatttctcgaaagcggcaaagatggtggtcaagatgggcttagcncgctcccagacgacgtcattgtcggaggcc

SEQ ID NO: 7933 - DNA, 101 bp, rice(Oryza sativa)
  misc_feature (71): n=a or g
caatgatcatactagtgcttctgtccataaaatcatagacatcgccgttatgccaagggatggattcatcnattagccttaagttgggctggaatgtgtgg

SEQ ID NO: 7934 - DNA, 101 bp, rice(Oryza sativa)
  misc_feature (71): n=t or c
actggatccaaagctccacatggtggtcagctcttacttccttgtgttacagagtggttatcaaaggatanagatcagttaaaggttacagtggatgatga

SEQ ID NO: 7935 - DNA, 101 bp, rice(Oryza sativa)
  misc_feature (71): n=t or g
agacagaggaatgaaatgggaatacttcgagaacttatccacaaccacaaaaattgagttgaatttcccanatttaggaagaccctctataaaatccatag

SEQ ID NO: 7936 - DNA, 101 bp, rice(Oryza sativa)
  misc_feature (71): n=a or c
actacgagttcttcagattttgctggaatgaggggatgagattgccctcaaaacaaaattgcccaggatgnagtgaaatcgacgaagaccacaatggcagc

SEQ ID NO: 7937 - DNA, 101 bp, rice(Oryza sativa)
  misc_feature (71): n=t or c
agctgccatgttcttaatcctgtcactggagatgtctacaacttgccaaagagtccagcagaggagcacangtaccatgtcaatctgcgcaagcctttcac

SEQ ID NO: 7938 - DNA, 101 bp, rice(Oryza sativa)
  misc_feature (71): n=t or c
actctttctgcaaaagtgatattgttcaacttgataaatgccctggagttgtagaggcttggtgctgtagnctggagtttgtgcaacgagaatagctgtga

SEQ ID NO: 7939 - DNA, 101 bp, rice(Oryza sativa)
  misc_feature (71): n=a or g
caaattcgtgtgagatttgggcgactggatttgaatactcgaatacatccatagcagaggggatgtaaatntgaaagaaaatgcacttttcattcctaagt

SEQ ID NO: 7940 - DNA, 101 bp, rice(Oryza sativa)
  misc_feature (71): n=a or g
aattttcggaaatacgggaagtttcgaaccgaaatttcagggctgacggaaccaagctgccgcctgttcanttcctatttcagcgccaccttccctcccat

SEQ ID NO: 7941 - DNA, 101 bp, rice(Oryza sativa)
  misc_feature (71): n=a or g
gatctgtacgccggtggctgccatctgcagccttcgtctaccgaggactacggggagaacctgtatttcanctccgatcaaagctcgacggcggccgacgc

SEQ ID NO: 7942 - DNA, 101 bp, rice(Oryza sativa)
  misc_feature (71): n=t or c
acttagaaacctcgagatattgccaaggtacattgcagcggaaaatcacgagcacaccatctcagagttgngtcccttagttagtttgaaggaactcagta

SEQ ID NO: 7943 - DNA, 101 bp, rice(Oryza sativa)
  misc_feature (71): n=a or c
ctgcatgcatggtaactagcaggaggaagaggataatatgtcttgggggtgcttgttgctgctgctgctgntgatgattgtctcggcatcatcatctgcta

SEQ ID NO: 7944 - DNA, 101 bp, rice(Oryza sativa)
  misc_feature (71): n=a or g
gatgactgtaagtttcaggaaggtgatgtgaacagccttgagcttcggcttggcatatcttccgacaatgnccagatcagtggtggtggtgctgctagtcc

SEQ ID NO: 7945 - DNA, 101 bp, rice(Oryza sativa)
  misc_feature (71): n=t or c
ggcaagcaattctggtgggaaaaggcccttccagcccttgtaccagttcatgatttcattgaaatcagganttggtgaacacagccaatggtacaggacct

SEQ ID NO: 7946 - DNA, 101 bp, rice(Oryza sativa)
  misc_feature (71): n=a or c
cagaataggcccatggaaaacactcaaaccttctctctggcggctggcggcggctctgcttaaaccccgcngcccgcgcgccttcttccccaactccggcg

SEQ ID NO: 7947 - DNA, 101 bp, rice(Oryza sativa)
  misc_feature (71): n=t or c
gccggttttggtatacccattgaactggaggtctcaatccttgatgattccttagaacttgattcaacctntgagttagtcatagtaaatgctatgttgat

SEQ ID NO: 7948 - DNA, 101 bp, rice(Oryza sativa)
  misc_feature (71): n=t or c
ctcctaaactcgtccttcaccttctgcattgattgtggattttgcagtaattcaacaattgcccactctantgcagttgagcccgagtcagttccagcgac

SEQ ID NO: 7949 - DNA, 101 bp, rice(Oryza sativa)
  misc_feature (71): n=t or c
gttgaggcttttcgtccttcggggttttactttgacctccttgtgggttcggtccgttcttgatctacccnatggagcaatgctccatccttggtctcctt

SEQ ID NO: 7950 - DNA, 101 bp, rice(Oryza sativa)
  misc_feature (71): n=a or c
cttacagcctcatcaaacagcttatctgtctcctgaacttgccccttcttagacaaggcatatatcaatgncgtataggtcactactgtcgcacggacccc

SEQ ID NO: 7951 - DNA, 101 bp, rice(Oryza sativa)
  misc_feature (71): n=t or c
tattcctgagatggatacatggttcaaggaaaagaagttgatgcaacaacttgtacagcaacaccttcacngcgctcagcagcaaatgaaacactttgccg

SEQ ID NO: 7952 - DNA, 101 bp, rice(Oryza sativa)
  misc_feature (71): n=a or c
agcatttatttcgtgcagtaccaatttcttgaatttttcttgttgggcagagaagctcagatcaactcttntggtgatttttatgttcgtacatgactgct

SEQ ID NO: 7953 - DNA, 101 bp, rice(Oryza sativa)
  misc_feature (71): n=a or g
caagacgatgtcaatgaaggaccaatctgtatgcagcagttgccagatggtttttggttttactagaaagnagcacaactgttacaactgtggttccatgt

SEQ ID NO: 7954 - DNA, 101 bp, rice(Oryza sativa)
  misc_feature (71): n=t or g
tcatctaaaggattcagtgccaagttgttgttcaagatgtgcagaactccccgtgtttttttcttggattntttactgccggcaacgctggctgtagctcc

SEQ ID NO: 7955 - DNA, 101 bp, rice(Oryza sativa)
  misc_feature (71): n=t or c
cacagtatcatcaaccagattttctctcgcagcccgtgctttaagcctgattttcttagccttcagcatangcattgtagatgctgttgcaagttgatggt

SEQ ID NO: 7956 - DNA, 101 bp, rice(Oryza sativa)
  misc_feature (71): n=a or g
tataataaaaataaataaatctttcctgcgcaggtgctaaaaggactgatgtacttacatcatgagaagcncatcatacaccgagatctgaagccgtcaaa

SEQ ID NO: 7957 - DNA, 101 bp, rice(Oryza sativa)
  misc_feature (71): n=a or c
ctaactccagcaacagtgcaagaggaagaagtaccaccaaggctcatgacattattaggtggcataaaagnggaattagcttgatttgactgcaatatttg

SEQ ID NO: 7958 - DNA, 101 bp, rice(Oryza sativa)
  misc_feature (71): n=a or g
agcctgtgctgcagtcattcttctacgtggatccttgcaaagcaagcgcttaacaaaatccattgcttccngagtaagagaaggccaaggtgcctcattat

SEQ ID NO: 7959 - DNA, 101 bp, rice(Oryza sativa)
  misc_feature (71): n=a or c
tatgaataatttgaaataattgcaggaatctgtatatgaataccttatttttggctctcgaggttgttgangctgagaattgtgccttctgtttccaaccc

SEQ ID NO: 7960 - DNA, 101 bp, rice(Oryza sativa)
  misc_feature (71): n=a or g
ttggaatgaatttgtagcttacaagacaggggtggtagggcaggcaaagatgacgaagaacaaagctaacnccgctaagaagaagtaccatcaccacctag

SEQ ID NO: 7961 - DNA, 101 bp, rice(Oryza sativa)
  misc_feature (71): n=t or c
gaaaagttgagcttcatatatctgttgagattgtgatccaatcactgtgtctataattatcactttgcctncttccctatttgaaatagcctctctgcatc

SEQ ID NO: 7962 - DNA, 101 bp, rice(Oryza sativa)
  misc_feature (71): n=a or g
tgtgagatgacattttatatagtatagtctcaccatcaatttcttttgtagtggatctgaacatgtcaatnaagggtatttataatgacttgtttgttttc

SEQ ID NO: 7963 - DNA, 101 bp, rice(Oryza sativa)
  misc_feature (71): n=t or c
ccaaaggttcagggcatcatcgaatgagacatctttgattaagagatctccggtgttccgtgcagaagctnggtcaactgaaactgagaaattccgtacca

SEQ ID NO: 7964 - DNA, 101 bp, rice(Oryza sativa)
  misc_feature (71): n=a or g
tgatacatgtcatatcaaggctagtgtggtggaaactgggatgactgaggaagccattgatgagcttgctnttgtttgggtcaaaatctttggcattccca

SEQ ID NO: 7965 - DNA, 101 bp, rice(Oryza sativa)
  misc_feature (71): n=t or c
cgatcgatctcatcacatcactctctcttccgtgcatggtgatcaattaaactgcaaagtgagcctgtcgngaccatcacgccgacgatcaccgtgacgga

SEQ ID NO: 7966 - DNA, 101 bp, rice(Oryza sativa)
  misc_feature (71): n=t or c
catccatggcggtgggagtttgggctttctagcccatccctgtagccacgggtgtgggtaccctccctccngacagctggcgcatctggatcggcatctcc

SEQ ID NO: 7967 - DNA, 101 bp, rice(Oryza sativa)
  misc_feature (71): n=t or c
aattaaaaacactccccatttttgcagctaaaagaaatggctgaaaggcttcctccagcatcatgtgacangaagcaaacacggcagccttatctacctgg

SEQ ID NO: 7968 - DNA, 101 bp, rice(Oryza sativa)
  misc_feature (71): n=a or g
acaatgtattgaattatcgttaagatgtgtggaggccaaccgagacaaaaggcctgcgataaatgatatantccatcaactgaacgagttagatgctgaga

SEQ ID NO: 7969 - DNA, 101 bp, rice(Oryza sativa)
  misc_feature (71): n=t or c
ccatcatcccggatggcatgttctcaaatgccagccttccaaataacttggcattaacttggcatgttcgngcccaacttcccttcggcggcggtagccgt

SEQ ID NO: 7970 - DNA, 101 bp, rice(Oryza sativa)
  misc_feature (71): n=t or c
ccaatggttattggtccgttcataccatcctcccctacctctaccatgatatgtaggtctccctctacccngaccaccaaaagtcctatatggtgcttgtt

SEQ ID NO: 7971 - DNA, 101 bp, rice(Oryza sativa)
  misc_feature (71): n=t or c
ctctatatcttttatagatttcaaaccttcttgtttatcagcaagaaactttgagaactccagaacttttncccctctaccattttctggggaggtactga

SEQ ID NO: 7972 - DNA, 101 bp, rice(Oryza sativa)
  misc_feature (71): n=a or c
tgcatgacttgcggtattccatcacaccacttgagcaactgcaccgtctcagggctagggatctcatcagnatcagccatgatcaatacatcccccacagc

SEQ ID NO: 7973 - DNA, 101 bp, rice(Oryza sativa)
  misc_feature (71): n=a or g
atggctcacaagtcctatggctgcgaacacaaaatcaatatctccggacttcaaacgaaacaataattcanttaagtacataatatatgcattcagttgtg

SEQ ID NO: 7974 - DNA, 101 bp, rice(Oryza sativa)
  misc_feature (71): n=a or g
caccatcttgtatcgttgcgagtatcggtacgcaaactccaatgcaagctccgtcttgccgatgcccgaancgccattgatgcagatcacaccggcattgc

SEQ ID NO: 7975 - DNA, 101 bp, rice(Oryza sativa)
  misc_feature (71): n=t or c
accctctgcaaaattttgttgataaagtgcaatatttgcaccatcaactatagcttcatatgctccatgtncttccaaccactcctataaagtcatagcac

SEQ ID NO: 7976 - DNA, 101 bp, rice(Oryza sativa)
  misc_feature (71): n=t or c
taagataaagaaggtgtggcaggttaaggagaagacactgttcctgtacctccggaacagggtgcctcgtnaagctgaaatgttggaggtacggtcatgct

SEQ ID NO: 7977 - DNA, 101 bp, rice(Oryza sativa)
  misc_feature (71): n=t or c
tcatcagttgagacgtgcaaagcgagctcatgcatcattcgggacatgctataacggtgtcgttccccacnatggtgaaccagttctctctggaaaaacga

SEQ ID NO: 7978 - DNA, 101 bp, rice(Oryza sativa)
  misc_feature (71): n=t or c
ctatcacggattgtccacacatccacaaacctgaagctcatcttgatcttacagtcctgcaccacaaaatntgtatgggacaacccagacaccgagcgcac

SEQ ID NO: 7979 - DNA, 101 bp, rice(Oryza sativa)
  misc_feature (71): n=t or c
acaacaaagatacgtcaccacaaatccacatgaaaatatatacagcccatggatgatcagctgtcgttgangaccctgcagtcgcacctgacctcgccgtc

SEQ ID NO: 7980 - DNA, 101 bp, rice(Oryza sativa)
  misc_feature (71): n=t or c
gctgtgattaaaaattgctcaatcctctgttcataaatcatcaatgtgagatcggtgaggattacccggtnccataagccggggtcaggtttcttgagcac

SEQ ID NO: 7981 - DNA, 101 bp, rice(Oryza sativa)
  misc_feature (71): n=t or c
aggtcttgcaaggaaagaggactttgcattcattacatattactgcccgcactgtaatgccctcaatggancacggcagcatgatgagcatgaaatggtat

SEQ ID NO: 7982 - DNA, 101 bp, rice(Oryza sativa)
  misc_feature (71): n=t or c
tgtgcagatgttccacccactgtcgcagaaacaaagatgaattttctcaagtcatacaagcgtcctatccnaagcatttacagtacagttctacaagaact

SEQ ID NO: 7983 - DNA, 101 bp, rice(Oryza sativa)
  misc_feature (71): n=a or g
tcacatggtggttcattcattttgttgacggattcttctcgccaatctatgctcaactgggaatcaacatntttggtatgtgaactcaccaaatatttctg

SEQ ID NO: 7984 - DNA, 101 bp, rice(Oryza sativa)
  misc_feature (71): n=t or g
atgtttgaggcagctgtcaagaaattaccgtatgctctacgctacgagtacattccctatgattgtgctgnttcatatgacctgctagtatcccaggtctt

SEQ ID NO: 7985 - DNA, 101 bp, rice(Oryza sativa)
  misc_feature (71): n=t or c
ggcaagaagtctcgggagtagagtcgcagagctagcccctcctcatgctcccccacaacctctgtggacangacggcggattggtggaccgacagagcagt

SEQ ID NO: 7986 - DNA, 101 bp, rice(Oryza sativa)
  misc_feature (71): n=a or g
tcgctactggtggtactcttgtcttccttcttgcatttgctcgtgctcgttccaagtctcagagagacganttcaggctcctcgatgtcggtggccggaga

SEQ ID NO: 7987 - DNA, 101 bp, rice(Oryza sativa)
  misc_feature (71): n=t or c
tatatataagcacataatttgtgatggctatatttgctagtacttctcttaagggccttcaggcgcaaacnttcttccaccccatcctgcctccctttgac

SEQ ID NO: 7988 - DNA, 101 bp, rice(Oryza sativa)
  misc_feature (71): n=t or c
gggcgtcaccgccggccagaccatcgtcttgcactggttgatgatggtgaacacgcgggccgactcacaangcctcacaaagcagcagcacaggagggcca

SEQ ID NO: 7989 - DNA, 101 bp, rice(Oryza sativa)
  misc_feature (71): n=a or g
tttatccttaaaacagagagcatggatgaagatgagcctgttcaaggaagtttcttaaatatgttgccccntaaggaggggcaaccttcatctcactccac

SEQ ID NO: 7990 - DNA, 101 bp, rice(Oryza sativa)
  misc_feature (71): n=t or c
gcttacttccgatctagtggctccaccaatcatgaagacaaaaattcggttgcctagcctcttgaagtcantagatccatgtctcaagaccgaggagtcac

SEQ ID NO: 7991 - DNA, 101 bp, rice(Oryza sativa)
  misc_feature (71): n=t or c
acagcagcccttgctgcatgtaaagcgtctgttaccctatcttttttctcaccaacttcaacttcactagntcccccaatctgcagtcaaaatggatatcc

SEQ ID NO: 7992 - DNA, 101 bp, rice(Oryza sativa)
  misc_feature (71): n=a or c
gttcatcaaggcgtatttgttccggtctgttatcaaattaaagatttgttccggtctacgaaagaagaatnttaaggtatcggcacctcacgggatcagat

SEQ ID NO: 7993 - DNA, 101 bp, rice(Oryza sativa)
  misc_feature (71): n=t or c
cttcagaaacttgaaggccatactgacactgtcatctcggtgtcctgccatccaacggagaacaaaattgngtcgggcggcctcgacaatgataggactgt

SEQ ID NO: 7994 - DNA, 101 bp, rice(Oryza sativa)
  misc_feature (71): n=t or c
gccttagcatactccacaacaagtttcacagtcaagcatgctgtcaagcttgtagctagtaaatatatagngatggacatcatggaagatctctggccagc

SEQ ID NO: 7995 - DNA, 101 bp, rice(Oryza sativa)
  misc_feature (71): n=t or g
atgcttatttacttctacaggtgcctactgttactgccatctgccaagaaaccaatggttctgggaaatgngaaactttttcaccatattcacaagataac

SEQ ID NO: 7996 - DNA, 101 bp, rice(Oryza sativa)
  misc_feature (71): n=a or g
cagtatttgtatgctcccttttgtcttatgctactaatccgattgcaggaacatgaccagatgaatgggcngaccttgcagctagagaaggagctcatcat

SEQ ID NO: 7997 - DNA, 101 bp, rice(Oryza sativa)
  misc_feature (71): n=a or g
agtgttatccttcttcttaactaataggacaggtgaagcaaaaggactacagctatgagtgattagaccancctccaacatttcacaaacttgtttttcaa

SEQ ID NO: 7998 - DNA, 101 bp, rice(Oryza sativa)
  misc_feature (71): n=a or g
agctctttaaataactcaatcttaggatttttcctatcactccatcggcataattctttctgatgataganttttctccatctagcaatctgcaacctgca

SEQ ID NO: 7999 - DNA, 101 bp, rice(Oryza sativa)
  misc_feature (71): n=t or c
tagctcgtcgagttgtcatcgtagcccttcatctatcctccactattcatctcctgccaccattcctcggncatatttgttgtcttcaggtcggcggcgcc

SEQ ID NO: 8000 - DNA, 101 bp, rice(Oryza sativa)
  misc_feature (71): n=t or c
caacaatttcgattttgttcgaaaagagtctcgccctctttatggcaatgccaaaagtaataagagtgcancgagagtagttcgaggaagaggctctaaac

SEQ ID NO: 8001 - DNA, 101 bp, rice(Oryza sativa)
  misc_feature (71): n=t or c
ctgccctttaaatatatgtgtcattaaaagcagttgttttttgtatgggtgtagggtgtgcaagatgggtngcagaatcatgaggcttacttgttgttccc

SEQ ID NO: 8002 - DNA, 101 bp, rice(Oryza sativa)
  misc_feature (71): n=a or c
taccacatgcggtctacctcgtttgccttatatctgaaaccgagcttcagcaagtccagcctgtgacatangaaatgtctaatagtgtcaagcagttcaaa

SEQ ID NO: 8003 - DNA, 101 bp, rice(Oryza sativa)
  misc_feature (71): n=t or g
tgttgcatgcttttggtagttgaccaggtatggtaatacagcatgtacttctgctcaaattcggagtagtntgtgtcgggatgcaggccggcgacgtaaac

SEQ ID NO: 8004 - DNA, 101 bp, rice(Oryza sativa)
  misc_feature (71): n=a or g
gtacgagagcagaacagctaatggacaaccaccagttacttttgccatagctgcacaagagaaagaagatnttcatatctcggaatgcccttactttataa

SEQ ID NO: 8005 - DNA, 101 bp, rice(Oryza sativa)
  misc_feature (71): n=a or g
tggacaagtcgtgttgacagggacagacctggcaaagatgttctaggttattcatgcaattccgagacagntggtttgtcttgccatgctcgttcaaagaa

SEQ ID NO: 8006 - DNA, 101 bp, rice(Oryza sativa)
  misc_feature (71): n=t or c
aattcgcctgctgttcccagctacatggctgcaacacaatctgcgaaggcgaaactgcggggacagaattnacccagacttagttctgactctgcggagaa

SEQ ID NO: 8007 - DNA, 101 bp, rice(Oryza sativa)
  misc_feature (71): n=t or c
atcgggctcattgtcacccacggcgtctgtgtgaaactcagcaaatactagaactttttcagagccagtgncagcatagaagttcagatgggcatatttct

SEQ ID NO: 8008 - DNA, 101 bp, rice(Oryza sativa)
  misc_feature (71): n=t or g
ggcctttaaaaatcgctggcttggcaactgaactcttatacttactctcgaattttctttgcagtcctctntgttgcactctcaaccgaaatctactgtcg

SEQ ID NO: 8009 - DNA, 101 bp, rice(Oryza sativa)
  misc_feature (71): n=t or g
atactatcatgagtcagagttcttacaagccactcggaagaaacattcaagccatacttggagagctatantagcgagaagagatattctgttcaaggggc

SEQ ID NO: 8010 - DNA, 101 bp, rice(Oryza sativa)
  misc_feature (71): n=t or c
ggcgttccagtcggaagattgggaccagtcaccacctcgatcttgaccgaacggtcttctgtcatcatttnggttccaatttttgcaaccatcctggtccc

SEQ ID NO: 8011 - DNA, 101 bp, rice(Oryza sativa)
  misc_feature (71): n=t or g
tgatgtccctgcaccaatgacggtggtgaaggaactgtgtggcttggatattgtggagaagtacttggaanatttatctaaccgtggagctgcaagtggca

SEQ ID NO: 8012 - DNA, 101 bp, rice(Oryza sativa)
  misc_feature (71): n=t or g
ttaaattatcatcaatgatcacagtgagagagtaaaacccttacatgcgaggtggaatccacggtattgtngccgctggagcatttcccggcgaaggcgct

SEQ ID NO: 8013 - DNA, 101 bp, rice(Oryza sativa)
  misc_feature (71): n=a or g
tgcctatgggatatccagtactccaacaacctggaatacctgctcctgttcagcctcatgttaattcgatntcttgtggtccacctggttgccatgtggta

SEQ ID NO: 8014 - DNA, 101 bp, rice(Oryza sativa)
  misc_feature (71): n=t or c
accagattatctaatgcacattcagttttgaaagagagcaataccaatactacagacaccaggacaatgcntgtgctccctttgggtgatctctctttacc

SEQ ID NO: 8015 - DNA, 101 bp, rice(Oryza sativa)
  misc_feature (71): n=t or c
atgtttgcaatgttctcagcagaggttgagtgtaactgttctggttgttttgagaacaagtaatcagtagntgttggaggtggggtcacttcatcaatcgt

SEQ ID NO: 8016 - DNA, 101 bp, rice(Oryza sativa)
  misc_feature (71): n=t or g
aagcacaccttatatatacctgcactgggcgcagggatctggtccagtagcgcaaatccgcatccaagttntcccagaacatctctttgtcgtaatcttcg

SEQ ID NO: 8017 - DNA, 101 bp, rice(Oryza sativa)
  misc_feature (71): n=a or g
gcccctgtccctctctggaagtaaggctgatccaatcaagaacaggagatatgccctggtgccatacatgntctgatcattggtggggcgttccgggatcc

SEQ ID NO: 8018 - DNA, 101 bp, rice(Oryza sativa)
  misc_feature (71): n=t or c
atagaaaagtgcagtaatttatcatacgataccgaagatctactcaaattgacaagcggcgctccctcatntatattccatattcttgcagaaccatcagt

SEQ ID NO: 8019 - DNA, 101 bp, rice(Oryza sativa)
  misc_feature (71): n=t or c
tggacgaatgtggacatccacttgctattgccgccttgattgtagtagaacctcccaagaagtgtagatgnggtctgaccggcaatgaggaagaacatgtt

SEQ ID NO: 8020 - DNA, 101 bp, rice(Oryza sativa)
  misc_feature (71): n=a or c
aattactgtacattctcagacaaaactaaatgttgcagtactcctgtaggaatgcattacccaaatgtacncatcacacgcgtcgagacattggtgacatc

SEQ ID NO: 8021 - DNA, 101 bp, rice(Oryza sativa)
  misc_feature (71): n=t or c
atggcattttggggcagaatggaaaattgtttgaaagcttcacaaccacttcttgttgctctaaggatagnagatggagatgagacaccgatagctctaga

SEQ ID NO: 8022 - DNA, 101 bp, rice(Oryza sativa)
  misc_feature (71): n=t or c
ttgatctattgatacaagtattatacctgtggagagctgctttgaaaggcacttatcattttctgcactgnactatttgatccactttgctccggtgattc

SEQ ID NO: 8023 - DNA, 101 bp, rice(Oryza sativa)
  misc_feature (71): n=t or g
ctagaatgacttacattgtgaaacggagggagtagcatggaacttaactaagagtgctcaagttcaggccncatcaagtactgctaccaatggtgaaagga

SEQ ID NO: 8024 - DNA, 101 bp, rice(Oryza sativa)
  misc_feature (71): n=a or c
tcctgtgcaatgttcacctgttacatgccatcaattgaatggaatgagtagaaggggatcactcagttacntggttcaactgcagcctataactagacagg

SEQ ID NO: 8025 - DNA, 101 bp, rice(Oryza sativa)
  misc_feature (71): n=a or g
atctgtctcctgatcttctttcatttgaatcgatacattcatccatgtaggggcaatcttctcaagttgtntctaaaagtttcctcagatgataagggata

SEQ ID NO: 8026 - DNA, 101 bp, rice(Oryza sativa)
  misc_feature (71): n=t or c
taaatatacttgtggatggtattctattcttaaataccgagtttcgtcgccacgccattgcgccaccagangtcggcgcgcttcttcgtcgccatcagcgg

SEQ ID NO: 8027 - DNA, 101 bp, rice(Oryza sativa)
  misc_feature (71): n=a or c
gctttgcacatggtgatgatggaattcaccacttgttgcaccgagccatatgcatcattaaagacttgatnatttctttggagccaaattccccatgttgt

SEQ ID NO: 8028 - DNA, 101 bp, rice(Oryza sativa)
  misc_feature (71): n=t or g
ccaaaagttattcagatcatacattatgatgggtagaacagggtgttgaaagattattcagaagatatcancgatgacggtgccattagacacgtggcata

SEQ ID NO: 8029 - DNA, 101 bp, rice(Oryza sativa)
  misc_feature (71): n=a or c
gtttctgttgagtgtgtaattccaggaagcattttcgctgtacaggcactcttctcttcaataaaaccacngtttgccacttcactcaaacaagagtactt

SEQ ID NO: 8030 - DNA, 101 bp, rice(Oryza sativa)
  misc_feature (71): n=a or g
tgcaacggagagatctgcgcaggaagaacactttagatgcatcatgaacaagcagatggtgggcatctttntgtcagtctgggtgagaagcaatcttaggc

SEQ ID NO: 8031 - DNA, 101 bp, rice(Oryza sativa)
  misc_feature (71): n=t or c
tcatctcctgaactcctatccaaatttagtttttcaggataaatactatcaggactgccttctttcttttncaagctcatatcagtatcttgcagagacat

SEQ ID NO: 8032 - DNA, 101 bp, rice(Oryza sativa)
  misc_feature (71): n=t or c
atgtacatattgaggcagatgcctgaacaattcgactctgttttgtgcttctgcttggttgaccagtgaangcttctttgttttctccacccgatgtacat

SEQ ID NO: 8033 - DNA, 101 bp, rice(Oryza sativa)
  misc_feature (71): n=t or c
ggcgtcgtcgccgattacgctgcttctgcctctcctttctccttgcttgaagcaatgcttgaccgcgtganacatggcgcggggctgtgttacctgggatg

SEQ ID NO: 8034 - DNA, 101 bp, rice(Oryza sativa)
  misc_feature (71): n=t or c
tcggggccttccagtgcggcaaagaagcggccaacctcgggcgtggacacagtgtgagaatggtggtgacnatccatggcggcatccacgacttgccctgc

SEQ ID NO: 8035 - DNA, 101 bp, rice(Oryza sativa)
  misc_feature (71): n=t or c
aagaacagaatttggattggttctaactatcccttgcagcttaaaattatatctgaattgcactccagccnagtgggaggccactctggtttcccagttac

SEQ ID NO: 8036 - DNA, 101 bp, rice(Oryza sativa)
  misc_feature (71): n=a or g
tgaaaatggccgtttgcagattcttcaaattcatacgaataagatgaaagaaagctctttcctttccccgnatgttaatcttcaggagctaggtatattct

SEQ ID NO: 8037 - DNA, 101 bp, rice(Oryza sativa)
  misc_feature (71): n=t or c
tagaacctcaaggcttcaaataacaactaccaagaagggagttgtatggtttgatcaagtctctctcatgnctgcagacacttacaaggtacattatattt

SEQ ID NO: 8038 - DNA, 101 bp, rice(Oryza sativa)
  misc_feature (71): n=a or g
tgtcgccatcaaccagctgacagcaatgcacactgcatataatagttatgaaaggaacaattctagagctnttactatctttttatttttctcattattaa

SEQ ID NO: 8039 - DNA, 101 bp, rice(Oryza sativa)
  misc_feature (71): n=a or g
gcgccttaagaccatgctcgtggaggagaaagacaagaacaaacaccataagatcatactcgaggaggaanaggacaagaacgagcgtcttaagaccatgc

SEQ ID NO: 8040 - DNA, 101 bp, rice(Oryza sativa)
  misc_feature (71): n=a or g
ggataggtctggagcattattgttgagctattacagatccaatacattgttgttgagggcgaactcaaacncatcgtttacatcttcattaggatcagctg

SEQ ID NO: 8041 - DNA, 101 bp, rice(Oryza sativa)
  misc_feature (71): n=t or c
gtatatgcaatggtatcaggaaccagtcctttctctaacatcatctgcaacaagatgagtgcaggcacaancttacctcttttgcaaaacccatccagaag

SEQ ID NO: 8042 - DNA, 101 bp, rice(Oryza sativa)
  misc_feature (71): n=t or c
gctcagagtttaaatgggcaacttgatatagctggacgtgtgattaaggcaagtgttttcttcagatttantagaatacatgttgttttcaagctatacat

SEQ ID NO: 8043 - DNA, 101 bp, rice(Oryza sativa)
  misc_feature (71): n=a or g
aattcttattagatttttctttttcctttttggcagaagatggatgccactaggagtgcacaatcaatccntggccaagatgaacaaaaattgtatgatga

SEQ ID NO: 8044 - DNA, 101 bp, rice(Oryza sativa)
  misc_feature (71): n=t or c
tgcattctattctgtatatatatagatagatagctctttctgggtactctcaaacctttcctataataganggctttggcaaaataagcattaagtttctc

SEQ ID NO: 8045 - DNA, 101 bp, rice(Oryza sativa)
  misc_feature (71): n=a or g
ttattattatttagataagattgtttagtataacttcattgctaattttattcaggactgcaatggaggancactgacaaattttaataggaatattgtga

SEQ ID NO: 8046 - DNA, 101 bp, rice(Oryza sativa)
  misc_feature (71): n=t or c
actgagttcttctattgtcaacttgcaccatctaccggatctgatactgctcatcattggccttccctatngtaagttttttttccttcccaatattaatt

SEQ ID NO: 8047 - DNA, 101 bp, rice(Oryza sativa)
  misc_feature (71): n=t or c
ccaccatgcaacaactagaaataccggagctgagctaagctgagcttcaattcttcacctgtaatcacgangtcgcggaggccgtcgccgtggatgaagct

SEQ ID NO: 8048 - DNA, 101 bp, rice(Oryza sativa)
  misc_feature (71): n=a or g
gtcttacagttctgtgttcctttctttccagtgcccatcatggtgaagaagaaaagaactgggtctggcancaccggtgagagttctggagaggctccagg

SEQ ID NO: 8049 - DNA, 101 bp, rice(Oryza sativa)
  misc_feature (71): n=a or g
cagcggtataacacgaaagcctgaagatattaacggagcatcatcagggaaaagctcatcgattggtgcanagacaagctggaagcaggatcccattgatt

SEQ ID NO: 8050 - DNA, 101 bp, rice(Oryza sativa)
  misc_feature (71): n=t or c
tttgtccagtgatgatgagggtggaagaatactagacggtgtgtcaggacagatttcgtctccatttccanatgttgggaggagttcatcgtcagatgaga

SEQ ID NO: 8051 - DNA, 101 bp, rice(Oryza sativa)
  misc_feature (71): n=t or c
tcgctgttcgaattgctgagcacggaagtgatggcggggttacgcagggtgatgagttgcaggtacaggtncaggctgtgcgccctgatcagctccagcgg

SEQ ID NO: 8052 - DNA, 101 bp, rice(Oryza sativa)
  misc_feature (71): n=a or c
gttgtcgtcgaggctattgatatccaacaagtagggcatgaaatgatcgtggtggtccaccacgtagaganggttgccgtcgatcgcctgctgcacggtga

SEQ ID NO: 8053 - DNA, 101 bp, rice(Oryza sativa)
  misc_feature (71): n=t or c
acctgcatgtccagaggaataggcattggagagacaagatgttcatcagaaagctgtcctttccctactcnggttgattcttttaccatactaagagactg

SEQ ID NO: 8054 - DNA, 101 bp, rice(Oryza sativa)
  misc_feature (71): n=t or c
gcaacaggagagtatgccacgagagggtgcttgatcagtccacatttcttaatcagcttttgaagaacatncgccaccagaataaagaggtatggcgacag

SEQ ID NO: 8055 - DNA, 101 bp, rice(Oryza sativa)
  misc_feature (71): n=a or g
attattgctgcgaacaggagtgaagccaaaaaaaattctcaattactatttaagcctgtgccagctgatcngtccaatcttgatttattggcatcaagcta

SEQ ID NO: 8056 - DNA, 101 bp, rice(Oryza sativa)
  misc_feature (71): n=a or c
aaccgaaaagaagtcaaggattcagtaccagtaacagcctgataagaaatagccataaaaactggttctanaggttcagatacagtatcgacggactcatg

SEQ ID NO: 8057 - DNA, 101 bp, rice(Oryza sativa)
  misc_feature (71): n=t or c
tctgaagcctgataatattctccttggagacaactttgtaggcaagctaggggactttgggatatctcgtncgttgaatctgacaaacaccaccatcacac

SEQ ID NO: 8058 - DNA, 101 bp, rice(Oryza sativa)
  misc_feature (71): n=a or c
gttaatgccactcctctcttgctctttgaagcttcaaatacacagatgtcaccttcttgcaacagattgcngcgaaagaagtccaaccagccagtagagag

SEQ ID NO: 8059 - DNA, 101 bp, rice(Oryza sativa)
  misc_feature (71): n=a or c
gacgagcttttaaagacatgctcaaagacccgtcatggcgtagtcttcaagccggatttggtgtcttcatntacttttgacaaggtaagtattgaggaatt

SEQ ID NO: 8060 - DNA, 101 bp, rice(Oryza sativa)
  misc_feature (71): n=a or c
gactgcttgagaccaaatatagaagatgatgcactgatcagcttatcgtctttatttgaagcaagtggcanttgtgacacagaactctccagaagggtgcc

SEQ ID NO: 8061 - DNA, 101 bp, rice(Oryza sativa)
  misc_feature (71): n=a or g
gattcgactggttgccggtttagctaactgatggcgctgatttgcaggaggaaagctgtggcagcacaggncagtggcggcacaagatcaaaaaaagcctc

SEQ ID NO: 8062 - DNA, 101 bp, rice(Oryza sativa)
  misc_feature (71): n=a or g
ttgcaagaacagaaaaccagctttctcatatggggaaatatcaccattttggtgtgatcgcctgaagaccntcaaaatcaaatgtaccgaacatgatgaga

SEQ ID NO: 8063 - DNA, 101 bp, rice(Oryza sativa)
  misc_feature (71): n=a or g
cagcagtcttatctcattgtagtgctaaggatggagcaagacattttgaagttcattcatgaccctacgcngacagagtttgacttccatggtcttcctac

SEQ ID NO: 8064 - DNA, 101 bp, rice(Oryza sativa)
  misc_feature (71): n=t or c
ttctccgcaatttggacatcgtcttcctcctcgtcgctctcatcgggcagctcaatgtcctcattgttagnagcagcagcctgttgttgcctgctgctgct

SEQ ID NO: 8065 - DNA, 101 bp, rice(Oryza sativa)
  misc_feature (71): n=a or g
tccgtcatcacatcattctgtgtattcaactttctaccactacctgtatccattgaacaaccttgattacnttcttgtttatcattgtcattcctattgac

SEQ ID NO: 8066 - DNA, 101 bp, rice(Oryza sativa)
  misc_feature (71): n=a or g
cacgttggaatagagaattttcttgacaacgagctttcatggagcatattgaagtgcaacactgatgggcngaagctacattcttccaagaagattgcgca

SEQ ID NO: 8067 - DNA, 101 bp, rice(Oryza sativa)
  misc_feature (71): n=a or g
gaaaagagatgtgttttcatttcgtgaaaattcacgcctggatggcactaatctaatccctatcagtgagnattcagaccagataaacgggaatgatccaa

SEQ ID NO: 8068 - DNA, 101 bp, rice(Oryza sativa)
  misc_feature (71): n=a or c
cacctcccacgacaggaaaggggttcctattctcgtatcatagaagttcataccaatacaatccccatcangagtaacaacagggcctccaatcccagcct

SEQ ID NO: 8069 - DNA, 101 bp, rice(Oryza sativa)
  misc_feature (71): n=a or g
ggcgggcacgacgccgcgtggaagtccacagacaactcggctgctgctgctgttggtgaggagataaggangacggcgacgaaggagaccagctccaggac

SEQ ID NO: 8070 - DNA, 101 bp, rice(Oryza sativa)
  misc_feature (71): n=a or g
agaggccgtcatcgaagatgcagtcggagaagcggatgttgttgtggaaggtgatcttattccattgcttntctgatgatctagctgcatgtaaggattgt

SEQ ID NO: 8071 - DNA, 101 bp, rice(Oryza sativa)
  misc_feature (71): n=a or g
ggtctctgaagtaaaacagcatttctaatctcccgacgcaacccatcaataaatctatgtgtcaagtaacncatatttaccccaggatcataaactagcaa

SEQ ID NO: 8072 - DNA, 101 bp, rice(Oryza sativa)
  misc_feature (71): n=t or c
cggcgtcgtggaccacttcgtcatggagtggaggaagcagctccgtgagctcgcctactactcggaggacngcatcgacctcagcctcctccatatcaggt

SEQ ID NO: 8073 - DNA, 101 bp, rice(Oryza sativa)
  misc_feature (71): n=a or c
tcggatgatgctgatactccacaggctacaaaggaacaacctgacaacatgcctgttttgcctatgaaatntggtacctttttaagcttttattatgaata

SEQ ID NO: 8074 - DNA, 101 bp, rice(Oryza sativa)
  misc_feature (71): n=a or g
ttatggattcccatccttggaacgtatccgaatcggtggggaaagttgcaggcttgagttgacttttgaanttgggtgcttgccgaagctacaacaactga

SEQ ID NO: 8075 - DNA, 101 bp, rice(Oryza sativa)
  misc_feature (71): n=a or c
tctatcttgatatcagaagaggtcatgtctgactctacatcagcactggtcatatcaagggcaccaattgnttcgttggtgccaacatcttgtgtcttctc

SEQ ID NO: 8076 - DNA, 101 bp, rice(Oryza sativa)
  misc_feature (71): n=t or c
ctcctcgttggtgtacggacaccactgaacgttatcctccttaagtagatcgaacacttcagtgaagtatncgtacgcacttcgaacctgaacattcgccc

SEQ ID NO: 8077 - DNA, 101 bp, rice(Oryza sativa)
  misc_feature (71): n=t or c
cttcgtaaattggatggaaatgttttaagatacacaccagcaggcaggtgcaatttcaaaagcatcactgngagtatcataagtctctagtagccttcctt

SEQ ID NO: 8078 - DNA, 101 bp, rice(Oryza sativa)
  misc_feature (71): n=t or c
ctatcagaccttgtggtcttggacaaaagacacacccatgggcagcttggccagtcacatttagccctaanccttctaggatcactcttgatgaagttgat

SEQ ID NO: 8079 - DNA, 101 bp, rice(Oryza sativa)
  misc_feature (71): n=t or c
agctctcagcaaaagaagacttcccgagaacaaggaaaaattaagtctacatatatacttacgtggcttanggctttgaggagcaacgcggagtgaggggt

SEQ ID NO: 8080 - DNA, 101 bp, rice(Oryza sativa)
  misc_feature (71): n=t or c
gactaagccattaagctgatccaggtccaaaatctttagatttctaaacccaccaatctggcactctatcnggtccacattaagtgcacgaatcaatgaaa

SEQ ID NO: 8081 - DNA, 101 bp, rice(Oryza sativa)
  misc_feature (71): n=a or c
ggaggctcgtcgcggagaggcggaccgtgtcattccaactttgaaaccaaagcatctgttctctggaaaangttctataggcaagacgagcaggcgataag

SEQ ID NO: 8082 - DNA, 101 bp, rice(Oryza sativa)
  misc_feature (71): n=t or c
ctcactactactgggcccaagtagccatggaccccgccaatcaacctcagaatgcgcgcatgccaactcancctccttcgtgggccgtgcacacccttgcg

SEQ ID NO: 8083 - DNA, 101 bp, rice(Oryza sativa)
  misc_feature (71): n=t or c
atcgacgtcaagctggaagatggtgagtgcaggtcgatatccgtggagtacgagcgcgtcgggagcatatnatgcgggacatgccggatattggggcattc

SEQ ID NO: 8084 - DNA, 101 bp, rice(Oryza sativa)
  misc_feature (71): n=a or g
aatatgaaggattcgtctgctatatgctctgaaagaactgggaagtcaagtacacttcacaagcgaatggngtgccaattgctgtgggttctttttgtgtt

SEQ ID NO: 8085 - DNA, 101 bp, rice(Oryza sativa)
  misc_feature (71): n=t or c
agtttattgtctttcaggaatataaggaagatgtcatggaaatggtgatgggctgaccttcttggttctgnggcgcctagctcgctgaatgaagctcttct

SEQ ID NO: 8086 - DNA, 101 bp, rice(Oryza sativa)
  misc_feature (71): n=t or c
gctcttttggtgaggaagaaggatggtacctggcgcctttgtgtagattacagacacctgaatgccttaantgtcaagagcaagtacccagtgcctataat

SEQ ID NO: 8087 - DNA, 101 bp, rice(Oryza sativa)
  misc_feature (71): n=a or g
cgtagcagccttaaagatgtagagggttttgatcactcagttgtcaatgagactttaggagcctgtggttncctgcctggagaccagcaaggtccttgtct

SEQ ID NO: 8088 - DNA, 101 bp, rice(Oryza sativa)
  misc_feature (71): n=a or g
cctgtgaagcccgtagccgaggtcaaaaaaccaaagtctaccgagtccgaagcagctggaagcagcggtgncaaggaggacgagaaggaagaggaagagaa

SEQ ID NO: 8089 - DNA, 101 bp, rice(Oryza sativa)
  misc_feature (71): n=a or c
tttacatggatatggagagtctcgacattggggaagcatttgaggaagcttggaagcattctggcttcatngcggactgtgaatttcacctctagtgccaa

SEQ ID NO: 8090 - DNA, 101 bp, rice(Oryza sativa)
  misc_feature (71): n=t or g
ctgaattggtgagtgcatatgcaaacggctcgattcaagagaaattggacaaggttgagaacagtgggcangttgaggggagagctgcagagagtgatgtc

SEQ ID NO: 8091 - DNA, 101 bp, rice(Oryza sativa)
  misc_feature (71): n=a or g
aataacaataatacattgcatgctaatgctaggcatttgttgtaaccagatgggtattgaggacagaactntaaacagattgtgattcatgaattggataa

SEQ ID NO: 8092 - DNA, 101 bp, rice(Oryza sativa)
  misc_feature (71): n=t or c
gtatccggtgttgctcacaccacacttcccatcttcccatcttccttggccaatcccgcgatggctcgtgnttcttgtctccagccagtcggatccaccag

SEQ ID NO: 8093 - DNA, 101 bp, rice(Oryza sativa)
  misc_feature (71): n=a or g
tggggaaacaactgagattagacaactgctgctggaagtctaccacacctcatgttttggaggacattctnggatcagggcaacatatcatagaattaagc

SEQ ID NO: 8094 - DNA, 101 bp, rice(Oryza sativa)
  misc_feature (71): n=a or g
ataaagtagggcctcgagtatatatatgagagatagtgtggtgcggtgaaacgaagatgcatttatactcnctggaaagctcctgactcgtgaggtcttcg

SEQ ID NO: 8095 - DNA, 101 bp, rice(Oryza sativa)
  misc_feature (71): n=t or c
tcattttcatgcatgggcggagacggggttgcattggcaaggcttaatccagagcctcgcgtggcgtcgtngacgatcttgtccagcctcgccgccatcgc

SEQ ID NO: 8096 - DNA, 101 bp, rice(Oryza sativa)
  misc_feature (71): n=t or c
aacagatacaccgtatccaaaacaaatccagccacgctaacaaagagagtagacttgtgctcttcggtgtnaacgacgaacaacaggtgaaacaccagcac

SEQ ID NO: 8097 - DNA, 101 bp, rice(Oryza sativa)
  misc_feature (71): n=a or c
tactaactaaaagtggttccttatgcagtttgaagaccctcgtgatgcacaagatgcaatttatggccgtnatggatatgactttgatggccacaggttgc

SEQ ID NO: 8098 - DNA, 101 bp, rice(Oryza sativa)
  misc_feature (71): n=t or g
ccttctggttccagaagagtttcaggtaactccatccactgacgtgttgctgggttgcacaccacaaagtncgcaacggatggagaagaagtattgcgccc

SEQ ID NO: 8099 - DNA, 101 bp, rice(Oryza sativa)
  misc_feature (71): n=t or c
aaatctagcaggcccacgcacaattgcaaaacgggcttgcaaaactccaaatgcacgctcaacatctttgngggctgcttcctgttgttgggcaaagtgtt

SEQ ID NO: 8100 - DNA, 101 bp, rice(Oryza sativa)
  misc_feature (71): n=t or c
tgttcatgtattgatcgactaaccaaagaaaataaccaatactacctgcgatacgttgaagcctagcttgnatttcaaatgcttcccttaccacatctgga

SEQ ID NO: 8101 - DNA, 101 bp, rice(Oryza sativa)
  misc_feature (71): n=a or c
ggtagggcagataggatgcatgaggctgagaacctattgcatatcatgattgagaatggtgtcagaccaancaatgtaaggtgcactacgttgatcagcat

SEQ ID NO: 8102 - DNA, 101 bp, rice(Oryza sativa)
  misc_feature (71): n=t or c
agagtttgcaaaggacgtatcgttgtggaaaccacatgtgtgtttttataggaggagccagagtctagatnggattcatacacatacgtctttccaaagga

SEQ ID NO: 8103 - DNA, 101 bp, rice(Oryza sativa)
  misc_feature (71): n=a or g
agcaccacccaggcgtaggggtggtgatggtcaggactcatccaacttgggcaagtggcaggagaacttcntatcatcacaagggcggcaaggcggcggga

SEQ ID NO: 8104 - DNA, 101 bp, rice(Oryza sativa)
  misc_feature (71): n=a or g
aatgctccctaacatgcccgggaaaccacgacgctcaccaatctgcactaagcgttcaacatcttgcaccntggggcgtcgcaaatactctgcaccgaata

SEQ ID NO: 8105 - DNA, 101 bp, rice(Oryza sativa)
  misc_feature (71): n=a or g
cgattccaagcaacgtggagattggacattgatttgactcgtatactcttggtcatcagcctcacagcccnaaggtccttgcaatggccttttgcgttttt

SEQ ID NO: 8106 - DNA, 101 bp, rice(Oryza sativa)
  misc_feature (71): n=t or c
ccattgcgtagtcggaaagcttccatctcacatcatgctcgttatacttcaggcctcagatgcatctcccncgcctccgcgacggcaacggcttgtaacgc

SEQ ID NO: 8107 - DNA, 101 bp, rice(Oryza sativa)
  misc_feature (71): n=a or g
ctccccgtcgacaggaagtcacccagatgcttgtgaacaagatacagcgcgtacacattgcaaaggatgcncagttgctccttcactccctcaccagggat

SEQ ID NO: 8108 - DNA, 101 bp, rice(Oryza sativa)
  misc_feature (71): n=t or c
aatttattgggtgagcgacggacttggccagcagcctctctgcttttaaattctccaggatacgaccaaantaggcatggaagaggctcatcttttgatgg

SEQ ID NO: 8109 - DNA, 101 bp, rice(Oryza sativa)
  misc_feature (71): n=t or c
ttctctcaaagttaaacattgtctttcagtataccaaattgttgtagagctgacttaaggttatctggacnatatccctcgattgaagtaattcctggttt

SEQ ID NO: 8110 - DNA, 101 bp, rice(Oryza sativa)
  misc_feature (71): n=a or g
gaaacagtgttttcttgaggagctagaacattcttgtggatcctctgaaagtgatctggatgagactgatnggctttcagaattagatgagactgaaatgc

SEQ ID NO: 8111 - DNA, 101 bp, rice(Oryza sativa)
  misc_feature (71): n=t or c
gttccttctgtttctttaaaacgagtggattctgcttcttttgttaaacagtttcctagacagttctctcnaggcccttctactcccaagcctgtttcagt

SEQ ID NO: 8112 - DNA, 101 bp, rice(Oryza sativa)
  misc_feature (71): n=t or c
tgtgatagctagctagagatacatatgtgcacatattaacatatatacctttggtgttggagttggctctncatccattggctgggaggggaagatgttga

SEQ ID NO: 8113 - DNA, 101 bp, rice(Oryza sativa)
  misc_feature (71): n=t or c
aggcatttctcttcaaagagggcatagtacttcttaaattcaatctcagccttctcaccaaaagcatcaancttgtcctcatacttctcatacagtactgg

SEQ ID NO: 8114 - DNA, 101 bp, rice(Oryza sativa)
  misc_feature (71): n=a or c
tttgttgccgcttgttttgactgtgaactactgaactttgctttctttggttggctggaattcgtctgatnctgcaaaatgaatgcaaaagcacatgagaa

SEQ ID NO: 8115 - DNA, 101 bp, rice(Oryza sativa)
  misc_feature (71): n=a or g
taacgcaacaatttcatcttatctagtagaatatgatcatgaccatgtgatgggttgttattgttgtgacncgaaagtttcttgttggctaggtctagctc

SEQ ID NO: 8116 - DNA, 101 bp, rice(Oryza sativa)
  misc_feature (71): n=a or c
ctgttcccttaccacgttgatggctggcctcatgaaatcgtttttcatcgcctcgtagacatcaagcgaanactgttgccacctgaagttcagaatatgca

SEQ ID NO: 8117 - DNA, 101 bp, rice(Oryza sativa)
  misc_feature (71): n=a or c
cctcctgacctaagctgccaatcatcagagaaactatcacatagtagatttgccattggagtatgagcagntggactatgtattttcacatttgatggatg

SEQ ID NO: 8118 - DNA, 101 bp, rice(Oryza sativa)
  misc_feature (71): n=t or c
aaaatgtacttggatggatttttgcaggcattgattttccaccatcttggcagatcttggagaaggccctnggagaaggtgagatacatgactacctgctg

SEQ ID NO: 8119 - DNA, 101 bp, rice(Oryza sativa)
  misc_feature (71): n=a or c
tggaatctggaggaaactgaacctcctgaatcaagcccgacagagtgccaacttgctgcaatttgtcgaanaagtcatgacatcttcgccgccccattctc

SEQ ID NO: 8120 - DNA, 101 bp, rice(Oryza sativa)
  misc_feature (71): n=t or g
gatgagattcccaaatgaagagaaattggaggagctgtcgaattttgtttcgtttggactgaaaggcacangtgttcagattagtgtaaagagatggtccc

SEQ ID NO: 8121 - DNA, 101 bp, rice(Oryza sativa)
  misc_feature (71): n=a or g
tgcacaagtttgtagctctcgatgccaataatattatattactttaatatgcacaggaactagtaggtccntgaaaggaaggacaacagaactaactccag

SEQ ID NO: 8122 - DNA, 101 bp, rice(Oryza sativa)
  misc_feature (71): n=a or g
gccgcagccttcaccctgcctgggggatacagcaacgattctggaagcgagggacttcctgtcatggcaangaagttagcgtttcaagcattcttgatctc

SEQ ID NO: 8123 - DNA, 101 bp, rice(Oryza sativa)
  misc_feature (71): n=a or c
cctatggtgactattgcaaggggaagtccattacacttcttcaagatcagattcgcttgttcaactaagtnaggatattgttcatccaaatttgtcttttc

SEQ ID NO: 8124 - DNA, 101 bp, rice(Oryza sativa)
  misc_feature (71): n=t or g
ttctcactgagtgcttcactgtactgttttgcagttcgctcatttggaactgaaggtcgtaagaaggatgntcaacagattccagccagtgacaagatata

SEQ ID NO: 8125 - DNA, 101 bp, rice(Oryza sativa)
  misc_feature (71): n=a or g
aatcgaacttcatatgttgacttcacactaccatatactgaatctggggtggcaatgattgtgccagtcanggacgacaggaataagaatacatgggtttt

SEQ ID NO: 8126 - DNA, 101 bp, rice(Oryza sativa)
  misc_feature (71): n=t or c
ctcgtatgaaaatctgtcaatgtcacgaatatgttgctgaaccttgtaaattaagcatgattctgttccantatcaatatcagtgcccagtgaccaataat

SEQ ID NO: 8127 - DNA, 101 bp, rice(Oryza sativa)
  misc_feature (71): n=t or c
aacaacaacgaatccattggtagaccaccggagagagaattgtgggagaggttgaggtgcaacaacttggngagattgctaagggatggagagatgctccc

SEQ ID NO: 8128 - DNA, 101 bp, rice(Oryza sativa)
  misc_feature (71): n=t or c
tctgatccgttgtgcgagggtaacgctgcaccttcttcttcttctagctcggggcaggacctgaaacaatngaagaactcgatcctgtcctgcgttttcag

SEQ ID NO: 8129 - DNA, 101 bp, rice(Oryza sativa)
  misc_feature (71): n=t or g
gaaaaagaatgccgctcttgtggagtggttgctgcgagaaagttgaacaaccaacacaacctctttgcaanagaaactgttgaacttcgagctgtatacgc

SEQ ID NO: 8130 - DNA, 101 bp, rice(Oryza sativa)
  misc_feature (71): n=t or c
tctgaccaactagtgttcttcaccgtgaccattgtggctaccagtccgatgtcaccattagggctattccnggtgcaaccaccagtctgtgccctccagca

SEQ ID NO: 8131 - DNA, 101 bp, rice(Oryza sativa)
  misc_feature (71): n=t or c
tccctccacgccaaccatgcaaatatcactctgctcctctgcccgtccgacaggttcctcattggcattanctgtgccttccctgacaacccaaacttgcc

SEQ ID NO: 8132 - DNA, 101 bp, rice(Oryza sativa)
  misc_feature (71): n=t or c
caggcatactagttaatgacataattcagatgcagaacatacttctttcgaccccctcggcctctttcgcnagaccttccaccttttggagtattgtcagc

SEQ ID NO: 8133 - DNA, 101 bp, rice(Oryza sativa)
  misc_feature (71): n=a or g
aacttttctcccacctttgcataggtgcaaaggttaatgatggcttattactttttttgcggggtatcgcncgatgtggctgccaaaccagcattggtagg

SEQ ID NO: 8134 - DNA, 101 bp, rice(Oryza sativa)
  misc_feature (71): n=a or g
ctgctcaaggtactcaacccagacttcttccttgtatcgcaatgtcgtccagaagagttcagcgtggcaangtatgatgacacgctgcagaagctaaggat

SEQ ID NO: 8135 - DNA, 101 bp, rice(Oryza sativa)
  misc_feature (71): n=a or g
ctgtagaggtcctcctttcgagtttggagcaatttcaatgacctttccatccctaattatgttaccaatcncagcagcttcaattgaagctaactgatact

SEQ ID NO: 8136 - DNA, 101 bp, rice(Oryza sativa)
  misc_feature (71): n=t or g
aaacaaggcacggcagatgctagaatcttgacatggaagcttctccaggggattagaaaggcgaaatacanaagtggggtgttccccctcaacctcaagta

SEQ ID NO: 8137 - DNA, 101 bp, rice(Oryza sativa)
  misc_feature (71): n=a or g
cgaactgtagctgtgtgtcccatcaacgctgcagcatgtataggtgagaatccctcgttatcctgcatgtntggagcgctcggcggagagcatgctaagat

SEQ ID NO: 8138 - DNA, 101 bp, rice(Oryza sativa)
  misc_feature (71): n=a or g
gaagacaggaatggaaggctgcaattcaactcaggttccaatggaggcaaagttgaaactgagaaaggacngtaatggtgaagctgtagattcagctttgt

SEQ ID NO: 8139 - DNA, 101 bp, rice(Oryza sativa)
  misc_feature (71): n=a or g
gtgaatactttgtccttaatgttccactctgtcagacctgttgatagcctctccaaggcaattgttgtgtntgtgtacttcacatttttcatagctattgt

SEQ ID NO: 8140 - DNA, 101 bp, rice(Oryza sativa)
  misc_feature (71): n=a or g
attttcctggttttgtttttcagcttatcttgcatctctgaatgaaccggacaccactgaacttgcatttnttgaatacaagtctgctactaacatgacgg

SEQ ID NO: 8141 - DNA, 101 bp, rice(Oryza sativa)
  misc_feature (71): n=a or g
tgcaggcaaggatgtgtcagatgtttctgaggatgaagcttttgaggacccatttgctgcatatgaggctnctagggatgtggctgccggtgagggtccct

SEQ ID NO: 8142 - DNA, 101 bp, rice(Oryza sativa)
  misc_feature (71): n=a or g
tcaatgccaacctcaccatcccatccataagacacatcccctccatcattgtacggggacccaatgaggtnaaacttgagcgggtggtatagatctagagg

SEQ ID NO: 8143 - DNA, 101 bp, rice(Oryza sativa)
  misc_feature (71): n=t or c
accactgcagctgcagctaatagtagtaaattccatccatggccgtcgcctacactagtgaccaccggcancaccaccaccaccacgacgtcgtgggcagg

SEQ ID NO: 8144 - DNA, 101 bp, rice(Oryza sativa)
  misc_feature (71): n=t or g
aaatggtgtattacatgctacaatattcatttcaggttggagaagagaagctagttttggaaattggtcangcggctctacgacgcccagattctaggcca

SEQ ID NO: 8145 - DNA, 101 bp, rice(Oryza sativa)
  misc_feature (71): n=a or c
tggtcttcaacttccatattatcttccttggaacaaggcacatcaacagcagtaccttcactttggagacnattgccatgatcttctgtgggggcagtatg

SEQ ID NO: 8146 - DNA, 101 bp, rice(Oryza sativa)
  misc_feature (71): n=t or c
cttcttcgccaagcaaacgagagactgcaggtggaagctgacatcctaaaagacaaggaagacagtttganttcctcacatgaattactgtcgaaagaggt

SEQ ID NO: 8147 - DNA, 101 bp, rice(Oryza sativa)
  misc_feature (71): n=a or g
agtatcaaaagcaagatagagaagatggaccaaacaataggaagagctaaagcatgcactgttgattgtancaacgtcgacagaaagcttcgccaaatact

SEQ ID NO: 8148 - DNA, 101 bp, rice(Oryza sativa)
  misc_feature (71): n=t or c
tcaattacttcagagcctaagacagatatgccatccttccactgctcacattctgtagctgaattctccanctgcactttaagctcgtcgatttcgacact

SEQ ID NO: 8149 - DNA, 101 bp, rice(Oryza sativa)
  misc_feature (71): n=t or c
tttgtattacttgtgcttctgaaggcagctttagtggtggatccagttatggtgtccacaagtggagatantctttcagaatcatctactctctctgtata

SEQ ID NO: 8150 - DNA, 101 bp, rice(Oryza sativa)
  misc_feature (71): n=a or g
ttgcaaaagttgtataagcatgcgaatgccatggccggccgggttgctgctacttttttctcttgtaaaantttcatgtgctgcggacggcgggaggcaca

SEQ ID NO: 8151 - DNA, 101 bp, rice(Oryza sativa)
  misc_feature (71): n=a or g
cacctccgctccccgtgtggtttcgcatggtattcacgatggccctggcttcccaatgttcacgaccgagnagcaggtggcggcgggacagctttcacgcg

SEQ ID NO: 8152 - DNA, 101 bp, rice(Oryza sativa)
  misc_feature (71): n=a or g
agtcggagcactttcagttagattgtcaggtctacagaagggaagtgagtagtacgagtaggtgatctgantctcgatggacatcagctcgttcatcttca

SEQ ID NO: 8153 - DNA, 101 bp, rice(Oryza sativa)
  misc_feature (71): n=a or g
atttcagaaggtctgatcttgtcacagaagaaatatgcaaatgaattgttaaaccgtgcaggtttgaaagngtgtaaacctgtcaatacaccgctctctat

SEQ ID NO: 8154 - DNA, 101 bp, rice(Oryza sativa)
  misc_feature (71): n=t or g
gccttcaattggcttaagagtaaatgtgcagaagaactcatcctcaagaaccacttcactaaagggaacanaacgttcttgttcatatccggtagaatttg

SEQ ID NO: 8155 - DNA, 101 bp, rice(Oryza sativa)
  misc_feature (71): n=t or c
atactcgaaagttgtctgctgaatgctcggccattaccatagggtccatacatgtcctccatgcctaatantgtcggcgagcatggagacgatccttgaga

SEQ ID NO: 8156 - DNA, 101 bp, rice(Oryza sativa)
  misc_feature (71): n=a or g
acaatggaataggcccaggtttggagcggggagggaagaaggcacaatatcgagggcactagggagaaggngaagaggtttgttgcaaccaaggggacgtg

SEQ ID NO: 8157 - DNA, 101 bp, rice(Oryza sativa)
  misc_feature (71): n=a or g
agaggaattgtgccccagtacatcacttaccagaagcttatgagagagctcaagcgacttggtttggttcntctgatccaaaagttgacaaatttaatgcg

SEQ ID NO: 8158 - DNA, 101 bp, rice(Oryza sativa)
  misc_feature (71): n=t or c
cggaagaattccatgcaggcttagtcgacttggatctctgatttgtagagagcgttggccttccaattatnggggatgacgtcgttggcgacaagcttctg

SEQ ID NO: 8159 - DNA, 101 bp, rice(Oryza sativa)
  misc_feature (71): n=a or g
acaaaagtacatacataccggcgataacggcaaggcataatagtaatagtcgagcgtctcaagcgaggtanccatggcggacagaaggtttggggcgcttg

SEQ ID NO: 8160 - DNA, 101 bp, rice(Oryza sativa)
  misc_feature (71): n=t or c
tgtggtggtgttgtcataggtggagggcttgatggagttacacttgggggactagatgaaggtggtgatanggtaggtggaggggttgatggaggtggtga

SEQ ID NO: 8161 - DNA, 101 bp, rice(Oryza sativa)
  misc_feature (71): n=t or c
attttcatgtcatacatgttaccattaagtattttcttgttctctgcaggcatggtcaccatttcaccttngcagcgatgttggttgtggtgagattgggg

SEQ ID NO: 8162 - DNA, 101 bp, rice(Oryza sativa)
  misc_feature (71): n=t or c
tttctttttgtcctccttagctaacaactcaatcttagcaggggtgtagtactgaatctgggaactttccnccctgcccttgtccttccctaaacttgcct

SEQ ID NO: 8163 - DNA, 101 bp, rice(Oryza sativa)
  misc_feature (71): n=t or c
gaatcagctcaacgaacacaggacattcaactacgtggtgtgcagtcctaccgcgaagaaatttgtcgtcntcccggactccacctgctccaagaaggtcc

SEQ ID NO: 8164 - DNA, 101 bp, rice(Oryza sativa)
  misc_feature (71): n=a or g
gaaaaacagatcagtcagatcgtcactgtaaataacatccgcagcaaatagtgttgtagctttctcagccncctcgatttcacttgtataccataagtatt

SEQ ID NO: 8165 - DNA, 101 bp, rice(Oryza sativa)
  misc_feature (71): n=a or g
tttaatgttgtgagagacaatcgctctagattagctggaagcccaagaaccggtggctcctctttcggacnaggaggctatggtggttttggagaaggccg

SEQ ID NO: 8166 - DNA, 101 bp, rice(Oryza sativa)
  misc_feature (71): n=t or c
ttgatttctcaaccgctctctaaagatccacctccgatgacaaaggaggtcaacgttcttgtggatgtatngctggagaagaagacgatagccggcacaac

SEQ ID NO: 8167 - DNA, 101 bp, rice(Oryza sativa)
  misc_feature (71): n=t or c
tgacaacataaagattggcaaaataataaaacttacattggtggcgaccagcaaatggttgcctaggatcnggtagcaagaaaaagatacccacaagaatt

SEQ ID NO: 8168 - DNA, 101 bp, rice(Oryza sativa)
  misc_feature (71): n=a or g
aacactggcctaaggaatccccaccgcccaaacctcttgatgagcatgacatatgtgtccatccttggccnacaacccctctcgagcattttctcaaacag

SEQ ID NO: 8169 - DNA, 101 bp, rice(Oryza sativa)
  misc_feature (71): n=a or g
tttgttactgtctgctggttttcctggctctttggtagctccagaatctctccatccactgccttcaaccntcttggccaaccgctgctccatggagtcga

SEQ ID NO: 8170 - DNA, 101 bp, rice(Oryza sativa)
  misc_feature (71): n=t or c
tttcactctgtaaaaaatcagcaacattgcctcacaacattgcctttcccggctgtcagcactatgacacngcggtccaagcatgcatcgaccaaaggacc

SEQ ID NO: 8171 - DNA, 101 bp, rice(Oryza sativa)
  misc_feature (71): n=a or c
aacaacgattcaataatgttacctcacagactaagtagtcaccaacatcaggagcatatggaagatctagnaactcattttcatacattagttcaaacact

SEQ ID NO: 8172 - DNA, 101 bp, rice(Oryza sativa)
  misc_feature (71): n=t or c
ttgaccttcgagctgaaactaactgttcctcagctccttgagaggtcattccgggtttccgatctttcaanccctcgccctggaaaatgactgcagttgcc

SEQ ID NO: 8173 - DNA, 101 bp, rice(Oryza sativa)
  misc_feature (71): n=a or g
tgccaactgttgttgtaacatacttaatgaacacaaggattgtgctgcctaaaacaggttccactgtcgantgtaaagggaactggtcctgatgggcgcat

SEQ ID NO: 8174 - DNA, 101 bp, rice(Oryza sativa)
  misc_feature (71): n=t or c
catcttctcatatatagtgtaactgttgtatttgtttcaggcaactgaggataatgctctagatggacttncatgttctttggagaaactgaagagcttaa

SEQ ID NO: 8175 - DNA, 101 bp, rice(Oryza sativa)
  misc_feature (71): n=t or c
cataccttgtcatttgcagccatacttaaaatatctagtgaccatgggtctactggattttgttcattctntgaatcatctgaatcaccattttgatcacc

SEQ ID NO: 8176 - DNA, 101 bp, rice(Oryza sativa)
  misc_feature (71): n=t or c
cagagtgactcacagatatggttgcttggtgtttctgaaaccaagctgtcctcaatcgcggtgatggatanagagaagtcggaacttttttcgtgctggga

SEQ ID NO: 8177 - DNA, 101 bp, rice(Oryza sativa)
  misc_feature (71): n=a or g
tggttgttgacgtggtgatgcagctatcctgttttgatcagcctgtctagcatccttggtgaattgctggntgccacggggttgagctggttgtgcagttt

SEQ ID NO: 8178 - DNA, 101 bp, rice(Oryza sativa)
  misc_feature (71): n=t or c
cgtgaaacctgccgttgcgaagcaaaatggagaggttgtgagcagagctaccaaatctgatgcaccagtgnctaaacccaaagttgacccgtcagttcctg

SEQ ID NO: 8179 - DNA, 101 bp, rice(Oryza sativa)
  misc_feature (71): n=t or c
agtgaaaatgatgtgtaaattcaagtaccatgctacagacatccagctcgaaggtgaaagttgtgcactgntgagagatgtcaagcatggataatgctgag

SEQ ID NO: 8180 - DNA, 101 bp, rice(Oryza sativa)
  misc_feature (71): n=t or c
caaattggaaatgatactgttgacgactttgaatagagcttcttatttccttccaaaaatacggcactcgngttttggaaaaagcaatcagttggaattgg

SEQ ID NO: 8181 - DNA, 101 bp, rice(Oryza sativa)
  misc_feature (71): n=a or g
attttcatcgagtttttcacttttcaatttgtaagattttgcactatcagtgtctccttcctccatctccnaggcgtgaaaaccactaagcttatctctca

SEQ ID NO: 8182 - DNA, 101 bp, rice(Oryza sativa)
  misc_feature (71): n=t or c
tagtagtttcatgtcacccatgaagtcaagcaacacatttgcaaaactgtcatctatgacttgaatgatcngaaactttttacagttcataaacaatgctt

SEQ ID NO: 8183 - DNA, 101 bp, rice(Oryza sativa)
  misc_feature (71): n=a or g
gtggcggaagaactcaagaagaagcaagctttcaaggtggcggatctgccgattcgcgccatcgagttcgncaatgtcgacgagatctcaggtgtcactgc

SEQ ID NO: 8184 - DNA, 101 bp, rice(Oryza sativa)
  misc_feature (71): n=a or g
gtgactgaattcatatcttgcatgagtggagaaactcccttgtccatgtaaggatttaccgtgtatgacanggtgacggatgatctctaagatgttattgg

SEQ ID NO: 8185 - DNA, 101 bp, rice(Oryza sativa)
  misc_feature (71): n=t or c
gacctactcccagaaatcaagagttctgtaatagaggtaattaatggtgataagcaacattgcttgcacanaaacattgccttggaactaatggaagagat

SEQ ID NO: 8186 - DNA, 101 bp, rice(Oryza sativa)
  misc_feature (71): n=a or c
ctgtgtggatcttgaaaaacatcagcaaactcatgcactaactgagaaacagcaggtggaactgaatcagnagaagggaagtcagctgtttccagcagtgc

SEQ ID NO: 8187 - DNA, 101 bp, rice(Oryza sativa)
  misc_feature (71): n=a or g
cagatttctgatttagccaggaagatgagcaccctggaaccattggtgcccatcgcaccaaaacttagcgncctgccggaacgcgtcacccaggtgcaagc

SEQ ID NO: 8188 - DNA, 101 bp, rice(Oryza sativa)
  misc_feature (71): n=a or g
cacgaatattgctagttactaatacttggcaaaattattttgtttcactgtagttttgaccctgttaattngattccaggaggccctgatgtgatgaacaa

SEQ ID NO: 8189 - DNA, 101 bp, rice(Oryza sativa)
  misc_feature (71): n=t or c
tcttgaaacaaagaaccatgcaaatccaataaagaaaacttcaagaataaaaatcgcacccgcaaacccanacaagtaaaaccatcttgtttctccctgac

SEQ ID NO: 8190 - DNA, 101 bp, rice(Oryza sativa)
  misc_feature (71): n=t or g
ttccccaccttttcgccgaagcttctctatgagatcctcgcttacttgttcaagatgaagttcctccaganctgctaggtgctcaatgccatcaggaattg

SEQ ID NO: 8191 - DNA, 101 bp, rice(Oryza sativa)
  misc_feature (71): n=a or g
atactaatcgtcaacaaggatgcagcaccattatattgccgaatcatgggctggggaagaacccctgtganttccccgtccctcatcctctccttgaccat

SEQ ID NO: 8192 - DNA, 101 bp, rice(Oryza sativa)
  misc_feature (71): n=a or g
agaggtctcagaatacattgaaccactgtatgatgcactcttctgtccactgacaaatcaggtaatgactnatcctgtgttaacggagagcggtgtgacat

SEQ ID NO: 8193 - DNA, 101 bp, rice(Oryza sativa)
  misc_feature (71): n=a or g
cacaccaagtaacacggacttgccctcgaattgctgccgcagctcagcaaccttcttttctttctcggacnatcgcaacactgattgcaattgacccatat

SEQ ID NO: 8194 - DNA, 101 bp, rice(Oryza sativa)
  misc_feature (71): n=a or g
attgtccacttttgtatcaaaataatttacttcaagttgatacgggggttggattctaatctttcgagggnataattataacacattttttttactgcttg

SEQ ID NO: 8195 - DNA, 101 bp, rice(Oryza sativa)
  misc_feature (71): n=a or g
aaattaatccacaatgactcggtttttaatgtaatcccaagcacaagaacaaaaaaaacacgaatattagnaaagaacctaatatcaaatgtagtaattag

SEQ ID NO: 8196 - DNA, 101 bp, rice(Oryza sativa)
  misc_feature (71): n=t or c
tttcactgtgaattctacaccatacgaacaaattacgcagacagattaaagcgctagctaaacagtttganacctttttgtacatcctcgcaatgccggat

SEQ ID NO: 8197 - DNA, 101 bp, rice(Oryza sativa)
  misc_feature (71): n=a or g
ccaaacatgtgtcgatcatggtgaacctaatctagatcaaattccctatcgaagatgtgcacattattcanaaagtggaggactgacttgaacgcggactt

SEQ ID NO: 8198 - DNA, 101 bp, rice(Oryza sativa)
  misc_feature (71): n=t or c
cctccttccttgcgatcaattgcagctagaatctcatcataagcaaccctttgttcggtgttgagggagtntgataatggtacatcttgagggtctacctt

SEQ ID NO: 8199 - DNA, 101 bp, rice(Oryza sativa)
  misc_feature (71): n=t or g
tccttttgacttggacttaacgtgtacaaggctgccggcaaagtgtattttcctatatggaccaataaatnttgatccttcctaatacccaattcttgcaa

SEQ ID NO: 8200 - DNA, 101 bp, rice(Oryza sativa)
  misc_feature (71): n=a or g
gggcaccaacttccagtgtttcgcgtcaacaggagatgggtcaattgttgttggttcacttgatgggaaantccgtctgtactcgaagagttctatgagaa

SEQ ID NO: 8201 - DNA, 101 bp, rice(Oryza sativa)
  misc_feature (71): n=t or c
catgataatagcttgaattgaaccatctgatgattgctttactttatcacatgctgctaatgtacaggagngtagcaagacaacaagctatatatgtacac

SEQ ID NO: 8202 - DNA, 101 bp, rice(Oryza sativa)
  misc_feature (71): n=t or g
taactgatagagagatccttctttagtgtgaatagacaactcagccaatagttgagcagttctctcatccngcaaatatccttgagaaacttcttccaacc

SEQ ID NO: 8203 - DNA, 101 bp, rice(Oryza sativa)
  misc_feature (71): n=a or g
tagcttcatgctcacgcctagctcgtgcttaaacctgcagagaaggacagagagctaggacatgcatatancgaaattaaaggcctaaaggtgacggaagc

SEQ ID NO: 8204 - DNA, 101 bp, rice(Oryza sativa)
  misc_feature (71): n=t or c
ccgtactattcgttggagttatcgttgtacggctacttcccaacctcaccgctggactatccatcctcacngtcatcgaggtcgtcatcggtgtattctcc

SEQ ID NO: 8205 - DNA, 101 bp, rice(Oryza sativa)
  misc_feature (71): n=a or c
ggtggtactgaagcttgaggaaaaagtactgtagtagatggaatccatgattgcgctggtgctgaatgtgnatcatgatcagatgctgctattggagctgc

SEQ ID NO: 8206 - DNA, 101 bp, rice(Oryza sativa)
  misc_feature (71): n=a or g
gaccttgttggagttacactgggaccaaagggaaggaatgttgttttggagagcaagtatgggtcccctangattgtcaatgatggtgttacagttgcaag

SEQ ID NO: 8207 - DNA, 101 bp, rice(Oryza sativa)
  misc_feature (71): n=t or c
tcaacaacatttgaggcaaatttctgttggctcatctgaatgatctgcccagctagtttttcaataatganagatcgctcatgaggcttcccgtgctccaa

SEQ ID NO: 8208 - DNA, 101 bp, rice(Oryza sativa)
  misc_feature (71): n=a or g
caaagaagcgattagacaaactgatcattttcaccttgattattcttctccaggaatcgcagcagagtgcngcgtatcgatgagaggtatcaacaccatcc

SEQ ID NO: 8209 - DNA, 101 bp, rice(Oryza sativa)
  misc_feature (71): n=a or g
tctattgcaacaaaccaatagtaaagtccagtaatagtcaaaactgtctccatgctgtttgagagagtacncgtgatacagaagagcatgaaccagttaac

SEQ ID NO: 8210 - DNA, 101 bp, rice(Oryza sativa)
  misc_feature (71): n=t or g
ttttattacatcccagcatctctgatagaagaggccagtgaagccgtcaggaccaggggatttctcattcngcatggccttgattgtagcccagacctctt

SEQ ID NO: 8211 - DNA, 101 bp, rice(Oryza sativa)
  misc_feature (71): n=a or g
ccggatgacctcttccagctgcagatcttcagcgaacatcagatcatcagctaccctggaaacctcatccntctttgccaccatagagctgttcccggcca

SEQ ID NO: 8212 - DNA, 101 bp, rice(Oryza sativa)
  misc_feature (71): n=a or g
tccggcgaagcctccccggtcgcaatcgagaacttcccggaagccactaaatcgagcatcagtccgagcancgatgaaccctcactgggaaactactccgg

SEQ ID NO: 8213 - DNA, 101 bp, rice(Oryza sativa)
  misc_feature (71): n=t or g
acaacgaaaaagggatggtgttttaatctccagacaagcaccgttggcagcggcattcgaagccaaatccntcggcgagaatcctctgacgggcatcgacg

SEQ ID NO: 8214 - DNA, 101 bp, rice(Oryza sativa)
  misc_feature (71): n=a or g
acagatccaaggagcacctcagcagaagccttgggcatatatgacatccgatgtgatgagggagaaattcnggctatggcctaaggacagtgggaacttgt

SEQ ID NO: 8215 - DNA, 101 bp, rice(Oryza sativa)
  misc_feature (71): n=a or g
agtgaagagatcggaggccccaaccctaagttggttcttctctcggagcttgaaccggatgacgatggcancggatgagttcatgataaggtttgaggtgt

SEQ ID NO: 8216 - DNA, 101 bp, rice(Oryza sativa)
  misc_feature (71): n=a or g
cgttctcttatatccggaggcaaagagccctccatatggactggaacttgactgaccgataatacaccagnaccttgtcctttggaaggaagcagccagct

SEQ ID NO: 8217 - DNA, 101 bp, rice(Oryza sativa)
  misc_feature (71): n=a or g
gcaacccttcatcatggctgtccatgaaaccaagcttttctgttccagtaaatcaaatataacccttgctnctgcaggttttccgcaaactgagtacatat

SEQ ID NO: 8218 - DNA, 101 bp, rice(Oryza sativa)
  misc_feature (71): n=a or c
ggatttattactgacttgaatgttgctacttcagaggaggcgttagggaacaccaagaactggaatccatntgctggtaatgctaatcggggcagccagcg

SEQ ID NO: 8219 - DNA, 101 bp, rice(Oryza sativa)
  misc_feature (71): n=a or g
gcacaggaaaatactttctcacaatcatcggaatcaaagatcagaacctcaaaacgagaattctcgacgcnacggaacaacaaggagtcattctcttctat

SEQ ID NO: 8220 - DNA, 101 bp, rice(Oryza sativa)
  misc_feature (71): n=t or g
tataaaaatgccactaagatattaagggatgccttccaagcctcggaaacttttgcagacgattttagcangtggttgtatggctatgaggaggaggggga

SEQ ID NO: 8221 - DNA, 101 bp, rice(Oryza sativa)
  misc_feature (71): n=t or c
tattgcagatgccaaattagtcatccgtcctgttgatgaatcgggtccttctcctcatcctgggtatactnttgtttttgaggatttctttgaggctggtt

SEQ ID NO: 8222 - DNA, 101 bp, rice(Oryza sativa)
  misc_feature (71): n=t or c
aattgatactagctcctttaagtcaaactgaacgacctattcttctatcggtatgtccatgtttcttgctntttttttttaactttaaaatacttattctg

SEQ ID NO: 8223 - DNA, 101 bp, rice(Oryza sativa)
  misc_feature (71): n=t or c
tcctatttaacgcgcgcctcgctctcaactcaaggtctcatggatcccacgatgcccactccacatactanttcgggtacttccccttttccacgcaacag

SEQ ID NO: 8224 - DNA, 101 bp, rice(Oryza sativa)
  misc_feature (71): n=a or g
agtatgcacagccagaggtggttgtcctgattggcaggcaacatggttgtcacctgatttttgtaaggccnaagatgagtcatttctgccacaggaactga

SEQ ID NO: 8225 - DNA, 101 bp, rice(Oryza sativa)
  misc_feature (71): n=a or g
tgattggtatactccgtgaagagctggcgaaacacttcccctaccttagaaatggcatctgcaccgagagnagcatacatgagaaagctctcaatgcaaat

SEQ ID NO: 8226 - DNA, 101 bp, rice(Oryza sativa)
  misc_feature (71): n=a or g
gcagaaccagtggtcctgcagatggcaaatgaaagcagtttccagctcagggtcaaataggcatgaccccncatctggggagtcaagggggataacttgca

SEQ ID NO: 8227 - DNA, 101 bp, rice(Oryza sativa)
  misc_feature (71): n=a or g
gagattggaaatagaaatttctctatgcttattgatgagtctcgagatgtatcaataaaggagcaaatggntgtcatcttgaggttagtagttcacatatg

SEQ ID NO: 8228 - DNA, 101 bp, rice(Oryza sativa)
  misc_feature (71): n=a or g
ttggtgtggtgttaacaacctatgtgtatgctacattcaactgcattctcttgctcaatcagtaaattacnaatatgcattcatgcaaaatattttcctta

SEQ ID NO: 8229 - DNA, 101 bp, rice(Oryza sativa)
  misc_feature (71): n=t or c
ttaaaatttagccgggggctcaaaaatctttttgacaccaccactggtactggtagagttcaaaggtacgnaaggccgaggggaggtccggcgccgcggag

SEQ ID NO: 8230 - DNA, 101 bp, rice(Oryza sativa)
  misc_feature (71): n=a or g
taccagaggaaccatacaaatatcatgcgaccgatgaatgaaccttacaaagttcctatgaaaatcatccngaatcttaagatatgcaaacaataattgtt

SEQ ID NO: 8231 - DNA, 101 bp, rice(Oryza sativa)
  misc_feature (71): n=a or g
aagaacctgagccagctcttttcgtgtttttcaccagctttcattatgtacttgtccagatatagtttganaagcttggaccgctcatcttccccaggcaa

SEQ ID NO: 8232 - DNA, 101 bp, rice(Oryza sativa)
  misc_feature (71): n=a or g
gctaactcgtagctgctgttgttttgttgcttgctcttgccacacacagagcttctgggattccagcagcngcggcggcgaggggggtctcatgcatgaat

SEQ ID NO: 8233 - DNA, 101 bp, rice(Oryza sativa)
  misc_feature (71): n=t or g
caagcccagagcttcaccgttccgtcaaacctccaatactgtcttgcataggagatattgctcttacaatnggcgaacattttgagaaatatgtcccatac

SEQ ID NO: 8234 - DNA, 101 bp, rice(Oryza sativa)
  misc_feature (71): n=a or g
ggtgcaaagaaacaaatcatatcttccagcggagaaagcagtactccaaaacatgatgatcaggcattcancatactagaaaattcagctttggagcatgt

SEQ ID NO: 8235 - DNA, 101 bp, rice(Oryza sativa)
  misc_feature (71): n=t or c
aaggtcactacaggggaaactttcgaagatgtgccgatatcacaagaaccaagtatctcaaagtctccctngggcatctcggatgcgacatcaagtggccc

SEQ ID NO: 8236 - DNA, 101 bp, rice(Oryza sativa)
  misc_feature (71): n=t or c
aggtagctgcggagggaggtgaagatggaactgttttcgtcaatcaaggccctcctgaattctcaagaggnggcagcgtcagtggcggctggaaggacgag

SEQ ID NO: 8237 - DNA, 101 bp, rice(Oryza sativa)
  misc_feature (71): n=a or g
agccctccgagaaaaccgaggcaagatcttgttgcatcggtcaaaaccgagatttcttgtctagccagtcncagcgatgctaaagtgttgagaggcagctc

SEQ ID NO: 8238 - DNA, 101 bp, rice(Oryza sativa)
  misc_feature (71): n=t or c
ccatgtcttctcgattgttatcgagaacgaccaagtgagcacgatggcgttgacaaagaagtcgcggactngcggacgacaacgtgagttcatttgagttg

SEQ ID NO: 8239 - DNA, 101 bp, rice(Oryza sativa)
  misc_feature (71): n=t or g
ctcgagaagattgtcttgtccaatacaaacatagagtctcttgatggagtcgacggccttgcaaaattganggagattgacttgaagggtaataagaccat

SEQ ID NO: 8240 - DNA, 101 bp, rice(Oryza sativa)
  misc_feature (71): n=a or g
gtgattcagtctccatagcttctcccactgaagggctgcactgctcgttttccccgatgaagattcacctntttgtcgtattgcctgacgatcacgctgat

SEQ ID NO: 8241 - DNA, 101 bp, rice(Oryza sativa)
  misc_feature (71): n=a or g
caatggtgtcaaatattttgaaacggagagagtagtagctgggcgtcaacaccacactgcttacgctttcngcacaccacactgctgctgtttgcgctttc

SEQ ID NO: 8242 - DNA, 101 bp, rice(Oryza sativa)
  misc_feature (71): n=a or g
ggagcttccaccaataccagatcacctctcagaagagggcagagactttataagacagtgcctgcagcgcnatccatccagccgtccaacagcagtggatc

SEQ ID NO: 8243 - DNA, 101 bp, rice(Oryza sativa)
  misc_feature (71): n=a or g
aagccatgatgctaaggttaaagaattgcttgtttcggtatgcaacggggcagtggagactatggtgaagnccactcaccatgttatgtccaatgccaatt

SEQ ID NO: 8244 - DNA, 101 bp, rice(Oryza sativa)
  misc_feature (71): n=a or c
agctcttcaaatgctctgacacccttctcacctaaagcattatcagagatgttcaagtatctcagtacagngccttctaaagcttttgagaagatgcgcat

SEQ ID NO: 8245 - DNA, 101 bp, rice(Oryza sativa)
  misc_feature (71): n=a or c
tactccagtagctggcaagaaggtgaagtgagagtgtgagaagtaattggagctagcatccatggcgtcancaagcagaagatcgcaccattgctgcctgg

SEQ ID NO: 8246 - DNA, 101 bp, rice(Oryza sativa)
  misc_feature (71): n=t or c
ggtatcctccaatagtctgcgccggctaagttgtacagttggatttcttgcagcaaattgtgaagaaagangagctggtcgaaagatgaaggtatgttatg

SEQ ID NO: 8247 - DNA, 101 bp, rice(Oryza sativa)
  misc_feature (71): n=t or g
gcgttccggactaggaaatcttctatcgaacgcttgtcgaaaacgttcggaagttcaaagtgatcagatangtgttttagcttctgaagacactgagctct

SEQ ID NO: 8248 - DNA, 101 bp, rice(Oryza sativa)
  misc_feature (71): n=t or c
ctggttgaacaaaaggacaaagtccatatgatgctaaacgataatccagataaatttggtcaagtagtgantcaactgatctcatccttggagtttatgtt

SEQ ID NO: 8249 - DNA, 101 bp, rice(Oryza sativa)
  misc_feature (71): n=a or c
agcgagtacgacaagtaatcgctcgacagcttcatcaactcgctggcgacgctcaagctgttcaggagtgngcgatgtagaagaagggcggtgcggcgcaa

SEQ ID NO: 8250 - DNA, 101 bp, rice(Oryza sativa)
  misc_feature (71): n=t or c
ccctggagagaaatattcctctcagatccgggaccaatccatcctgcaaaatctcgcggatgagctcgtcncacctggaacgggctcacggcgtgaggcgc

SEQ ID NO: 8251 - DNA, 101 bp, rice(Oryza sativa)
  misc_feature (71): n=a or g
tagtgctgatgtgcagaatcgcgcagggaagcaagaaaagccttccttgcactctctggtacaaaaactgntggtcaaaaaatacaagttgattcacacaa

SEQ ID NO: 8252 - DNA, 101 bp, rice(Oryza sativa)
  misc_feature (71): n=a or g
ttagatcttaggttagcaaacgctgatcgtcatgcagggaacattttagtgtgcaaggatgaagaaggtgncaattacaagttggttccaattgatcatgg

SEQ ID NO: 8253 - DNA, 101 bp, rice(Oryza sativa)
  misc_feature (71): n=a or g
caagaggttggcgagaagttgaccaaacaaaatcacaaacacaaagtgagcttaccgtacagtgatctgantagtatcttaaggtcctgaattcaaatctc

SEQ ID NO: 8254 - DNA, 101 bp, rice(Oryza sativa)
  misc_feature (71): n=a or g
gggactcgccacccgggcgcccggggttgggcagtttctccttcattctgcacagattggtgaggtttccnttgcaaatgtgttcctgcacaataaatctt

SEQ ID NO: 8255 - DNA, 101 bp, rice(Oryza sativa)
  misc_feature (71): n=t or g
tccggaaagatgctcgcaagagctagttcaagaggctctgcgacggaactcatgcgacaacctaactgtantggttgtgtgcttctcatcagacccaccac

SEQ ID NO: 8256 - DNA, 101 bp, rice(Oryza sativa)
  misc_feature (71): n=t or g
aagctaacggatgatgctgccttcaggccactgtagcttgtgaagccatgattccttggctttgagatcangccagcctgagcgccaaccgaactgatggt

SEQ ID NO: 8257 - DNA, 101 bp, rice(Oryza sativa)
  misc_feature (71): n=a or g
aggcttaccatggagatactcaaaaagtgtcccgtttggagcatactcaaacaccatagctctggtaaaangattctcttcttcacaatagccgagcagat

SEQ ID NO: 8258 - DNA, 101 bp, rice(Oryza sativa)
  misc_feature (71): n=t or c
tcagttggatcgtccggcaaagtcaattttgccttgtgagagaatgccacaacaagcacttggagcacgcncttcaacgggctgctcgccggcgccgccgg

SEQ ID NO: 8259 - DNA, 101 bp, rice(Oryza sativa)
  misc_feature (71): n=t or c
caactcttccttatgcaactacctagtatggctgcctagtcctcaacaaccggtgattgaaagcacatggnaagcatcctgcatagggtgcagagcagtgt

SEQ ID NO: 8260 - DNA, 101 bp, rice(Oryza sativa)
  misc_feature (71): n=t or g
gcactagtccctccacaaaaagcatgagctttagcacttaggaattgaccaagtactccaataacattttnagtctcatgtgctaagtcatgtgttggtac

SEQ ID NO: 8261 - DNA, 101 bp, rice(Oryza sativa)
  misc_feature (71): n=a or c
tcttttgaatccagttcaggtcatgatacttctcgcactagcacctttattagtgaaatgtacatcaaatntatattgcatactttagtatgagcaaatct

SEQ ID NO: 8262 - DNA, 101 bp, rice(Oryza sativa)
  misc_feature (71): n=t or c
aacatttctaaacatatccaaggcagctatcagacatccaaacacaatcagacacatcatcatcttgctgnccatagagaattgcttcgtactgccgcgca

SEQ ID NO: 8263 - DNA, 101 bp, rice(Oryza sativa)
  misc_feature (71): n=a or g
tcgggggtagaatcttcgggcaatgataatcccagttgcaccaactcgagcaccggtgtgcctcccaccantaacgaggttaatgatcctaaagctgatgc

SEQ ID NO: 8264 - DNA, 101 bp, rice(Oryza sativa)
  misc_feature (71): n=a or g
ggtttgacaatatcacttcgggctgttctacttgacaagattcatgccaagtacctcaaggcaatctctcnattacctatgcaagatgttcgggctcgtta

SEQ ID NO: 8265 - DNA, 101 bp, rice(Oryza sativa)
  misc_feature (71): n=t or g
tggtcactaaactcatgggtatcatcaaatgaagaatacccatgttgaactgggtgtcttccaagtttaanacgctcagattcaggagaacgtgagtagcg

SEQ ID NO: 8266 - DNA, 101 bp, rice(Oryza sativa)
  misc_feature (71): n=t or c
cctttttgggtttgcaggttgattggttatcctgtatcaaccgatattctagaagagcatcgcactgacantggctggtaagcaaaatgtatctatgtatt

SEQ ID NO: 8267 - DNA, 101 bp, rice(Oryza sativa)
  misc_feature (71): n=t or g
tgtttcattcgtatctccagagggtgagttcacatatcttggtcgaaattcaacaaatgatggttctctcngtaaaacgactgctgcagcacgagtcagaa

SEQ ID NO: 8268 - DNA, 101 bp, rice(Oryza sativa)
  misc_feature (71): n=a or g
gttcccgctgtcaaggagcacagcaactggggaactggcgattgtattgtttacaatattggtagaccatncaggagattcagaatgattcactaggagaa

SEQ ID NO: 8269 - DNA, 101 bp, rice(Oryza sativa)
  misc_feature (71): n=t or c
ctagatccaagacgaaatggaagacactgcatctttacctctctcaaagcttggccctgcactgacggggntccggacgggcacgggaccaacactgagct

SEQ ID NO: 8270 - DNA, 101 bp, rice(Oryza sativa)
  misc_feature (71): n=a or g
gtcgtagatgaggaaccgcgctatcgctaatcttctgctagcttcccattccttgcttctctgcagtgganctccaataggtttacctcaccaatatctgc

SEQ ID NO: 8271 - DNA, 101 bp, rice(Oryza sativa)
  misc_feature (71): n=a or g
ctgctcctgaagcctgcgtgcaaactcctcatcggattcaatttgtctggttcttaactgattctcatcangaagtgggtagttgagccccttgatcctcg

SEQ ID NO: 8272 - DNA, 101 bp, rice(Oryza sativa)
  misc_feature (71): n=t or c
aaggacgagaaggttgcgaaacctaaggatgccaaggatctcaccgacttcatggaaaaaaactacgactngatcaaggacgtgacaagcttcgaagattt

SEQ ID NO: 8273 - DNA, 101 bp, rice(Oryza sativa)
  misc_feature (71): n=a or g
caacagagatcaccacaacagcaggcaggtggatagggaatgcacacaaccttcaattgcttccatggcgnattactcggttacgcatcagaattgcagaa

SEQ ID NO: 8274 - DNA, 101 bp, rice(Oryza sativa)
  misc_feature (71): n=t or g
aggttgatggtaaagcatacttcaatagatttttttttgtgcccttaagccttgcattgatgggttcttanagggttgtaggccatacattagtgtagact

SEQ ID NO: 8275 - DNA, 101 bp, rice(Oryza sativa)
  misc_feature (71): n=t or c
ccttttagaaaggaacctctctacccatctaaatctcaaattatgttcactatgtgcatctgtttcagtgncactttcaagtcttgggcatccaagtaaaa

SEQ ID NO: 8276 - DNA, 101 bp, rice(Oryza sativa)
  misc_feature (71): n=a or c
aaggacgagcatggtgtctaggagctggagaaggctttggagatgctacccaaatcttgtcttcaccaganaaacaatgctccatggcagcataacagctg

SEQ ID NO: 8277 - DNA, 101 bp, rice(Oryza sativa)
  misc_feature (71): n=t or c
atccatggtttatacatgtgtggtgtttcaattgcaaaaacactatgttctacagtccgtagatacagaanaccatgaagtaggacatgtggcattgaaat

SEQ ID NO: 8278 - DNA, 101 bp, rice(Oryza sativa)
  misc_feature (71): n=t or c
gaaaacaattgctctccagtatgtgccctcagaactgcaagtcgcggactttttctctaaagcacaaactngtgagcagcatcgtcttcacttgctcaaac

SEQ ID NO: 8279 - DNA, 101 bp, rice(Oryza sativa)
  misc_feature (71): n=t or c
ctctctttctctttcatcatttcctatggagaggtatggtgaaataatgaggtatgtctgcttcaccttgnctttgctggtattgcccatttttctgattc

SEQ ID NO: 8280 - DNA, 101 bp, rice(Oryza sativa)
  misc_feature (71): n=t or c
tctcgtcgtagattaagcctgttctcaaagttcaatagctgggcatatgtttctgatagagtaataggttnagttttggccgctaaagccgatacaacaga

SEQ ID NO: 8281 - DNA, 101 bp, rice(Oryza sativa)
  misc_feature (71): n=t or c
gcttcccgcggtactctgatcacgggcatgctgttcttctatctggttcttggaattttggcaggatatgngggtgttcgtgtgtggaagacaatcaagtg

SEQ ID NO: 8282 - DNA, 101 bp, rice(Oryza sativa)
  misc_feature (71): n=t or c
tccatcctcgtcgtcgtaattctccatgtcaagctcgcggaggccatcagcaatgtaatcaacactacaancatcgctctgcagagccacctcgtcctcct

SEQ ID NO: 8283 - DNA, 101 bp, rice(Oryza sativa)
  misc_feature (71): n=a or g
ccggcaatcgtaatagtatgggtcgttcatcgtgccatgcaaatccggcttgttgtcggcgttgttcagcntgcggcgccgaccgccgccggcgggggaag

SEQ ID NO: 8284 - DNA, 101 bp, rice(Oryza sativa)
  misc_feature (71): n=t or g
tatcccaaaggaagcttcttccatcttccacgcgcattcacagttatcatcaagcgtacaatctggcaagncttgtagccaagtgccatagtacgggatcg

SEQ ID NO: 8285 - DNA, 101 bp, rice(Oryza sativa)
  misc_feature (71): n=a or g
ggtgtgtgcgtgtggtgtgtcaagcaggttcgcctactcgagggaggagtgtgaggatgacacggagcacnatgacgaggacgatgacgtggaggacacgc

SEQ ID NO: 8286 - DNA, 101 bp, rice(Oryza sativa)
  misc_feature (71): n=a or g
attatggcgggcttggcattgcagaaatgaaattatccatggcaaggagatgagccctatagcaagctctntcaactttttgatgaactacgaagattgca

SEQ ID NO: 8287 - DNA, 101 bp, rice(Oryza sativa)
  misc_feature (71): n=t or c
tagtactgtagttgagagtatatatatatagatcagtggcagtgtgcacaccatgtccattggtcgtcttngtcttcctcctgcaagcggcacgaagctgc

SEQ ID NO: 8288 - DNA, 101 bp, rice(Oryza sativa)
  misc_feature (71): n=a or g
gtataattcttgtcagcttcacaatctttgtcgtagaaataagcctggtgaaacttggccacaaagtaaancttttaaagtgccaaatgatgaaagcatag

SEQ ID NO: 8289 - DNA, 101 bp, rice(Oryza sativa)
  misc_feature (71): n=t or c
gcaaacaaaagcaccaaagaggatgaatgggctggttcggctgcgatacagccgtctggaaacaatgctcngtgtaagcaaccgtggcaacaaaactgtgt

SEQ ID NO: 8290 - DNA, 101 bp, rice(Oryza sativa)
  misc_feature (71): n=t or c
ttcaaaagtgctttgccattacctttaccgccgactcggggaatgcaagttgggatggtgtctagaacagnagatcacaagggaaatgacaattccaaaat

SEQ ID NO: 8291 - DNA, 101 bp, rice(Oryza sativa)
  misc_feature (71): n=t or g
agctagacttcacaatatactgttgattttttttcttttgtgtttgtacatgttaaacgcagaaatcttcnagggctcactctaaacagtctgtggattga

SEQ ID NO: 8292 - DNA, 101 bp, rice(Oryza sativa)
  misc_feature (71): n=a or g
tcgtgggacagggacattccttgatctgtacagcctcttcaaacttgcattcaagcatttcgatgatccantaacgcacaaggtacccctttcacaatctg

SEQ ID NO: 8293 - DNA, 101 bp, rice(Oryza sativa)
  misc_feature (71): n=a or c
caggaaatctctgagaatggtaaaagttctctagaagaaacaggcatatcaaatgaagcgacggattgtanaggcccagaaccggaatctgctgctaattc

SEQ ID NO: 8294 - DNA, 101 bp, rice(Oryza sativa)
  misc_feature (71): n=a or g
caggtggcgatcggcttgctcgtgtcgcagttcttgtagtccgacttgctcaccgccatcacgttgtgganctgcttgttgtacgtgaagactgcacggct

SEQ ID NO: 8295 - DNA, 101 bp, rice(Oryza sativa)
  misc_feature (71): n=t or g
aactctcaaggcagcaaggtgaagaaaggaacatcaacatcatctcctgtaagaaggtgcatgatgcattngcgcccatagatgtcatcaacgtcggtggc

SEQ ID NO: 8296 - DNA, 101 bp, rice(Oryza sativa)
  misc_feature (71): n=t or g
ttggagtatgccaagagtggcaagcttttccacaaaatggctagggcaaagctcaatgaggagtcggcganaaagtattttcaacagttgatctctgcagt

SEQ ID NO: 8297 - DNA, 101 bp, rice(Oryza sativa)
  misc_feature (71): n=a or g
aaatgctgaaggtccaccagggatgtcagaaatatccaactcttcattgccttccacattgcttgaagcanctaatctttgcaggcaggaactctttgaca

SEQ ID NO: 8298 - DNA, 101 bp, rice(Oryza sativa)
  misc_feature (71): n=t or g
gaaaggcgagcgcatgaaagggaagaggtggtctacagggcatggatggttggtggtggtacagatgacanggcgacaacggaggttatggacttgtggtt

SEQ ID NO: 8299 - DNA, 101 bp, rice(Oryza sativa)
  misc_feature (71): n=a or g
gccgttggagccgttgccggagtggttctctgcttccagcttctcgcatcgtgcgtcccattgctcctcantgaggtacagcaacgctggtggctcctcgt

SEQ ID NO: 8300 - DNA, 101 bp, rice(Oryza sativa)
  misc_feature (71): n=a or g
ggcgagggagcggcggcagatggaggagatcctgcagctcgatatggaggagctcaacgtggagatggtcnacgacgacggctcctcctccgaggaggcga

SEQ ID NO: 8301 - DNA, 101 bp, rice(Oryza sativa)
  misc_feature (71): n=t or c
ggagacagcgccggtggtggaggagtgtacgctgctgtgagctgctcgacatcaatgggctgccactgaangggttgttgcggcgtgccttgggcagcccc

SEQ ID NO: 8302 - DNA, 101 bp, rice(Oryza sativa)
  misc_feature (71): n=t or c
tttgcgtgattgtcaggttcctctgacagcaacatttgcagattatcagcccaatggacaaacaccaattncttgtacagacaagaaaatcactcctacag

SEQ ID NO: 8303 - DNA, 101 bp, rice(Oryza sativa)
  misc_feature (71): n=a or g
ctatgatttgtattcataggtccatacaaagaggcgcaacaagctactttatgataggatgagagatattntctttgtcaaattgaactccaaattaataa

SEQ ID NO: 8304 - DNA, 101 bp, rice(Oryza sativa)
  misc_feature (71): n=t or c
atcaccaccgccgtcagcatgggaggaatcgattgggacttgcgattcgtcttcctcattgtgtgcgtcangatttcgccttttgcggtggcaacggcttg

SEQ ID NO: 8305 - DNA, 101 bp, rice(Oryza sativa)
  misc_feature (71): n=a or c
gaggagttcaagccagagaggtttgccgagggtggcatcgacttctatggtagcaactatgagtacacgcnattcgggtcaggacggaggatgtgcccagg

SEQ ID NO: 8306 - DNA, 101 bp, rice(Oryza sativa)
  misc_feature (71): n=a or c
tatagcattttatttgatggtctctcaagaaatggtgactcaaaggcaatgctttcattgtttggaaaatntttgaagaatggagtgacaattggagatta

SEQ ID NO: 8307 - DNA, 101 bp, rice(Oryza sativa)
  misc_feature (71): n=a or g
aatgatgaagaagacctgttattgaggggcaattacttggcagcaatctctccttgcgttcttcctacagntgtgtctcagggaagaaaatctttctctta

SEQ ID NO: 8308 - DNA, 101 bp, rice(Oryza sativa)
  misc_feature (71): n=t or c
tgatgactagcacctctgagattagcccttttttttctcccaattcatgaaggtattcagatacaagttgncctatatcatagtgacctccctcagagcct

SEQ ID NO: 8309 - DNA, 101 bp, rice(Oryza sativa)
  misc_feature (71): n=t or c
tttacaatggtccattcattatcttgctcagcttgccagagatcccatttccgtctccaatcaggacctcnattcttccagagaaaaaaccgaaccgagaa

SEQ ID NO: 8310 - DNA, 101 bp, rice(Oryza sativa)
  misc_feature (71): n=t or g
atttttatttccctacccccataggacaaatacccacttttccaaggctgcatccttttttccaccctttnaatgatcaaacaaaaatctttcatggtgat

SEQ ID NO: 8311 - DNA, 101 bp, rice(Oryza sativa)
  misc_feature (71): n=t or g
aagcgaccagaacagaaatccacggttttatggctagagagtcggggaatcaccggatcgaggctgaggtncttgcagagcgcgtaggccatggcccgctt

SEQ ID NO: 8312 - DNA, 101 bp, rice(Oryza sativa)
  misc_feature (71): n=t or c
tctcgacgtccggcgggaaatggacgattccccgctagataatctgtttgatggaaatggattggattcancggcaggcgcggacagctctagctccacgg

SEQ ID NO: 8313 - DNA, 101 bp, rice(Oryza sativa)
  misc_feature (71): n=t or c
tacaacgatgagaggattgaacagaaatttgatatcaaagcctgggtctgtgtctgggatagatctgatgncgcagagctaacaagggagatattgcagtc

SEQ ID NO: 8314 - DNA, 101 bp, rice(Oryza sativa)
  misc_feature (71): n=t or c
aggggtcatggcaattgaaagatacatcagggggaaagttccatctattgttgagttaactattcgtgagncttgtacgtggtgccatgatcttgaacgct

SEQ ID NO: 8315 - DNA, 101 bp, rice(Oryza sativa)
  misc_feature (71): n=t or c
ctgtcccggtcacaagcacatgtttctgaacttgccaatcgccatgtttgcaatgcatcaaaaacacaaangttcaattacgctacacagagcaacaaagg

SEQ ID NO: 8316 - DNA, 101 bp, rice(Oryza sativa)
  misc_feature (71): n=t or c
acagggaaattttaccttgttgactcgggctatccaaatcgactaggatatctatctccatataaagggancaaataccatttaccggaatttcgagaggg

SEQ ID NO: 8317 - DNA, 101 bp, rice(Oryza sativa)
  misc_feature (71): n=t or c
acaaaactcgtgggtttagatggcttgggtgactctgggtcaagccttatatctcggataaaagctgctgntaggaaataataccaagccaagatgttgga

SEQ ID NO: 8318 - DNA, 101 bp, rice(Oryza sativa)
  misc_feature (71): n=a or g
cattgaaaaatttacaggtacttgccaactaaaaacaacagaaggatgagagaaatcgatcgagaggtccncaaaattctgcttgaaataattggaaacaa

SEQ ID NO: 8319 - DNA, 101 bp, rice(Oryza sativa)
  misc_feature (71): n=t or c
agtgtatgaaccaccaaggttcatgtctgtaaacaccgcaataagtcagcttttggaggtggaggaactgngtgggggatctggtattctcatggaatctc

SEQ ID NO: 8320 - DNA, 101 bp, rice(Oryza sativa)
  misc_feature (71): n=a or c
ccactttcagtggtgccttcgccatgatgtccttgaagggcggatccatcattcttcttagaagcagaacntttctttgcaaataagggagtagttgcacc

SEQ ID NO: 8321 - DNA, 101 bp, rice(Oryza sativa)
  misc_feature (71): n=t or c
ctaccgaatcaacaacatcctcaagctgctcaattccagcaacaggcaaagaaatcgtcaacaaagactangtgtgtacagatggacgctcggcgcagacg

SEQ ID NO: 8322 - DNA, 101 bp, rice(Oryza sativa)
  misc_feature (71): n=a or g
gaaagtacatggaatccctgctgaagcaaagacagaggatgcactgagagctctgattgaattagtggggnattataaagatattgatggtcgcagtttaa

SEQ ID NO: 8323 - DNA, 101 bp, rice(Oryza sativa)
  misc_feature (71): n=t or c
ccatgaatcgccaaaaacaatttcttccttacacgccagaagctccatttccagtgcatcatagcaccttncaaaaaatctgcaggaagaaaagatgacag

SEQ ID NO: 8324 - DNA, 101 bp, rice(Oryza sativa)
  misc_feature (71): n=t or c
gcctgagcctacatgttttattttaagtggacatcgccaacagagaaaggactatagatcaatacttcggngcctgaaggcacgagtttgcagggattcac

SEQ ID NO: 8325 - DNA, 101 bp, rice(Oryza sativa)
  misc_feature (71): n=t or g
taaacatgtaacaaaacaattaacttgtgcaaatgatactgcaggttttgactgatcctatatgcttctgncacaccctaaaaatccaaaatatataaatt

SEQ ID NO: 8326 - DNA, 101 bp, rice(Oryza sativa)
  misc_feature (71): n=t or c
gcaagcctaaactatgttttggtctttttatcatctagtaacatctatcctgatactttttcttgctaggnaaatgaagatacaaattgctattcctttga

SEQ ID NO: 8327 - DNA, 101 bp, rice(Oryza sativa)
  misc_feature (71): n=a or g
aacagcaaaaagaggaaaggcaattctaagcccaataatgatagcggcagcaaaaccgcctgctacaggtntggttgctacaatcatattgctaagaaatg

SEQ ID NO: 8328 - DNA, 101 bp, rice(Oryza sativa)
  misc_feature (71): n=t or c
gaaaacaagattgataagtttgcttaaatgcctaaactccattgaccctaaatcttcaaagatagcatcantgaaagatgaaatatccaatagatcagaaa

SEQ ID NO: 8329 - DNA, 101 bp, rice(Oryza sativa)
  misc_feature (71): n=a or c
tccatctcttgcataccatggcatcaaatgactcgacgcactctgcccagagttcgacccacgtgtactcnacgaggagcgtgctctaggaagtcgtcgtc

SEQ ID NO: 8330 - DNA, 101 bp, rice(Oryza sativa)
  misc_feature (71): n=a or g
gtctgccaatgatgaggaagcgatagataaggatagcattattcagaaggcagatgatttagcagttaggnttgaagaggagctgttcaaactatttggtg

SEQ ID NO: 8331 - DNA, 101 bp, rice(Oryza sativa)
  misc_feature (71): n=t or g
ccgcccagcgcgcgcgctgccgcgacaaaggaaacggggtcacttttccgccggcaaaagcatcggaattncggggatctgacgagcgaggccgagctcag

SEQ ID NO: 8332 - DNA, 101 bp, rice(Oryza sativa)
  misc_feature (71): n=a or c
ctctcaattattctaaatatgttcacgcaggagacaagtacctaaagcctgaagtcatatgtgagccaganatcaccataaccgtgaggaccgtcgacgac

SEQ ID NO: 8333 - DNA, 101 bp, rice(Oryza sativa)
  misc_feature (71): n=t or c
cagctggaagccgctaaattagaagctgccactgtggctgtccagcatgatctgcaggataaacttcaggntgcagagaaggaaaacaagggcctgaagat

SEQ ID NO: 8334 - DNA, 101 bp, rice(Oryza sativa)
  misc_feature (71): n=t or c
ttcagctaagaaaccatacagttgccttttcccaccaggtatgacgatcctatgattcaaccacgcatacntgtctgttctttgatcaacaaagtgattat

SEQ ID NO: 8335 - DNA, 101 bp, rice(Oryza sativa)
  misc_feature (71): n=a or g
gttgaggcaggacttggagatctccgtggaggtgttaatgtttttgcagatggaggagttgaaggtctccntgatggtgttggtggttgcaatgcaaatgg

SEQ ID NO: 8336 - DNA, 101 bp, rice(Oryza sativa)
  misc_feature (71): n=t or c
cgcatctcctctggaagaggtgcttggagtcaacttgttctgaactaccacaagtaatacatccagccagntagcagactgaacaagcataacagaatctc

SEQ ID NO: 8337 - DNA, 101 bp, rice(Oryza sativa)
  misc_feature (71): n=a or g
aatgtcaaatttcgttccattgtgaagaaattttgccacatttgcattaccattggcttcaaacaaaaccnttatattttcaatacttgtgaattgccatc

SEQ ID NO: 8338 - DNA, 101 bp, rice(Oryza sativa)
  misc_feature (71): n=a or g
atgggattcagcagccgcctcctcatggttgacgagaagattctcaagcgccttgcacgcaccagatcgtncagccatcagcagctgcggatccataatca

SEQ ID NO: 8339 - DNA, 101 bp, rice(Oryza sativa)
  misc_feature (71): n=a or g
gatcgtaggcggctggagaaggaactcgacgtcgatgggggagaggcgaatgagattgcagctactagccnttgatgctgtgtttggccagccaaactagc

SEQ ID NO: 8340 - DNA, 101 bp, rice(Oryza sativa)
  misc_feature (71): n=t or c
atatatgggtatgaccatcaggctggaaaattaagctctcgtagtacgggacatgatgatgtactgcaagnatctcatgcggatagccctttaagtcaatt

SEQ ID NO: 8341 - DNA, 101 bp, rice(Oryza sativa)
  misc_feature (71): n=a or g
gcaggtctcccaccaaatttacctatccgactacctaaacacgccgaggaggatggttatgctgctgaagnaattcctctcagatctgctgctgatggcat

SEQ ID NO: 8342 - DNA, 101 bp, rice(Oryza sativa)
  misc_feature (71): n=t or c
cacgcgtcctcgtggacgatggcgtccgtgagaagacggatgatgcttgtaagatgtgcccgcaaggagangaggctgagctcatcatcatcatctcgccg

SEQ ID NO: 8343 - DNA, 101 bp, rice(Oryza sativa)
  misc_feature (71): n=a or c
ctcaagaacctggtgtgtgggaatggtcaacctggtggtgatgaccatggggaaaagcatgatgactcgcntggagatcaggtgccccgccttaacgaggc

SEQ ID NO: 8344 - DNA, 101 bp, rice(Oryza sativa)
  misc_feature (71): n=a or g
cctatcgtgtacctccatggccttgtccattgcttgacccttgcatagggcagcaataatggagctgtaantcacaacatttggcaaaatcctccggtcaa

SEQ ID NO: 8345 - DNA, 101 bp, rice(Oryza sativa)
  misc_feature (71): n=t or c
gttatcactgccatctcttgcattaagtcccatgattacaccatcgtcgtcatcatcgtcattgctgccantgttattattggattcatccccactttttg

SEQ ID NO: 8346 - DNA, 101 bp, rice(Oryza sativa)
  misc_feature (71): n=a or g
tgtggggagagggtaggcggtgtggtaccaaagggcgttgaggatatgatgttggagacggggtccaaggncacgacgagggcgcggaggaggcggccacg

SEQ ID NO: 8347 - DNA, 101 bp, rice(Oryza sativa)
  misc_feature (71): n=t or c
atggcaaggcaaaggcgcaaggacgttaatgacggccaaaccggcctctccaagaccaaactagctacacnctgtcctggatccaacaagttgggagcagc

SEQ ID NO: 8348 - DNA, 101 bp, rice(Oryza sativa)
  misc_feature (71): n=t or c
aaattagtaggagtacgaattaataactaacctgcgcagttagtccctgcgtgtaacggattgccacattnttttgcaacgttaacccactttgacaaagc

SEQ ID NO: 8349 - DNA, 101 bp, rice(Oryza sativa)
  misc_feature (71): n=a or c
aatactgagatgacggattaaagtattgtatgtgataacggtagctacaaactctttgcttctcagcaganaaagcgctttatgaagtctccccaatttac

SEQ ID NO: 8350 - DNA, 101 bp, rice(Oryza sativa)
  misc_feature (71): n=t or g
gcatggcacaactgaactagagttgacgtcatcaggagaactcctcccaatcacctcgcccttggccatgnccacggcaagaacctcgtggaggaatatca

SEQ ID NO: 8351 - DNA, 101 bp, rice(Oryza sativa)
  misc_feature (71): n=a or g
cccatttatgggtgaagttgttcaagctttgaagttggtatgcgatgaaggcagcgagttcaatgaatcangaagtttcagccaagatttacatattcagg

SEQ ID NO: 8352 - DNA, 101 bp, rice(Oryza sativa)
  misc_feature (71): n=a or g
cgaaaattactttgtaacatttattgtccactttgtccatagatcccgtcaatcccttacgtagcaaatcngttcgacgacacaattatatggaacatgtg

SEQ ID NO: 8353 - DNA, 101 bp, rice(Oryza sativa)
  misc_feature (71): n=a or g
tacaaccatgggatcctgtacagtttcctccgttgtcacggttttctcatcttcaaccatgggctcctgtncggtttcctcggttgtcatggttttctcat

SEQ ID NO: 8354 - DNA, 101 bp, rice(Oryza sativa)
  misc_feature (71): n=t or c
tttgaccgagggagtatgcaggtatatgcgtaccttgtccaggaactggcaaaccgccggaaaggcccagncatggtcctgaggagacgacttggacagcg

SEQ ID NO: 8355 - DNA, 101 bp, rice(Oryza sativa)
  misc_feature (71): n=t or c
tgtgacttcttttcccgaatcacaagctctggaaaataatctctcaatctctaccatgcctgtatataggnccttcacagatatgcttaaataaggatacg

SEQ ID NO: 8356 - DNA, 101 bp, rice(Oryza sativa)
  misc_feature (71): n=a or g
tggcatgttggcccttgcgtcacatggcggccaagcacgagggaagagtaggcacagaactgccgtaatcnccacccgtcgggtcattgcatcaccgtcgc

SEQ ID NO: 8357 - DNA, 101 bp, rice(Oryza sativa)
  misc_feature (71): n=t or c
gatgagcaccgccacttgaagcaggcgtcaacaagtgtattgtaagtcactacatccggcaacgcggtgcngagccgttccatctcatccttcagccggaa

SEQ ID NO: 8358 - DNA, 101 bp, rice(Oryza sativa)
  misc_feature (71): n=t or c
acggcactgttccgtagcaccagatattctttcgttgcgaaccctagtcggtgggcctaacagaattaccngcattcagaggggcctaggtgaaaaagcgg

SEQ ID NO: 8359 - DNA, 101 bp, rice(Oryza sativa)
  misc_feature (71): n=t or c
gccgccgggcggagtcagagcagcggtggatcttgctcatcgatgcagcgcggtcgacgccgctcgacacngatctagctgcgaggggggaccagatccgc

SEQ ID NO: 8360 - DNA, 101 bp, rice(Oryza sativa)
  misc_feature (71): n=a or g
ttgggtgggcagtatggaatacatgactcttggtgggactgtgggcgaagtcaaactgtcaaaggatgcanaccaagccttgctaaatgagttgccagatg

SEQ ID NO: 8361 - DNA, 101 bp, rice(Oryza sativa)
  misc_feature (71): n=a or g
acacaccaaaatatacgagtccacatcaagcaggttgaatagagaaatggatctgaatatggagccacagnatgacgacaattttactgatgagatggaat

SEQ ID NO: 8362 - DNA, 101 bp, rice(Oryza sativa)
  misc_feature (71): n=t or c
aaacaaggtcaatcatgtgaagactactctaaaaggcaaagaagtaatggcctcaaccactgtcaagcgcnctagagggaggcccccaaaacgaggaaagg

SEQ ID NO: 8363 - DNA, 101 bp, rice(Oryza sativa)
  misc_feature (71): n=a or g
ggtcttactagtgctccagccacctttcaaggggtgatgaatagcattttgtcctcgctcttgcggcgctncgtcttggttttcatcgacaatattctgat

SEQ ID NO: 8364 - DNA, 101 bp, rice(Oryza sativa)
  misc_feature (71): n=t or c
ctcctcaatgccatcctcacccttaccagatttctcctcttccacagcattggcttcatccacagggccancggcgcctggctccgcctcgctttccacag

SEQ ID NO: 8365 - DNA, 101 bp, rice(Oryza sativa)
  misc_feature (71): n=t or c
tgactgatggcatcaccttttcttttcttggcaccattactctttttcgtggtgtcatcatttaactcacnatttgggtattttgtttcgtcaacatcttt

SEQ ID NO: 8366 - DNA, 101 bp, rice(Oryza sativa)
  misc_feature (71): n=a or c
tcatctctcaatccatttttacttaatttccccccacttccccttttgcagaaaaagccggggcttagcgngtacgccaataacccgcaggaggctgccaa

SEQ ID NO: 8367 - DNA, 101 bp, rice(Oryza sativa)
  misc_feature (71): n=a or c
ctgttacttgcccttggtggtgtcaccaccatgcatgtgcctaaacaagatgtgccatcatccctggaggnactcacccttgatggccatttcagcttcca

SEQ ID NO: 8368 - DNA, 101 bp, rice(Oryza sativa)
  misc_feature (71): n=t or c
gcaagcagggagtatgctagccacagtcactgcatcaggactctcgctctcgcacatctcgcaaaaaatgntcaaagcctcgtcatacctcgcattctgca

SEQ ID NO: 8369 - DNA, 101 bp, rice(Oryza sativa)
  misc_feature (71): n=t or c
gaaactactcttctctgaaaaagatttcgggaatatggtcaacgaacaattttctgggcttcttgatgaantttttgaagcgatgttcattgccacgtatt

SEQ ID NO: 8370 - DNA, 101 bp, rice(Oryza sativa)
  misc_feature (71): n=a or g
gcgcgtcaagaaggtgtgcaacttcaagatctcaaactggacgaatgattgcaatgaagccatgagtagtnttttcagacaataccaagagattgacatct

SEQ ID NO: 8371 - DNA, 101 bp, rice(Oryza sativa)
  misc_feature (71): n=a or g
atgctagtgtggttatgctcctcagctactttcctgtgcttccttgtccaatcaggatggctccataaatngagaggtggtgcagaggcattccacccttc

SEQ ID NO: 8372 - DNA, 101 bp, rice(Oryza sativa)
  misc_feature (71): n=a or c
tttttctctcctctttaatgtaaatgttttggagaaagtgtatagctatctcttgcatgagccaacacttntcgcttttctttatctctctttagtataag

SEQ ID NO: 8373 - DNA, 101 bp, rice(Oryza sativa)
  misc_feature (71): n=a or g
attagaagggagctatttacctgaaatgcttttggacatctaccatttgacgctgcaaagcaaccaaggtnacatgataattcctgccaaaaaaaaaattg

SEQ ID NO: 8374 - DNA, 101 bp, rice(Oryza sativa)
  misc_feature (71): n=t or g
atcaaccggtaagctttttgaaggagctaggtgagcttaccaagctgagagtactagcggtatcttggatncctgaccatgttagagattctgatgaggcc

SEQ ID NO: 8375 - DNA, 101 bp, rice(Oryza sativa)
  misc_feature (71): n=t or c
catatagctctgtaagaaccgttgtgaagcctctatcgaagggctcggtttcccatgtatgatctcattanggacgaaccaaattcgccacagaaccataa

SEQ ID NO: 8376 - DNA, 101 bp, rice(Oryza sativa)
  misc_feature (71): n=t or g
tttggccttgtaaaggtttgcagtgctggttctccaatactggaactcaatagtttccgtggaggaaggtngacagagctacaaaatgatataagttttgt

SEQ ID NO: 8377 - DNA, 101 bp, rice(Oryza sativa)
  misc_feature (71): n=t or c
accccatcctgcccagttccccatcaatccccgtccggcagcaagtgtgacaaggcaacaaaacgagctgncattttccgtacctggatacatacatgcac

SEQ ID NO: 8378 - DNA, 101 bp, rice(Oryza sativa)
  misc_feature (71): n=t or c
ttcattgtgataaccttaatggtgagatcctgaacaaccttttcaatttcttgtgatgcaacaatggcctnacgtgcttttgtttcagtgttatccctttg

SEQ ID NO: 8379 - DNA, 101 bp, rice(Oryza sativa)
  misc_feature (71): n=a or c
cttatgcattatcttgatagccaactcaacctcccattcttgtgaccacttgcgtggcatcttattctttntctctctttcccatgtccatccccaagcat

SEQ ID NO: 8380 - DNA, 101 bp, rice(Oryza sativa)
  misc_feature (71): n=a or g
caacagaaacacagaacaatgtgcagcaaacagaagtgctcacctacagaggggaacatggcaagtttcangtgcagagcacatgcgagaatgcagctcaa

SEQ ID NO: 8381 - DNA, 101 bp, rice(Oryza sativa)
  misc_feature (71): n=t or c
tcgggccacaccatcgaccagcttcacaacctcacacaatgtccatgctcgatgatgcttccgcttcccancccgctttgttttgggattgtcatcagagt

SEQ ID NO: 8382 - DNA, 101 bp, rice(Oryza sativa)
  misc_feature (71): n=t or c
ttttctataagaccagctaccacctcggcattcatatgatcatgcaagaagtgctggagatggctctcaanagggaaggcctcaaaaaggaacttcttgta

SEQ ID NO: 8383 - DNA, 101 bp, rice(Oryza sativa)
  misc_feature (71): n=t or g
atttttctttaccatgccagtcttggatttgatggctccgatattattcaaacatgcgtgtatatgaaggnttgaacttggagtctttcggataaccatcg

SEQ ID NO: 8384 - DNA, 101 bp, rice(Oryza sativa)
  misc_feature (71): n=t or g
tcatgaactggcaatgcatgtgctgtatcagctgcacagtgtgagtgttgctgattcaccagaaagcaccntacctgcttctaaaaattatgagaacttct

SEQ ID NO: 8385 - DNA, 101 bp, rice(Oryza sativa)
  misc_feature (71): n=a or g
tgaattatcatgtgaacatggtgacatcacaggacatgaggattccgaaatgtatgcgccaccggaatgcnaaaccgatgtgcagaaagagagttgctgcg

SEQ ID NO: 8386 - DNA, 101 bp, rice(Oryza sativa)
  misc_feature (71): n=a or c
ctcgcgaggtgatggctgccaacctgatgcttttgagctccctgcaacaggcgaagaacctgatgattgcnatgctgaagcttttctgcccacatcaggag

SEQ ID NO: 8387 - DNA, 101 bp, rice(Oryza sativa)
  misc_feature (71): n=a or c
ggcggaggcgacgaaatcggcgaggccgtgggcgaggaaggtggtcttaggatccatctttaacgcgaagngaacggcgtcgccgactgccttggcgacgg

SEQ ID NO: 8388 - DNA, 101 bp, rice(Oryza sativa)
  misc_feature (71): n=t or c
tcacgtggagcaagtcgagggtggagcagcgctgatcggtgactatggcttgatggaacttgggtatctcnatgccatcagcggtgcgattcatggtggcg

SEQ ID NO: 8389 - DNA, 101 bp, rice(Oryza sativa)
  misc_feature (71): n=t or c
cttgggccaaatggaggaaaaccacgaggcacaccaaaaggatcaggcataccaaaaccaccaccaaaacnaaaaccgtcgccgatcatgttgggagggaa

SEQ ID NO: 8390 - DNA, 101 bp, rice(Oryza sativa)
  misc_feature (71): n=t or c
agttcaatatgcacgatgtataacttacaaacactaaggctgaaccgttgcaaaaaactgagatatttacnggaaggtatgagaacaatgagcaagctcat

SEQ ID NO: 8391 - DNA, 101 bp, rice(Oryza sativa)
  misc_feature (71): n=a or c
tcaccgttcgagcagcttagtaacacccaccatggcttctcccccggaggacgcgccagctattccttcanatccatcggtgcctcaggaggtaggtaacc

SEQ ID NO: 8392 - DNA, 101 bp, rice(Oryza sativa)
  misc_feature (71): n=t or c
tgtcagggtagcattctttgtgatgaactggtccaaacccaccatagcaacagtgttgccacaaggaacancttccactgactcctgcttcttgcccatcc

SEQ ID NO: 8393 - DNA, 101 bp, rice(Oryza sativa)
  misc_feature (71): n=t or c
atcctctctatcactctaccaaaatcttcactgctgaccaaaatgctagactcaaacaagctctgttgtgnagcaagcttgtctctcagctcaattccaag

SEQ ID NO: 8394 - DNA, 101 bp, rice(Oryza sativa)
  misc_feature (71): n=a or c
aaaacagaacagaaaatctttatctttgccctcgtttgctaggcatttgccccaagtttcatacaatatgnttttcagagcaacaggggggttctcaacat

SEQ ID NO: 8395 - DNA, 101 bp, rice(Oryza sativa)
  misc_feature (71): n=t or g
caagcaacaaaacgaactcggtatttggcaggtcagacgacgagcgattcagaggaggaaccagagacganacctggaaggggatgggcttgtcgaactgg

SEQ ID NO: 8396 - DNA, 101 bp, rice(Oryza sativa)
  misc_feature (71): n=a or g
aatcaatacctgaatattctgtatttgtagaccaataaattggttcagcctgatttccttttgctcccaantttggcttcttgattctaacaattcctcaa

SEQ ID NO: 8397 - DNA, 101 bp, rice(Oryza sativa)
  misc_feature (71): n=t or g
tgatattacatccaaaggatattctggatggtttattctgacttctattttccttttccatttcagtgagnagcgatgctggccatgctgagccatcttgc

SEQ ID NO: 8398 - DNA, 101 bp, rice(Oryza sativa)
  misc_feature (71): n=a or c
tcccacttgtcaaacctcaccagccaattaattgtaccgattgatgaagcgacaattctatccacccatantcggaacttcttgccttgtttatcagcata

SEQ ID NO: 8399 - DNA, 101 bp, rice(Oryza sativa)
  misc_feature (71): n=t or c
acaattgtgttgtccatccatggctagtgttttggcactgaatttgagctcaggataatgtctccaggacngtaaaagttctcgtgaggcacaggcagcac

SEQ ID NO: 8400 - DNA, 101 bp, rice(Oryza sativa)
  misc_feature (71): n=a or g
ttctgaactattttcggttgatagagagtcgcccagaactgcattttccacagctatcgagtttttagatnattggcaaggagaagcatcgtctgtttggt

SEQ ID NO: 8401 - DNA, 101 bp, rice(Oryza sativa)
  misc_feature (71): n=a or c
taatgcacttgagtctgaagtccgggcgtgtgcagaaggcattgctctagccctccaatggtctctgctcnccattgtgctggaatctgactgtgaaacag

SEQ ID NO: 8402 - DNA, 101 bp, rice(Oryza sativa)
  misc_feature (71): n=t or c
gacagaccatgtcctaaggaatacattctcattgttgttgatagagcggctctggtggtagccatcaatgnagacaaacctgatgaggctgtcgttgccac

SEQ ID NO: 8403 - DNA, 101 bp, rice(Oryza sativa)
  misc_feature (71): n=a or g
ttggcccaactagtactagtggggaagggaagacacacatgacgacctaattggcaagtataacataaagnggtggtgactctgggtggtgggatgacaga

SEQ ID NO: 8404 - DNA, 101 bp, rice(Oryza sativa)
  misc_feature (71): n=a or g
tatagaagggtactttcataatttttcactttgtgggctggagtatctttatcaagtggtctcagattttnaagaacccattggaggtatccttcagtgag

SEQ ID NO: 8405 - DNA, 101 bp, rice(Oryza sativa)
  misc_feature (71): n=a or g
ataggcgataaaaactgtttgtgttatgcaacatgggcatcctactttgtgtgtaacatttaccctttganactgctcaatttatgcctattattgtaaac

SEQ ID NO: 8406 - DNA, 101 bp, rice(Oryza sativa)
  misc_feature (71): n=a or g
tgattgatgaaagaaagatatggtggcatgaaggtctactcacttgatctcagcctcttccacacctttcncagattgctcccctacgtcggcttttttat

SEQ ID NO: 8407 - DNA, 101 bp, rice(Oryza sativa)
  misc_feature (71): n=t or g
ccatgtcgaaggaatagagttggtttcattacctgagcatctgagaaacgcagctgttctgcaataaaaanagctctaccatgtatttccggtggagagtc

SEQ ID NO: 8408 - DNA, 101 bp, rice(Oryza sativa)
  misc_feature (71): n=a or g
acacaacacatctccaaacccaaagcttctttgcctgaaactacacatccaatggcatcacaaattgaganccaccgctccggtgctgaggtcgtcaatgg

SEQ ID NO: 8409 - DNA, 101 bp, rice(Oryza sativa)
  misc_feature (71): n=t or c
aaaaagaacatgttggtaagcaacactctttttttatggttgtcactccttcccttgatcaagaacactanatctgtgtttactttacgtcaaaattaaaa

SEQ ID NO: 8410 - DNA, 101 bp, rice(Oryza sativa)
  misc_feature (71): n=a or g
ttccaggagccctctgcttctgttgttccagcagataacagcaagaacattccaaatgcatctgctactcngtttacagatgatttaggccttgttgaaca

SEQ ID NO: 8411 - DNA, 101 bp, rice(Oryza sativa)
  misc_feature (71): n=t or c
tatcataacaattttgccatagcgtacatcataagcttgctgtttgtagatgacaatttcgccctgctttnggagttcctgggaagagtaaggagccaggg

SEQ ID NO: 8412 - DNA, 101 bp, rice(Oryza sativa)
  misc_feature (71): n=t or c
gcacagctgaaattctcacaagatggcagtagccttgccatcatcataaaccgtgccactgaatccacagnatggtccagacaaattgccaataggacagc

SEQ ID NO: 8413 - DNA, 101 bp, rice(Oryza sativa)
  misc_feature (71): n=a or g
gaaatccatgtgctgcgagcgtgagccctccatcagcaacccgatcacaatcttactgtcgttggcatccncattggtgttgcggttgctgccaccgctgc

SEQ ID NO: 8414 - DNA, 101 bp, rice(Oryza sativa)
  misc_feature (71): n=a or g
ggcaactaaaacatttggatagcaatctgcagctgtaatgaattcaagaatctcaggtgctgacttcaaancatctggcaaagtcgcttgcaacactttta

SEQ ID NO: 8415 - DNA, 101 bp, rice(Oryza sativa)
  misc_feature (71): n=t or c
catgaatcatccaggtcagagtattgtgcgctccaggcactaaaagcttcgcttgatgctggcaatgaccntccagcctcctgttctctggttgggactcc

SEQ ID NO: 8416 - DNA, 101 bp, rice(Oryza sativa)
  misc_feature (71): n=a or g
caatcatgacttgttcttgttgattgaaaaatgcaattattgctgtttcttgttgattttctttggtgcantcacaggcgaagcacttaatgaactggaaa

SEQ ID NO: 8417 - DNA, 101 bp, rice(Oryza sativa)
  misc_feature (71): n=t or c
ggagttgtggtgatggaggataacaatgagggggctgtcagcggggcagagtggggtggcacaaaaggtcntgctttggaaaggtgagagtggggaggcag

SEQ ID NO: 8418 - DNA, 101 bp, rice(Oryza sativa)
  misc_feature (71): n=a or g
atgcaggaccatggtgttgaaccaagagctgaacactacgccgctttcattgatgctcttggtcggaatcnccagctggaagaagcaagtgagttcatcaa

SEQ ID NO: 8419 - DNA, 101 bp, rice(Oryza sativa)
  misc_feature (71): n=t or c
acaataccaaggtcatccttcaatgtctataggaaccagctccatgtgttataagattcaacctccacaanagccattgcaattgggaaaatgcaatcatt

SEQ ID NO: 8420 - DNA, 101 bp, rice(Oryza sativa)
  misc_feature (71): n=t or c
cgcaccgtactcatcatgatgcatctcgatgaccctcctccctgacaaagccgggtgccaggaccaatctnggatagccacgacatcaacgacaaggagta

SEQ ID NO: 8421 - DNA, 101 bp, rice(Oryza sativa)
  misc_feature (71): n=a or g
atggcattcctgaagaactctgccaagaggaaatcaccaggcttcctttcagacaaaccaagtttcaaaangcaaaaacatcataaacccaatgctggcaa

SEQ ID NO: 8422 - DNA, 101 bp, rice(Oryza sativa)
  misc_feature (71): n=a or c
cgcattcttcactattggattaatgctaaaattgtaaggaatgttagtattccatggttgctttatattgntagatttttcatcgttatccctatttggca

SEQ ID NO: 8423 - DNA, 101 bp, rice(Oryza sativa)
  misc_feature (71): n=t or c
gtggcaaatattggtgttcagcatttttttgtttctgcaggatatgatgtttgcacaactatcggaagagnatctaaatctcatatatctctaattggtaa

SEQ ID NO: 8424 - DNA, 101 bp, rice(Oryza sativa)
  misc_feature (71): n=t or c
ttgccgccattgaaccaatcattcataggctctagttcctggaatccattattatagccatctttcatgtngattttgatcgtgtagagaagctgccacgg

SEQ ID NO: 8425 - DNA, 101 bp, rice(Oryza sativa)
  misc_feature (71): n=t or c
tctgtcggtgtccttttcggcaaaaagtttcttcatctgcaaagttggcagagagaaattccttttgatgntacgacaaagattctccacggttttgcttt

SEQ ID NO: 8426 - DNA, 101 bp, rice(Oryza sativa)
  misc_feature (71): n=a or g
aaaccactctgtgcctcgccaagaaaagcggcgtggtacttcaaagttgacttcctcattatcccgttccngtagtaccaagacgatttcctcattttctc

SEQ ID NO: 8427 - DNA, 101 bp, rice(Oryza sativa)
  misc_feature (71): n=t or c
caaatcttccacctagtttgagctactactagcaaaaaaaaaaagaagtctacaggtccaatacctttgtntgttcccacactttactttggcagagctaa

SEQ ID NO: 8428 - DNA, 101 bp, rice(Oryza sativa)
  misc_feature (71): n=a or c
cttggtggttggaaacttggaatctggaaatgcagctaattcatccttggagaggatgaaatccttctggnggcatccaaggcaacaccagtgccaatcag

SEQ ID NO: 8429 - DNA, 101 bp, rice(Oryza sativa)
  misc_feature (71): n=a or g
atcaaaaggttaatttgatatgcatttgagaagaaaagggatcatgccatggctagtcctgccaggtgcgncgatctctgctgctgctgctgctgctccgg

SEQ ID NO: 8430 - DNA, 101 bp, rice(Oryza sativa)
  misc_feature (71): n=a or g
tacaggtaaaagcttgtacaattgatgattgcaaatctttatacttatcagcttgtcttgatcacctgatnattcctgaagattcaagatgtgcacatcaa

SEQ ID NO: 8431 - DNA, 101 bp, rice(Oryza sativa)
  misc_feature (71): n=a or c
ccgttgtacataaaacagtgtactatttcctgatttgaaaccaaccagatacgagaatgtgagaatacctngttgctgagcgaaactgctgttatccccca

SEQ ID NO: 8432 - DNA, 101 bp, rice(Oryza sativa)
  misc_feature (71): n=t or g
agctcaaatctaaagcgtggcataataagcatttatttgcttgctttggctaggtgacaggaaacagttcnatctatagctacggtaaaatttactcttga

SEQ ID NO: 8433 - DNA, 101 bp, rice(Oryza sativa)
  misc_feature (71): n=a or g
ggctgcgtggatggtgggctcaatgataaccgcagcgggcgagacgaccacgagaggcaacacaaacgacngttgcgtggatggcgggctcgaggaggcgg

SEQ ID NO: 8434 - DNA, 101 bp, rice(Oryza sativa)
  misc_feature (71): n=a or g
cattgatgtctttactcaggcattggctttgcttccttatcctgttacatacaagtttataccatttgggngtggtaatgaaaatccacattatgacaaac

SEQ ID NO: 8435 - DNA, 101 bp, rice(Oryza sativa)
  misc_feature (71): n=t or g
gagaacccggcagccgctcgcaattgtgacacatggaagaccggatgaatagcactataagagggcaactncaaacgataagctacagcccccactctgtc

SEQ ID NO: 8436 - DNA, 101 bp, rice(Oryza sativa)
  misc_feature (71): n=t or c
gattcctgattcttctgcataggtgcaagcattttacggaccatctcatggatatgcatacccgtgacagnttcattacgagatacttgtgccagaagagg

SEQ ID NO: 8437 - DNA, 101 bp, rice(Oryza sativa)
  misc_feature (71): n=t or c
gacgcttactccggttaccaccaagtctggttgcacccggaggatgaggctaagaccagtttcgtcacccnagacggggtgtactgttacgtccggatgcc

SEQ ID NO: 8438 - DNA, 101 bp, rice(Oryza sativa)
  misc_feature (71): n=t or c
tacctagcattatcctgacatgtgagttcctatcttgcagatgtggtaaacatggatacttcaggtcttgnggcgctggaagaactgcacaaggagctggc

SEQ ID NO: 8439 - DNA, 101 bp, rice(Oryza sativa)
  misc_feature (71): n=a or c
cgctggtgctagatccggtggccccaaagtctatcgccgctagatctggcgaccgcgagatccactgttgnaaggccagccaaccgctgacattgccagca

SEQ ID NO: 8440 - DNA, 101 bp, rice(Oryza sativa)
  misc_feature (71): n=t or c
aagtttttttggaatgtcattaaatttgacttattggaactgtttaaagattttcatgctgggaatttgcntttatattctcttaactttggtactattat

SEQ ID NO: 8441 - DNA, 101 bp, rice(Oryza sativa)
  misc_feature (71): n=a or g
tcagaaacaactgtaggacaatgattactgagtgggcgcctacatgggcttgcttggaaggggttcggatngctactgagtgggtgcatatgccaatgatt

SEQ ID NO: 8442 - DNA, 101 bp, rice(Oryza sativa)
  misc_feature (71): n=t or c
tccatgaaaacatttaagtttttccctgggtgctctgggccaggaataacaagtgaaagaagaatattatnatctttagtgcacatttcaggtggtagatt

SEQ ID NO: 8443 - DNA, 101 bp, rice(Oryza sativa)
  misc_feature (71): n=t or c
ggtcgtcgattccgctgtgcctcgttgctggagcaggctatgaaccctatcaccttcgagacgaggttagntgccctccagatttctgcgcagttttcggg

SEQ ID NO: 8444 - DNA, 101 bp, rice(Oryza sativa)
  misc_feature (71): n=t or c
cggtaatgcccctccttcacctccttcagtcggtggagatcgacacgctacatggcccgctagatttgctngatctctgtgatattgtcaaacacgctccg

SEQ ID NO: 8445 - DNA, 101 bp, rice(Oryza sativa)
  misc_feature (71): n=t or c
attggtgagagttcataaacttgggatgtgaacccagttcccgcgtccataataagggcccaaagattggntgaagatgccactgagctaatgaacaatcc

SEQ ID NO: 8446 - DNA, 101 bp, rice(Oryza sativa)
  misc_feature (71): n=a or g
catcattccttgttgggggttacctaaatccattttgctggttgaaggatttgataagtgtgtggcagcancttcatgaaaaccatttgagtcatcatgta

SEQ ID NO: 8447 - DNA, 101 bp, rice(Oryza sativa)
  misc_feature (71): n=t or c
ctatgggtgagcacttccagcttcttgaggcttgtcaagttctcaatgccggcaaggatcggtctcccagncccatcattgtcatagaaaaacactctgaa

SEQ ID NO: 8448 - DNA, 101 bp, rice(Oryza sativa)
  misc_feature (71): n=t or g
tccggcgccagcttgctctgatggcaggacgatcatgtcaccgtaggagctctgatgatcggcacaatcancattgccaggagggagatccaccactgccg

SEQ ID NO: 8449 - DNA, 101 bp, rice(Oryza sativa)
  misc_feature (71): n=a or g
gaaagaagcgctctagcgcggaaagaacttacttgccaagtggaagaggagcgcttgcagcagcccagagntgacagcagcatccagccacctcctcgccc

SEQ ID NO: 8450 - DNA, 101 bp, rice(Oryza sativa)
  misc_feature (71): n=t or c
ctatttgtttccttctttatgtcaccaactgcagttggcatgccaccatcttgtgccttaaccagggaagncttgacatctttttcctcaatattcacttc

SEQ ID NO: 8451 - DNA, 101 bp, rice(Oryza sativa)
  misc_feature (71): n=t or c
tcgacgcaagaaggtcgaaatagacttatcagttattgcagctattccattgcatcaaaggagcactatcnggtcactagcacaagcccttggtgtttcca

SEQ ID NO: 8452 - DNA, 101 bp, rice(Oryza sativa)
  misc_feature (71): n=a or g
aaaccactggcttcagcgagctctcttgcgtgagctacatccaggaagaagaaaagcagagcagataggangacaccaagcagaaggagattcttgcgagc

SEQ ID NO: 8453 - DNA, 101 bp, rice(Oryza sativa)
  misc_feature (71): n=a or g
gacaggtcacaccatggtgactcgttctcaaaccggacatctccgacctattcaccgtttcacttatacanccactcatgatgttgtttcgccggttccat

SEQ ID NO: 8454 - DNA, 101 bp, rice(Oryza sativa)
  misc_feature (71): n=a or g
ccaagtcttggccgatttcgtagccgactggtctattctagaggatagaccagccggtcaagcggataacnaaatttggaccatggcgttcgacagcacgc

SEQ ID NO: 8455 - DNA, 101 bp, rice(Oryza sativa)
  misc_feature (71): n=t or c
accctgggcgcatctctcaaaatatcagcaatgtgcctgtaccgaacaggagcaccgtcggtgtcaatttngccagcagagtgtggtgtgctctgttcacc

SEQ ID NO: 8456 - DNA, 101 bp, rice(Oryza sativa)
  misc_feature (71): n=t or c
atagcattcgccttctctgccatattagtgaacagagattttgggtaagagcccacccccgtgggaacacngttgaagccatagtacacccaccaatctcc

SEQ ID NO: 8457 - DNA, 101 bp, rice(Oryza sativa)
  misc_feature (71): n=a or c
cttgaaggagaggactcataaatacattcaccatcactgcttccatctggcataatcatattttctcttanatcagaactgtcttcattcggatcaatagg

SEQ ID NO: 8458 - DNA, 101 bp, rice(Oryza sativa)
  misc_feature (71): n=a or c
gccaccacagcaaggagatgcacatcaccaagtcctgggcggacctccgcaaatgaatgcacaccagaacnaaaaagagctcaatcagcagacagaagaag

SEQ ID NO: 8459 - DNA, 101 bp, rice(Oryza sativa)
  misc_feature (71): n=t or c
gcagtgctagactcgggagcagcggattcacctctgctaacctcggtgacgtcgacgatgagaatgacggnagtagctagggcaacggcgacaatagcaac

SEQ ID NO: 8460 - DNA, 101 bp, rice(Oryza sativa)
  misc_feature (71): n=t or g
tcctccaatgtcccttctctctccttcgtttgcatgccttcacgtggagtgtccgatgtgtacagcttcgncgtgatcctcccagtgctgctcaccaggaa

SEQ ID NO: 8461 - DNA, 101 bp, rice(Oryza sativa)
  misc_feature (71): n=t or c
gtcgtcaccaagcctctccgctttctctgctgtgttagaaacagccaagagaatcccagcagccggttccngtccgtcgaagcctgccggaagctccccat

SEQ ID NO: 8462 - DNA, 101 bp, rice(Oryza sativa)
  misc_feature (71): n=t or c
taacataactgcaagactacattcttcactgatttatgggacccactaccgatggtccacatgtcagcgangatgctatgatgacgttatcacgttacctc

SEQ ID NO: 8463 - DNA, 101 bp, rice(Oryza sativa)
  misc_feature (71): n=t or g
gcaagagcagctcggatctgcccgtttttggccgtggtagagtaagacccgaccgctctgacctcggaagntgtcggatcaggtgggtggctgcgctgtta

SEQ ID NO: 8464 - DNA, 101 bp, rice(Oryza sativa)
  misc_feature (71): n=a or c
atgggtccaatcacaatcagattaactgtaccctctgtagacacctacaatacgagtacagtcacctcctntgtagccaccgacaatacgagtacaatcac

SEQ ID NO: 8465 - DNA, 101 bp, rice(Oryza sativa)
  misc_feature (71): n=t or g
tttccactatatccgtgggaaagcctgcggacaacagacatctgcccctcatcctggggccaatttacagngcttactctagctcgtccataagcagtgtc

SEQ ID NO: 8466 - DNA, 101 bp, rice(Oryza sativa)
  misc_feature (71): n=a or g
aggtgaagacgtatgcaatagctaggtcctcgtcaagtgatacggagcaggccacgaaggaagaaggcatngggatgtacctgcccatggcagagagccag

SEQ ID NO: 8467 - DNA, 101 bp, rice(Oryza sativa)
  misc_feature (71): n=a or c
ttggtgtataaaagggttagggactataggtaatgtgacctagtgccggaaccgacttatcattgaagtanttctcagggaatagacctctgatgtagctg

SEQ ID NO: 8468 - DNA, 101 bp, rice(Oryza sativa)
  misc_feature (71): n=a or g
agcacagatgctgatgacaaccacaggaagcaatcaatcataaacacaattactaagttaactcctactcnatatcttgctagagcagccacttctgaaat

SEQ ID NO: 8469 - DNA, 101 bp, rice(Oryza sativa)
  misc_feature (71): n=t or g
cttgctggattctcacagtagtactagtagatgactgtggaacggtgtgctcgcatgcgatcagaacaagngtatgcatgcatgaatcatgatgaattcat

SEQ ID NO: 8470 - DNA, 101 bp, rice(Oryza sativa)
  misc_feature (71): n=t or c
aggacgctgggcaacatctcaacataggaatcgagcacaatggaggcctgcgagctccactctccagtctncgacgagtatacacacgcccatgagtgatc

SEQ ID NO: 8471 - DNA, 101 bp, rice(Oryza sativa)
  misc_feature (71): n=a or g
caagaggccgacgagctcgcagcttaatccaccgccaccatggggatccgctgtcgctgctcgcaaagaanggagggggagtccaatgatgttatcccttc

SEQ ID NO: 8472 - DNA, 101 bp, rice(Oryza sativa)
  misc_feature (71): n=t or c
ccctgcgccatctcaattctttcacgtggatcatacattgtttcatctcttatggcctgaaggatcgaatnaggaggaagttccctgtaaatacaaatgaa

SEQ ID NO: 8473 - DNA, 101 bp, rice(Oryza sativa)
  misc_feature (71): n=a or c
aaacctgagcctaagcctgaaccaaaaccagaaccaaagccatacccagagccgaagccaaagcccaaacnggagccaaagccagaaccaaaacctgagca

SEQ ID NO: 8474 - DNA, 101 bp, rice(Oryza sativa)
  misc_feature (71): n=t or c
aagaaatgttcatctcgtcagctcagatcacataatcggaggctcttcagccaatgcaatttcaagagagntgctaacaaggaattggcagcaacagagaa

SEQ ID NO: 8475 - DNA, 101 bp, rice(Oryza sativa)
  misc_feature (71): n=a or c
cgcctcactgcttacgccaacaatggacccctcaccacgttgaagcccacaagtggcacattgacgaaacnctcatcaccatccttcaccacagcacccca

SEQ ID NO: 8476 - DNA, 101 bp, rice(Oryza sativa)
  misc_feature (71): n=t or c
gtgcttccaatgttgggattcagagagttaaatacctcctccagattcacagaggagtaaatcagctttgnacaagtttgatagttcttccagaggaccta

SEQ ID NO: 8477 - DNA, 101 bp, rice(Oryza sativa)
  misc_feature (71): n=a or g
ggggatcggaaatccaatcatccaatccaagattccaaaagtggttggattaatcgagtcatcgagatganctcgccgggcggcgtgaacgagtgggagga

SEQ ID NO: 8478 - DNA, 101 bp, rice(Oryza sativa)
  misc_feature (71): n=a or g
tgctgggtttcactatgggtatggccatggtcatggattccatggcggacatatgggtcatgccgcccacngtgtccctcgacaaggaccactggagcaac

SEQ ID NO: 8479 - DNA, 101 bp, rice(Oryza sativa)
  misc_feature (71): n=t or c
tgctggtggctgaagctccatgttttccctggttaacatgaaaatgacagatgatatatgaggcctctcancagggtccggctggacacacaatagcccaa

SEQ ID NO: 8480 - DNA, 101 bp, rice(Oryza sativa)
  misc_feature (71): n=t or c
ttagtgtcctaattttaagcttatgcaatgagacatatataaacaagcctcacctgagagagccacatgangctcattgaggaatggaagagatggacgct

SEQ ID NO: 8481 - DNA, 101 bp, rice(Oryza sativa)
  misc_feature (71): n=t or c
aattcgagagagaggattaaacgacacagtgctcacatctttcttgtcctggttgctcggcttggctccanactctttgttacatcgtacacggtaaaggt

SEQ ID NO: 8482 - DNA, 101 bp, rice(Oryza sativa)
  misc_feature (71): n=t or g
tgatatactgcggtgctgaaggtgatggtaggctggggcatgctcttcttgagcttcttgtgggtgagganggtgcggatcctcgacgcgagcggcgagtc

SEQ ID NO: 8483 - DNA, 101 bp, rice(Oryza sativa)
  misc_feature (71): n=t or c
caggtggagcagacggcgccggagcggacgaggtcgtcggggtcggccaaataccccattacggtgatgangacgtcgtccggcagcgccgaccagtctgc

SEQ ID NO: 8484 - DNA, 101 bp, rice(Oryza sativa)
  misc_feature (71): n=a or c
ccaatccccaacacgaacacgaacgatccgatcaaaagcaagcgaaacagttacacgcacagctgcctggngagctcgcagatgatccgctcgccgtcgtc

SEQ ID NO: 8485 - DNA, 101 bp, rice(Oryza sativa)
  misc_feature (71): n=t or c
aatatccgtctctcgtctcgtctatctatctcaatcttacgtataccctagcatcaacgattcttacactntacaaataccttagacgggtacaacctaca

SEQ ID NO: 8486 - DNA, 101 bp, rice(Oryza sativa)
  misc_feature (71): n=a or g
tgctgctgctgccgctgctggtgcgatgggtttctcaccggtggggattggggatccgaccatggggaatnggctgatgtccggagtggcagggattgggg

SEQ ID NO: 8487 - DNA, 101 bp, rice(Oryza sativa)
  misc_feature (71): n=a or g
agagagaaccatagctatgaccataagagacatgacaaagagaacagcagtaccatccttcttgaaaatcnccatatcgcgggcgatatacctatagcttt

SEQ ID NO: 8488 - DNA, 101 bp, rice(Oryza sativa)
  misc_feature (71): n=a or g
tggcggcggaggtgggggtggagggggtggtggcggcaatggcagtggtagtggatcaggatatgggtatnattatggtaaaggaggcggacaaagtggtg

SEQ ID NO: 8489 - DNA, 101 bp, rice(Oryza sativa)
  misc_feature (71): n=a or c
aagatcgatttgtcggttggcaatgacggtgatggggagcacagcatgccaccggccatattcagtttcgnggcaccccgtgctggtcccaagtactttgc

SEQ ID NO: 8490 - DNA, 101 bp, rice(Oryza sativa)
  misc_feature (71): n=a or g
tcctgaaaaaagttgaacagcatactgtgcgatttcctctgtttcatactcagcaaaagcgtaacctttgngacaactagtttccttgtcacgaggtatgc

SEQ ID NO: 8491 - DNA, 101 bp, rice(Oryza sativa)
  misc_feature (71): n=a or g
agacgtgaggggagagctggcttaggtggtggtaatgatgtaaattgcaacagtacagctattagactgcnatcagctagggattcttcagccctgaccag

SEQ ID NO: 8492 - DNA, 101 bp, rice(Oryza sativa)
  misc_feature (71): n=t or c
ttgtcacacagcaaactctaacacgttgtaccatgcatgcatctcgaccatgtttcacttcgccacagatngatggaccatgtataatatgattaatagga

SEQ ID NO: 8493 - DNA, 101 bp, rice(Oryza sativa)
  misc_feature (71): n=a or g
acaaaagtttttcacagtgatttggacatgggcttggagaatctcacctccctcaagactgtacattttcngattgactgtcgttacgctaggctctggga

SEQ ID NO: 8494 - DNA, 101 bp, rice(Oryza sativa)
  misc_feature (71): n=t or c
gttatttaggcgatgtctcagtaaggtgaaccaatatcgatgacactagtgggtccacaagggcacggacncctaggacagggaacaaaatccctaagaaa

SEQ ID NO: 8495 - DNA, 101 bp, rice(Oryza sativa)
  misc_feature (71): n=a or c
gatcaggtgaactcacatggagtcggcctcgagcaccttgatgaaagctttaccacggtcggctcgacggntgggtgtcctcacatgcgtccatgctgcca

SEQ ID NO: 8496 - DNA, 101 bp, rice(Oryza sativa)
  misc_feature (71): n=a or g
atcggtaggaagtgcaggaggagtagaccagttaattaactggagctcgtggttatgctttttactagttnacaaaaaatttggtcggtctcggtcaaacg

SEQ ID NO: 8497 - DNA, 101 bp, rice(Oryza sativa)
  misc_feature (71): n=a or g
ataaaacaaatggccaaatgctatgcgaaaaatcaacggcatcagcatcatacacatttatttatgcccantgctgcgtcgccacgtcatcagccagctgg

SEQ ID NO: 8498 - DNA, 101 bp, rice(Oryza sativa)
  misc_feature (71): n=a or g
tgtcatcattcctactctaattctaaccacatcctttgtctttaaagctaccatatccacttctatcacangtcctagattagaacccacttcatgtagag

SEQ ID NO: 8499 - DNA, 101 bp, rice(Oryza sativa)
  misc_feature (71): n=t or c
ccattctgatcatctctccccctggacaggtaatcatctctctccctggagaggtaatcgctgtcacctcncctgtagctcccattctgatcatctctctt

SEQ ID NO: 8500 - DNA, 101 bp, rice(Oryza sativa)
  misc_feature (71): n=a or g
acagctggtgaccttcacacaagaatccagtgggaagaccttcgtcctctcgagcgcgaatggctctctcncaatgcaagaacggccgacggtcgatggca

SEQ ID NO: 8501 - DNA, 101 bp, rice(Oryza sativa)
  misc_feature (71): n=a or c
ctattcatctatctataggctttggcagcaaagctctcgaggtaccagcagggtcggaatttcggtccctntgatactattacttcgactgaaatttttca

SEQ ID NO: 8502 - DNA, 101 bp, rice(Oryza sativa)
  misc_feature (71): n=a or g
caccggcaagtggatttttcggcacaagattcaggtggatggttctctcgaccgctgtaaggcacgatgcnttctttgcagctgtactaagtgccccaaca

SEQ ID NO: 8503 - DNA, 101 bp, rice(Oryza sativa)
  misc_feature (71): n=a or g
gatgcagcacttgcttctgctgtagcttgggtgactgacagtttcgatctaagatcgtccaactcgtggangtactgcacataattagaatagttattgag

SEQ ID NO: 8504 - DNA, 101 bp, rice(Oryza sativa)
  misc_feature (71): n=a or c
tctagtagttccagtagctctcagggtaccagcaacagcaagtctccccagagacagagagagcgatctancaaaaaaattggaaaattaggaaagtactg

SEQ ID NO: 8505 - DNA, 101 bp, rice(Oryza sativa)
  misc_feature (71): n=a or g
cttgttcccgtatgtaccggatggaacacacaggcacctctcgcagcagtagttgcagtatgtcatgcacnccgtcgtgtgagatgtggccgagcaacggt

SEQ ID NO: 8506 - DNA, 101 bp, rice(Oryza sativa)
  misc_feature (71): n=a or g
gctgggagagcgccacgtcagcgattttttagaaaacccctcatcatctggtgaaatagcaaacacgttcnaattcacgtggaccgtactatctgatacga

SEQ ID NO: 8507 - DNA, 101 bp, rice(Oryza sativa)
  misc_feature (71): n=a or g
gttgtcgtctccaccttcctccaaacattggcaattgcccttcgtcgatgcagcgttaccgcgctgagacnttgcatcgctgccgaaattggatatgggag

SEQ ID NO: 8508 - DNA, 101 bp, rice(Oryza sativa)
  misc_feature (71): n=t or c
ctgaacattgatattgcttaagtaaggcaaccgtattgcccaatggacaacctgtcagagccactgctcgnagagatcatcaagaggattgccaagacaag

SEQ ID NO: 8509 - DNA, 101 bp, rice(Oryza sativa)
  misc_feature (71): n=t or c
aaaaagtgctgaccattcttaacctgttataggttgcccagtttttagttggtcttgcagtgccttctgangacaatagttatcccaaaaggtaagaacac

SEQ ID NO: 8510 - DNA, 101 bp, rice(Oryza sativa)
  misc_feature (71): n=a or g
aaaatcattgaaaggataacctgtcactggaggtagagatttcctcacagttggtgtgctttcttgtgggntaactggagaagcactcgctgggaccgtgg

SEQ ID NO: 8511 - DNA, 101 bp, rice(Oryza sativa)
  misc_feature (71): n=t or c
tgggccactttgtttttaataccatcgcatatgcagggcatgccgataacaaagacaaggtggtcattcgnggtgcagatgtcaagggtgtacacaagagc

SEQ ID NO: 8512 - DNA, 101 bp, rice(Oryza sativa)
  misc_feature (71): n=t or c
tagctctacaaaactcctgggcttccatctgatgctttagcagtaaaggattcaattgtgaatgcagcaanggagttggacataaagctgggtaaaattta

SEQ ID NO: 8513 - DNA, 101 bp, rice(Oryza sativa)
  misc_feature (71): n=t or c
aaaagggtggttttcagctatggagcgacggaagagcagcctgagtcgagcatgtgctcttcagaagatangtgcagtgagaatgtctgcaagatctgcta

SEQ ID NO: 8514 - DNA, 101 bp, rice(Oryza sativa)
  misc_feature (71): n=t or c
tttactgaatggcatcgatcttttcagggttcgcttcgaccccctttcggacaccagaaaatccaataacntacccgcgcaaacaccaaacacacacttct

SEQ ID NO: 8515 - DNA, 101 bp, rice(Oryza sativa)
  misc_feature (71): n=a or g
tagatgtttgacagcaacacataagcagccgtacaactagggtccaggaggagcaacttctctgctgcatncttcccaacttcggagttgccatggaagct

SEQ ID NO: 8516 - DNA, 101 bp, rice(Oryza sativa)
  misc_feature (71): n=a or c
cggagacgaaaaggcatcgccatggtcgcgacgacggcgagagaagacgagggggtttctgggaggagganttgtagacttgtagccttctggaaggcgtg

SEQ ID NO: 8517 - DNA, 101 bp, rice(Oryza sativa)
  misc_feature (71): n=t or g
atgggtagatccgcccctgaatcactgtgatgaaagagttcaagctgcttggcgtgcagattcttgagaancttgtggatgatcaggacaactgcacacaa

SEQ ID NO: 8518 - DNA, 101 bp, rice(Oryza sativa)
  misc_feature (71): n=a or g
tgatatcttccatattttatgacaggatcgcttaactattaaccgagaagtctatcctagtattagcgtcnccttcagcaagatataccgaactgatggaa

SEQ ID NO: 8519 - DNA, 101 bp, rice(Oryza sativa)
  misc_feature (71): n=t or c
attcaacaacagacggtgcaacagataccgactgggttgagaacacctaaaaatcggcaaagacaacaaantgtggctcaagttatccctgagcacttgct

SEQ ID NO: 8520 - DNA, 101 bp, rice(Oryza sativa)
  misc_feature (71): n=t or c
ggcaacttcgaggacgggccggacaagtcccagctgaacggcacggtggtgacgggtcgatacgccatacngaactgggagatctcggggttcgtggagta

SEQ ID NO: 8521 - DNA, 101 bp, rice(Oryza sativa)
  misc_feature (71): n=a or g
gtaatttttagtgaaaatgtatatctacaatacacaactcaccttagtaagattgttgaatgtcccatctntaagtgtggtaggaaggcaagtctgcagtg

SEQ ID NO: 8522 - DNA, 101 bp, rice(Oryza sativa)
  misc_feature (71): n=t or c
ttccatggaagactacaagtgcaagaaggtagaagaaggacatggtgagaaaaggaaggtggaaaaagggnatgatcctcgctagtcttctctcatcgaga

SEQ ID NO: 8523 - DNA, 101 bp, rice(Oryza sativa)
  misc_feature (71): n=a or c
gatcgatcgatagagatcgatcatgccacaatgaatctacgccaaaccccccacagcgaaactaatcgcancgaacccagcagcgcgattaggcgatcgat

SEQ ID NO: 8524 - DNA, 101 bp, rice(Oryza sativa)
  misc_feature (71): n=a or c
gtcggagagacgcccggatcccgccgggaatactcccgatatggaccttgcatggctagatccggttgtanccctcgccgccttcaccaccaccgttggcc

SEQ ID NO: 8525 - DNA, 101 bp, rice(Oryza sativa)
  misc_feature (71): n=t or c
ccttcacgaggctacagaaactcaatttagaacttacctctgaacacgacttgaactgatgctaatctcangcaataacctagatggtgctgttttgaaat

SEQ ID NO: 8526 - DNA, 101 bp, rice(Oryza sativa)
  misc_feature (71): n=t or c
ttctgtctacctttgctcctacacgcagtctatggcagggtgacccactgtctcccttcctcttcttgttngtagccgatggtctctccttattgctagac

SEQ ID NO: 8527 - DNA, 101 bp, rice(Oryza sativa)
  misc_feature (71): n=a or g
cagctgtttgtttgcacttggcaatgcctagcaatctgattctgtttcttccttcatgtggaaccataggncacagcatctcccaagactacaactcctac

SEQ ID NO: 8528 - DNA, 101 bp, rice(Oryza sativa)
  misc_feature (71): n=a or c
ctcacttcctccacctcttcctttctacctcatctcctcctcttcactggaggccggcgaggcagcatatnggagacgctgctcctctccccttccggccg

SEQ ID NO: 8529 - DNA, 101 bp, rice(Oryza sativa)
  misc_feature (71): n=a or g
atcttcgccgaagcatacactaggatggggttcctgaccttggctctctctcaggcgctcactttgcttcncggctttgggggcgaagcggtgcaagtcct

SEQ ID NO: 8530 - DNA, 101 bp, rice(Oryza sativa)
  misc_feature (71): n=t or g
tgttcatctgtgtttcaagtgtttgaagagttcgttttgtggtttgattttggcaggacgcgagtgaaganacgaccgggagcatggatcgcgccaaggca

SEQ ID NO: 8531 - DNA, 101 bp, rice(Oryza sativa)
  misc_feature (71): n=a or g
tcctgatttgtcaaggggaagatagattctatccatacctacattgatcggttgtcggatactcggatggnctgaatatacatactcaccgatactatata

SEQ ID NO: 8532 - DNA, 101 bp, rice(Oryza sativa)
  misc_feature (71): n=a or c
ccttcactgccagtggactgtccttagcctgttgtgttcatcaagcaacaaaacagtaagaatcacagggnattcttgcacttgcaacagtgctagtaaat

SEQ ID NO: 8533 - DNA, 101 bp, rice(Oryza sativa)
  misc_feature (71): n=t or c
catcgctcaaatatggtgtgtatgcaactgtatgcaaaggaaattgaatgtccaccaggagcatcctctgnggcgtctattttgtcaaaaaatttgcaaag

SEQ ID NO: 8534 - DNA, 101 bp, rice(Oryza sativa)
  misc_feature (71): n=t or g
ctgctaatatgtttatatggtatttaccattttcagctaccggtaccagtttgacacaaactactggagtnttatctataaacacaaggccagtaagcatg

SEQ ID NO: 8535 - DNA, 101 bp, rice(Oryza sativa)
  misc_feature (71): n=t or c
aagccaattcttacatctggctatgaaattcgtcctaaaattataaacatgattagggtgaaatccttctntggcttagatcaagagaatccctaccatca

SEQ ID NO: 8536 - DNA, 101 bp, rice(Oryza sativa)
  misc_feature (71): n=a or c
gaagattgtctctattgttggatttggaggactcggcaaaaccactctttccaaagcagtatatgacaaanataaactggcatttgactgtggggcttttg

SEQ ID NO: 8537 - DNA, 101 bp, rice(Oryza sativa)
  misc_feature (71): n=a or g
gtgccgatgctgtgctggccgctgcactcggagcagaagatgaacatggttcttatggtggaggagatggncatcgctgtggagatggccgggtggaagca

SEQ ID NO: 8538 - DNA, 101 bp, rice(Oryza sativa)
  misc_feature (71): n=a or g
ggaaaaagatttcatcacaatgttgcacggagttaatctctcaactggtagaattatgcaattgatgtcanaattgtatggaggggctaggaatgtaccct

SEQ ID NO: 8539 - DNA, 101 bp, rice(Oryza sativa)
  misc_feature (71): n=t or c
tccgcgttctcgccgtcgatcggctccttgccggaaaacatgggatgcagtatgatcacaccttccactgntgctcctgggggtaggctagattggccggc

SEQ ID NO: 8540 - DNA, 101 bp, rice(Oryza sativa)
  misc_feature (71): n=t or c
caacttcgacggcgaccactacatcaacaactcccaggcgttccgcgccgccctgtgcttcatgctcgacngccgccacggcgacgacaccgcattcgtcc

SEQ ID NO: 8541 - DNA, 101 bp, rice(Oryza sativa)
  misc_feature (71): n=t or c
tgtgtgaatatagtgttatatatgtcggtgtagctacgcgtatgtctactgtataattgcaagaaaaaaantttaggatttcaacgaaaatttagtgagat

SEQ ID NO: 8542 - DNA, 101 bp, rice(Oryza sativa)
  misc_feature (71): n=a or g
ggcttcaatgcagtagggtggcaaatcggctttgtcaggcatgtcatgaaggcgtcgccgaggatgagacnggtgcacttgctcgatgggcatgtcgttga

SEQ ID NO: 8543 - DNA, 101 bp, rice(Oryza sativa)
  misc_feature (71): n=t or c
ttgccttacttccaacgggctgagcagacgtgatagtatcctcgaacccttcccgagcttcgaccgcttgntctcatcgattggctggccaatgcaagtga

SEQ ID NO: 8544 - DNA, 101 bp, rice(Oryza sativa)
  misc_feature (71): n=a or g
actactactcatcatcatggtcagtcatagttctagatgttgtagctcgctttttttagtctttttccttnctactgcggcatgtcgagggcctgagagtg

SEQ ID NO: 8545 - DNA, 101 bp, rice(Oryza sativa)
  misc_feature (71): n=a or c
aattcgacaaagggaggggcaatttgattattctccggctattctatgcaagtgtgggtacaatgacggtnagatggatttcttgagtgggaataatccat

SEQ ID NO: 8546 - DNA, 101 bp, rice(Oryza sativa)
  misc_feature (71): n=t or g
gaaggaattgcaggggcgtgatcaacaggtcaagaataaggcgagcacatacataccgcgagcaaagccanctttggggcttcccaagcccatctctttct

SEQ ID NO: 8547 - DNA, 101 bp, rice(Oryza sativa)
  misc_feature (71): n=t or c
catcggatgctactacttcatcggagttcctatcggtgttctgcttggttggagtttcaaccttggagttnttgtagggttccaattttgatatccccata

SEQ ID NO: 8548 - DNA, 101 bp, rice(Oryza sativa)
  misc_feature (71): n=t or c
tgtggatgttttttattttaccaattttcgttgttcgtgtgctggaacacatcaatttccccagtggcaangcacgaacacctgtaaaaaagaaaagagaa

SEQ ID NO: 8549 - DNA, 101 bp, rice(Oryza sativa)
  misc_feature (71): n=t or c
gcgcaattcagaaaaccttgaccatttcagacccgacagaacagaattggatacgacgagcttgcaaacangtaccagatcggagtcggagaggcaatggc

SEQ ID NO: 8550 - DNA, 101 bp, rice(Oryza sativa)
  misc_feature (71): n=a or c
tctcgagtctggaagcaggcgttgctcggcttctctcactatgaagggccaccattccttgccgccgtcgncgccgcccaagcgccgctgcactgccctgg

SEQ ID NO: 8551 - DNA, 101 bp, rice(Oryza sativa)
  misc_feature (71): n=a or g
ccaaatttggggccagagttgaaatgtgcatattttaatgagctgagggaccaaaatgaacgattttacanttgaggaccatgccctcagcaacacacagg

SEQ ID NO: 8552 - DNA, 101 bp, rice(Oryza sativa)
  misc_feature (71): n=t or c
caacattaatatgctggagggaattacatgcaagtttgagaatctgagggagggcggcctgatcatagatnttggccagcgctcaagtgttctatcgttag

SEQ ID NO: 8553 - DNA, 101 bp, rice(Oryza sativa)
  misc_feature (71): n=t or g
ataccggaaagaagaaaagaaccaagccatcggttgtagatccatcggctaccaagaagaagaaaacaaanaagcaaaaaactttagcaaccgatgatcta

SEQ ID NO: 8554 - DNA, 101 bp, rice(Oryza sativa)
  misc_feature (71): n=a or g
agaacagagtttgtgtaccacgatctggaggaggaagtgaaggaacagcagctcagctaccacagcgagangctggccatcgccttcggtttgctgaacac

SEQ ID NO: 8555 - DNA, 101 bp, rice(Oryza sativa)
  misc_feature (71): n=a or g
gtgttcttctggcacttgttggacttgtgaatgctcttcgccaaggttttgagaaacgattcagtgtcctncacatatccaatatgatacttgctatcggc

SEQ ID NO: 8556 - DNA, 101 bp, rice(Oryza sativa)
  misc_feature (71): n=a or c
atagatgaaaaatggttcaatgccaccaaaaagaacaggactttctacctgcatccccttgaggaggaacnctatagacctgtccaaaataagaatgcaat

SEQ ID NO: 8557 - DNA, 101 bp, rice(Oryza sativa)
  misc_feature (71): n=a or g
aaccagggcatgggagcctacgcagtcggtccaggaatagtgggagaaactggaactggccaatacggtangagttcccaaaaaagaatggcgcactctca

SEQ ID NO: 8558 - DNA, 101 bp, rice(Oryza sativa)
  misc_feature (71): n=t or g
ttgagttcatcaatatcttcacagatgatggaaaaataaacaacaatggaggtgcacaatttgtaggaatnccaagatttactgctcgagttgctgttatt

SEQ ID NO: 8559 - DNA, 101 bp, rice(Oryza sativa)
  misc_feature (71): n=t or g
tgcttctggtcagtaacctaattaagatcgatctaacaagcagagttaatgttgcggcaacaaactgacanatccctttcttcaagttacctctctctaag

SEQ ID NO: 8560 - DNA, 101 bp, rice(Oryza sativa)
  misc_feature (71): n=a or g
gccatcttatcgcttcccccacggtcactgctattgaggtccatcaaggtaggaggttgaagaggatggcnccctgccctagcggtcaccgccaccactgc

SEQ ID NO: 8561 - DNA, 101 bp, rice(Oryza sativa)
  misc_feature (71): n=t or g
tggtgtcgacgagccaccgctcgaactggacacgcatcatctccccctccatgtagtggtagttgttgctnttgtaccacggcgagtgcatgagcacgatg

SEQ ID NO: 8562 - DNA, 101 bp, rice(Oryza sativa)
  misc_feature (71): n=t or c
atcagaggagtctagaggccagcgggattgagattaagctcgatggcaatggcgcacctcacatggaggcngagcggcatagggggctcgtcaaccttccc

SEQ ID NO: 8563 - DNA, 101 bp, rice(Oryza sativa)
  misc_feature (71): n=a or g
aacctatgtgcagctgtgcgtaaagtgtcgccatgtcccattctatttcagcactaccagagcagtattgnaatgaccagaagggagttccttaatgggta

SEQ ID NO: 8564 - DNA, 101 bp, rice(Oryza sativa)
  misc_feature (71): n=t or c
gaactcggcggcctccgggcaccggtatcatctttggcttcgcttagcacacggctcctcagtggtggttnggaggagctcggagccatcaatccaaacga

SEQ ID NO: 8565 - DNA, 101 bp, rice(Oryza sativa)
  misc_feature (71): n=a or g
ctgaaatttataggtgtattattggttttcattgctgatgtgaccaagacggtacaggtgtctgaaattanacatgcctctacctcctttcaacctttgca

SEQ ID NO: 8566 - DNA, 101 bp, rice(Oryza sativa)
  misc_feature (71): n=t or g
cgtcgtcatcgcctcgtcgcctcatctcgatctcgtcgattctatccgagcagtagactagggtttttgcngctcgagcggagagcagatggggaaggact

SEQ ID NO: 8567 - DNA, 101 bp, rice(Oryza sativa)
  misc_feature (71): n=t or c
tgcctccagggcattcttgtagctatccagggacttacatgctgcaaaaactatactatcactgttgtccngtagaatcataacgatacctcccttcccac

SEQ ID NO: 8568 - DNA, 101 bp, rice(Oryza sativa)
  misc_feature (71): n=t or c
cttcaagacctcgttcctggctgcaacaaggtggcaaaattcagccaaaaaataaatttaaatttcacgcnggtaaaacatttttcacagaggaattatta

SEQ ID NO: 8569 - DNA, 101 bp, rice(Oryza sativa)
  misc_feature (71): n=t or c
ccatttatctactgaggaggttaagaagatcttacattttaagaatgtgcgcactgttatcattgaaggcncaggtttgattgacagcaatttatttcatg

SEQ ID NO: 8570 - DNA, 101 bp, rice(Oryza sativa)
  misc_feature (71): n=a or g
caacaggctagctgcagtaccggctgggacaaccttataaccaacagggttcccaactcgtgtcttcttcntggggttgacaatgtggaactcggatggct

SEQ ID NO: 8571 - DNA, 101 bp, rice(Oryza sativa)
  misc_feature (71): n=t or g
agacaagctgctaggccacactccccaaagttgagctggatgctgtctttgatagctttggtgatattganctgcgtgagaatgagagggtcgggctggcc

SEQ ID NO: 8572 - DNA, 101 bp, rice(Oryza sativa)
  misc_feature (71): n=t or c
aagtattctttatattgcaggttcaaaggcacagagaatccaccattacaagcggatttgtatttcagcanacaaggtagaagtttgtgatataataagat

SEQ ID NO: 8573 - DNA, 101 bp, rice(Oryza sativa)
  misc_feature (71): n=t or c
cgaggtcacccgggtggaggcgatggcgtccctcacgtcgaacagatgcgacgtcggctttccttccttcnggaagatcatctcgtggatgagccctttcg

SEQ ID NO: 8574 - DNA, 101 bp, rice(Oryza sativa)
  misc_feature (71): n=a or g
gtggaggagcatgttcaggtcaccaagcgtgtagttcagaagctttgggcctttgaagaacgccatggccntggctcctcccacgcagactatggttccgg

SEQ ID NO: 8575 - DNA, 101 bp, rice(Oryza sativa)
  misc_feature (71): n=a or g
taccatgctaagtctttttgatgaaatggttgcaaagaggatcaaggcaaatgcagtaacttacagtgtcnttgttaaagggctttgtaagcagctcagat

SEQ ID NO: 8576 - DNA, 101 bp, rice(Oryza sativa)
  misc_feature (71): n=t or c
gcagatgttgctaaatcggtaattgaggattatgctgcttgcttggagttccgctttgatgatttccaggncatagagaacacaaaagatgacgttggtgt

SEQ ID NO: 8577 - DNA, 101 bp, rice(Oryza sativa)
  misc_feature (71): n=t or c
caaggaaagcctttgaaccttcagattggagttctccttttctgcttctgctgtcataatcttgctacccngcaacatagttatctctctcaacgaatcat

SEQ ID NO: 8578 - DNA, 101 bp, rice(Oryza sativa)
  misc_feature (71): n=t or c
ataacccccatatccaccatgattaccatacgatgcatctcctccatatccaccatatccatagccctggntcccatagcctgtgcctgcaccagcggcct

SEQ ID NO: 8579 - DNA, 101 bp, rice(Oryza sativa)
  misc_feature (71): n=t or g
gaaggccaccatcgtctgcctcgacggagaataccgtccaactcgcgtgttcccggaactgtcctccaagntgctggacttcttctcgcacagggaagcta

SEQ ID NO: 8580 - DNA, 101 bp, rice(Oryza sativa)
  misc_feature (71): n=a or g
gcatgttcacaagatcgtgcagactcccctccacaccaactgggggaagaaaaaaagaaagaaggaagaancggcaggacgacgaggacacgaaggagatg

SEQ ID NO: 8581 - DNA, 101 bp, rice(Oryza sativa)
  misc_feature (71): n=t or c
catagttactgaagagcaactaggttgtatgccctacctaaaggcggtcatcaaggagacacttcggctanaccctccagcaccacttctaatgccgcatc

SEQ ID NO: 8582 - DNA, 101 bp, rice(Oryza sativa)
  misc_feature (71): n=t or g
aacatcgactcaagaattggtggcgtctctatcgtgggctctggtatcgagtgcttcatagtacggcgttnacggcgcgacgacacacgtgatagctgtgc

SEQ ID NO: 8583 - DNA, 101 bp, rice(Oryza sativa)
  misc_feature (71): n=a or g
tgtactattaacgtcgaaaactcacaatattgttttgaatgtatgcaggacgcagaggaaatccttgaagncataaagcccactccaacacttgtccttgg

SEQ ID NO: 8584 - DNA, 101 bp, rice(Oryza sativa)
  misc_feature (71): n=t or c
gcttgggagaggcaagaagaagacaatggtggaggcatgaacaaggacgacaagcccaagtccaagagcangttcaagggaaggaaaaccaaggagaacct

SEQ ID NO: 8585 - DNA, 101 bp, rice(Oryza sativa)
  misc_feature (71): n=t or c
cttaaccacatccaaattttcagccattgaattaccttgggaagagctctggctgtcgtcttggcttcatncgggccatctatgaatggtcctgcacattt

SEQ ID NO: 8586 - DNA, 101 bp, rice(Oryza sativa)
  misc_feature (71): n=a or c
cacaggcgcgggaacgtcccgctgaaagtggggaacttcagcttcgccagacgaaagaaccctcccgagtngccgtcgatcctggcggcgcgcgacgccgc

SEQ ID NO: 8587 - DNA, 101 bp, rice(Oryza sativa)
  misc_feature (71): n=t or c
ggccaaatccgccacgtgggcttgagaagattgttgtcaccgcgtgggctcaaggaagctgccaccgccgngtgggctcagggtagccaagggatgagact

SEQ ID NO: 8588 - DNA, 101 bp, rice(Oryza sativa)
  misc_feature (71): n=t or g
ggctgccacgcttcggtccgaagcctcggtccaaggtcctggacattgtgcttccgctggccaccgcattnctcgtcgctgcggtgctagctgccgtcttc

SEQ ID NO: 8589 - DNA, 101 bp, rice(Oryza sativa)
  misc_feature (71): n=t or c
ataaaggatgttatggccttggtggaggaatgtggtgctgttgaacagataaatgagtatttcattgcaantgaaatatttatcaagaaggatcaaaggga

SEQ ID NO: 8590 - DNA, 101 bp, rice(Oryza sativa)
  misc_feature (71): n=a or c
agcagaaatgacaaagactactcacaaggatcagagaatcctcccctggccgtggcaaacctttcaaggcnatgtccttggatatgtagccaacaccaccc

SEQ ID NO: 8591 - DNA, 101 bp, rice(Oryza sativa)
  misc_feature (71): n=t or g
acgaagtccaacctgttccagcatcatggaaccgtgaagatcttggatatatcggagagaacgagctgcangatacaaatatttttcgagcatctcatagt

SEQ ID NO: 8592 - DNA, 101 bp, rice(Oryza sativa)
  misc_feature (71): n=a or g
tcctctctctccctccattctctcttctttggtgaggttgtcggcatatagctggctgcctgcaatcaacngggtgaccctatggctggcggtgaaggcgt

SEQ ID NO: 8593 - DNA, 101 bp, rice(Oryza sativa)
  misc_feature (71): n=a or g
atgtaaggccatcatcagaagcccaacagagttggttcgcatggatacggcaactggcgctggaggtctcngagccaactcaagggctccggagctctcac

SEQ ID NO: 8594 - DNA, 101 bp, rice(Oryza sativa)
  misc_feature (71): n=t or g
ctgggccgtgccagcgccgaccttcaccacactgcttctgttgcctcgtgccctcgccggagaagacagtnggtggacgcgtcggcgcatcgggcggcgtt

SEQ ID NO: 8595 - DNA, 101 bp, rice(Oryza sativa)
  misc_feature (71): n=t or c
accagggagcccttgaggtttccattgagcaccttgattcgccctagggttttgagcaaggagttgccgangcagttcctcctcctcgcgagctccgcacg

SEQ ID NO: 8596 - DNA, 101 bp, rice(Oryza sativa)
  misc_feature (71): n=a or g
agtagaagcagtgacgtagaaataagtgttcttgagggtcttcaaccccatccaaatctcagacatctcangataataaattatagaggctctacatcacc

SEQ ID NO: 8597 - DNA, 101 bp, rice(Oryza sativa)
  misc_feature (71): n=a or c
catgaatgggatcatcaccgggcgcttatctcggattatatctttgaagtacacatgtatgaggttcgtantgcttaccgtcacccttcgacagttggtat

SEQ ID NO: 8598 - DNA, 101 bp, rice(Oryza sativa)
  misc_feature (71): n=t or c
aataacaaagttttaagggattatgtattgtataacctgatttctgtttctgtttgctgtatttgcaattngctctgttggacacagaaaaaatgtatcgc

SEQ ID NO: 8599 - DNA, 101 bp, rice(Oryza sativa)
  misc_feature (71): n=t or g
agatttaaggttggcaccgtttggatcaggtcgtcgggtgtgccctggacggatgatgggtctctccactncctatctatggtttggccggatgttgcaag

SEQ ID NO: 8600 - DNA, 101 bp, rice(Oryza sativa)
  misc_feature (71): n=t or g
tgtattgaacaaagcttttagagctagaagttgtttcccagaggcttgcatgaatagcaatgtatcgtctncatattgcacaattggaaaattttgatccc

SEQ ID NO: 8601 - DNA, 101 bp, rice(Oryza sativa)
  misc_feature (71): n=t or c
ggattgacagctccgacatgtatttccttacacagaacccattgtacaatggataccccatcgtttcagangctccaccctacgtggctggaacgatgtac

SEQ ID NO: 8602 - DNA, 101 bp, rice(Oryza sativa)
  misc_feature (71): n=t or c
catgagcttgttgaacgtttggaagaatacctggatgtaagtatttatttttgttactgcaccagtttatntttaattcaaagttctatttgcagctgatt

SEQ ID NO: 8603 - DNA, 101 bp, rice(Oryza sativa)
  misc_feature (71): n=a or g
tctggcgttgctgacccgcaagtcgtcgtcaaagaagaggaggcctccagggccatggaacctccccttgntcggcggcctcctccacctcctccggtcgc

SEQ ID NO: 8604 - DNA, 101 bp, rice(Oryza sativa)
  misc_feature (71): n=a or g
aaccatgctaacacaagcaggaaatgtgaggatcactcgaagaattacaactcacggggcaactaagcatntattccggacagtaaaagacacattggaca

SEQ ID NO: 8605 - DNA, 101 bp, rice(Oryza sativa)
  misc_feature (71): n=a or g
ctcatcaattaatcttgtagttaatatgtattcgttggtgctctctttctcttgatccctagatggttttngtgaacggggtagaccatccataggggatg

SEQ ID NO: 8606 - DNA, 101 bp, rice(Oryza sativa)
  misc_feature (71): n=t or c
cacggaggtggcacactcctctcgcctcgcttttcccttctagatctcgccgctctctctccgtctcttgnggtctcgccgtcgtcagtcgccctcttccc

SEQ ID NO: 8607 - DNA, 101 bp, rice(Oryza sativa)
  misc_feature (71): n=t or c
ggctgcctcgtcataagcacaagctgcagcttcggcagttgggaaggtccccaaccagagtctactttgcngattcggctcccgaatttcagcaacccact

SEQ ID NO: 8608 - DNA, 101 bp, rice(Oryza sativa)
  misc_feature (71): n=t or c
tctctccagtcggtgtcgatcatgcttactttttgaatgtctaccgcctcggttatttcttttcttggtanggttggttcataaagatgctcaacaaacac

SEQ ID NO: 8609 - DNA, 101 bp, rice(Oryza sativa)
  misc_feature (71): n=a or c
acccgcaccaccacctccaccaccaggaccaccaccgtaaccatatcctttgccatagcctgcaccatacntgtatcctgaggctccaccacctcctccac

SEQ ID NO: 8610 - DNA, 101 bp, rice(Oryza sativa)
  misc_feature (71): n=a or c
acggcacatacatgtcacgcagcacgcgatccgtcgccagcattgaataaccagcctcagggaagaacggntcctcctcgaattcatctcccgcccttcca

SEQ ID NO: 8611 - DNA, 101 bp, rice(Oryza sativa)
  misc_feature (71): n=t or c
tcgaaacatcataactaaccgcacgctagcttttttggtttacttgtttaaccgacttaattacttcaacnatccccacaaaaaaaaaacttacttcacca

SEQ ID NO: 8612 - DNA, 101 bp, rice(Oryza sativa)
  misc_feature (71): n=a or g
ttcagggtcggattgcttcttggttgaaaacttgaaatagcatgtacaagaaaccaacataacagtggganagcttatcaagatggagttaacgaggcagt

SEQ ID NO: 8613 - DNA, 101 bp, rice(Oryza sativa)
  misc_feature (71): n=t or g
gtatggcatcaaatcaaatctgatgatgacgataaaacataatttagtaccttgtagtttccaaggttatnccacggccactgagtgagaggccctggctt

SEQ ID NO: 8614 - DNA, 101 bp, rice(Oryza sativa)
  misc_feature (71): n=a or g
aaagtgaagggcaccactgaatctgaggacaagcgcttgagcttactagctgtgccactcttatgtgctgntaagtattactcacacgtgcttaaatctgg

SEQ ID NO: 8615 - DNA, 101 bp, rice(Oryza sativa)
  misc_feature (71): n=t or g
ggcggcgacggcgcaactcatcaacatcaagtcccacgttcccgtgatccttgatctcggcgactccaacntcggcacctggcgcaccttcttcaccattg

SEQ ID NO: 8616 - DNA, 101 bp, rice(Oryza sativa)
  misc_feature (71): n=t or c
aataaatctgtagcagaatatgaaatagaattttcaagacttgcaagattggctcctgaatttgtacaganggatggctctaaagctcgacgatttgaaag

SEQ ID NO: 8617 - DNA, 101 bp, rice(Oryza sativa)
  misc_feature (71): n=t or c
gtccatcaaaagtatatcattgtcgatggtctttggaactgctacaactgaaacttttagctttctcttcnggcactgcaattgtggagaaaaatgaatat

SEQ ID NO: 8618 - DNA, 101 bp, rice(Oryza sativa)
  misc_feature (71): n=t or c
atcttgtcactgccctccttccttttaactttttcctctttgctttgggcctaccagattcatcaaccagngcaacatcttcttgtttctgctgaggttct

SEQ ID NO: 8619 - DNA, 101 bp, rice(Oryza sativa)
  misc_feature (71): n=t or c
atccctgctgggcacatgcagtagaaactccctttcgtgttgatgcacttatgcgtgcatggcctcttaanggtgcattcatcaatatcttataaaaaaat

SEQ ID NO: 8620 - DNA, 101 bp, rice(Oryza sativa)
  misc_feature (71): n=t or c
ggcaagggttcagggagttttgccccgtaacaagtaaagcttcaggagcaaaaatcctaagatatcccacntgagatctctcggaggagcgaggccacgtc

SEQ ID NO: 8621 - DNA, 101 bp, rice(Oryza sativa)
  misc_feature (71): n=a or g
gtcagcagtgtgtcaacgtacgagtggttgaatgttgtgttgtcgtccttcttcttctctgatgccgctgnatcaccggactgttgaatttgtttcttgcg

SEQ ID NO: 8622 - DNA, 101 bp, rice(Oryza sativa)
  misc_feature (71): n=t or c
gggatgtcggtgttatcattcgatgtggagccaaccaaaattgccgctagcttgcgtctgaagatgtctanatcaccctgtataatatgtagatgtagttt

SEQ ID NO: 8623 - DNA, 101 bp, rice(Oryza sativa)
  misc_feature (71): n=t or g
gaaatcgaaaggggttgcagttcttccattagggtctgtggctatggcgttgcgtttattgcccaatacanttgctgcaaataggatttgaaacttgtgag

SEQ ID NO: 8624 - DNA, 101 bp, rice(Oryza sativa)
  misc_feature (71): n=a or g
catcctttcctcgaacccttccgggaaccactcgtctgtggccccgctgatatcgtcaccattagtggatnaggagccccgctgcttctgtaaattcatag

SEQ ID NO: 8625 - DNA, 101 bp, rice(Oryza sativa)
  misc_feature (71): n=a or g
tggctctcttgagttgctaatacatggtcagtacaagcaacatgtccatctcctgtttcattactagccgncccttgactattgccctgatccgtacaagg

SEQ ID NO: 8626 - DNA, 101 bp, rice(Oryza sativa)
  misc_feature (71): n=t or c
taattcaaaccaatttgagctgttttcttttcttaatcattccttgctaaatttctaggcgcctgatgctnataaagcagcatgggatttactgaaggtaa

SEQ ID NO: 8627 - DNA, 101 bp, rice(Oryza sativa)
  misc_feature (71): n=t or g
ataatgctgcttctgccaattcagttgaaccagaaaaatcagaagaatgtttggagtttgatgatgatgangaggaggaggtagaagaggaggaaattgaa

SEQ ID NO: 8628 - DNA, 101 bp, rice(Oryza sativa)
  misc_feature (71): n=a or g
agtagctctatccgtgtcactgcaggcattatccaactcggtggtatcacttttactggtagcaccgagcncctgcagaagaatggagatttcaatttgct

SEQ ID NO: 8629 - DNA, 101 bp, rice(Oryza sativa)
  misc_feature (71): n=a or c
ctactatcgaattcaatgtaatcgaaactcggaatgtcctgatgaacatcttggacaggtatactttcgtntgctgtaactccatctgctcaatcaatatt

SEQ ID NO: 8630 - DNA, 101 bp, rice(Oryza sativa)
  misc_feature (71): n=a or g
tcttccttcaggattggacagctcaaagacattgattgcatctcgatccttcagcagcttgaacatggcancccacaagggcggtgtcgcctctgtgaccc

SEQ ID NO: 8631 - DNA, 101 bp, rice(Oryza sativa)
  misc_feature (71): n=a or g
tatttattcaccaatgatagaatttctattaacttcattaatttggacctcatttagctgccgatagaccntgccttggagaagctaccctcacacaacaa

SEQ ID NO: 8632 - DNA, 101 bp, rice(Oryza sativa)
  misc_feature (71): n=a or g
ttctacaattcatatgctagaagagtgggatttagtgtacgaaagtgccacgttaactacagagcagatgncactttatcatccaagtacatggtttgcag

SEQ ID NO: 8633 - DNA, 101 bp, rice(Oryza sativa)
  misc_feature (71): n=a or c
gcgcgtgctctccgtctccggcatatttgccgttgaagaagacgtctacaagctcaccccggcatctcgcntcctcgtcggtgataaggcctcgtgcaact

SEQ ID NO: 8634 - DNA, 101 bp, rice(Oryza sativa)
  misc_feature (71): n=t or c
gttcttcctgcatttccaggaattccaatttccgcttcctgtcggacacagaatcttctgaaggaagaacngtcccaacagtatctacaacttcatctgga

SEQ ID NO: 8635 - DNA, 101 bp, rice(Oryza sativa)
  misc_feature (71): n=t or c
cttcagcgccgtcgccttcttccccccgagcactctcacgaagatctgcatctcatccgtagcagcaggtngagtcgttagggtttgatgatgctcttgga

SEQ ID NO: 8636 - DNA, 101 bp, rice(Oryza sativa)
  misc_feature (71): n=a or g
tactcccaaccccaactccgcccgtgcagccccgtctacaggtgccaccactagtcttgatgatctcgatnatctttgtcacctggctggatatatggatt

SEQ ID NO: 8637 - DNA, 101 bp, rice(Oryza sativa)
  misc_feature (71): n=t or c
tcgccgtcgccgccgccgccggagaggatttcggcgaggaggcggaaaggaagagagaagatgaaggccangagctccacaatctccgcgaggaagtggca

SEQ ID NO: 8638 - DNA, 101 bp, rice(Oryza sativa)
  misc_feature (71): n=a or g
cacggacccgcgcacgatgttctcgaggttcgggcagatgctggcgtagtagttctgcttcagctgcgccnccgccaatggcgacgagatcgccaccgcca

SEQ ID NO: 8639 - DNA, 101 bp, rice(Oryza sativa)
  misc_feature (71): n=a or c
ttgccggaaggacgcctaggattattggaagtttggaggcaggcactcgcagatgggccacaggtgggagnagccccatttgcagcggccgtcgacgttgc

SEQ ID NO: 8640 - DNA, 101 bp, rice(Oryza sativa)
  misc_feature (71): n=a or g
ggtcaatctcgacgccttgcgcccgttctatgaagtagaggagaattcgaccaagtcagcagcagccggtngtggagaggggaaggaattagcgtcgcctt

SEQ ID NO: 8641 - DNA, 101 bp, rice(Oryza sativa)
  misc_feature (71): n=a or g
cagtaacaaggagcatagcgaacggagtgagcgaagtgagcaaagtgttgagcaaggcatacatgaggtgnttgtgcgacagttcgttggtaacaaggaac

SEQ ID NO: 8642 - DNA, 101 bp, rice(Oryza sativa)
  misc_feature (71): n=a or g
ttgtctctcttttttctttactttatattgatttctttgtcatcttttggctatacagattgctgttgggntaatgtcatcattagttttgttatatgctc

SEQ ID NO: 8643 - DNA, 101 bp, rice(Oryza sativa)
  misc_feature (71): n=t or c
agtagtggtggttctcaccatggttctgatgaggaagaggttactatgcctgtgtttgatgctaatttgcntgctggagttaaggatggattggaaagtgc

SEQ ID NO: 8644 - DNA, 101 bp, rice(Oryza sativa)
  misc_feature (71): n=t or c
gccccaaggtcaccggtagtcgcctcctctagatctactcgagcgacgatgaccgccgaagcaccattgangttgacttcctcctccggcgtcgagcttgg

SEQ ID NO: 8645 - DNA, 101 bp, rice(Oryza sativa)
  misc_feature (71): n=a or g
ttcagttttaccttcagttttccaatattgatattttgagacgtggagactgtgtaataagcaatagtaancatatgacaatctgaaatcagtatcacatg

SEQ ID NO: 8646 - DNA, 101 bp, rice(Oryza sativa)
  misc_feature (71): n=a or g
ttcgtatttttcatgggctaaaattcccagtcaaaccattccttctacctctcctgacaccctcccatctngaccagatagccacttgcctgcatggccca

SEQ ID NO: 8647 - DNA, 101 bp, rice(Oryza sativa)
  misc_feature (71): n=t or c
atctacttcatgaggcataggatcccaactaatccagtcagcaagcttgaagtctgctgaattcaactgcntatttggtaacagcctgtcgattctaatgg

SEQ ID NO: 8648 - DNA, 101 bp, rice(Oryza sativa)
  misc_feature (71): n=t or c
gccgctgattcggggtccttctccgacgatctggtgctactcgctgcatctcccatgtcgaatctcccccnttcctttgggcctaggacgagggtttgggt

SEQ ID NO: 8649 - DNA, 101 bp, rice(Oryza sativa)
  misc_feature (71): n=t or c
gtagttaacactgaatcattgatgacgctcacactcctttaatttaatactacagttgtgctgacactacnacattatcgattttttctatcgataaaatt

SEQ ID NO: 8650 - DNA, 101 bp, rice(Oryza sativa)
  misc_feature (71): n=t or c
gatatattctcagcgcacaagtgcatactcgctgctcgttcatctgtcttcagagctgagttctttggcgncatgagtgctaaagcccgtaggaccatcaa

SEQ ID NO: 8651 - DNA, 101 bp, rice(Oryza sativa)
  misc_feature (71): n=t or c
tggagcggtggacgctccaattcagattgctcctgtggcgtcatatcaccaaatatattgagaccccaggnataagacttgccagacttgttgaactcaat

SEQ ID NO: 8652 - DNA, 101 bp, rice(Oryza sativa)
  misc_feature (71): n=a or c
cactgaacaaaccctccttttttttttaatacagtaacaaactcaccttgttgtcacggcagaagctctcntcgctccagcagttctcgtcgatgatggta

SEQ ID NO: 8653 - DNA, 101 bp, rice(Oryza sativa)
  misc_feature (71): n=a or g
gtgaagatcaatataatcaacagggccatgaacgtcgaataaatcagcccaaaatccattcttcctcctcnggttgcaccccatgtcccggcatagcttat

SEQ ID NO: 8654 - DNA, 101 bp, rice(Oryza sativa)
  misc_feature (71): n=a or g
tgcatgtcggtccaccctctcaatttcttcagctatagcaggtatgtcctccccttcatcggtttcaccantaggatggcggttgaccacttcatctcctt

SEQ ID NO: 8655 - DNA, 101 bp, rice(Oryza sativa)
  misc_feature (71): n=t or c
ggtgagagttccatccaagctctcactagctctggcctctggaagcagtcatccatggcggagagatcagnagcagccaagtgattggtcttgtcagagag

SEQ ID NO: 8656 - DNA, 101 bp, rice(Oryza sativa)
  misc_feature (71): n=t or g
acagatggaggatgtagagaagtgtaaagaggatgaagaaaaggagagagatgattcacaactggagaatntagagaagtgatttaagtcagatcggggct

SEQ ID NO: 8657 - DNA, 101 bp, rice(Oryza sativa)
  misc_feature (71): n=a or g
ttcgtcgaggaggtcgtctgtaaccatggagaagctagagagccttggttttgacccatcctgtttcctcngggccattactagcggggaactcacacatc

SEQ ID NO: 8658 - DNA, 101 bp, rice(Oryza sativa)
  misc_feature (71): n=a or g
tttcacatttgacaaagtatttgagcagtcggcatcacaagaagatgtgttcattgagatttcccaactcntccaaagcgcccttgatggctacaaggtaa

SEQ ID NO: 8659 - DNA, 101 bp, rice(Oryza sativa)
  misc_feature (71): n=t or c
ggatatggcagagaagatggcagagtgcccggcgagtggcaagacaaaggtcgggagttgacagcgcatgnggcagcaagcagagatggaattcggctgcg

SEQ ID NO: 8660 - DNA, 101 bp, rice(Oryza sativa)
  misc_feature (71): n=t or c
attacacaaaaaactattcgtgtgttctttttattttctcccgtcggcatcgctcctcctcctcacttcgncgtcaccgccgctcctcctcgccgagacgc

SEQ ID NO: 8661 - DNA, 101 bp, rice(Oryza sativa)
  misc_feature (71): n=t or c
gcatcaccaccagaaggagcgcaacatgtccagggagctatctcggctgactcaaagcgtgaccagcagcnagagcgacgctggagccgtcgatccaacaa

SEQ ID NO: 8662 - DNA, 101 bp, rice(Oryza sativa)
  misc_feature (71): n=a or c
tattgatcgattgttgccaagatactggtgctttccttgtccatcttctcaatttcacaaatccaaaaatnaagagattcacagatcacaaaaattagagg

SEQ ID NO: 8663 - DNA, 101 bp, rice(Oryza sativa)
  misc_feature (71): n=t or g
gttgtgtatgacattagtagcgatgacgaaccatgttcgtcgaaccattccttaggtggtggggattgcantgggggcgaacatgtaatttatttgtaagt

SEQ ID NO: 8664 - DNA, 101 bp, rice(Oryza sativa)
  misc_feature (71): n=t or g
ttgtcttcaaaatgtaatcctgaagattatcaccaaggccataactttgaggatttctgaaataattgggngggtaatcaactggactcagtctgctttta

SEQ ID NO: 8665 - DNA, 101 bp, rice(Oryza sativa)
  misc_feature (71): n=a or c
tgctaaaccgcaacactaattaatctagcatctctgctaacatggaactcagatgcaggagagagggttgngtaccttgggaagattgaggatgggttgac

SEQ ID NO: 8666 - DNA, 101 bp, rice(Oryza sativa)
  misc_feature (71): n=t or c
aatagcctagatccagattaaattgagaatgcatgttagtgtggcactgcaaaccacactgcatgatccanaatatgcaagtagaagaaaagcctagcatg

SEQ ID NO: 8667 - DNA, 101 bp, rice(Oryza sativa)
  misc_feature (71): n=a or c
caagaagtgtttcgtccttaccgaggagggactttgtccgatgcctgtataagaggttctggcttccgtcnacctgatggcaaccatgcacctggtgcagc

SEQ ID NO: 8668 - DNA, 101 bp, rice(Oryza sativa)
  misc_feature (71): n=t or g
tccctccttttcgtggatccaagaagcacgacggatctgctggaggttgctgattgggccaaggcatggangcatcctaagggcaaccagggacgtggagg

SEQ ID NO: 8669 - DNA, 101 bp, rice(Oryza sativa)
  misc_feature (71): n=t or c
agtgacagtgtagatacctttttcttgacgtcgtagtactcgagctcgtcgaggtgcctggccaaatcggnggctagccgctgaaccaggtcgatctgcgg

SEQ ID NO: 8670 - DNA, 101 bp, rice(Oryza sativa)
  misc_feature (71): n=t or g
gaaaaaggttatgccactggttctgctctactttgcccatttgtgcactcaagacacgttgcacaataagnctctcatattggtccgcaacatcagccccg

SEQ ID NO: 8671 - DNA, 101 bp, rice(Oryza sativa)
  misc_feature (71): n=a or c
gggagcagcgcggtgatgagggcgacctgctcctggctgatctgcctgatcttgccgagcacgctccagangacgtcctcggtgcacggcggcgccgtcag

SEQ ID NO: 8672 - DNA, 101 bp, rice(Oryza sativa)
  misc_feature (71): n=a or c
cgacatgacccttcgcataaccctccctagccaagcgcaccacactataggtttcgccctacccttaaaancaaggtaagcagccccctcttctgcccagg

SEQ ID NO: 8673 - DNA, 101 bp, rice(Oryza sativa)
  misc_feature (71): n=t or c
cgcacctcgcaccgtgatgtgatggtggatgtagtgatggacgtgctgcgtgcactcgccagtcccaactnggatgttaagaggaaggtgctggatttggt

SEQ ID NO: 8674 - DNA, 101 bp, rice(Oryza sativa)
  misc_feature (71): n=t or c
cgctgccctgatgatgacgccggacggagtagaggaggaggccaccgtccctgtaatgtcgctgctggagnggctcgacggggcggagtcagaggaggctg

SEQ ID NO: 8675 - DNA, 101 bp, rice(Oryza sativa)
  misc_feature (71): n=a or c
tgtcgtaatgtcgacgtagcgacgaggggagacatctgaccggagtgctttgcccctatcagataacgatncttctcctgtaccgataggaagacaagggg

SEQ ID NO: 8676 - DNA, 101 bp, rice(Oryza sativa)
  misc_feature (71): n=t or g
atctcccactactccgtgcccctccacgacggcatcgtcttgattccccatttcgacagcatcgatggcgnagaagaagatgaagaggagcaccgccttgt

SEQ ID NO: 8677 - DNA, 101 bp, rice(Oryza sativa)
  misc_feature (71): n=a or g
cacgagaagtggaagtctgtgatgaggacgtcgggagattggtccttgatgagcgcctcctgtgctggccntgtcatcgcctcgtcgaaggcagcggcgtc

SEQ ID NO: 8678 - DNA, 101 bp, rice(Oryza sativa)
  misc_feature (71): n=a or c
acgaatttgttgaatccaccactaaataccttctctgaaataacctcaaggagctccaggtcagcaacagnagaacctgttgatgtcttcaatttgaggaa

SEQ ID NO: 8679 - DNA, 101 bp, rice(Oryza sativa)
  misc_feature (71): n=a or g
agtgtctgcgtagatgcacgaagcagtgcagatgtcatcgcagctgccgcagaacatctttgccgcggccngcgcgacggaggaggacagtactagcacgg

SEQ ID NO: 8680 - DNA, 101 bp, rice(Oryza sativa)
  misc_feature (71): n=a or c
taaatgtgagagagtaagacatacggtccagcattcccaggctctagctctaatagcttcttagcagcaanctcagcaatctcagcattcctgtgcatcct

SEQ ID NO: 8681 - DNA, 101 bp, rice(Oryza sativa)
  misc_feature (71): n=t or g
cagatacagactctcttagcgtcagtactcctaacggggtcgccaggtccttgacaccaagccctctgganagcccgacttggatggtggggcacaacgac

SEQ ID NO: 8682 - DNA, 101 bp, rice(Oryza sativa)
  misc_feature (71): n=t or c
tcatcataagttcaggactactgtagccttttttttttccttcttcatgcataggtgtgtttagttcacgntaaaattaaaaatttaattgaaattgaaac

SEQ ID NO: 8683 - DNA, 101 bp, rice(Oryza sativa)
  misc_feature (71): n=a or c
acttgccaagcaccctctgggactggaaggggttgtaacaaacctggatacttagcacggtcaggtttagnttggagacatacttgacattgtttcaacaa

SEQ ID NO: 8684 - DNA, 101 bp, rice(Oryza sativa)
  misc_feature (71): n=a or c
acttcaaccccacggtgaagatgacggcgacctacagctccaacaagcaggtgttcaacggccacgagttnttcccgtcggcggtcgtgtccaagccgcga

SEQ ID NO: 8685 - DNA, 101 bp, rice(Oryza sativa)
  misc_feature (71): n=t or c
gactccttcctcgctccagctcatgttggagactatcttttctatgagattgattgctcctctgaccgtcntggaaaagaaggctcctccacttgccgtgt

SEQ ID NO: 8686 - DNA, 101 bp, rice(Oryza sativa)
  misc_feature (71): n=t or c
ggcggcgtcggaaaatggccgacaatgaggtcctaccggactgaggactggctgcgcaaggaggttgctgnggtgatgcagactgtggtggggagcaaggg

SEQ ID NO: 8687 - DNA, 101 bp, rice(Oryza sativa)
  misc_feature (71): n=a or g
gtgaattgggctctcccctagtaacctcaagtaggcctgcattcggaacattttgttcaaaccgtgtcaanaacagccgacagtgctgaaaacggttgatg

SEQ ID NO: 8688 - DNA, 101 bp, rice(Oryza sativa)
  misc_feature (71): n=t or c
gagaagtatgatggccccgtcgacctgacggagtacctccagatattatcaccgccatccaggcagccganagcgatgagaaggtgatggcgaactacttc

SEQ ID NO: 8689 - DNA, 101 bp, rice(Oryza sativa)
  misc_feature (71): n=t or c
ccactcttgcgacatctctttttgctcaactctggtgcatccctgtcggtcgacttcttcttctcatctcntgccttgctttttccctccttgcgcctcac

SEQ ID NO: 8690 - DNA, 101 bp, rice(Oryza sativa)
  misc_feature (71): n=t or c
atcatattcaaaatccatggcaagtttccagtttttattctttagtgcctctatatgatcactaggttcancagaactggtaaagcagccatatctaactg

SEQ ID NO: 8691 - DNA, 101 bp, rice(Oryza sativa)
  misc_feature (71): n=t or c
atcccttcagggacacgagtcttggtcaatgtttgggccattggtagggatccacgcttctgggaggacgnggaggagtttgtgcctgagaggttcattga

SEQ ID NO: 8692 - DNA, 101 bp, rice(Oryza sativa)
  misc_feature (71): n=t or c
gccggcggcggaagcgcgaaggtccacgttaagttgaaaggccccggagtgaggaacaactgctggctcgncatgttcatggcgcgctgcgtcttgtacac

SEQ ID NO: 8693 - DNA, 101 bp, rice(Oryza sativa)
  misc_feature (71): n=t or c
ataaaatggtcgatcaattgtaaccttctcaataagttcacgtgcaaggcatccttggggcatttttgtgnttggtgagactgaaatcaaagaagtaacat

SEQ ID NO: 8694 - DNA, 101 bp, rice(Oryza sativa)
  misc_feature (71): n=t or c
cgcggcttcattggtgaagttgttgcagttgttgctgaggaggttgtagtttgcaggagtgtaccttgggntgatatcctgaaggaagtcctcaaagatct

SEQ ID NO: 8695 - DNA, 101 bp, rice(Oryza sativa)
  misc_feature (71): n=a or g
tacccgcggcatttctcggatggatgctgctggtacggaagaacacggaccccaatctgaagccgagaatnaggaaaaagggtcagaaatagtactacctc

SEQ ID NO: 8696 - DNA, 101 bp, rice(Oryza sativa)
  misc_feature (71): n=t or c
gtcgtcgcgtaaattccgtcagtgcttttcctgtgcttcttctgtatcttggtcctccagaagttcttganctcgttgtcggtccggccaggaaggtacct

SEQ ID NO: 8697 - DNA, 101 bp, rice(Oryza sativa)
  misc_feature (71): n=a or c
ttattaacaactggatatctagtccatttgtaaacatttgaaaatggtagctggcagatcactccatttgntacaatatgatggcttgaacaatgttttat

SEQ ID NO: 8698 - DNA, 101 bp, rice(Oryza sativa)
  misc_feature (71): n=t or c
ttgcaactacccttcctatcccagtcaaaagccttcaaaaatttattatctccaccacatcatcacaagcngcagcagtcagaaaaacaaggggaagaaga

SEQ ID NO: 8699 - DNA, 101 bp, rice(Oryza sativa)
  misc_feature (71): n=a or g
cttgccgcagagggagcactcctcgaggaagtggtggatttgggcgacgtccgcctcgtggacgtagaacntggacgacggcatcgctgcaccgctcccct

SEQ ID NO: 8700 - DNA, 101 bp, rice(Oryza sativa)
  misc_feature (71): n=t or c
aaataaacctcataataatttagaatggcagatctcctctcccgttgtaatattgtaagtggttcactttngatcactagcggttgagaaggttcttcgag

SEQ ID NO: 8701 - DNA, 101 bp, rice(Oryza sativa)
  misc_feature (71): n=a or c
gtggaacaccaagatgtctctgatggtgacagcattgtcgattcgctcgaactgggggcagaacgcttgcngcaccatggcctcgaaggacgcactgcccg

SEQ ID NO: 8702 - DNA, 101 bp, rice(Oryza sativa)
  misc_feature (71): n=a or g
cgtctcgtcgtcactggaatcggactcttggtcgtcatcgccggacgaggacacaatcttgttcgccttcngcgctgactcttggtcgtcatcagaatcag

SEQ ID NO: 8703 - DNA, 101 bp, rice(Oryza sativa)
  misc_feature (71): n=a or g
tcacctaggtcaataccaagtcattcatctaattctagtcaagattgtttcccgcgaaagaatcggtccgntggatcaaatgtgaaaaatgtgaagaaggt

SEQ ID NO: 8704 - DNA, 101 bp, rice(Oryza sativa)
  misc_feature (71): n=t or g
ttcatcaacataagaacgaactgtggaaatataggcaatttgatcaccctgtataaccccaagtctatttnctatgcgagtaactaaagaagtgcattcac

SEQ ID NO: 8705 - DNA, 101 bp, rice(Oryza sativa)
  misc_feature (71): n=a or c
ttgctagcgtgcctgcatgcagtggacggtgagcctgtagtcgtcgttgattctacctctgttgaggctgntgccttggatcatgtcatcatcaccgtcga

SEQ ID NO: 8706 - DNA, 101 bp, rice(Oryza sativa)
  misc_feature (71): n=a or g
tggcatcatcgaagacctccgcgagttcgtcaagggcatgactacgctaccgacaccctcctcccgcgtcnacgccgacaaccttctccatgctaccgcca

SEQ ID NO: 8707 - DNA, 101 bp, rice(Oryza sativa)
  misc_feature (71): n=a or g
tatcatcatgcctgtcatgctatgacctcatatgaaggtgaactcaactcctgcaacgcaatcccggtgtngtaccaaactgcttttcgttaatgctcata

SEQ ID NO: 8708 - DNA, 101 bp, rice(Oryza sativa)
  misc_feature (71): n=t or c
aagcaccagatcaacatgtataggaggcagatcgtcagctgtaccagtgtagtcccacattcttgctatcnttgcacggatcttccagcctctgcttgctg

SEQ ID NO: 8709 - DNA, 101 bp, rice(Oryza sativa)
  misc_feature (71): n=t or c
ccagcgtgtggaggccatcgatcgatttgtagttgcggttgcaatgacagattgggagcagcaaaaaaatncacaagaatctcaagacaaagctcaagctt

SEQ ID NO: 8710 - DNA, 101 bp, rice(Oryza sativa)
  misc_feature (71): n=a or g
cgaaagaagggtagaagtggttgtaaggcagtccctcttgatttggaacaattgcacaacattcctctcangcaaagaatgaccatagaagatgtgtctag

SEQ ID NO: 8711 - DNA, 101 bp, rice(Oryza sativa)
  misc_feature (71): n=t or c
tcccaaaacggcccgaaatgcgagatgccatcgcagaattgccggacagccacatcaatgttccatgacangaatctattccagaagtgccagagagagac

SEQ ID NO: 8712 - DNA, 101 bp, rice(Oryza sativa)
  misc_feature (71): n=a or g
gctcaaagctcaggaacaatcaacacgaaccgcgggtttctattcagatgcttcgggccatcgcccacganctgaaggatccatcaagcttatatcgtctc

SEQ ID NO: 8713 - DNA, 101 bp, rice(Oryza sativa)
  misc_feature (71): n=a or g
aaagggagaccagaaagaaacacacaacgaagaagagcctacaagtgaaaaaaagcagcctgtgtctgctnaaataaaaaaatctgttcccaagagaatat

SEQ ID NO: 8714 - DNA, 101 bp, rice(Oryza sativa)
  misc_feature (71): n=a or g
cctgcaagccggcgacggcggcggccgggtctggaggtgggtctgcaagccggcgatctggatgttcatcnccggccgcttcctgctcttctactcgttcc

SEQ ID NO: 8715 - DNA, 101 bp, rice(Oryza sativa)
  misc_feature (71): n=t or c
aactttgtggctgacaagtggggtcatgtggcaattgtcacatgttaatttacgtcggaggatcatattcngctgcaaagttggatatttacatgtttaca

SEQ ID NO: 8716 - DNA, 101 bp, rice(Oryza sativa)
  misc_feature (71): n=a or g
ggtgtagtcgtggatctcctcaatatggaagagaaccgggtgcttgacctcttgttgccaatgctccggcngcgtctccgagatcgtgatcgactcgagga

SEQ ID NO: 8717 - DNA, 101 bp, rice(Oryza sativa)
  misc_feature (71): n=t or c
aacaaagctaagctctttggatcgccactcctcagatgtggtcttggcttctgcttccagctgttccaccntattcttcaagcagatcctctcgtagtttg

SEQ ID NO: 8718 - DNA, 101 bp, rice(Oryza sativa)
  misc_feature (71): n=a or c
ttctctccaatcctcctcctcttattccaaagaaccataactagcaccctatacttgtctgcaaggtcacnaattggtagtgctttatagtccttaatcca

SEQ ID NO: 8719 - DNA, 101 bp, rice(Oryza sativa)
  misc_feature (71): n=a or g
actattcctcacatcatagttcaaccgaaagacatcaagatcaaacagtccaagttcaggaatccaattcngcttcctgctacagtgctgaattcaaacgg

SEQ ID NO: 8720 - DNA, 101 bp, rice(Oryza sativa)
  misc_feature (71): n=a or g
gaacacatcacaggtcaaactgctgcgttgtagtacgctatctaacaaacagaaatccaacgcgcattccncgttcgcctgcctcccaacatgcatgcatt

SEQ ID NO: 8721 - DNA, 101 bp, rice(Oryza sativa)
  misc_feature (71): n=t or g
gatgccggagagggtacctgcataccagggcgtgctggaagtgggtggttgtgttgtcccatagtggactnggaactggaggggggcgcaggtgatggtcc

SEQ ID NO: 8722 - DNA, 101 bp, rice(Oryza sativa)
  misc_feature (71): n=t or c
actgcaccatggacaagggccatacataaacaaggaccccagaagcacaaattaacaatgatgttgagctngaatgccaaaccacaatgctcctttcttat

SEQ ID NO: 8723 - DNA, 101 bp, rice(Oryza sativa)
  misc_feature (71): n=a or g
acttctgtgcaaggggactcatgttttgcactgcaactatatgcagatgctgaagaatgcaagcattgaanaggtaatgcaattgatcctaaaggcagtac

SEQ ID NO: 8724 - DNA, 101 bp, rice(Oryza sativa)
  misc_feature (71): n=t or c
tgtcactccggatccacgccactattgtcgaggtcatcgccctccgagtcctcaatgtgctgtctactcgncatcggccgggataggagggggcccaatga

SEQ ID NO: 8725 - DNA, 101 bp, rice(Oryza sativa)
  misc_feature (71): n=t or c
agcgaccccgtcccgtagatcgtcctgttcccgtcgtctgggaactgagtgctcaggtatcggcatatcgntcttgaatctatgccacaaaacaacaagaa

SEQ ID NO: 8726 - DNA, 101 bp, rice(Oryza sativa)
  misc_feature (71): n=a or g
cccatattattcgcctttcgcttctgcttgctttccgatcgatcaccgaggcgccgatcgatgggtcgtcngcgacggcggcgcaaccgcgacgccgagtt

SEQ ID NO: 8727 - DNA, 101 bp, rice(Oryza sativa)
  misc_feature (71): n=a or g
gagagagaggagattggcaattgcttcaccggcggtggggaggttttgtaccttattgtgtgcttaccgcncttattgctagggcgcggtaacgtttttcc

SEQ ID NO: 8728 - DNA, 101 bp, rice(Oryza sativa)
  misc_feature (71): n=a or g
tggtgaggaaggtggctgggacctagaagacctggaacttccgcctgaagcagagacccctaaaaacgccngtaatgcactctcagtggtctttgttgctc

SEQ ID NO: 8729 - DNA, 101 bp, rice(Oryza sativa)
  misc_feature (71): n=a or g
cttgagcaggccacgggcggcaaaccccatgagctcagaagggtccgtgtgctgtctgaagaagagcggancaccgaaattggagcagatctcggcacttg

SEQ ID NO: 8730 - DNA, 101 bp, rice(Oryza sativa)
  misc_feature (71): n=a or c
gggcgacgggctggagttggtgttggagcccttgttgccgccctgcttgcctttgcccttgcctttcttgncgccattgccgttgccacgagagccacccc

SEQ ID NO: 8731 - DNA, 101 bp, rice(Oryza sativa)
  misc_feature (71): n=t or g
catcacactagatgaatctagaattgaggatattccgcaggtaatgaatgaggaaaatgaattcctaacancacctttctcggaggatgagatccagggag

SEQ ID NO: 8732 - DNA, 101 bp, rice(Oryza sativa)
  misc_feature (71): n=a or g
atcgccaccgccaccaaatctgcaaagtgccgacccgttgctccacaaccatgcaggggggtgggttatcntgctcggatataatgccgatagtggtatgc

SEQ ID NO: 8733 - DNA, 101 bp, rice(Oryza sativa)
  misc_feature (71): n=a or g
tgggttgttactaatttgagtctctggccatcctccagctgatatccttgtgcgattgcagctggtctgcnctgcagaattgaaatgatgtattaagactg

SEQ ID NO: 8734 - DNA, 101 bp, rice(Oryza sativa)
  misc_feature (71): n=a or g
gatacatctttttgttgatgtgcatacatgtgaatgggttcatagtcccgtctttactatggtaacaagtnaaagctatttctagtgtagtttcaacaaaa

SEQ ID NO: 8735 - DNA, 101 bp, rice(Oryza sativa)
  misc_feature (71): n=t or c
aactgaaaacgatcatgttaatgtatctccatttgccaaaatttcgagtcaacgttctctctctctgcagnggcaagcatgtgggggcttgtcgccctgag

SEQ ID NO: 8736 - DNA, 101 bp, rice(Oryza sativa)
  misc_feature (71): n=a or g
cgtcgagtttgacaccctcatggatgtgcagttcggggatgtgaatgggaatcacgtcgggttggatcttnggagcatggtgtccgccgcggttgccgatc

SEQ ID NO: 8737 - DNA, 101 bp, rice(Oryza sativa)
  misc_feature (71): n=a or g
ggtcggtgtggtacgcccctctcctctatgtgctcgtaccccctggccgtcgagccacttcctcgcaacantggcggccttggcgacaggcaccccaatgc

SEQ ID NO: 8738 - DNA, 101 bp, rice(Oryza sativa)
  misc_feature (71): n=t or c
agccccatccacatgatcccgctcatcgagatgtttgacttgggtgcagcgaggaggaggagatgggtggnggacagtggcggatccagaaaatcagtttg

SEQ ID NO: 8739 - DNA, 101 bp, rice(Oryza sativa)
  misc_feature (71): n=a or c
ctgcccgtcagctcagataacctttagtttactgccggatcagatagccgtgaggacagtgtcagaatccnttacgaggcaccatttgatttagattagaa

SEQ ID NO: 8740 - DNA, 101 bp, rice(Oryza sativa)
  misc_feature (71): n=t or g
gatcatgtcatcatgtaagcagcagcttgagaagctaaccacctccaaggtagaggagaagtgaaatgcanatattactagcaagtagctcatgtaatttg

SEQ ID NO: 8741 - DNA, 101 bp, rice(Oryza sativa)
  misc_feature (71): n=t or c
aagttcaagctgcgttccactttcggtaatcctggcatatagttcttttgcagcagcagttcttctggtgngaaataaaccatgcagaattatgttatatg

SEQ ID NO: 8742 - DNA, 101 bp, rice(Oryza sativa)
  misc_feature (71): n=t or c
taatgatcctagtgctgacatgaagtttccttgaggctgaccactcccaatattagtcttgatttctctanacttgggaaaaacaccacttggaaaacaga

SEQ ID NO: 8743 - DNA, 101 bp, rice(Oryza sativa)
  misc_feature (71): n=t or c
tgcagccgtctatgtcttgagcaaatcaccaatgaagagtcttgatggggtgacgccgtatgaagcgtggnatggtcgccgacccactgtcgaacacctgc

SEQ ID NO: 8744 - DNA, 101 bp, rice(Oryza sativa)
  misc_feature (71): n=a or g
accgtcctagatgcgcggtggatccccatcacgacctgtcccacctctccgatctctcttgatctcctccngccggccgtcaccaccgtccgtcttcgcac

SEQ ID NO: 8745 - DNA, 101 bp, rice(Oryza sativa)
  misc_feature (71): n=a or g
tccaatggctgacccagagtctagcatcagtgaaatcccagaagggccagaatctgctctcccgtcactcnaacagctaaccagagcggagccatctccgc

SEQ ID NO: 8746 - DNA, 101 bp, rice(Oryza sativa)
  misc_feature (71): n=t or c
atcttctagtaactggccttcttgctcttcgacaaagccttctgcaacccaaaaccgcacaagatcagcangatgcatcatctgaccttcgacatagagag

SEQ ID NO: 8747 - DNA, 101 bp, rice(Oryza sativa)
  misc_feature (71): n=a or c
cccctttatccaccaaagtccatattacatctctccagaacccaagttcctctctgaaagtctgtattttntccctcctccaaacttcgggcagtagccca

SEQ ID NO: 8748 - DNA, 101 bp, rice(Oryza sativa)
  misc_feature (71): n=a or g
tggaggtgcacggtatgctggcggatatggtgtaggtgctggctatggtggtggatatgggggatacggcnataatggtggtggtggtggaggtggtggtg

SEQ ID NO: 8749 - DNA, 101 bp, rice(Oryza sativa)
  misc_feature (71): n=t or g
tttatattttaataagaatttctatagttctttttgacagttacaaccttgcaggttttccataacacggngaagatccactaaggaaacaggagagcaat

SEQ ID NO: 8750 - DNA, 101 bp, rice(Oryza sativa)
  misc_feature (71): n=a or g
gccttcagatcttggccaagccccattcctggatggaggaactggtacctccgcgtctctgaagctaagantaccatatgggaagtttatgatataaacca

SEQ ID NO: 8751 - DNA, 101 bp, rice(Oryza sativa)
  misc_feature (71): n=t or c
gagaatctctaactatatctgtttgttttttttaagggtggtggagagcgtgggggagaacgtggaggggntcgcggcgggggacacggtggtgccgacgt

SEQ ID NO: 8752 - DNA, 101 bp, rice(Oryza sativa)
  misc_feature (71): n=t or c
ctctcccttcctccgcctcctcggcttcccacctgtccagcgcccacctccctttctcctcctacacctcngccaccaccaccaccaccgtcctcgccttc

SEQ ID NO: 8753 - DNA, 101 bp, rice(Oryza sativa)
  misc_feature (71): n=t or c
gctctcagcatcgccgaaccctagtccccaactcgctgtcaccgatcccacacatcctctgccccatcctngccgatcccccacctccgccatcatgccac

SEQ ID NO: 8754 - DNA, 101 bp, rice(Oryza sativa)
  misc_feature (71): n=a or c
gtgcctcctcctccttcgctcccagtgtcatggatcgatcaatgtcatgtcaccctggcgtttgattgatntcttctttgtagatttctacgacgatgtcg

SEQ ID NO: 8755 - DNA, 101 bp, rice(Oryza sativa)
  misc_feature (71): n=t or c
gccccacaccacgtccttcgctatccatgctctgcaccacgccggagcttgtcccggaggctgcatcctcngtcgtccatagccatgccacgccgggaact

SEQ ID NO: 8756 - DNA, 101 bp, rice(Oryza sativa)
  misc_feature (71): n=t or c
agtgtccacgtaacatgccacgtaaatggccatggcaatatgaaaccggaataatcaataagtttagaganatgagagtttggcaatctagatgacataaa

SEQ ID NO: 8757 - DNA, 101 bp, rice(Oryza sativa)
  misc_feature (71): n=a or g
ttctttcttgggtcggagaattgattggtgtttgtgtgtgttggtttcagttgcaggtcagggcgagcgcngcggcggcggcggcgaacggcggcggggat

SEQ ID NO: 8758 - DNA, 101 bp, rice(Oryza sativa)
  misc_feature (71): n=t or g
ctcggtgtggacaacggcgacaatgacgacttcaagtgcccactgtacagggaagtgacggagggaggtgncggacgtatgtgcctgccacagtacggttc

SEQ ID NO: 8759 - DNA, 101 bp, rice(Oryza sativa)
  misc_feature (71): n=t or c
gccttcctgattggaaaagatggtacaccatcctcgttccatgcgaagaggactatgcagtgttgggcgtnccaggatggctacgactggtttgggtggca

SEQ ID NO: 8760 - DNA, 101 bp, rice(Oryza sativa)
  misc_feature (71): n=t or c
atcttgttctccttccttgtctgctccaccgtcatcattgtatcctccttttgcgcctcggtagcgctcgncaccgccgtcgatgttggcgatggccactt

SEQ ID NO: 8761 - DNA, 101 bp, rice(Oryza sativa)
  misc_feature (71): n=a or g
cttgagaagagattgaattcttgggggaataatctgtcccatgctggaagagctgttcaaattaatgcctntctctcttcaatcccttcctatgccatggg

SEQ ID NO: 8762 - DNA, 101 bp, rice(Oryza sativa)
  misc_feature (71): n=a or g
cccacacagtatagtggtcggttttggctaatgtggcgagtaggatccacgtggaccccacatattagcgnccaactcttctccctcatctccctctccct

SEQ ID NO: 8763 - DNA, 101 bp, rice(Oryza sativa)
  misc_feature (71): n=a or c
ggttcatgatgacggaacacttccagcgggagttgactttgggaaaccgatggccggggtagagatcaacnttgcggagtggtgggaagtggcggaactga

SEQ ID NO: 8764 - DNA, 101 bp, rice(Oryza sativa)
  misc_feature (71): n=t or c
cactccctccacccagggcagggactggaccgaaatggctacactcacgcagcggagtaccagacgacaanggcgcgagacgccctatggcggaactcgcg

SEQ ID NO: 8765 - DNA, 101 bp, rice(Oryza sativa)
  misc_feature (71): n=t or c
tcagcagagggagcagcaaactcgcggagagccttgttagccacaatcttgaaggtctgtggggctagtanggctagtttctctgtcggtagagttttttg

SEQ ID NO: 8766 - DNA, 101 bp, rice(Oryza sativa)
  misc_feature (71): n=a or g
agccgtagtgactgcctccccccaatagcacgccggcactgacttggccttgagaagactctgcaccatcnccagaatcatctggttgcggcgctcaacca

SEQ ID NO: 8767 - DNA, 101 bp, rice(Oryza sativa)
  misc_feature (71): n=a or g
ggactccaaggggtcttctgctgctgagcaattctgggttgcatactcggcgttgtcgctgagcaatgtcnatcagctgcggaaagggatgcagtctgcaa

SEQ ID NO: 8768 - DNA, 101 bp, rice(Oryza sativa)
  misc_feature (71): n=t or c
gttgtcagaaactcttctaacaaatctggactatcataccgtagaaagcaccataaaggtgctctattgcnattcatatgtttcctatgttacttgaccct

SEQ ID NO: 8769 - DNA, 101 bp, rice(Oryza sativa)
  misc_feature (71): n=t or c
gtttcatttttcattaatgcataatattctttgtccatggcctctttccagttcctatctcctagagcctnagctaggttctgtggttccccagatgatgt

SEQ ID NO: 8770 - DNA, 101 bp, rice(Oryza sativa)
  misc_feature (71): n=a or g
tgacacacaatatcgcggctacgcgatgaagatgttggtgtgggagcagtaggccgacgagactctgtgcntgcagctggagatgatgccgaagatggttg

SEQ ID NO: 8771 - DNA, 101 bp, rice(Oryza sativa)
  misc_feature (71): n=t or g
ttaagagacaaaagttggaggaaaagaagatcattaggaaggaaagaagaagggaagaaaggatggcattnaaagaagataaatctgatagggaaaggtca

SEQ ID NO: 8772 - DNA, 101 bp, rice(Oryza sativa)
  misc_feature (71): n=a or g
atctagtttttttaagatgcttatagtttataggaacgagacgagagtacccatgttacgcgcgcgtgtanttgtagtgtttcttaaaaaaaatatattaa

SEQ ID NO: 8773 - DNA, 101 bp, rice(Oryza sativa)
  misc_feature (71): n=a or g
accatttctcctcactgttgttccttctttcttttggtcaaccccgagtttctttgatttgtattctcagnattttttttaatgcaatggcaggattagct

SEQ ID NO: 8774 - DNA, 101 bp, rice(Oryza sativa)
  misc_feature (71): n=t or c
gccgccaccacccaagagctgttgtcgaggaggcaatggcactccaccaccacgtcagaccaagtggtcangacaggcggcggcgcgaccacaggagcggc

SEQ ID NO: 8775 - DNA, 101 bp, rice(Oryza sativa)
  misc_feature (71): n=t or c
ttgtggtgtctatttctaattttccatttgtacttttctcaagcaacattgcataaattgctcgcttttgnatgtttgtcaaatctcttggttgacttggc

SEQ ID NO: 8776 - DNA, 101 bp, rice(Oryza sativa)
  misc_feature (71): n=a or g
taccaaaatcatcaaaattaaaagaattgcaattaaaaccttttgtagcacataatttccatagatatccntcaccaattcaatagcatcaggcatgattt

SEQ ID NO: 8777 - DNA, 101 bp, rice(Oryza sativa)
  misc_feature (71): n=a or g
gtggtttacctcggggggctcatagagcggcatgtccgtggagatgctggaggagtaggagatggcgtccnacgacaacgacaaccgcacatacgccacgg

SEQ ID NO: 8778 - DNA, 101 bp, rice(Oryza sativa)
  misc_feature (71): n=t or c
acacagaccaaatcatggatattctgccaagggaccaatttctctcgggcacagagggcacagttgcccanttcatcaggcttccgtccctggtctgtctc

SEQ ID NO: 8779 - DNA, 101 bp, rice(Oryza sativa)
  misc_feature (71): n=a or g
tcaaacaaaggcaacaaaactagtccgccaatcaccttatagttgccaagcaagggtctcatgctgtctgnacaacctactcatccgtggtgctaacgact

SEQ ID NO: 8780 - DNA, 101 bp, rice(Oryza sativa)
  misc_feature (71): n=a or c
gcggcctcgcagcacgccatcccgatcttgatcagcttcaccatctcccccttgctctcctcgtcctcccncttcctgatcatgtccgcgtccaccacctt

SEQ ID NO: 8781 - DNA, 101 bp, rice(Oryza sativa)
  misc_feature (71): n=t or c
gacttggagctcaccggagaaagaggaaccaatgatggagctcagcggcttgacttggagaagaatagctngatctctctcctcggtgctcagatcttggg

SEQ ID NO: 8782 - DNA, 101 bp, rice(Oryza sativa)
  misc_feature (71): n=a or g
aattctggtggattctgggagtactagcaacttcttggctgaaagggtagcagaaaaattgaacctaccantaagaggaacaaccctgtcacaaataacca

SEQ ID NO: 8783 - DNA, 101 bp, rice(Oryza sativa)
  misc_feature (71): n=t or g
caagatttccttgatgtagaatgcagcagcatgaagaacgacgacggtgatcgcgacggcgacgatgtcanctcagcctcagagacgccgccggccagcac

SEQ ID NO: 8784 - DNA, 101 bp, rice(Oryza sativa)
  misc_feature (71): n=t or c
caatgatcatcactccagggcaggtcaattccgtgatcaatgtaccacctcaggaaatgtatacgatcttngcagcccagctcgtcagctcaatcagcgtt

SEQ ID NO: 8785 - DNA, 101 bp, rice(Oryza sativa)
  misc_feature (71): n=t or g
agtcaattatttttagtttgaaaagaatacctccatcttatcttggatctcttgaagacagctccaaaaancttgcaggttcttcattatcagcatctaca

SEQ ID NO: 8786 - DNA, 101 bp, rice(Oryza sativa)
  misc_feature (71): n=t or c
tctatccgaggcgaattcacggatacgtcgggggattccagctgctcgaggatgctgatgctgctgacgcngcgcttcggtgtctcggatgatggcagtgg

SEQ ID NO: 8787 - DNA, 101 bp, rice(Oryza sativa)
  misc_feature (71): n=t or c
aatcttccactgggacacaccacaggcccttgagagcaaatacggaggattcctgagtgagaatatcatgnaagttttttagatagagacaaagaaaatcc

SEQ ID NO: 8788 - DNA, 101 bp, rice(Oryza sativa)
  misc_feature (71): n=a or g
gcggaagatgatgcatgcatgcatgattatagtattagtgtggtgtggtgtgttgtttatgcaattcagcnagcgagtaattaacattagggcccctttga

SEQ ID NO: 8789 - DNA, 101 bp, rice(Oryza sativa)
  misc_feature (71): n=t or c
tcaatggtgatccagtgtgggtgctcgggtgactcgcgattcagcggaggatcatgagtctccccaacacnaacacttgatccgcctctgccatgaggtga

SEQ ID NO: 8790 - DNA, 101 bp, rice(Oryza sativa)
  misc_feature (71): n=t or c
agctattaccatatagatacaactgcctttcaaaatattctggacaaccaacgagtaccttgtcgacaacntaccacctacatgctctgaaaatgctgctg

SEQ ID NO: 8791 - DNA, 101 bp, rice(Oryza sativa)
  misc_feature (71): n=a or g
agcaaggttgtaatgctcctgacaatatagaaaatgaccctccacagtggtaccatccacaaagcgaactncaacctgaaatagtagttaattattgcatt

SEQ ID NO: 8792 - DNA, 101 bp, rice(Oryza sativa)
  misc_feature (71): n=a or g
tagcatttccttgccgaattctttcttttgtttcatatcaattgtgatgcatcttttgacggctatttccntgtttcccttgagaagtcccttgtaaacag

SEQ ID NO: 8793 - DNA, 101 bp, rice(Oryza sativa)
  misc_feature (71): n=a or c
ttatctctgctgctgaattgcgtcacgtcatgactaaccttggtgagaagctgacagatgaggaggttgangagatgatccgtgaggccgatgttgatggt

SEQ ID NO: 8794 - DNA, 101 bp, rice(Oryza sativa)
  misc_feature (71): n=a or g
gcaattggaaaaagaaacaatggttcttgtaatagatagacctattcaacaagttcacggcgtcaatagcnctaaagatttgagtcgcaacagtagcattg

SEQ ID NO: 8795 - DNA, 101 bp, rice(Oryza sativa)
  misc_feature (71): n=t or g
tttgcgtgtttcatgcaatgctggagaagaatgtgctttcctgctctttttggcaggaggggaaatgttanccctgctatcggcctccataccctccccaa

SEQ ID NO: 8796 - DNA, 101 bp, rice(Oryza sativa)
  misc_feature (71): n=t or g
ccacgcctccttcgcggtgtccttcgacgccaatgttgccaacatttccgacggcaccgcttggaggatgnccgccaatgccatcctgtcgatccggtgct

SEQ ID NO: 8797 - DNA, 101 bp, rice(Oryza sativa)
  misc_feature (71): n=t or g
tggaagtgcagttgtctcagtgatgcaaacagagtgtttgaagaatgttcttctggtgacattatagcttntacatccatgatcacagcactctcacagtg

SEQ ID NO: 8798 - DNA, 101 bp, rice(Oryza sativa)
  misc_feature (71): n=a or g
aactttgttcgtcttccgaggagtgtccaacattgctgccttgaagaagtgatccgcgttcacgtcctttnggttcaggcaagcaaatccattgacaagca

SEQ ID NO: 8799 - DNA, 101 bp, rice(Oryza sativa)
  misc_feature (71): n=a or c
cgccttcaccggctggccctcgacgagacacaagtagacggagatgtagtcggcgtagtcagagcccttgncattggggaagtagctgagccgccattggt

SEQ ID NO: 8800 - DNA, 101 bp, rice(Oryza sativa)
  misc_feature (71): n=a or g
ctctcctctctctacacccacagctagggctgtatatgaaggaggcttgggctcagcttgagagccaattnatacgagtccaaaccaaactgttaacggta

SEQ ID NO: 8801 - DNA, 101 bp, rice(Oryza sativa)
  misc_feature (71): n=t or c
atggtccaatagcttttggcttgatgacctgaacatctcccaagtccaccaagcttgaaacccggaagtcncacacatctcagatcctatcttttgaagca

SEQ ID NO: 8802 - DNA, 101 bp, rice(Oryza sativa)
  misc_feature (71): n=t or c
catctggatttttacctaattttctgaatgtagtatatggcattagatttacaacagctcctccatcaacnatcatcttggacatcggcttcccattgaca

SEQ ID NO: 8803 - DNA, 101 bp, rice(Oryza sativa)
  misc_feature (71): n=a or g
ctcaccccagcccgaatccataggacccttggagaagcgcttcatcaatggagacggacgcatcagagctnaagacttctccgaaggtggagcagtgaact

SEQ ID NO: 8804 - DNA, 101 bp, rice(Oryza sativa)
  misc_feature (71): n=t or c
gtctactctaccgcactgctatgcttctcttttgttgcaccatgtggtgccctcgacgcagcaagaccttntgccatgcgttgggcttgataatcgaactt

SEQ ID NO: 8805 - DNA, 101 bp, rice(Oryza sativa)
  misc_feature (71): n=a or g
acgggatcaagtgcgccgacagctcatgcacagccatctgtgtcctctgaggtaatgagaccaaagaccangttgcagagtgggattagaaaggagaaaat

SEQ ID NO: 8806 - DNA, 101 bp, rice(Oryza sativa)
  misc_feature (71): n=t or g
gcctacctcaaggacctatacaagaaaattgatacctcaatggtacacaacaatatatcttatgggacagnagttactaaggacatggtagataaaatagt

SEQ ID NO: 8807 - DNA, 101 bp, rice(Oryza sativa)
  misc_feature (71): n=t or c
cgacggctgtgtccaatgcacgtcttgcggaacttgctcctatcttgagacctattcagcacatggatggnttcaaccgatgacctgaaaatacaataata

SEQ ID NO: 8808 - DNA, 101 bp, rice(Oryza sativa)
  misc_feature (71): n=a or g
cctccagctcccctgacgacggcatcttggtgcagctcgtcggagttcatcggcgggaagataagagaggnggaatgaagacggagagggaggaggcaggg

SEQ ID NO: 8809 - DNA, 101 bp, rice(Oryza sativa)
  misc_feature (71): n=a or g
ttgtagaacgcgctcctttcacctttttggaacatcaatgctcatagcattgtctatattactcaaggtcntgccgggttcaagttgtcaacaacaatgga

SEQ ID NO: 8810 - DNA, 101 bp, rice(Oryza sativa)
  misc_feature (71): n=a or c
atggaggattttcgcttaggtggagctaggaatcgcgactaagcttggcccctcgtccccaaacatagcgncacggtaccacgctttgacgagtccacgcg

SEQ ID NO: 8811 - DNA, 101 bp, rice(Oryza sativa)
  misc_feature (71): n=t or g
ttttggccatttaccagtcttcagaagcaaaaatgcttgtggaggaagacttaaatgatccttgaccccanattagaatagcgctcttctagtgctacata

SEQ ID NO: 8812 - DNA, 101 bp, rice(Oryza sativa)
  misc_feature (71): n=a or g
tgtggtgttaattaaccacaaatagtacacttacccacaaatattacacacatgtactccctccgtactcntaaaggaaatcgtttaggacaatgtttaag

SEQ ID NO: 8813 - DNA, 101 bp, rice(Oryza sativa)
  misc_feature (71): n=a or c
ccatcgccgtctctgtcgaaaaccttgagcattctctcacactcctcatggccagcgtcacgctgcaaacncaaccttctcatcacattctgcagctccag

SEQ ID NO: 8814 - DNA, 101 bp, rice(Oryza sativa)
  misc_feature (71): n=t or c
aatacctgagacagagagtagagaacaatgtcatcaacactacagatgatatcaccagcctcaatgctgcnacaattttctggtaacacttctgatatcta

SEQ ID NO: 8815 - DNA, 101 bp, rice(Oryza sativa)
  misc_feature (71): n=a or g
gttagttgacccggcccatgtgaactactccaggcccactaaaatctggcccacgtggaggagaggcgagncccatctccatgcggcggcgcccctgccta

SEQ ID NO: 8816 - DNA, 101 bp, rice(Oryza sativa)
  misc_feature (71): n=a or c
atgagcatatgatagcacatccaaatcccactcccactggcctaccgtttccaatcatccacgccgaatantttggtggcgagccgggggggcccacgcgt

SEQ ID NO: 8817 - DNA, 101 bp, rice(Oryza sativa)
  misc_feature (71): n=t or c
ttctgtgaagacttttgctgaagaaacacattagaattttgagatatttatgtgtgatcgattgatcactnacctacttataacatgcatcatgcagggtt

SEQ ID NO: 8818 - DNA, 101 bp, rice(Oryza sativa)
  misc_feature (71): n=t or c
cctaattgagcaagaatgtcattaggttcaacaacagtggtttctatctctgtttcactatcattaggttnattggcaacatcactatcaagtgtctgatc

SEQ ID NO: 8819 - DNA, 101 bp, rice(Oryza sativa)
  misc_feature (71): n=a or g
ttaccactaatctaccaaccaatggctaaaatctgtgggaccgagggagtaaaacatagaaaaggtggtantggaaaataaggatgcatggtagcactttg

SEQ ID NO: 8820 - DNA, 101 bp, rice(Oryza sativa)
  misc_feature (71): n=t or c
aagaaattaccaagaaatacagtaattaagcagtagtacatgcagttaattaacttagtactccctacgtnctaaaataaaatataagatacaaacctcta

SEQ ID NO: 8821 - DNA, 101 bp, rice(Oryza sativa)
  misc_feature (71): n=t or g
gctagctagatagttgtggaagaattaatggaagctgattaagggagatgatcacctggctttgtggcagngtggttaatcaggtttgtcacaagtgtgta

SEQ ID NO: 8822 - DNA, 101 bp, rice(Oryza sativa)
  misc_feature (71): n=t or g
ttgtctgtgttggtgtccaggaggagatcaaacgaggtgagggagtatggatccacaatgacacccatctnctcgcccgcgttggttatggggcttgccgc

SEQ ID NO: 8823 - DNA, 101 bp, rice(Oryza sativa)
  misc_feature (71): n=t or c
acaaccaaaacagctatcatgagtagtacagcaccagtagcaaggacagaaaaagtgatcaacttcttggnatgcttttgcttctgtccagacaattctga

SEQ ID NO: 8824 - DNA, 101 bp, rice(Oryza sativa)
  misc_feature (71): n=a or g
agtcataacccgactaaaatcccttcctagaagctttgccattccaaagtcagcaatttttggaacgaacnaatcatcgagaagtatgttttgtggcttga

SEQ ID NO: 8825 - DNA, 101 bp, rice(Oryza sativa)
  misc_feature (71): n=t or c
caagagtggccttggtaagacactgaactactgaaagctctaatgctaaagatcttgctgtgtcttagctntgaatgttcttgctctttcagaagctctgg

SEQ ID NO: 8826 - DNA, 101 bp, rice(Oryza sativa)
  misc_feature (71): n=a or g
agcccgtgccaagttcaagacataattgaggcatcagtcataaacgccacttcagctggtttactcgaggncgaactcacaagaaaaatcgccaacaagga

SEQ ID NO: 8827 - DNA, 101 bp, rice(Oryza sativa)
  misc_feature (71): n=t or g
ttgtcctcaccaagatctgtctcctcacctgcatatgtgtcttctgcagcattgtcatcatctatagttgnttgtgtttcgcaatccacattatcctggtt

SEQ ID NO: 8828 - DNA, 101 bp, rice(Oryza sativa)
  misc_feature (71): n=a or g
tgtagcatatgtatcaaatatatcatctagaatggtgataaatgctgtcatctttgtaagtataattcgtnaaagagaataatggggctccgagcatgctc

SEQ ID NO: 8829 - DNA, 101 bp, rice(Oryza sativa)
  misc_feature (71): n=t or g
gctggagctcgagtgtttccccgcgaacacaagcgccacgagtagaccgacgacctccacatccgtcaagncacgctcgtccttgtacctgccgtcaatga

SEQ ID NO: 8830 - DNA, 101 bp, rice(Oryza sativa)
  misc_feature (71): n=t or c
gtggccctcgaggtggcaagatccacgcagagcttgacctcgacgagcggtaggacaggaggtccctctcngtcctccttctcaagccatatgtgcattgc

SEQ ID NO: 8831 - DNA, 101 bp, rice(Oryza sativa)
  misc_feature (71): n=t or c
cctagccacagtcgttgtcgagaccccaccgcacccaacgttactggcggcggacatgccactcccaagancagggtctttggatccgccaccaggcagct

SEQ ID NO: 8832 - DNA, 101 bp, rice(Oryza sativa)
  misc_feature (71): n=a or g
aactcgtttgttgacgtgttacagatagatcagtttaattacaaaaccttttcaaacccacagagcatttntatccatttcccagttgatatccaaatcta

SEQ ID NO: 8833 - DNA, 101 bp, rice(Oryza sativa)
  misc_feature (71): n=a or c
ttctccgtgttctcaaggactcgtgctccatcgatttgatgctcatcaacttccttggcgcgaaattcatntggtagaacaaaaggttcttcaatttcaga

SEQ ID NO: 8834 - DNA, 101 bp, rice(Oryza sativa)
  misc_feature (71): n=a or c
agaggttgcttacaaggtgaaactaccagatgctttgatcggagtacatgatgtatttcacatctccatgnttcgtaaatgccttcggaggccaagtgatc

SEQ ID NO: 8835 - DNA, 101 bp, rice(Oryza sativa)
  misc_feature (71): n=a or g
ggcgatgacgtcccatgtgaggtcggtggtccccagtgtcctcaatggagcgtcgacaaaggcaaacactnggaagaggaagacaagagatgggaggggac

SEQ ID NO: 8836 - DNA, 101 bp, rice(Oryza sativa)
  misc_feature (71): n=a or g
tttttaactagcggggtcattatttactattgcaattgcggattttatttattttatttttacctggtggnagcggcggggcagaaggtgatggcgtagtc

SEQ ID NO: 8837 - DNA, 101 bp, rice(Oryza sativa)
  misc_feature (71): n=t or c
gttgatgagagagcgaggcgaaaggagcttgggtcgtcgtcgctagcatctagcgcggctcaaatctggtnatcgtcgatcccgtcgatggcctgcctgga

SEQ ID NO: 8838 - DNA, 101 bp, rice(Oryza sativa)
  misc_feature (71): n=a or c
ttgatatcttgcctgtacaatttgtcaagctgagtgcaaagttaagttctccactaattaaagaattagangttccacggtatcaaattgataaataacga

SEQ ID NO: 8839 - DNA, 101 bp, rice(Oryza sativa)
  misc_feature (71): n=t or c
gagcctcttgaagagaactcgctggcaccgctccatcgtcggccttgaagtctgcttggcaatgcgtttgntgcgccgggtggcctgaccgcatttccttg

SEQ ID NO: 8840 - DNA, 101 bp, rice(Oryza sativa)
  misc_feature (71): n=a or c
aggaccttcttgttggtcgcgtacaaagtatcatcgaaggcggtggtagggcgcggaggtggcggacagtngccggctggctgctcttggcggcttgccgc

SEQ ID NO: 8841 - DNA, 101 bp, rice(Oryza sativa)
  misc_feature (71): n=t or g
ttcttctccgcgcgagatgggctgatgaattgctcactccgcgtcgaaggagatgagcttccgaatgccgnattcggcgacgagcgccgtgccgccggcgt

SEQ ID NO: 8842 - DNA, 101 bp, rice(Oryza sativa)
  misc_feature (71): n=t or c
atgatctctatggtcgtgcactacttcgtcctgctaccgcttgttgacactagcctcctcacctatgcatngaaagcgagccgtggcagcttcaaccgcat

SEQ ID NO: 8843 - DNA, 101 bp, rice(Oryza sativa)
  misc_feature (71): n=a or c
ttaacagtaagttatatttgtcatatctaaggggttgtttggatgggagggactaaccatccaaatagganctaagagagtggcaaatagtggatggctgt

SEQ ID NO: 8844 - DNA, 101 bp, rice(Oryza sativa)
  misc_feature (71): n=a or g
cttaacatggtacagaatgtacaacatgtctacactgtctacactatctgttgcaggatgtttcaccttangtaactacaggaaagaaaaccacaactgta

SEQ ID NO: 8845 - DNA, 101 bp, rice(Oryza sativa)
  misc_feature (71): n=t or c
gttgcggagctgatggcgatgatgacgccggcgaggacacccagaaggctgagtactaaaccatggccgcnggcgccggccgcgaagaaggcgatggcgca

SEQ ID NO: 8846 - DNA, 101 bp, rice(Oryza sativa)
  misc_feature (71): n=t or c
aaataaactagtacaagttaccttgcaacatcgacgtatagttaaatgtagcagtgatagtttcaagctcnggagcttgtatggtataacaatccacctgc

SEQ ID NO: 8847 - DNA, 101 bp, rice(Oryza sativa)
  misc_feature (71): n=t or c
agatgagaggacatcctctcgagggataaaaatagtttccccttttactctcctcaataagaaaaaaaacnaacttagatgggatgtgacacaacctcaca

SEQ ID NO: 8848 - DNA, 101 bp, rice(Oryza sativa)
  misc_feature (71): n=t or c
gttacttagagctggataccactcttgtagacagagccggccgtaaagctttcggggatgacatcgtcgangacgcggtacccgccattcttgacgaggaa

SEQ ID NO: 8849 - DNA, 101 bp, rice(Oryza sativa)
  misc_feature (71): n=a or g
cgttctcgagcttgccatccttgacaagcagctccgactcctcccctaaacaccagcaaaaggctgcgtcncggaggtctcatgcaccctctcttcaccaa

SEQ ID NO: 8850 - DNA, 101 bp, rice(Oryza sativa)
  misc_feature (71): n=a or c
ctttgtcaatgattcggtgcggcagagtctctaagtttctgaaaaccatgctattcctctctttccaaatntcccaggagagtaggattagaatcgatttg

SEQ ID NO: 8851 - DNA, 101 bp, rice(Oryza sativa)
  misc_feature (71): n=a or g
tctttcaccatttcgaacaaggttttaccgtttcgaaatataggcttcttacggtgcttgcctttcttccngacagtgtggttcgtaacaagaaatcgacg

SEQ ID NO: 8852 - DNA, 101 bp, rice(Oryza sativa)
  misc_feature (71): n=t or c
ttctgttggaaaataaacagggcctctctcacctcaattcctcatccgtctgattttctctatctacacgnttttgcagtaaggaaggccctgatggcctt

SEQ ID NO: 8853 - DNA, 101 bp, rice(Oryza sativa)
  misc_feature (71): n=a or g
tacccttaatggtgtaactgcgacgataactttattatgagtttatgataggggtgtcttttcaggtacgntgagtaaaaatggttagattagattttcag

SEQ ID NO: 8854 - DNA, 101 bp, rice(Oryza sativa)
  misc_feature (71): n=a or g
aaagatatgttgtcacggcttggaaacaagacttctcccatcccctcaactagatcacactgtaaatgtanaacgctgaaaacactttgtattctttatca

SEQ ID NO: 8855 - DNA, 101 bp, rice(Oryza sativa)
  misc_feature (71): n=t or c
aaatatgctaatgggttagctgtgcggtggtggtgggctgacgacaccataacaaagatgttggaagatgngatgagcagttctgagcgtttagtctatga

SEQ ID NO: 8856 - DNA, 101 bp, rice(Oryza sativa)
  misc_feature (71): n=a or g
gttcctaagcccgccggtggtggatccgccactctcgagcccgcacgtagctacggtgatcttggtcgctnctcccggtgcagggccgccctttcgcctcc

SEQ ID NO: 8857 - DNA, 101 bp, rice(Oryza sativa)
  misc_feature (71): n=t or g
ttaaaaagttcaatttcctcttctttttgtgcaggacatgttcgtggcgagcagcgagacggcggcgacgncgctgcagtggaccatgtcggagctgatga

SEQ ID NO: 8858 - DNA, 101 bp, rice(Oryza sativa)
  misc_feature (71): n=a or g
tagattagcaccacatattcaaaaaggaaatgaagatggtttgtttataagttcagtttcatcctgttcanatctgtgggctttaattatggatgctggca

SEQ ID NO: 8859 - DNA, 101 bp, rice(Oryza sativa)
  misc_feature (71): n=a or g
cacgaggccgcgcgtcgcggttcgcgccatgaactcgtccagccattcctgaacctccggcctcgacgaanctaattccgactccttcaccacccagagga

SEQ ID NO: 8860 - DNA, 101 bp, rice(Oryza sativa)
  misc_feature (71): n=a or c
tatattttttttatacggagggagttgaaaaaagaacaccaccgtagtagcggtggataatctagtggcantggaagagggggaggagtaataataatctt

SEQ ID NO: 8861 - DNA, 101 bp, rice(Oryza sativa)
  misc_feature (71): n=a or g
cgacacgagcactcccagccgcgaacaccgcaaaatcaccccaaaatcaccgtctaccccgacacttttcncgctcctgcgtccaccggccgcgggacgga

SEQ ID NO: 8862 - DNA, 101 bp, rice(Oryza sativa)
  misc_feature (71): n=t or g
aggaaattgtaagatttacatgtgatggcatgaatttatcatcctccttctacagttctactgctacatgntaaaatgatgtcgtagtgttcctgtaaatt

SEQ ID NO: 8863 - DNA, 101 bp, rice(Oryza sativa)
  misc_feature (71): n=a or g
ggtaatatcccggttaaaaatccacttacatatgcgtcgtattggtggacactagaatttcagtcttggtnagtggagcaatgcaagagcacgcaggtggg

SEQ ID NO: 8864 - DNA, 101 bp, rice(Oryza sativa)
  misc_feature (71): n=a or g
gtacataatattgtttcatggtaggaacaagatcatgaagtatcatgactcaactcagattagtttttctntgtttataatgaagtatcctgaattgacca

SEQ ID NO: 8865 - DNA, 101 bp, rice(Oryza sativa)
  misc_feature (71): n=t or g
ttctcggaatagaggtgaagaaagtatctgatgatatactattgaatcaagcaaagtatgccttggacttnctaactaaagttggtatgaaagattgcaaa

SEQ ID NO: 8866 - DNA, 101 bp, rice(Oryza sativa)
  misc_feature (71): n=t or c
taaagatgcatactatgtaatagaaatatgcatacctttgaaccctgatagttgaactctaaatttgtaanaccggaaaggctctggagatactggccgag

SEQ ID NO: 8867 - DNA, 101 bp, rice(Oryza sativa)
  misc_feature (71): n=a or c
aattgtagagattatgtgagttgtccataatcctcgcatcaatagtagaggctcgagccacatcactcttntgatagaattgccccaaagaactaggattt

SEQ ID NO: 8868 - DNA, 101 bp, rice(Oryza sativa)
  misc_feature (71): n=a or g
caagacattatatggttgaggttgtaggttccaggaaaaagccttgcctggtggatcactgggcgccttcnggcatcgtaaccccttggggcggtgcgagg

SEQ ID NO: 8869 - DNA, 101 bp, rice(Oryza sativa)
  misc_feature (71): n=t or c
ttcaatccactaaatctcagagaaaaattcaaggagatcttgcacggcaagtgcttccgctgcctcgcttnagatcaccaggcagcagcttgcagggatcc

SEQ ID NO: 8870 - DNA, 101 bp, rice(Oryza sativa)
  misc_feature (71): n=t or g
ggccttgagttgatttcgccgagcctgaccttgagttgattaccatggaagtatgaagatttcgtgattancagttaccctagttatcgcggcgtataatt

SEQ ID NO: 8871 - DNA, 101 bp, rice(Oryza sativa)
  misc_feature (71): n=t or g
ggacggccggcccgggtggatttcggacaacctcaacgagggacacctggactacttcttctgggtcatgncggcgctgtgcacgctcaacttcgtcgtgt

SEQ ID NO: 8872 - DNA, 101 bp, rice(Oryza sativa)
  misc_feature (71): n=a or g
ggtcatgtctagattttatttatagccatttcgttttgggtcgagagcagagggaatatcttgcatgtaantaaacatagagttaaatcaaagacatttgt

SEQ ID NO: 8873 - DNA, 101 bp, rice(Oryza sativa)
  misc_feature (71): n=t or c
agaggaccagagcgccttgcccaccttgcgaacacccatgctgttcacctagcctctgtgcttgcagatgncttcaaggacgccagagcttccctgcatgt

SEQ ID NO: 8874 - DNA, 101 bp, rice(Oryza sativa)
  misc_feature (71): n=t or g
caccaagcttctatggctactgcttagtggtcgccttctctcttcctgagccatggtggctgccaaggagnctacgagcggatctaagcagcgtggccagc

SEQ ID NO: 8875 - DNA, 101 bp, rice(Oryza sativa)
  misc_feature (71): n=a or c
aacggcggcgagtccatgagcgacgaggatatgtgctcacgcatggtcacccttcgagctcgaggagcggncggcctctgttgtgtccgaggaattttcgg

SEQ ID NO: 8876 - DNA, 101 bp, rice(Oryza sativa)
  misc_feature (71): n=t or c
gccaagcgcgagagcgggagcgagggaggagcagcggccgcgaacgccacgacaccggagaaatggattgngccgtgagcaaggagaagggcggcgctggt

SEQ ID NO: 8877 - DNA, 101 bp, rice(Oryza sativa)
  misc_feature (71): n=t or c
gggaagtgtttcatctgtgccgggaagggggagagaatatcctgtaagttgagggtgccacatctaatggnatagacttcgcttttggataaattggtcac

SEQ ID NO: 8878 - DNA, 101 bp, rice(Oryza sativa)
  misc_feature (71): n=a or g
agttagagcattgccaaaatttggaaagcgacagatttccttcatggggccggtctgatcaccgcctatgngacagtgtaactagcacatagggttggtct

SEQ ID NO: 8879 - DNA, 101 bp, rice(Oryza sativa)
  misc_feature (71): n=t or c
ggttcctcacgtgccaagggtcatgaccatgtcaaacctacggcgacgctccctctgaactttgagtcggnaggagcagtgccactcatggaaggaaacaa

SEQ ID NO: 8880 - DNA, 101 bp, rice(Oryza sativa)
  misc_feature (71): n=t or c
gcagaggggtcatagactaaaagctgattcatcaattcatcgaattgctcataaaactcccacaccattcnagtttgttttatactatccatttgcctaat

SEQ ID NO: 8881 - DNA, 101 bp, rice(Oryza sativa)
  misc_feature (71): n=t or c
caccagcatcacgtcgcacgagaagctcatttacatccttggcatgtaccaggctctgagcgaggccgctncaggcctcctgctcatgttcaccgggccgc

SEQ ID NO: 8882 - DNA, 101 bp, rice(Oryza sativa)
  misc_feature (71): n=a or g
ccaaaaacaaatataaccaatccgatataagcgaataggttccgtgcaaaactgcatatttgactttctgnaagggaaaagaaacaaatgacaactttaag

SEQ ID NO: 8883 - DNA, 101 bp, rice(Oryza sativa)
  misc_feature (71): n=t or c
gcgctagcgcgttgaagtcctgtgccgacgccagcacgaggagcatcgccgtcacgcacttttttctctgntattccccagcgcagagcagaggcagacgc

SEQ ID NO: 8884 - DNA, 101 bp, rice(Oryza sativa)
  misc_feature (71): n=t or c
gagagagatagggagatacagacatggagcgatgaagccaaggccagcaacggcgaggcacaccttcttcntgagcttcggagcagtagaggagggtgccg

SEQ ID NO: 8885 - DNA, 101 bp, rice(Oryza sativa)
  misc_feature (71): n=t or c
cagaacgagcggatcacgccgtcgaaattcgcgcgcgcgaatccgagcttgtattcccggagcgccttcgngacgtcgtccttgagccccgggatgtcgcc

SEQ ID NO: 8886 - DNA, 101 bp, rice(Oryza sativa)
  misc_feature (71): n=a or g
cacgtggcagcagagtccagagaaccctcctattggtgtcgacatggatgttgccaacacgacacatcagnatgtcgtcgtcagctataacaagataagta

SEQ ID NO: 8887 - DNA, 101 bp, rice(Oryza sativa)
  misc_feature (71): n=a or g
agggaggcacaatggccgaggaggattaaagatgcggcgatcagaggagaaggaggaagggaggtgtggcngttagagaaaggagagctcggcgggagcgg

SEQ ID NO: 8888 - DNA, 101 bp, rice(Oryza sativa)
  misc_feature (71): n=t or c
cacgtacgtttaattcttcactcgaaccagtatagcttagctttttagctgttggtggcgttgcagaaccncctgacctccccccgcgccccggtgagcac

SEQ ID NO: 8889 - DNA, 101 bp, rice(Oryza sativa)
  misc_feature (71): n=a or g
accgaacgagaggtccaattagcgaaatgagaccacagcgaattggcagaaaccaccaaattgaagagttngacgttctagagattgagggatgaactagc

SEQ ID NO: 8890 - DNA, 101 bp, rice(Oryza sativa)
  misc_feature (71): n=t or c
actatggccgcctccgcctctgccctcacctccctctccgctactgccagcaagtgcctcctcctctcctnccctggctccctctccttctccttcgcctc

SEQ ID NO: 8891 - DNA, 101 bp, rice(Oryza sativa)
  misc_feature (71): n=a or g
aaaaaaagataggtttaataccttctttctagacctttcttggagtgggttgttgtacattttgtagatgntatcttctccaaaatatcttttcttctcat

SEQ ID NO: 8892 - DNA, 101 bp, rice(Oryza sativa)
  misc_feature (71): n=a or g
atatggcgccatatttctagcaactccgtaaatcaattgcttcttttaccatgattaatatttttaactcnggtcttttttttttttaaaaaaaaggccct

SEQ ID NO: 8893 - DNA, 101 bp, rice(Oryza sativa)
  misc_feature (71): n=t or c
ccacaataactatgtgtagatatgatatgatactgctacatatctagatatcataatcaagaacagtgtgnttataattatctttactacaaaataaatgg

SEQ ID NO: 8894 - DNA, 101 bp, rice(Oryza sativa)
  misc_feature (71): n=a or g
aaatatcatgttttcatatcgatttatatcggaaatggcaccgatcgagcgctcgatcagcggaagaaaantcgggcgctcaccgcttcctgcgtcgtccc

SEQ ID NO: 8895 - DNA, 101 bp, rice(Oryza sativa)
  misc_feature (71): n=a or g
tttgggacctgaatgctttgtgggctaagcactgctctttcagtgacaagaagcccattagccgctatttncctgaatgtattcgcctctctctctgtgtg

SEQ ID NO: 8896 - DNA, 101 bp, rice(Oryza sativa)
  misc_feature (71): n=a or g
tgatggccaccaccaaccccgaatcccctccctccttgccagcctccatctgcatatcggtgtcgacgcanggccctgagacaagcttccgcgatggcttg

SEQ ID NO: 8897 - DNA, 101 bp, rice(Oryza sativa)
  misc_feature (71): n=a or g
agactcatccatcagcctttgactgcggcggacaatgtgcgtttcagggtctcaacccaagtcgacccgantaaaaccgctacttcaggagaaggatccgg

SEQ ID NO: 8898 - DNA, 101 bp, rice(Oryza sativa)
  misc_feature (71): n=t or c
atgcgccaccacaccatggagcttgggcgtgtgagagttcatcattgcctctccccaagccgaggagctgntgtcgcatcctcacatgcgaccgtccgcac

SEQ ID NO: 8899 - DNA, 101 bp, rice(Oryza sativa)
  misc_feature (71): n=t or c
gatgatgtcagtggcgattgcagctgaaacctgagcaccagagtcatgctctccggtagcccttggggatnaagaatcgcccagatgttcccttgcatcat

SEQ ID NO: 8900 - DNA, 101 bp, rice(Oryza sativa)
  misc_feature (71): n=a or g
agaacatgccagaagaaatgcatgcatgtttgtgctccgagttgaaccttgaacatatagttgcatgcgcntgtcaacttccttttccagcttttatcgac

SEQ ID NO: 8901 - DNA, 101 bp, rice(Oryza sativa)
  misc_feature (71): n=t or c
acccacgtcatgtccgtatccatgatcttgctgactcgcctaaacggcctcctagtgccggatttcatgtnccacacgtcgtgtgtatcgacgaaataaat

SEQ ID NO: 8902 - DNA, 101 bp, rice(Oryza sativa)
  misc_feature (71): n=t or c
agtagtgcgtccttgaagaaattgtaggaggagggcactctccccagtcatgggactatggagagggaacngggaggtactgaacctgaacccgtcctggg

SEQ ID NO: 8903 - DNA, 101 bp, rice(Oryza sativa)
  misc_feature (71): n=t or c
ttttcaaaacctactcagaatctttctggcatcaagaagaggcaaacacaaaaaacggaccgtttccaagnatgaagttcctgagatgcgaatgaacaggg

SEQ ID NO: 8904 - DNA, 101 bp, rice(Oryza sativa)
  misc_feature (71): n=a or c
tacaagttgttcaaggctgttgaaatgttttcttcaactaacttctttgcatgctccctgaacatctcagnagcaatctgcaataaatttaaataatagaa

SEQ ID NO: 8905 - DNA, 101 bp, rice(Oryza sativa)
  misc_feature (71): n=a or g
ttcgcactcctcctttgtcgctcccttgcctctctccatttgcccgcatctctctccctctctttccccantgcgccgtcgttgactccgccccaccgcgc

SEQ ID NO: 8906 - DNA, 101 bp, rice(Oryza sativa)
  misc_feature (71): n=a or g
gacaccaccaagcacaagcgagcatcggggcactgcccccgcagctctagaagcccaaacaacatcggcantggccgccgccacggccacaacgatggcag

SEQ ID NO: 8907 - DNA, 101 bp, rice(Oryza sativa)
  misc_feature (71): n=a or g
cgccacgagctcgctctcacacgcgccatcagcccccaagtctctgagaatggcgacgcttgctctctgcntcctcaccctgctccagcttagcggcggcg

SEQ ID NO: 8908 - DNA, 101 bp, rice(Oryza sativa)
  misc_feature (71): n=a or c
cattaggaggacttggaggtggaggttgaaattcattgtggactggatctgggcctgtaggagtcaatctnttgccatcgccaatcacattagcaccatta

SEQ ID NO: 8909 - DNA, 101 bp, rice(Oryza sativa)
  misc_feature (71): n=a or g
agatctagaatatagaaagagagtgagatgaaactccaaaacaagcgttccagatgtcagagttctcttcnggggagttccggagaagtgccggagatgtc

SEQ ID NO: 8910 - DNA, 101 bp, rice(Oryza sativa)
  misc_feature (71): n=a or g
tcctgagattgaaattgagagcatcgtggtcactcaggtttactctttgtgttttgcacaagcagacaggncatgtgttaccacttttcaagttcatgtgt

SEQ ID NO: 8911 - DNA, 101 bp, rice(Oryza sativa)
  misc_feature (71): n=t or g
ctcacatcgcgatcatccgcatcgtctccgactcttccgtttttgattcaatttgatttgttcgcagctgntggaggcgtcgcaggcggcgtcgtggggga

SEQ ID NO: 8912 - DNA, 101 bp, rice(Oryza sativa)
  misc_feature (71): n=a or c
ggcgtcggccaccgtgccggcgagcaggtgaggaggtatggcaatggcaatgtggccgggcaagagtacgnaaacggcaacgatcacgaggagtttggcat

SEQ ID NO: 8913 - DNA, 101 bp, rice(Oryza sativa)
  misc_feature (71): n=t or c
cacaattctgtttagtgcctctccctctcccctatctatttaattattgtgtcttctgtcggatggactanagattactcaattctttactactagtagta

SEQ ID NO: 8914 - DNA, 101 bp, rice(Oryza sativa)
  misc_feature (71): n=a or g
ctacatgtcatttttttttgtaaaaaaggtgcagcccaccaagaattttgaaagcaactctacagagtttnttattgatatagaggggccatatgatgctg

SEQ ID NO: 8915 - DNA, 101 bp, rice(Oryza sativa)
  misc_feature (71): n=a or g
catcttctttataccttctttctctgcgatatgacatgaaaccagtctctagcatgggccaagtagtaggnatggctagtgtcaggatgaactgggcagct

SEQ ID NO: 8916 - DNA, 101 bp, rice(Oryza sativa)
  misc_feature (71): n=a or g
ggctcgactagatccggtgagcatgacgccggatttgtggacctttttggcgcttgagctcgccagatccngcgagcatgatgccggatccgcgccggaga

SEQ ID NO: 8917 - DNA, 101 bp, rice(Oryza sativa)
  misc_feature (71): n=t or c
aagctcatcgtcgcctcccacctccccttctccgagagaaaccggtgcatgacgcaatccgcgcctctganttcggctaccgcgaacctgtcgggtggccc

SEQ ID NO: 8918 - DNA, 101 bp, rice(Oryza sativa)
  misc_feature (71): n=t or g
caatgacctttcctccaaatggcaataaatgtccataataagggtctcaactgcctgacgctttgtcattncagcttcatcccaaataatcaaagatgccc

SEQ ID NO: 8919 - DNA, 101 bp, rice(Oryza sativa)
  misc_feature (71): n=t or c
acgcacgccccatcctccgtctgcgcggcggccttctcgaggatgtccctgatgttgttgtaggcgtcgangtggccccccggcatcagcgagggcccgtt

SEQ ID NO: 8920 - DNA, 101 bp, rice(Oryza sativa)
  misc_feature (71): n=t or c
cgtgagtgtctggtgcggaggcatcattgcccatcccagaaaatcataattagggaagaagaaaaaaaacntagaactttcatcttcttgttcatatcttt

SEQ ID NO: 8921 - DNA, 101 bp, rice(Oryza sativa)
  misc_feature (71): n=t or c
tatggagcttatgaattggttgtgtgataaatcaagtagccaactcaattgatttagcttgacaaacatgnctccgcttatgcttccagtaagggcattac

SEQ ID NO: 8922 - DNA, 101 bp, rice(Oryza sativa)
  misc_feature (71): n=a or g
gctccttcttcccccgcagtagctactgcaccactgaggtccttagcatcagccccaagatcccggcagcngtgactcccgtcggaccgaggtccccttcc

SEQ ID NO: 8923 - DNA, 101 bp, rice(Oryza sativa)
  misc_feature (71): n=a or g
tgcaggtgagcaatgccctctgcagcaccaatcgcaatcttcaggcgcaggtcacaagtgaagggacgatntatcttccccgcatcaccaaaaagaacatc

SEQ ID NO: 8924 - DNA, 101 bp, rice(Oryza sativa)
  misc_feature (71): n=a or c
aggcagattggatcgctaccatttggtcagccagtgtgggctgaaactctgtcaacctggcacgtatggtntatctatgcggcccaatgcttattgggatc

SEQ ID NO: 8925 - DNA, 101 bp, rice(Oryza sativa)
  misc_feature (71): n=a or g
tatgcgttctataacaaatacgcagagcatgttggttttgacgtgaggaagagtcggagcagggcagcatncagggaaatttgttgcagcagggagggcaa

SEQ ID NO: 8926 - DNA, 101 bp, rice(Oryza sativa)
  misc_feature (71): n=t or c
atttgcacaggcacaagggctggatttgggtttgatcctcacagcaacaaatacaaggtggctagatcttnctatcaaagggatagtgaaacacaagaatt

SEQ ID NO: 8927 - DNA, 101 bp, rice(Oryza sativa)
  misc_feature (71): n=a or c
tgtcgccggcgaggaggacaacgcatggtggcgccttccggagctcaggaagctcgagatcgatgagctgnacgagctggcggccgtgcggtggacgcgga

SEQ ID NO: 8928 - DNA, 101 bp, rice(Oryza sativa)
  misc_feature (71): n=t or c
agtcccattggtttttagtggctagcaccacaaattagtgggttgatcagcctgggtttgggactcactcngtgcttaaaaccattgatataaagtccttc

SEQ ID NO: 8929 - DNA, 101 bp, rice(Oryza sativa)
  misc_feature (71): n=a or g
accatttgtataatccgaccaggtctggttgcagccagatccaatccagtctcactcgctccccttatctnccgtactcgaaccatagttcttggtggagg

SEQ ID NO: 8930 - DNA, 101 bp, rice(Oryza sativa)
  misc_feature (71): n=t or c
gatgagtcatcaagtgatgaagacaataatggtggtgcatatgacataaagcatgatcctggattgaggantcctatatcacaatatgatgtcaatgacca

SEQ ID NO: 8931 - DNA, 101 bp, rice(Oryza sativa)
  misc_feature (71): n=t or c
catataaccggactagtgaatgttgatcgacatttaaaaaacggagggaggactaaactcattgcaaaaancaaaaataaggaaataataatatataaatg

SEQ ID NO: 8932 - DNA, 101 bp, rice(Oryza sativa)
  misc_feature (71): n=t or c
aaccgcttagcctatctcacggattgatgtaggcaagagcatctccaatagaatggtcaaattagactctncaaatacccatatagccaactctccaactg

SEQ ID NO: 8933 - DNA, 101 bp, rice(Oryza sativa)
  misc_feature (71): n=t or g
tttgcaggaccggggcgcacaattgtgcatgcatgcattggaggctagctaccagtaaactgtaagtccgnactactccagctagtacaagtggtagtgcc

SEQ ID NO: 8934 - DNA, 101 bp, rice(Oryza sativa)
  misc_feature (71): n=a or g
gacaggtacatgcgaccgctgaggttgcggtcgacgttgtacatggcatccttccacttgatgcaacaacncggggtggatgatcaggacggagctcttgt

SEQ ID NO: 8935 - DNA, 101 bp, rice(Oryza sativa)
  misc_feature (71): n=a or c
atcgtgacgtgaaggacacttgctgtggttggctccttgttacttggcatttcatcgaacaccttctgggnatcaacactggaggttgcccctggacttga

SEQ ID NO: 8936 - DNA, 101 bp, rice(Oryza sativa)
  misc_feature (71): n=t or c
tactccaccatctgtgatcacagcgagcgatagcaatttgggtcgttgaagtcgtcccagtcagcgcagangacgtcgctccagtcgatagcggcccatcc

SEQ ID NO: 8937 - DNA, 101 bp, rice(Oryza sativa)
  misc_feature (71): n=a or g
cacgcgcgtgtactcgcagttggcaacggctactgtacacatggagagagcaagggaggaagacgaagtcngcggcggcggtggcggcgtggtggcgcggt

SEQ ID NO: 8938 - DNA, 101 bp, rice(Oryza sativa)
  misc_feature (71): n=a or g
cccccggccacttggtgcagagcctgaaaaaaaaaagaatcaaagaacagcaaccatgcattacaggagancgagcaggggggaaattgagttgtatcgtt

SEQ ID NO: 8939 - DNA, 101 bp, rice(Oryza sativa)
  misc_feature (71): n=a or c
tgatctcggattcactcttctttttttgtcgtttatacatatcatttctatgaagccaatcgattggatcntctggatcaatattttccttatctagtaca

SEQ ID NO: 8940 - DNA, 101 bp, rice(Oryza sativa)
  misc_feature (71): n=a or g
aggaagagcattaccgtcgttgttgttgttgccgccaccgtttgtgacgttcggcgcagcgatgttgctangtgccatgtcgtcgtccccgccacaggtgc

SEQ ID NO: 8941 - DNA, 101 bp, rice(Oryza sativa)
  misc_feature (71): n=t or c
gtccctaccaggcctgcctaccggagcagtggggctagacaagaatggcccagccaataggccaaacagcncactagagccggcaggccaccaagcgaacc

SEQ ID NO: 8942 - DNA, 101 bp, rice(Oryza sativa)
  misc_feature (71): n=t or c
ttgatggtggccggttcggcgtccttcgagggaaggagcttgatccacatgaagcggctgtagtcatcgangaggagaaggaagtagcggttcccactcgg

SEQ ID NO: 8943 - DNA, 101 bp, rice(Oryza sativa)
  misc_feature (71): n=a or c
cagcacagtaacttgtaagcaagcaaacagaacatcaatagccaagactttagcatacggaaccagtacgnactcctgatacacgcgatagcatacaaaca

SEQ ID NO: 8944 - DNA, 101 bp, rice(Oryza sativa)
  misc_feature (71): n=a or c
agaaacacagaaggattggaactccattttttgctctgaaaactctgcctatgtccttgtcatgttgcgcnaatggataacattgaattgttcattactac

SEQ ID NO: 8945 - DNA, 101 bp, rice(Oryza sativa)
  misc_feature (71): n=t or c
gttgtaaaggcggtgcttttgatgcactacatttgtgcctcctcccgaggaggtttgtacagtttttcccntttccttaatatacatcggtcggcattctt

SEQ ID NO: 8946 - DNA, 101 bp, rice(Oryza sativa)
  misc_feature (71): n=a or g
atcgcatcatggttggacatagacgccaatagcatcgacgagcagtccagagcgcgcaaagaagccgacgncacgagcgtcgtcctggagcgggacactga

SEQ ID NO: 8947 - DNA, 101 bp, rice(Oryza sativa)
  misc_feature (71): n=t or c
ttatccctgatgacggtgttcatgatgccctcgaagccgccttccgttgtgaccttggagctcaggtagcnggagtagcgcctcctcgactgccccagcga

SEQ ID NO: 8948 - DNA, 101 bp, rice(Oryza sativa)
  misc_feature (71): n=a or c
catcgatggcctgaaggcgatggcgacagcagctgcaggcacggtgagctatgacgtcgaagagattggcnccgagacgtgtgacaagctcaagttcccgg

SEQ ID NO: 8949 - DNA, 101 bp, rice(Oryza sativa)
  misc_feature (71): n=a or g
gctgcaatggctattggctgcgccgtctagcttggtggtggtcttggtggacaggctgaggtcttccacgnccatgacgccgtcccactcgtcctccgtgt

SEQ ID NO: 8950 - DNA, 101 bp, rice(Oryza sativa)
  misc_feature (71): n=t or c
tgacggagagaggtagggagaatttgttagggcttgggaagaatactgcgcgccaccacctcctaaatcgncttcagctggcgggagggaccaacgcaggg

SEQ ID NO: 8951 - DNA, 101 bp, rice(Oryza sativa)
  misc_feature (71): n=a or g
gtcgcggtacacgccgccgatgctcgcgatcccggtcgagtgcttcgacgacccgtcgaagttgagcttcntccacccctcctccggcttcctccagatcc

SEQ ID NO: 8952 - DNA, 101 bp, rice(Oryza sativa)
  misc_feature (71): n=a or g
aagcagaggtagaatcataccgagttgtggttgtggttgtgagcggcgttgaagatcggccatgggaggcngaagcagcagacggggcggccgtcgtcggc

SEQ ID NO: 8953 - DNA, 101 bp, rice(Oryza sativa)
  misc_feature (71): n=a or g
gaaacacgtagtcgatgctcattatctattaatgcatagtgcacacccctcattgatctcccaagaaaatngtttttatatggagatacttcattattcat

SEQ ID NO: 8954 - DNA, 101 bp, rice(Oryza sativa)
  misc_feature (71): n=t or c
aaaaaaaaaattcgttgaaggccaagtccattgtgcaacgtgtgtcaaaaggtcaaaacgtttgtctgcgnctgctagtgcacttgcacttgcattgcagc

SEQ ID NO: 8955 - DNA, 101 bp, rice(Oryza sativa)
  misc_feature (71): n=t or g
gccgtgcttgggttgggccgttgggccttggccttatggccatctacaactccatgtctagcataggtccntatgcgatcaggaacccaaaccccctcttg

SEQ ID NO: 8956 - DNA, 101 bp, rice(Oryza sativa)
  misc_feature (71): n=a or g
ttcttttgcctcgttttctgtcgcggcatggagtagcccgaactttgtcttctaagtgaaagaaaattggnatcaaaacaattaaatcaatatttttcttc

SEQ ID NO: 8957 - DNA, 101 bp, rice(Oryza sativa)
  misc_feature (71): n=a or c
attaccatctgcaggaagagaacccttctcgagagcataccattgtaagaactgcgcaaaagctcaagccnttctcttttaacaaattctcggcagatggc

SEQ ID NO: 8958 - DNA, 101 bp, rice(Oryza sativa)
  misc_feature (71): n=a or g
tttcgttgccggggctgacaccatggctcttaccttggagtgggtaatggccgagctgctcaaaaacccgngcgtgatggccaaggcgcgcgccgagctga

SEQ ID NO: 8959 - DNA, 101 bp, rice(Oryza sativa)
  misc_feature (71): n=t or c
gctggtgggcccggcggaggggtggcggggaggggaaccagcttcctcggagcgtgagtactctgtcgtgngcagcaccaacaccgtctccgccactagct

SEQ ID NO: 8960 - DNA, 101 bp, rice(Oryza sativa)
  misc_feature (71): n=t or g
tggatttcaggaaagaaatcgggaccatatataattgcaagtcccatgtactcaaggggatatgaaaacanccagtttttttatacagccaatataattgg

SEQ ID NO: 8961 - DNA, 101 bp, rice(Oryza sativa)
  misc_feature (71): n=a or g
gatatgcccaggtatgaacttcgcgatcgccgccatcgaggtcatgctagcaagccttgtgtatcgcttcnattggaagctaccaatagatcaagcagcaa

SEQ ID NO: 8962 - DNA, 101 bp, rice(Oryza sativa)
  misc_feature (71): n=t or c
tgcaaactttaaagaatggaaagagaatgttttaatcgttcttggggttatggatctggaccttgcacttnggaaggaacaacctattctctcagacaaaa

SEQ ID NO: 8963 - DNA, 101 bp, rice(Oryza sativa)
  misc_feature (71): n=t or g
tggaaaaacaaatgttgaacggtttcgtccttataacaaaatcaacatttcgtaccacctttccatttgcncttagctagattatccttggttagagttac

SEQ ID NO: 8964 - DNA, 101 bp, rice(Oryza sativa)
  misc_feature (71): n=t or c
gccggaatttgcgtcgcggttgcttgtatattggcgaggaggcaaacgacgcggacacgtggatgtgcagngcctcgagcgccggcgccgcctcaaggagg

SEQ ID NO: 8965 - DNA, 101 bp, rice(Oryza sativa)
  misc_feature (71): n=a or c
tagggagtgacaactggcattctggcaggaagcgaagaaaaggggaatataccggtattaatactgcattnctatccagtttatacaaacaaaaggcaatt

SEQ ID NO: 8966 - DNA, 101 bp, rice(Oryza sativa)
  misc_feature (71): n=a or g
attgtcggcgtccctccatgttgagagcacgcaattgggatcctctgacaccctcaccgcgcccgctatcntctgctgggcaccacagctccgactgcgcc

SEQ ID NO: 8967 - DNA, 101 bp, rice(Oryza sativa)
  misc_feature (71): n=t or g
ctcgctggcaccaccgccggcgaacctcgcgctcgtcgacgtggacatcagccgaccttccttcttcaccnggaagtacgagccggtgtgccgcgtcctcc

SEQ ID NO: 8968 - DNA, 101 bp, rice(Oryza sativa)
  misc_feature (71): n=a or g
gcagaggccgtcggcgagcgcgtacacccatgataggaatgctgggaatgagatggcctcaccggtggcgntgttgacaagcgtcaggtgcgtggggagca

SEQ ID NO: 8969 - DNA, 101 bp, rice(Oryza sativa)
  misc_feature (71): n=a or g
ttgcactccctgagaaccatcacccttatcacctgacacatctgcagcacttttaccacctgattgagctntaccatctaaaacctgttgtacttctccat

SEQ ID NO: 8970 - DNA, 101 bp, rice(Oryza sativa)
  misc_feature (71): n=t or g
aagaaccaagtacgctgaaaacctggaaccaatggaccaaaaaaaaccaggtagtaatgaattacctcccngagaagcttgatgagctgcatcgaagcaga

SEQ ID NO: 8971 - DNA, 101 bp, rice(Oryza sativa)
  misc_feature (71): n=t or g
aattcatctgcacactaataattcaccaaaaacaatagtttctgtttccctatcttacttgccgccactanatttcgtatccattccgtgatctggatctt

SEQ ID NO: 8972 - DNA, 101 bp, rice(Oryza sativa)
  misc_feature (71): n=a or g
gtggtatccctgtgtccagcgctggcgctgctgctgcaggttcttgagttgtggccgtagttgccacagtnggagcacttcctcgccatggatggcgtggc

SEQ ID NO: 8973 - DNA, 101 bp, rice(Oryza sativa)
  misc_feature (71): n=t or c
ttgccgttcgagaatatgaatagattgttgtctaattttgtaggtgattcaacgctcgccgacgacgtggncgtcgacgacgaggggaacgcgtacgtgac

SEQ ID NO: 8974 - DNA, 101 bp, rice(Oryza sativa)
  misc_feature (71): n=t or c
aaaaaatcgaattcaactgattctaaagcatatactcacatgctcaagattagggcactttacaaacttantgtttggattcatcggggtcctcgacgttc

SEQ ID NO: 8975 - DNA, 101 bp, rice(Oryza sativa)
  misc_feature (71): n=t or c
attttggtccggtacggcggtaccaaccagcgggaggtgccccttctgttgcatgcatacgactgcgtcanacagacacttcctcattggtgtgaattcga

SEQ ID NO: 8976 - DNA, 101 bp, rice(Oryza sativa)
  misc_feature (71): n=a or g
agctgctactgctgctgcgaacagcctcaaccgagattttgggtacgtattgttgccagggatagagtcgntaaagttatggtggtcccttcgactaatac

SEQ ID NO: 8977 - DNA, 101 bp, rice(Oryza sativa)
  misc_feature (71): n=t or c
ggtatgagttggcttgtgtttacggctaacgaatgtcgtcggggcgttacatacaagcacgaggatttgcngactgaggttgttcaggtggagttggtgta

SEQ ID NO: 8978 - DNA, 101 bp, rice(Oryza sativa)
  misc_feature (71): n=a or g
ccaagccggatctgggcacctccaagctgctgtcgtgcgaggccgacaacttctgacagacctgtcccatnagccgcttgcgaccaagtggaggagggaaa

SEQ ID NO: 8979 - DNA, 101 bp, rice(Oryza sativa)
  misc_feature (71): n=a or g
acgcgtcatgcatgcatgaaccctctttcttttcttctccctacgaagaactttgatggagcgacgcacanagcaatcatgcagccagcagcaaagtccat

SEQ ID NO: 8980 - DNA, 101 bp, rice(Oryza sativa)
  misc_feature (71): n=t or c
gtgatctttgagcgtgaagctgaagatttggctgttgatggtggagttgcagttgcttgttgacggagaanttggttctcagcttctaagttcgttgattt

SEQ ID NO: 8981 - DNA, 101 bp, rice(Oryza sativa)
  misc_feature (71): n=a or g
gtattacacgattacttgggattagcagggagtacagtaggtcatagttagtggtgccacatggaaccatntatatataataagattaaaatgtcagatat

SEQ ID NO: 8982 - DNA, 101 bp, rice(Oryza sativa)
  misc_feature (71): n=a or g
caacacatgagacaaggtctaatttgttaatatcagtcctagttaatcaacttgcatgtccacttcgcaantaggcaaccacccttcatcatttgtgggta

SEQ ID NO: 8983 - DNA, 101 bp, rice(Oryza sativa)
  misc_feature (71): n=t or c
tcgagattctctttccctgtctcgctcccgatcccgatcccgctcttggtctcgatcgcgatctcgatttnggtctctgtccctctctctttccctttccc

SEQ ID NO: 8984 - DNA, 101 bp, rice(Oryza sativa)
  misc_feature (71): n=a or g
cacttgtatagtttctacgacctcttcttcttctttaccggaatcatcagggatcaaggattttgtctgcntcacggctgtacattgatgaatccaattgc

SEQ ID NO: 8985 - DNA, 101 bp, rice(Oryza sativa)
  misc_feature (71): n=a or g
ccactgggtgacgtcactgcggcagatggaggtggagacgaccttgacgcggatctccatggcctccggcngcgccacctccacctcctccatcaccagcg

SEQ ID NO: 8986 - DNA, 101 bp, rice(Oryza sativa)
  misc_feature (71): n=a or g
gggccacatattcctcttcatctccgtcattgggttgcgctccaagttcgccaagttcattcccaagctcntccggatatcgtcgtctaccgggattgggc

SEQ ID NO: 8987 - DNA, 101 bp, rice(Oryza sativa)
  misc_feature (71): n=t or g
caactgtgctctctctcttctgtcagacaaccccacacccacggcgcagatcaccatcccacagcctctcntcgccggcggcgggcagtacggcggcggcg

SEQ ID NO: 8988 - DNA, 101 bp, rice(Oryza sativa)
  misc_feature (71): n=a or g
cgagcacccttctcgccggcctcatcaagctcccatgtcgccgtggcctcctcgagctcctctgttgctgncatgtccaccttcctcgccacgacctccag

SEQ ID NO: 8989 - DNA, 101 bp, rice(Oryza sativa)
  misc_feature (71): n=t or g
taaacacttttcaggttttggtaaattttggcgtgatgaaggtgatatcatctgggcaccaggatttcaangcaggtgatcttgtttgggggataaccgga

SEQ ID NO: 8990 - DNA, 101 bp, rice(Oryza sativa)
  misc_feature (71): n=t or g
cctgcttcgtgttgcatcgcttgtcgagttgtcgtgcgcgcggttctgccgtttcaatgtacctgtgtccntctctgtgccgtgcacggcggtctcttcgc

SEQ ID NO: 8991 - DNA, 101 bp, rice(Oryza sativa)
  misc_feature (71): n=t or c
ggacggcgagcgttcgaggggatggccggagtttcgcgaaggtggtattgattgatcaaagcatgttgcanggcgtagtcaatccgatcttggaaattatt

SEQ ID NO: 8992 - DNA, 101 bp, rice(Oryza sativa)
  misc_feature (71): n=a or g
tgcactagatatggtctcaacagttgtagcaatagcaggaataagtgaagtcaacaaccacgctactactnaagagttggtagtactccaagtcttccact

SEQ ID NO: 8993 - DNA, 101 bp, rice(Oryza sativa)
  misc_feature (71): n=t or g
agccgtacgatcaggtgtaagctctgaatcgggacatcacttgcgcgtgcgcttgttgggctcaaaaaatnatacctggggcccacaatattgcgccacgt

SEQ ID NO: 8994 - DNA, 101 bp, rice(Oryza sativa)
  misc_feature (71): n=a or c
tcacgaacggttagatcagaagttgtcctgactcctgacaagaacatgtccaatttctccattcattctcntaacctaatcctaatcagcaaagccctgca

SEQ ID NO: 8995 - DNA, 101 bp, rice(Oryza sativa)
  misc_feature (71): n=a or g
agcattcaccaagttattggggttgcaatataaaatttgttataggaagggcagtaccaagtctgcagctnatgcattatccagaaaggagaatgatgagg

SEQ ID NO: 8996 - DNA, 101 bp, rice(Oryza sativa)
  misc_feature (71): n=t or c
ggtgattgaaatccatgtccttccatgccatgtgctagggcaggtgaaaacaacacgagatgagatgtccnggcagctgcagggtcctcctcctgcccttc

SEQ ID NO: 8997 - DNA, 101 bp, rice(Oryza sativa)
  misc_feature (71): n=a or g
ctaactctagtgaaataactttctcactttctcttggtggaccatatgcactgccaacatagacatctttngtggaaagcaaaagtggaggaagcaattcc

SEQ ID NO: 8998 - DNA, 101 bp, rice(Oryza sativa)
  misc_feature (71): n=a or g
acagtgacctggtccttaaatcgcccgacgagagagtgtgcagtggggagagcagtggcagtgagcgaccnggcgcacaagtgtggaaccaacctcgcgag

SEQ ID NO: 8999 - DNA, 101 bp, rice(Oryza sativa)
  misc_feature (71): n=t or c
cgccaccgtcaaggtccgcgccatcaggaaacacgcttttaagcagctcatcaaggttcatactaagcaanggctcccccaactggctctgaacctcattg

SEQ ID NO: 9000 - DNA, 101 bp, rice(Oryza sativa)
  misc_feature (71): n=t or c
tgccaaggaacaggatgcagcgacaacatcagatcggttcgtaggatatgttggaactaatccaaacgagncgtccgtgctacacctcttggaagactacg

SEQ ID NO: 9001 - DNA, 101 bp, rice(Oryza sativa)
  misc_feature (71): n=a or c
aaccatctagcaaaaggagttcaaggaacatttcacctcttgtcgataatttctctccaggcggtgaagcncgaaatgagagatctcgctctgataccaat

SEQ ID NO: 9002 - DNA, 101 bp, rice(Oryza sativa)
  misc_feature (71): n=a or g
ggaggaagatgtcatttttccatgacgacatggtgcacacataagacctttcggagctttcaacttaggcnaaccccgaatcaaatccataccactaatgc

SEQ ID NO: 9003 - DNA, 101 bp, rice(Oryza sativa)
  misc_feature (71): n=a or g
ctgaataccgatggacttgtgggttgtcatgtccgagtagtgataaattactgctactatgaataccgatnaattccactacaacaaaaaaaacccataga

SEQ ID NO: 9004 - DNA, 101 bp, rice(Oryza sativa)
  misc_feature (71): n=t or g
cgatgacatggccaccgaggatttagttgagctcactaaagtgaattccaagttcacactactgcaaacangtagctctccaccagtatcaccttggagag

SEQ ID NO: 9005 - DNA, 101 bp, rice(Oryza sativa)
  misc_feature (71): n=a or g
tgagatacttaaaatttctaatcaaatttaagattgaaatatgtgcaggctggagaaagttaacctgaacntagctggcatagctaaagtgggaggcacgg

SEQ ID NO: 9006 - DNA, 101 bp, rice(Oryza sativa)
  misc_feature (71): n=t or c
ttgacgccgacgtagagatcaaacacgggtagcttgttgaggccgtcgtagttgccgtaaaagaaggtggngcggaaaaggtacttgagcccggcgacgag

SEQ ID NO: 9007 - DNA, 101 bp, rice(Oryza sativa)
  misc_feature (71): n=t or c
atagatcggtgccaagtcactcgcagaataagtgatgcggataagaatgaaatgtgccaccttactcagangatctacaaccacccagatgacgtcctttc

SEQ ID NO: 9008 - DNA, 101 bp, rice(Oryza sativa)
  misc_feature (71): n=t or c
agcttgactaagggataagttttacaaaagtttataggaaccctagtacctccagaccctccatagcgganttacagcctgtactggccctaagtaaaggg

SEQ ID NO: 9009 - DNA, 101 bp, rice(Oryza sativa)
  misc_feature (71): n=t or g
gccgtcttcctcctgcagtctcagcagcacgccgagcagatcatcgtcttcgtctttcgcgccgacgccgncgtcactccccttcttctccttgcgctcct

SEQ ID NO: 9010 - DNA, 101 bp, rice(Oryza sativa)
  misc_feature (71): n=a or g
tacatcccaaaataaataaacttagtaagggatataatatatccaaacacaatactagtttgtttattttngaacgtagaggtactcgtcatccgcgtggt

SEQ ID NO: 9011 - DNA, 101 bp, rice(Oryza sativa)
  misc_feature (71): n=a or g
aaacactttccagcgcacggttcagggggcgctcaatgaccagcttggacacaatgtcaaggcctatgtcnacggcattgttgtcaagactaagaaaaaca

SEQ ID NO: 9012 - DNA, 101 bp, rice(Oryza sativa)
  misc_feature (71): n=a or g
tctctcactctcaatcccctttgtctcactgacctaaagaatgaccaagggcacattggtcacaacactcntgattttgtgtgttaatccaatgaaattga

SEQ ID NO: 9013 - DNA, 101 bp, rice(Oryza sativa)
  misc_feature (71): n=a or c
ttgcgaccaccgtttcagcgacgtgccgctctgccggcaaggccgcctcggacttcttcgacaacgctaanaaggccgcggctgacgccacgagcgctctg

SEQ ID NO: 9014 - DNA, 101 bp, rice(Oryza sativa)
  misc_feature (71): n=a or g
ttcccacccaaaaaaaaaaagaaaaaaaacgaaacgcagcgcagcagctactcccttcctaccctaatatngattttaatatttgcttgtactatttaatc

SEQ ID NO: 9015 - DNA, 101 bp, rice(Oryza sativa)
  misc_feature (71): n=t or c
atcagcgggtacaccattttcgataagttttgggggggaggggagggattcaggcagcagctcgcctgganggggactcgctcgattcgcttggcgaggcg

SEQ ID NO: 9016 - DNA, 101 bp, rice(Oryza sativa)
  misc_feature (71): n=t or c
ttatgaaaatggaaaaggaggatgagatgtcaggtcaatctgcttgcttgtcgtcgttggtaatggcaggnatggccactgaatgctgggtgcagtcaatg

SEQ ID NO: 9017 - DNA, 101 bp, rice(Oryza sativa)
  misc_feature (71): n=t or c
aaggatggcatcgagtcttaaacacaagagtagcctgaaatcacttgaattcgtgcatctgcaggaaaccnctcctgccactgctgcagcatgtttatgca

SEQ ID NO: 9018 - DNA, 101 bp, rice(Oryza sativa)
  misc_feature (71): n=a or g
gacaaagacatcatgcaattgcttccatgagtaaatgctatcaacaggcaaattgaaataccaagatctcnctatgccatcgagcgcgaggtgaattacct

SEQ ID NO: 9019 - DNA, 101 bp, rice(Oryza sativa)
  misc_feature (71): n=a or g
gctcacttacaatggcaacctggtcctcagtgatgctgatggtagcctcgtctggtcaagcggcagctcgngccggtctgtggctggcatggagatcactg

SEQ ID NO: 9020 - DNA, 101 bp, rice(Oryza sativa)
  misc_feature (71): n=a or g
gggcgaggacagcggcgtacccgatcttccagatgatcgagaggaacaccgtcaacaaggcgagctccaangccggccgcacgctgccgtcggtcgacggc

SEQ ID NO: 9021 - DNA, 101 bp, rice(Oryza sativa)
  misc_feature (71): n=t or g
ccctttcgggccacacggaaaaaatctcttttgtagcagtgaacctcggggattaggcttcaactgaacgntattatcaaatatcggatcttcctatgtca

SEQ ID NO: 9022 - DNA, 101 bp, rice(Oryza sativa)
  misc_feature (71): n=a or g
cccacttgtgcccagggcttcacctcccacgtctgcgaggaagaggcgctgctgtgattgcgagtgcgagntatgtgcattccccccacaaatctcggccc

SEQ ID NO: 9023 - DNA, 101 bp, rice(Oryza sativa)
  misc_feature (71): n=t or c
gcgccgcaaggcgcgcctgatgatggcgtaggtccagatgaagacgagcatcttgacgacttggcgcagcngcctgcggttctccaggaggaaatcggcgt

SEQ ID NO: 9024 - DNA, 101 bp, rice(Oryza sativa)
  misc_feature (71): n=a or c
ttcaaattaactagggctatcacagaacaataactgctgactcctacatcacgaacgatattgtgcactgnaaaatcaatcaaacacaaacatagcttcag

SEQ ID NO: 9025 - DNA, 101 bp, rice(Oryza sativa)
  misc_feature (71): n=t or g
gacgacgaggacgacgacgtcgacgcccttactacatgctcctccttgccgttgctcttctccttcttcgngttggccggcggcgctttgccttggtattc

SEQ ID NO: 9026 - DNA, 101 bp, rice(Oryza sativa)
  misc_feature (71): n=a or g
aggggaggggacgcatccgattaaagaaagcacttatgtacggcggcggggagataggaacgggaggaggnagcaagcggagggtcaaaatggcaagtcta

SEQ ID NO: 9027 - DNA, 101 bp, rice(Oryza sativa)
  misc_feature (71): n=t or c
cctatctcatcgtattttttttaattgttgaatatatatacaccggtacttttagctgggggatctagtcngttcatcatggatgtttgaacgagaaaata

SEQ ID NO: 9028 - DNA, 101 bp, rice(Oryza sativa)
  misc_feature (71): n=a or g
catcagaggttgggtcctgtgcaccaagatcgttttcaggatgaggatgaaggcaggaactcacagtggtntccttttggtttttttactaagaatcagaa

SEQ ID NO: 9029 - DNA, 101 bp, rice(Oryza sativa)
  misc_feature (71): n=a or g
cgtctagtgtctgaaggttggtcaggctggacaaatcaaggatgccaccaatgaggttgttggatatgttnaggtgctggagactctggcattgtttgaga

SEQ ID NO: 9030 - DNA, 101 bp, rice(Oryza sativa)
  misc_feature (71): n=a or g
gatctcggcgacgagcagcttgggcgcgttcgcctcgatggacgagttcaaaggcccaggggagaaggagnaggaggaggaggccggggacaaggccgcgg

SEQ ID NO: 9031 - DNA, 101 bp, rice(Oryza sativa)
  misc_feature (71): n=t or c
tggggcagtgacggggacgatatgggcttgtgattccgatccggttgggaggtgacgacgatgacaccggngaggtcgtcggtcgtcttgagaatgtgtga

SEQ ID NO: 9032 - DNA, 101 bp, rice(Oryza sativa)
  misc_feature (71): n=a or g
cggcaacggcgttgggcgggacctaagatctgacatgtgtacgtggcgaagggcaaaagtacacggcattngaatggatgacatattatcaaatttctcgc

SEQ ID NO: 9033 - DNA, 101 bp, rice(Oryza sativa)
  misc_feature (71): n=a or g
tttggacaagagaggggagaagggagaggaaggaagaagaaagtgctagtcgctgacatgtgggacccacntgggtcccacgctgactcagtttgccacgt

SEQ ID NO: 9034 - DNA, 101 bp, rice(Oryza sativa)
  misc_feature (71): n=a or g
cctcactggaatccccttagtcgcccccaccgtcaggaagagaaaagtttgtggaagaaaacagaccaccnccgtcaagacgagttgcaacaaactagggt

SEQ ID NO: 9035 - DNA, 101 bp, rice(Oryza sativa)
  misc_feature (71): n=t or c
cggtcaggtgtggcggaggccatgtgccgcctggcctctggtgttcggatggtggttttggattgggaganataccacggcggtagggttgtgagggttcc

SEQ ID NO: 9036 - DNA, 101 bp, rice(Oryza sativa)
  misc_feature (71): n=a or g
gcggaggattttttttttacttcaccgagaatgtttttgcaggcaggtggttgtagcacctacgaagatgnagtggtcacttgtgaaaattattttcgcag

SEQ ID NO: 9037 - DNA, 101 bp, rice(Oryza sativa)
  misc_feature (71): n=t or c
ggaaccggatggagtactcgggatggaaagcaatgttgacactactcgctagagaacgtcaataaaagtantccatccgtcctaaaataaaaaaacatagg

SEQ ID NO: 9038 - DNA, 101 bp, rice(Oryza sativa)
  misc_feature (71): n=a or g
gtggtttggatccgtcactgaaacataccctcttcccctctccgctcctctctttaggcctttgtcatgcnatatcgacgagcttcaggtctgaattagat

SEQ ID NO: 9039 - DNA, 101 bp, rice(Oryza sativa)
  misc_feature (71): n=t or g
gcgtttactccttccatcgtgtattcttccacccgaatgagttgattcgccagtgtaggttctccttcaanattgtaggtgttgtttgaggatgaaccaat

SEQ ID NO: 9040 - DNA, 101 bp, rice(Oryza sativa)
  misc_feature (71): n=t or c
tgtataccatacctttgtttgaatcccttagctactagacgagctttgtatctatctagtgaaccgtcagnctttcttttaattttatacacccatttgca

SEQ ID NO: 9041 - DNA, 101 bp, rice(Oryza sativa)
  misc_feature (71): n=a or g
tgctaaaccaagaggcttttccttgcaaggaagccattgattgtggtgtggtgttttcaatattctctctntcatgttggctgacacgcatatattcggat

SEQ ID NO: 9042 - DNA, 101 bp, rice(Oryza sativa)
  misc_feature (71): n=t or c
cttcctgaggcgggtgtaccagtaccagaacggcccgaggtccgacctgggctccaaccccttcaactcgnccggctggctcgccctcgagctcggcgtga

SEQ ID NO: 9043 - DNA, 101 bp, rice(Oryza sativa)
  misc_feature (71): n=t or g
cgtggagccgcggatggaggcgttggcggaggcataattgatgacgggggcggcagcgatggaacgtgacngttgcgcgccgcgtggtgactcggagatga

SEQ ID NO: 9044 - DNA, 101 bp, rice(Oryza sativa)
  misc_feature (71): n=a or g
cggggacaagtcgttcgctgcaagcgtgtcttgaagagttggtgccgcggcgcactcagcgttcagggacngcagcgtcttttctgcggacgtgatcggca

SEQ ID NO: 9045 - DNA, 101 bp, rice(Oryza sativa)
  misc_feature (71): n=a or g
aaattattgggtagagatggatgggtttttcgatattgttcaggtagtttggtctttagatcctggtttcnatgatcctgccaagtgcatttctttcaaat

SEQ ID NO: 9046 - DNA, 101 bp, rice(Oryza sativa)
  misc_feature (71): n=a or g
cgaagccaaacaagccaatgttgatgaagttgaggaagcctctactagattggttttgtcgccagaacagnaagtttttgagaagccagaagggacggaga

SEQ ID NO: 9047 - DNA, 101 bp, rice(Oryza sativa)
  misc_feature (71): n=t or c
taaacacaccctaaattgtcctaaattgtgcttgtgttgctactagactcatcatgtattgtcagaaaccncgaatgtgtggtcgtgcttgcaagtaaacc

SEQ ID NO: 9048 - DNA, 101 bp, rice(Oryza sativa)
  misc_feature (71): n=t or g
aaccctagaaaggaaaagagtacagcccacagctaaaatgttcacatcaattacaatcatttagttcaagngtttacatcaatttcatcatcaagatacat

SEQ ID NO: 9049 - DNA, 101 bp, rice(Oryza sativa)
  misc_feature (71): n=a or g
gagggtgaaacgcgacgtccttagagcgatggcgaggatcgcggggctggacgacgacgatcagcacttcntcgatcagctcggcggcagggcgaccgtgc

SEQ ID NO: 9050 - DNA, 101 bp, rice(Oryza sativa)
  misc_feature (71): n=t or c
gttaacgagctaaaaacctagcccatctgaactcgcgtgttggctcattaatgtatttttaccacctttanaattttaaattgactattttaacatatgta

SEQ ID NO: 9051 - DNA, 101 bp, rice(Oryza sativa)
  misc_feature (71): n=a or g
aagtatttgccacagtgggaagggcctccccaaaacactaatgagtaatgagtgaaaaataattcctcacnagtattttgtttgttaacttgttatcaagg

SEQ ID NO: 9052 - DNA, 101 bp, rice(Oryza sativa)
  misc_feature (71): n=t or c
ccggggcagctctccccccttgaagagtacatccgcagccagtacccgtcggccgttgagaccacaccgcngccaccggccgtgcctgcaccgccttccga

SEQ ID NO: 9053 - DNA, 101 bp, rice(Oryza sativa)
  misc_feature (71): n=a or g
gaggtcctcattactactcccaaaaacatcttttaacttcatttggtttatgttagactccaatgaagatncaaccagctgaatatccaaaatcttcttat

SEQ ID NO: 9054 - DNA, 101 bp, rice(Oryza sativa)
  misc_feature (71): n=t or c
agctagccggcggcggcgcgacgcgggcgtcgcatcggccagcctgaacaacgacgtgacaggtagaggtngccgcgcacagtggccgggatgtcgcgacc

SEQ ID NO: 9055 - DNA, 101 bp, rice(Oryza sativa)
  misc_feature (71): n=t or c
aaatcttatcacaacatttgcagggcgaaatacatcatgtcatgaaccctgatccttaccgtggaactttnggttctgatgctgtagcttatgccaaggaa

SEQ ID NO: 9056 - DNA, 101 bp, rice(Oryza sativa)
  misc_feature (71): n=a or g
agttttggacttagagaaatttgcacgagcattgagagtgcgatggctatgattcagttgggagagcccanacaaacattgggcagggacatgtaccaaat

SEQ ID NO: 9057 - DNA, 101 bp, rice(Oryza sativa)
  misc_feature (71): n=t or c
cagtgattacggtttcttttctgctttcctctttgtgttttcttttgcggtattttgctcctctctgttcnggggtcgatcctcaaactgtgtatatactt

SEQ ID NO: 9058 - DNA, 101 bp, rice(Oryza sativa)
  misc_feature (71): n=t or c
agatcttaattatgtattttacccatttccacgttttgttatcctgccttcacaaggagtcccagacccantgctcgttatcactataaaaattgtgtaac

SEQ ID NO: 9059 - DNA, 101 bp, rice(Oryza sativa)
  misc_feature (71): n=t or c
gcgctacaatattaagggagaacatatgatgatagtgtagggtctaaaacttagtccccgttcgaatcctncgaagacgaagattaaaaacaggcacacaa

SEQ ID NO: 9060 - DNA, 101 bp, rice(Oryza sativa)
  misc_feature (71): n=a or g
cgatcatatgccattattgttggatactggtgttaattctctcaaacaaccactattcaagtttgagcttngatggttgttaagagatggattctatgata

SEQ ID NO: 9061 - DNA, 101 bp, rice(Oryza sativa)
  misc_feature (71): n=t or c
actgattaccagatgatcatagcacagagaatcagatagaggacaaatacacagcacaaaattttataggntacctaggtactccgtagacaacaagattg

SEQ ID NO: 9062 - DNA, 101 bp, rice(Oryza sativa)
  misc_feature (71): n=a or g
cttggtaaaatttatgtgctgtacagactacaaggggtaaagtagtgagaagagatggtaaggtggcgccnctggatctgctgcaattgtcaagtgaacga

SEQ ID NO: 9063 - DNA, 101 bp, rice(Oryza sativa)
  misc_feature (71): n=t or c
gcactcacggtatatgaagttgtaaaggtcctgctgcatatttttaatgcctttgtcgtcaaagttggttngacgctcgattctaggcaactgcaagtacg

SEQ ID NO: 9064 - DNA, 101 bp, rice(Oryza sativa)
  misc_feature (71): n=t or c
ttcagcctagaggaagagggaggcttgacatcctggaggaacggagccggcctgacgtaggtgaacccggngaagctgctgtggccggcgccgccggcgac

SEQ ID NO: 9065 - DNA, 101 bp, rice(Oryza sativa)
  misc_feature (71): n=t or g
caaccctcaacctttaccgcaacctgaccctaacgcaccaccacagcctttgccgcaaccagaccctaacncgccgccacagcctttgccgcaaccagacc

SEQ ID NO: 9066 - DNA, 101 bp, rice(Oryza sativa)
  misc_feature (71): n=a or g
ccccccacacacacaccttcacgagctcgccgcaccaaatattgtgttccccatgctgcgtcctcgctccntcgcttgttgccatcctctgtccaatgctc

SEQ ID NO: 9067 - DNA, 101 bp, rice(Oryza sativa)
  misc_feature (71): n=a or c
gtgttgtatcttaagatgatttgtataagtgttctttaggagttgtgcacacactggtacgatttgagatnatcaaatcatctacacgttctctttttaat

SEQ ID NO: 9068 - DNA, 101 bp, rice(Oryza sativa)
  misc_feature (71): n=a or g
tcaggaagagtataaaatgatgggtaccatggttttttcaagcgaggaggaaggttacagattctatttanactatgcaaaggggaagggtttcagcgtga

SEQ ID NO: 9069 - DNA, 101 bp, rice(Oryza sativa)
  misc_feature (71): n=t or c
gtcctctccaccgccggcctccatcgagccccaacgaagcttgttatacatgctatatgtagtacaatctncgatgcttgtgtatatgtttgtattgctaa

SEQ ID NO: 9070 - DNA, 101 bp, rice(Oryza sativa)
  misc_feature (71): n=t or c
tatgatgtgcatctccgatgagtgagttcctcttcgtcatcattaacagtcggttctaatcttgggaattnagtttctgttacagatggccgattgacgaa

SEQ ID NO: 9071 - DNA, 101 bp, rice(Oryza sativa)
  misc_feature (71): n=a or g
ttcttttttactccctccttccaaaaacaccaactttttaaaaactccttctctaccacgtacaataaggntgtgtttacttcatactaaaattgaaagtt

SEQ ID NO: 9072 - DNA, 101 bp, rice(Oryza sativa)
  misc_feature (71): n=a or g
ttcaagaaaagaaccaactccggctacattttgcgtgaaaatgtctcctacagtattttagtgcacgttantacagcaaacaacgactaaggctgagtttg

SEQ ID NO: 9073 - DNA, 101 bp, rice(Oryza sativa)
  misc_feature (71): n=t or c
catctcccccctccctcccgtttcgttcacacggcgctgcatcggcgagtgctcgacgggggtaagtcagngacgacgaccaccctcacttcccctctccc

SEQ ID NO: 9074 - DNA, 101 bp, rice(Oryza sativa)
  misc_feature (71): n=t or c
gtactaggaaattttgttccggggaagaggagcaaggaaaaagtgcctggcactcacgtcataatggcgtngtgatgatatcaagcgcacgcgggacccat

SEQ ID NO: 9075 - DNA, 101 bp, rice(Oryza sativa)
  misc_feature (71): n=a or g
tgcccaaccattgcttttatgtaaaacaagctgttctctcagctttgcctccctggtacacaactcatgtnttttgtcctgaatcaataaaacacatgagt

SEQ ID NO: 9076 - DNA, 101 bp, rice(Oryza sativa)
  misc_feature (71): n=a or g
ccacgagtactttgttagaaaatatcctgtgagccactgtcaagcagaaatgacctagcaggccataatcntcacctgcaacctgagcaggactttggtag

SEQ ID NO: 9077 - DNA, 101 bp, rice(Oryza sativa)
  misc_feature (71): n=a or g
gggctaataacgccgccggtagaagaatccggccgggtgaagatggagctcgacggcggtgttgcctccancagcagggtatctctcccatcatgccgcgc

SEQ ID NO: 9078 - DNA, 101 bp, rice(Oryza sativa)
  misc_feature (71): n=t or c
gtccatcgtgtagtattcgtgtagcatatctgcttcaggggatggattttgttcgattttctgaaaggagngtattgtcaaaacgaacttggacgtgtttt

SEQ ID NO: 9079 - DNA, 101 bp, rice(Oryza sativa)
  misc_feature (71): n=t or c
cgttgccatatccaacgcctccacgagtttggggatggccagatctacaccctctgttgctccctcttggncttcaccttgctatggcccgttggccaccg

SEQ ID NO: 9080 - DNA, 101 bp, rice(Oryza sativa)
  misc_feature (71): n=a or g
gatgtgggcagctttaagtgctcaccatgatgacaggtcgcccatgggtgatcgcgccacgcatgggggcntgcaatctgggaaaatggagggcccgcctg

SEQ ID NO: 9081 - DNA, 101 bp, rice(Oryza sativa)
  misc_feature (71): n=a or c
acatcagggtatgcctgatgtttggaagagcaaggtacaataaacagcatatgttgctatgcagaatgcanttgtgtacatagtcattttgcttcaatgcg

SEQ ID NO: 9082 - DNA, 101 bp, rice(Oryza sativa)
  misc_feature (71): n=a or g
atgaggagcatacatgagcacaaactccatgcatattgtgcaaaattttaaaaatgaatagtaccaggcancacttccatactatttgcccatgatccttg

SEQ ID NO: 9083 - DNA, 101 bp, rice(Oryza sativa)
  misc_feature (71): n=a or c
tcatagcccatcacttgacattgctcctggcactccctcatgaaaagtggccccggggtatgtaaccgtanagtctccttaataacaaactgcaggtaagt

SEQ ID NO: 9084 - DNA, 101 bp, rice(Oryza sativa)
  misc_feature (71): n=a or g
agtgggcgagaaggaacgggaagcggcatggattgaggtgagaagaaggaagggttcgcattcaagagggnctcatctgtctccacctaccagaccagctg

SEQ ID NO: 9085 - DNA, 101 bp, rice(Oryza sativa)
  misc_feature (71): n=a or g
cgaaaactggtgctacaaccagacgtccccaatcacggacgagacgaagatcgtcccatggttcccgaggngcctggtgtccatcgtcgagaggaacatcc

SEQ ID NO: 9086 - DNA, 101 bp, rice(Oryza sativa)
  misc_feature (71): n=a or g
ctccacttgcatctgcatgcatgtgacgcagctcgcatggagtatataggagtaaactaacgagtctcaanaaaactaatcatcgccatataccgagattt

SEQ ID NO: 9087 - DNA, 101 bp, rice(Oryza sativa)
  misc_feature (71): n=a or g
cgccaccatctcctccctccaggccctgctcgctcatgtttggcgctcggtgtcgcgagctcatggcctcncgccgcgccaggagacggcgtacgtactgg

SEQ ID NO: 9088 - DNA, 101 bp, rice(Oryza sativa)
  misc_feature (71): n=t or c
cagacaagagatgtaccaccagctcaatccacgactccacgtgtaactgaacctgggcccgtttagttccncaaaaaattttcccaaaaatatcatatcga

SEQ ID NO: 9089 - DNA, 101 bp, rice(Oryza sativa)
  misc_feature (71): n=a or g
tgctgataacctcatttacaaattcttctccattccttgtcaaatcatggagaaatttcacagcaacagantggccatcaggtgaagtacctttgtatacc

SEQ ID NO: 9090 - DNA, 101 bp, rice(Oryza sativa)
  misc_feature (71): n=a or c
cctcccaccactcatgtaccgtcaaagatatttgttagctagaaggtcttagatgggcaatggtcattgcntgtccactgcgcgatttcattccaaattct

SEQ ID NO: 9091 - DNA, 101 bp, rice(Oryza sativa)
  misc_feature (71): n=a or g
gcattacaagcaaaaccatcgccaggagcagccttctcttcgtgctgttttctccccaccacagccagccnccccttttcccctctctgccacccgcctcc

SEQ ID NO: 9092 - DNA, 101 bp, rice(Oryza sativa)
  misc_feature (71): n=t or c
ggatcaaggaagttaactagaggggggatgaatagcggttttaaaattttttgtctgaaaccgagttttgnatgcggaagcataaatcaaaacggttttgc

SEQ ID NO: 9093 - DNA, 101 bp, rice(Oryza sativa)
  misc_feature (71): n=a or g
agatgggatcggtaaccgaaggttgcgcacaacagttgtgtcgtacccctcgccttctcggcgctccttgncaacgggcacgatggttcccaaccatcacg

SEQ ID NO: 9094 - DNA, 101 bp, rice(Oryza sativa)
  misc_feature (71): n=a or g
aacaccgtccaggcaacaggttgtgcagcctattcaacaaggatccccaattcagcaggccctgcaaccanttcagcagacgccaccaaggcgaccggctt

SEQ ID NO: 9095 - DNA, 101 bp, rice(Oryza sativa)
  misc_feature (71): n=t or c
tttaaaatcctttttcttcttggcaaaattaagtcaccaagctactagtccaactactagtactaccagcncagctactgccactgacagtggggcccatc

SEQ ID NO: 9096 - DNA, 101 bp, rice(Oryza sativa)
  misc_feature (71): n=t or c
ggtgtccgggtcacccaggctgatgcaattcagattcgtcctcgagatggagcactccatgctctccctcnctcaccttggattccctctcctctgcttcc

SEQ ID NO: 9097 - DNA, 101 bp, rice(Oryza sativa)
  misc_feature (71): n=a or g
cagaggcatgccaccgaatcatgctggcagttggaacggagagggccaaggagggttggctcacttcggangaagagtcactcgagttcgacgtggtgatg

SEQ ID NO: 9098 - DNA, 101 bp, rice(Oryza sativa)
  misc_feature (71): n=a or g
agaaagtgtactattactactgtttctccagtgaaagcagtgggtgctatcgcggcttcatccctcccgtnctcccgtgtgctgccgtttcttccgccatg

SEQ ID NO: 9099 - DNA, 101 bp, rice(Oryza sativa)
  misc_feature (71): n=t or c
atttgagatcgtaggtggcaaagcagagatcaagcagtagcatggaattaatccatttgtgatcctcgtantgcggtatcttgctctgcagtatatattgc

SEQ ID NO: 9100 - DNA, 101 bp, rice(Oryza sativa)
  misc_feature (71): n=a or g
ggagagcatggcgcacggcgtgcctgtcatcgggtggctgctgacggcggagcagttccacaatgtgatgntgctcgagggtctcggggtgtgcgtggagg

SEQ ID NO: 9101 - DNA, 101 bp, rice(Oryza sativa)
  misc_feature (71): n=a or c
cggctgctgtacctcccccgccgccgccgcagcagcagacgccgatgttgttcggtcagagcaatgtgttncctccgatggtgcctccgctctcgctggga

SEQ ID NO: 9102 - DNA, 101 bp, rice(Oryza sativa)
  misc_feature (71): n=t or c
cttttcaacctcaggaaatatcagctcttctccttttacctcatttgtgtcccaccatgtctcaaaatttntcatactggccaaggtaagctccttcagtc

SEQ ID NO: 9103 - DNA, 101 bp, rice(Oryza sativa)
  misc_feature (71): n=t or c
gaccgagcaaggttgcgcgttgctctgcttggggacgagcaaccaagtttggtcctggttccacgcgacangtcggacaaaatcctccgtgtcgccccata

SEQ ID NO: 9104 - DNA, 101 bp, rice(Oryza sativa)
  misc_feature (71): n=a or g
gaaacggatcataaaccgcacggctcatcagtgaatggcaagttaggcccagttatgagaaaaaaaaggangcagaggatagaacactggtgagcaacctg

SEQ ID NO: 9105 - DNA, 101 bp, rice(Oryza sativa)
  misc_feature (71): n=t or c
tcccggtcgctcgagcggtcgcggtcaatgccgggccggctgaggaggaagctgtcgtccaagaagatganccaggaggctgacaacgacggcaatgcgtc

SEQ ID NO: 9106 - DNA, 101 bp, rice(Oryza sativa)
  misc_feature (71): n=a or g
ggtgagcggacggcggtggccgtcgtagctcacggtgcggtccatggggaacaaatccttcgtcagcctgntcggcacgtcggcgttgggcacgaggaagt

SEQ ID NO: 9107 - DNA, 101 bp, rice(Oryza sativa)
  misc_feature (71): n=t or g
caggtgaagcctgaagtcgacatgataccaaggttgaagaacggccacagcgtaggaggaggaggaggagncgtcgttgccgcagctcaggatggcaatgt

SEQ ID NO: 9108 - DNA, 101 bp, rice(Oryza sativa)
  misc_feature (71): n=t or g
tgaaaagagaggctgctgtagttgtggaaggactaaagaagatgggtgttcatcccgtgatgctcacaggngacaactggagaaccgcaaaagccgttgca

SEQ ID NO: 9109 - DNA, 101 bp, rice(Oryza sativa)
  misc_feature (71): n=t or c
ctgctcgcagctagttatcttggatgattttcagctagttatattgttcaagatcctacatcgtgaagatngggacaacatccgtatcaggattggtgagt

SEQ ID NO: 9110 - DNA, 101 bp, rice(Oryza sativa)
  misc_feature (71): n=a or c
tattaaaaattttccatttcaaaattgaaaatctggtatcctctggtcacattcttttcattagttcacangtgacaccaaagttttattttaacataaaa

SEQ ID NO: 9111 - DNA, 101 bp, rice(Oryza sativa)
  misc_feature (71): n=a or g
actagtaacctagaaactgagcacagctatctcagtggaccatcaaccagtaactttgaaatcgagcacancaccgagtatagaaggaaggatgaagaaat

SEQ ID NO: 9112 - DNA, 101 bp, rice(Oryza sativa)
  misc_feature (71): n=t or c
aggaataaaaagaaaatcgataatggaatacaactactctatctataatataatatattccaacctgcacnattctaaaaaaatcaaatctcaaataaatg

SEQ ID NO: 9113 - DNA, 101 bp, rice(Oryza sativa)
  misc_feature (71): n=a or g
cgcccggcgttggcgtaccctgcgaccagcgagttccaggtggtcaggttcctgtgctccagcgcgtcgancaccttctgggcgcaatcgaggcggccgca

SEQ ID NO: 9114 - DNA, 101 bp, rice(Oryza sativa)
  misc_feature (71): n=a or g
tagacacatacagagagggaacaccactaggtggtcttctggaagaacgcgtcgatgcggcgggtcccacntggcaacggctttgcctctcctcttccgcc

SEQ ID NO: 9115 - DNA, 101 bp, rice(Oryza sativa)
  misc_feature (71): n=t or c
gaaaaacacctttttagataaaagggaaggtagtcatagctaatttgtagtgctggcattatgtcatcatnatttgtctgatgttgccactcatttctttc

SEQ ID NO: 9116 - DNA, 101 bp, rice(Oryza sativa)
  misc_feature (71): n=a or c
tcttcaaaataattccttgtcaaaatttgaagttagtgaatttggcttatttcagtcgtgttgctcgcccntttcttgatatggacttgatagcctttgag

SEQ ID NO: 9117 - DNA, 101 bp, rice(Oryza sativa)
  misc_feature (71): n=t or c
gatggtaccgagaagcttggtgagctcgttgaggagcttggtctttgcatgatggaacttgggattttggntgcacgagcctgcgacactgttactggtgg

SEQ ID NO: 9118 - DNA, 101 bp, rice(Oryza sativa)
  misc_feature (71): n=a or g
aaaataattcaaatatgacgaagagagtaaacggcttcttctcaaaatcaactctcttaaacatgccattntcctgttttggttgctatatttttcttaag

SEQ ID NO: 9119 - DNA, 101 bp, rice(Oryza sativa)
  misc_feature (71): n=a or g
cgcaaggcgcggttggtggtctaatgcgtggagaggcgggttgttgtatctagggataggcaaataaggcncactcagtgggcaagttggctagacccgtg

SEQ ID NO: 9120 - DNA, 101 bp, rice(Oryza sativa)
  misc_feature (71): n=t or g
gtttaggtttcctgttggtacttaattagagttgtttcttgcatattttacttcagattcagtcaagattngaagagatcttatgtgataattaacaggtc

SEQ ID NO: 9121 - DNA, 101 bp, rice(Oryza sativa)
  misc_feature (71): n=a or g
gcactcgcaccgcacgcgtcgaaggatcgggaaggcgcagccccgcgtcggatcgagagctagggttatgngcggcggggacggggaagaggcagccgccg

SEQ ID NO: 9122 - DNA, 101 bp, rice(Oryza sativa)
  misc_feature (71): n=a or c
gccgtgcgcgaacttgtagagcaccgacgtcaggtacaccgactcggtggaggcgaagacgcaggcgaacnccagcacccacccgatgttcacccgccaca

SEQ ID NO: 9123 - DNA, 101 bp, rice(Oryza sativa)
  misc_feature (71): n=a or c
acggagggcaacatccctggggtttggcccgtcgcagaagacgctctcgtccatcagagcactgaaactcnagaggtcattcaccacaagcacctcatcag

SEQ ID NO: 9124 - DNA, 101 bp, rice(Oryza sativa)
  misc_feature (71): n=a or g
cggtgatcatgattgtcaagttcccttcactggtacacaagcatggattagatttctgaacctttctgtanttgatgattggcgaccatggtatgctgctg

SEQ ID NO: 9125 - DNA, 101 bp, rice(Oryza sativa)
  misc_feature (71): n=t or c
tgtgtgtattttggttatgcataacttagttatgcaaagtccgagagtgttctcaatacagttatatcacnttgatgtaattggatgagctcaattaagct

SEQ ID NO: 9126 - DNA, 101 bp, rice(Oryza sativa)
  misc_feature (71): n=t or c
tattttttttccctttctactctgtggatggcagcaagccagcaagggcgccaaacgaggtggagaaggcngtctagttgtggtccatgatggcaacaaca

SEQ ID NO: 9127 - DNA, 101 bp, rice(Oryza sativa)
  misc_feature (71): n=a or g
cttttttttttctcaaatctgaattctgatattgttgctgtccttcatggcatgcagcgtccggtgagccnccgctgctgctggcgtcgtcggtgcactgc

SEQ ID NO: 9128 - DNA, 101 bp, rice(Oryza sativa)
  misc_feature (71): n=a or g
tactatggaactttttttttgcatgtactaaacacgtttcccatattttaaggagtgaagaagcaaatacntttttttttcttttgaaacagaagaagcaa

SEQ ID NO: 9129 - DNA, 101 bp, rice(Oryza sativa)
  misc_feature (71): n=t or c
aagttgagttcaaacgcgcaggatcagtagctccatagctggacctcgccatcgttgtcgtcttcgccgcnacctacggcaggatcaccggccattggagg

SEQ ID NO: 9130 - DNA, 101 bp, rice(Oryza sativa)
  misc_feature (71): n=a or g
aaggaactggccgagctcaagggagaagcaccgccgtcagctaccccagaggaggaagatccagaagaaanagagccagctattccagaggaagaagatcc

SEQ ID NO: 9131 - DNA, 101 bp, rice(Oryza sativa)
  misc_feature (71): n=t or c
cgcctaaactggagccaacctgatcgagacgcagccatgcgagcagccgtcgcccatcgaatcctcctctngctcgccctcttcgccgtcctctgcagatg

SEQ ID NO: 9132 - DNA, 101 bp, rice(Oryza sativa)
  misc_feature (71): n=a or g
ccgacggtgaggtcattggagacaccccgagacaggaaagcaatggagacgggacggcataggtcacagancctgggatctgcagggctcgcgttccacgc

SEQ ID NO: 9133 - DNA, 101 bp, rice(Oryza sativa)
  misc_feature (71): n=t or g
aatatgttacttatatgtcacattaccgtatattgttcaaggatctaggctgaggagtaggagtaacttcnagtttatttacgagtgcaaacaatagatcc

SEQ ID NO: 9134 - DNA, 101 bp, rice(Oryza sativa)
  misc_feature (71): n=t or c
cgtcgtgtggcgccggccttcgccccatcgttggagccgaggcgccgccatcgcagattcgtccacgaaanggcaccgccgccaacggcttcccatccaca

SEQ ID NO: 9135 - DNA, 101 bp, rice(Oryza sativa)
  misc_feature (71): n=a or g
gtgtgtaaaatctcagtgtatggtattcacaataatttcatcagataaccagccaacacaaccatgagggnaggggaggccatagtggaggactggaggag

SEQ ID NO: 9136 - DNA, 101 bp, rice(Oryza sativa)
  misc_feature (71): n=t or c
cgggttggggtttgggtggaggttggggtagggaacggggttgattagagagggggtggtgttggtgtttnttttttttttcgttttcgtttgggtgtttt

SEQ ID NO: 9137 - DNA, 101 bp, rice(Oryza sativa)
  misc_feature (71): n=a or g
aataattatattctcagatagtggcataggcgtatagagtatagctatagtggtaacgacatccaacattnggctccgtcggtggttttagctgttagtga

SEQ ID NO: 9138 - DNA, 101 bp, rice(Oryza sativa)
  misc_feature (71): n=t or c
tccgatggcagaaaagaccagatcctatgattttttcgagtaaagtccatcggtccctaaacttgtactgntgtgtcatcccggtccctaaacttgcaaat

SEQ ID NO: 9139 - DNA, 101 bp, rice(Oryza sativa)
  misc_feature (71): n=t or g
taaaaacatgtgattctgcaccactgcattaaaataaaattcaaaatgattctaacagtatgtgctttagngtacaaaatagaataaattagtgttcataa

SEQ ID NO: 9140 - DNA, 101 bp, rice(Oryza sativa)
  misc_feature (71): n=a or g
gaggtatccttggtagtagtataagttgtaacatgacctcggccataaggtgcgagaaggacttgtgcatnacggggttgatgcccatcctggacagcttc

SEQ ID NO: 9141 - DNA, 101 bp, rice(Oryza sativa)
  misc_feature (71): n=a or g
ttgatcgaatatatatatatatagttggacagtacaagtgtacaacttggttgacaataatcttcaagagnaaaaacaaaacaagcaaaaaaaaaaaaagc

SEQ ID NO: 9142 - DNA, 101 bp, rice(Oryza sativa)
  misc_feature (71): n=t or c
aggaggtcgtcgtcgttggcgctgctcgtcggccgaagcacccaggtggagatatggacgatgaagctganctgccacgggatggccttgctccggatggc

SEQ ID NO: 9143 - DNA, 101 bp, rice(Oryza sativa)
  misc_feature (71): n=a or g
caaaggttgagttcagaacagagttcatcttggattttttggcagcacacaaaacaatattaagttattancatatgattaatccagttttaatcactatg

SEQ ID NO: 9144 - DNA, 101 bp, rice(Oryza sativa)
  misc_feature (71): n=t or c
gctgaagggcagaccaccacagctggggaggatgcgagaagtgtcgtccgcggcgggaggaaacgatttcnggcgattccgcggctggagagaatgcgaga

SEQ ID NO: 9145 - DNA, 101 bp, rice(Oryza sativa)
  misc_feature (71): n=t or c
gttgggaaagcagccatcgctcccccaagctaccccgcgtcggcattttttccagaagcggcacgtgttcnggcagcaccagtcccatctccacctagcca

SEQ ID NO: 9146 - DNA, 101 bp, rice(Oryza sativa)
  misc_feature (71): n=a or g
gttacagaatcatagaaacactatcatataggctaacattagcacaacgagatagactaacgccgtatggntggttgtatgcgttccaatgtacttcttgg

SEQ ID NO: 9147 - DNA, 101 bp, rice(Oryza sativa)
  misc_feature (71): n=a or g
aattctgacaaccccaatgagctcgccaacctccagatctggtgtaggaagggagaaagtgggtggggatnccttgggtgtaagggatgatgatcgaggag

SEQ ID NO: 9148 - DNA, 101 bp, rice(Oryza sativa)
  misc_feature (71): n=a or g
ctcgacctgtcttcgaacaacctcaccggtgcaattccggcctgggtgtggcggcatgagaagctcgagtncctctacctgttcaacaacagcctcacggg

SEQ ID NO: 9149 - DNA, 101 bp, rice(Oryza sativa)
  misc_feature (71): n=a or t
gcgtgcacgttcatagaggataagcatacgcgcattgtgagcatggtttacaaccgctaggtacgataaangtaaaaccacgataaccccattaaacccaa

SEQ ID NO: 9150 - DNA, 101 bp, rice(Oryza sativa)
  misc_feature (71): n=a or g
tggtgtcacgggtcgtccatatttcacgaaaaacaaatgatgctcatgggagcctcattttttcgtttatncttatgtttattggaaccgcttattagcaa

SEQ ID NO: 9151 - DNA, 101 bp, rice(Oryza sativa)
  misc_feature (71): n=a or c
tgtccgtctctgcgttccttcgaactcttttcagaatcacactacaattttctccaaatgtaggtgttcgnaagacgcgtactctcactaatataaataca

SEQ ID NO: 9152 - DNA, 101 bp, rice(Oryza sativa)
  misc_feature (71): n=a or g
acggggtttactgggatgtgccattgtcattatcagctgacctggcttcagttggctccgagtctggattnagttatcatgtactattgcagcagaatagt

SEQ ID NO: 9153 - DNA, 101 bp, rice(Oryza sativa)
  misc_feature (71): n=a or g
gcaaagctttgtcttgtttctgatgattgcccagaactagaagaaatgcttaatgattgcaatggcacccnagatgaatcactttgacctcccaacccatg

SEQ ID NO: 9154 - DNA, 101 bp, rice(Oryza sativa)
  misc_feature (71): n=a or t
cgaagaaaaccaaaaaaagggtcggagtggattgattcttccccgtgcttttcccatggaattaacagtgnaggaaatcttcctgcgattttcctttgatt

SEQ ID NO: 9155 - DNA, 101 bp, rice(Oryza sativa)
  misc_feature (71): n=c or g
aatcccacgggcccaataatcccccttccctaacattctctgtctttatctctcactcatcctttctactntctcgcactatagacctccattttgataaa

SEQ ID NO: 9156 - DNA, 101 bp, rice(Oryza sativa)
  misc_feature (71): n=a or t
tacccatcattggttcaacaagctgaacgtgcaacagaaaaaaaacagagaataaatgcaatgtgacctanatttgtagaaaaaaatgcaaaaaaaaaggg

SEQ ID NO: 9157 - DNA, 101 bp, rice(Oryza sativa)
  misc_feature (71): n=a or t
tgaaaacttgaaaaaaaaacacagccttaatcttaacatggccagctgcacaggttgaggttttttttttnaaaaaaacacatcaactttattaagcaaga

SEQ ID NO: 9158 - DNA, 101 bp, rice(Oryza sativa)
  misc_feature (71): n=t or c
tcttacaatatatgcacgccttatattataggataaagagaggactataaaagagtccttaatattttctnatttaataacttaatgaatcatatttattt

SEQ ID NO: 9159 - DNA, 101 bp, rice(Oryza sativa)
  misc_feature (71): n=t or g
attcaaatctcaattaatttcagcatatttgaaacaatactttttaaaagtagtgcagagtgaaactatanacgctttatgttttaaaattttaagtaaat

SEQ ID NO: 9160 - DNA, 101 bp, rice(Oryza sativa)
  misc_feature (71): n=t or c
agtcggcttggtatttacaagggttacgacgctaccacaatcgcaatgttcaatcacgcgcatttttagtnggagacatggtcttgaggaaaattcaatct

SEQ ID NO: 9161 - DNA, 101 bp, rice(Oryza sativa)
  misc_feature (71): n=a or c
taaacacaacaagctaattagcatggcgaattaataattcgcaaccgactttacgatgaaccacgacttgntgtttggacgagacgtggttctctagtcga

SEQ ID NO: 9162 - DNA, 101 bp, rice(Oryza sativa)
  misc_feature (71): n=t or c
gcctctcgtagctagcgggaggatttctcctcctcaacatccgaccgaaggggcaattccgtctcatcatngggtggaggagcgaaaatctatttgggaat

SEQ ID NO: 9163 - DNA, 101 bp, rice(Oryza sativa)
  misc_feature (71): n=t or c
tcgactaaccaacggcatgcacatgcgctcctctatacaacatccaaattggccctatttggaagattagnccaggactaattttgagagctaatgtttag

SEQ ID NO: 9164 - DNA, 101 bp, rice(Oryza sativa)
  misc_feature (71): n=a or g
tccgcatcgccagcgtcacctccctcttcgtggtccgttcgcgcccgtcgggctcatcgacatgttcaacnccggtgacgccatcgaggagtgcgccatcg

SEQ ID NO: 9165 - DNA, 101 bp, rice(Oryza sativa)
  misc_feature (71): n=t or c
ttggctatcgtcgtgcctcggtgaatcgagacgtgatgatcatcagtggtatgaagtactccctccatttnaaaatgtttggctgatcattcgtcttatta

SEQ ID NO: 9166 - DNA, 101 bp, rice(Oryza sativa)
  misc_feature (71): n=c or g
tattttcttttcaactttgctcaatgtttttaggacaagctttatttccatcttcttctttcttttttttnttttttttcatagccatgcctttccctcct

SEQ ID NO: 9167 - DNA, 101 bp, rice(Oryza sativa)
  misc_feature (71): n=t or c
aagccaacttctagtgtagaagcttagcttaattttatatgtgaaattggaaagtggaaatgatactgacnccttgatcatgacagtatgaaagatatcta

SEQ ID NO: 9168 - DNA, 101 bp, rice(Oryza sativa)
  misc_feature (71): n=a or g
aattgtgagggctcccggccaattccaagaggatgaggtgaaatcaccgaagccctcgatccacaagctcnccgctcaagtgaagaaactccgcaaggaga

SEQ ID NO: 9169 - DNA, 101 bp, rice(Oryza sativa)
  misc_feature (71): n=t or g
accgcgttgtggaagaaaaaaaataatataacgacagacaaaacaaatttacggaatccttacttattttntaattaggtatagagtagatagatatagat

SEQ ID NO: 9170 - DNA, 101 bp, rice(Oryza sativa)
  misc_feature (71): n=t or c
ttttaataatacaatggttttttttgttcgatctggttttttggttgtgtttccagttggttgttttttcnggtccaatttggttttatacgtgtctaaca

SEQ ID NO: 9171 - DNA, 101 bp, rice(Oryza sativa)
  misc_feature (71): n=t or c
caaaacagcgtattagatatgttagcgggttaaacccgattagagatggatgatatgtcatcccaagatcnagctttccatttttactatactagctgttt

SEQ ID NO: 9172 - DNA, 101 bp, rice(Oryza sativa)
  misc_feature (71): n=a or t
gaactaaccatcttgatgtaccattaaattgattacacagttcctaactgtgtactttccgcttggtgggntgttttcatctcaatccttcctcttaatta

SEQ ID NO: 9173 - DNA, 101 bp, rice(Oryza sativa)
  misc_feature (71): n=a or g
attaattgataacccaataacaaagaaaacgatttctctccaatactcgaaaggaaatctattgggcacancatatactctcggagtgttagagatgtgtt

SEQ ID NO: 9174 - DNA, 101 bp, rice(Oryza sativa)
  misc_feature (71): n=t or g
gggaaggaagtcgcctaggaattgcctttgcgccgggggaatcgtcgagaagagagagaaaaggtttcacntgagcggtgaaaacggaagtcacggcgtga

SEQ ID NO: 9175 - DNA, 101 bp, rice(Oryza sativa)
  misc_feature (71): n=a or c
ttcttcagaatctagatagtgctttaacactttagataataatcatatatttctaacggcctacatgaatnatttaatttcttgttgttggattagacatt

SEQ ID NO: 9176 - DNA, 101 bp, rice(Oryza sativa)
  misc_feature (71): n=a or g
ttttctacaagtttgagttgtactgtcagcgttgtttccatgataagtgagcatcgaaacaaggaagatcnttatatgatttgtacctggaagacttcctg

SEQ ID NO: 9177 - DNA, 101 bp, rice(Oryza sativa)
  misc_feature (71): n=t or g
agtgctcgatttttttcattgcaggttgggcgcccgaggagaatcatttttgaaatctatcccataataantattactttaaaatagtacttgtcaaataa

SEQ ID NO: 9178 - DNA, 101 bp, rice(Oryza sativa)
  misc_feature (71): n=a or c
aatcagatgatgtgacttatcctggttgtattctcagattcattcttcactagtactccctctgtcccccngaaaaaaaaaaggatcctagtacaataaat

SEQ ID NO: 9179 - DNA, 101 bp, rice(Oryza sativa)
  misc_feature (71): n=t or c
ctgcaaagccgtcaatggcatcaatgtcgattttcgagtaaagggacttggtcattgctagcgccagactngctcccatactcccggcctctttgatgttc

SEQ ID NO: 9180 - DNA, 101 bp, rice(Oryza sativa)
  misc_feature (71): n=t or c
gtggcaaaaacatggcagcaacttgatcttgggttggctgattcgcgatttgcccagtagactttggatgntccctcattaacaaccgagggttcatcagc

SEQ ID NO: 9181 - DNA, 101 bp, rice(Oryza sativa)
  misc_feature (71): n=a or c
tgaaccagagattaaaataacagcatattggtgaaatagtcccttatatttgccaaattatctcacaaccncacatgtatactctcacttaagccatttat

SEQ ID NO: 9182 - DNA, 101 bp, rice(Oryza sativa)
  misc_feature (71): n=a or g
tgtgaaaactggataaggaattgcggtgacaaccaaggggcagaggttctccaaactttttttttacttcntttccgttcatgctcattgtcacaactgaa

SEQ ID NO: 9183 - DNA, 101 bp, rice(Oryza sativa)
  misc_feature (71): n=a or g
agccaaaaagtaatcattagatttgtgagaaactaaataaggtagcatcacttatatgtcatggtatagcnttagagaattacaagaacataacaagtgaa

SEQ ID NO: 9184 - DNA, 101 bp, rice(Oryza sativa)
  misc_feature (71): n=t or c
acgaaagagcgcgtcaaaaggcattggctttctgagtcagtcaagcaatgttcgatcatagaatattattnctgcacaaacgcacaaaggtctcgaggaag

SEQ ID NO: 9185 - DNA, 101 bp, rice(Oryza sativa)
  misc_feature (71): n=t or c
catcaagcaacacaaagatgggaccatgatagctcaaaagagcgatttcattcagaatagtcgctcgtaangatgattcgatttggaaagtaatcgccaac

SEQ ID NO: 9186 - DNA, 101 bp, rice(Oryza sativa)
  misc_feature (71): n=t or c
gacaaaaccattaaaaataattcggctaaccttgtcttatctcagcaggaggaaccaccgcaacaaattgncgcagctccgctgctacagtaaatccgacc

SEQ ID NO: 9187 - DNA, 101 bp, rice(Oryza sativa)
  misc_feature (71): n=c or g
taccactaaagttaaccccgtgagggggagttaacaaaacagtggtaaaacgtcaacattagttaaaaaantaagggcaaaattacaaagtttgaaaagga

SEQ ID NO: 9188 - DNA, 101 bp, rice(Oryza sativa)
  misc_feature (71): n=a or g
accaatttcattttttttgcataatcatagtcaaacatctaaacgttagtagccagcttctcagaatctgnaaaaactggtttcccagcttctggcttcta

SEQ ID NO: 9189 - DNA, 101 bp, rice(Oryza sativa)
  misc_feature (71): n=a or g
gattgactggttagggttagatgactcaaagggcatttcggtcattacgaaaaaatataacagtacaaacngagtatagctaacggactgtggacggcgat

SEQ ID NO: 9190 - DNA, 101 bp, rice(Oryza sativa)
  misc_feature (71): n=t or c
ttcaattgggacccgttgcaacacacggatacgatgctagttagctcaaacaaatgagttggtgttgtgcncttggtatactaacactccaaacacttgaa

SEQ ID NO: 9191 - DNA, 101 bp, rice(Oryza sativa)
  misc_feature (71): n=t or c
tcgccgcgcacatccgtcgttggagcgagcatcatcgtcagaatgatgtcttcaaccatcctccctccacngccgtcgcatcagtgccacgtctagccgcc

SEQ ID NO: 9192 - DNA, 101 bp, rice(Oryza sativa)
  misc_feature (71): n=t or c
gaggaggatcaatactcaattggtagtgatactccagagtctgataataatgaaagcaatacatctgattntgaatatgtgcctggggttgatgaggatga

SEQ ID NO: 9193 - DNA, 101 bp, rice(Oryza sativa)
  misc_feature (71): n=a or c
ccatttgaggatgaggatgagatactgtcggatatacttaagggagaactcgctgaacctgagtttatctnagctatttcgacatctgatgattggacgaa

SEQ ID NO: 9194 - DNA, 101 bp, rice(Oryza sativa)
  misc_feature (71): n=t or c
gatcatggttattcaaatctaacaccgacaatcctatacagaagcagcactaaaacaacaatacctattcnacctatggccaacaaaaaagtgtatttttt

SEQ ID NO: 9195 - DNA, 101 bp, rice(Oryza sativa)
  misc_feature (71): n=a or g
tcacagatgatgcgtattgagtctgtgtacttaaatcacctagtacgcacttttaatgctactgctgtttngttggggattgcaaacgtaaacggtaaggg

SEQ ID NO: 9196 - DNA, 101 bp, rice(Oryza sativa)
  misc_feature (71): n=a or c
ttgatgattattgtttagccatgggcattaaggtagaatattcagtaccacatatccacactcaaaatagnctagctgagtccttgatcaagaggatcaag

SEQ ID NO: 9197 - DNA, 101 bp, rice(Oryza sativa)
  misc_feature (71): n=t or c
taaccttcttgagttcgcctttacctctgggttacccttactcttgcccttgaatatgatacttcccttanctttccctttcttctcaccatggcctcttt

SEQ ID NO: 9198 - DNA, 101 bp, rice(Oryza sativa)
  misc_feature (71): n=t or c
aagaacaatggctggtgaggcttcatcgtcgaccatcggaaaactggtccaatttcggatgaggaacatgntgccttcctctccctatggctcgagaggtt

SEQ ID NO: 9199 - DNA, 101 bp, rice(Oryza sativa)
  misc_feature (71): n=a or c
ctgacgaaagaggcaaggaaaggaaggaagctagcacgcacatatccagccagcccaggattgcagattgntatccctcttattctcgcaaccacgctgat

SEQ ID NO: 9200 - DNA, 101 bp, rice(Oryza sativa)
  misc_feature (71): n=t or g
ctataacagcctgctaaattgaactgcagatgcgatagcaaccggctaagttaaaatagcagtcgctaagnctgtgttctttcctaggtgatctgggtgat

SEQ ID NO: 9201 - DNA, 101 bp, rice(Oryza sativa)
  misc_feature (71): n=t or c
agaaggaagcgtgctagagagaggtatgcatcaatgagcccaaagaaaaaggaggcgaggaaaatgaaggnccgtgtgtacaagcaattgaaggaggatga

SEQ ID NO: 9202 - DNA, 101 bp, rice(Oryza sativa)
  misc_feature (71): n=t or c
ttcacgttcgttctatcgttctcgttctgtctccatcgttcgttcacgtacgttctaacgtttctatcgtncgttcacgttcgttccactcgttttctcgt

SEQ ID NO: 9203 - DNA, 101 bp, rice(Oryza sativa)
  misc_feature (71): n=t or c
aaaggttcctacataatcacaattatatgccaaaccagtttttaatattgttgcatgtgggcagctccacntggtgatattacaaatgttagtgttgatga

SEQ ID NO: 9204 - DNA, 101 bp, rice(Oryza sativa)
  misc_feature (71): n=t or g
ggtacaaggatttggatcaaagattttgaggatgaatgtgagattgaatggagaggctcttgcaaaggagnaagaaagagaggaactagctcaggggcgtg

SEQ ID NO: 9205 - DNA, 101 bp, rice(Oryza sativa)
  misc_feature (71): n=c or g
aacatgttgccttagcagacaatgtgttttactactgatgaaaggtatttatgtattgtaccgaacacgtntactttggacctatttatgtatatatatca

SEQ ID NO: 9206 - DNA, 101 bp, rice(Oryza sativa)
  misc_feature (71): n=a or g
ggatcgttgtacggcattttcaggttccacccagtctccccattagggttaaataaaggatacgctaaagngtcataacaaccatggtatgctttgatgta

SEQ ID NO: 9207 - DNA, 101 bp, rice(Oryza sativa)
  misc_feature (71): n=t or c
acttgacgactttgatccactcagtgcaccctgcatgcgaatgcacaacacataggcaaattaacaaaagntgcagctaataacacagatcaaaaccgtta

SEQ ID NO: 9208 - DNA, 101 bp, rice(Oryza sativa)
  misc_feature (71): n=t or c
gcatggggcaatccggtttcctttctattttgtttgtattgccatggtgcacttcgttggattgtggtgtnctgtgtagttttctactatatttaggttta

SEQ ID NO: 9209 - DNA, 101 bp, rice(Oryza sativa)
  misc_feature (71): n=a or g
gtggagacggataagtcacatgatgattgtttgaatgaggcatccactttccaaatgccatttgctttgcntcgattatttgcaaccatattggtattttg

SEQ ID NO: 9210 - DNA, 101 bp, rice(Oryza sativa)
  misc_feature (71): n=t or c
ttgaggacagtgtcaggtacttcatactctacctttagagaggcatgcgagaagagagggcttgtggaganggataagtcacatgatgattgtttgaatga

SEQ ID NO: 9211 - DNA, 101 bp, rice(Oryza sativa)
  misc_feature (71): n=a or g
gtattcctccacatgcgtatatagtactaagacaatttcctggtgtaggtactcctctgtattcattaccngttggatggccatgacgagttgtcataagg

SEQ ID NO: 9212 - DNA, 101 bp, rice(Oryza sativa)
  misc_feature (71): n=t or c
tgaatgttacctgtgacggatttaagttgcagaccgtcaaaggtaactcttacctttgacgggtctttacncgtcagagttgactccgagtcgtcagtgac

SEQ ID NO: 9213 - DNA, 101 bp, rice(Oryza sativa)
  misc_feature (71): n=t or c
aggcaaatagtggttcatggaaagaaaatagaaaatgaaggacacctctatccttttggccataggttgcngttaataagcgatatacccgacccacccaa

SEQ ID NO: 9214 - DNA, 101 bp, rice(Oryza sativa)
  misc_feature (71): n=t or c
cctaagtggcctagtagtttttaggtctttacaagcctagggaggtttatagtactttatttcttttcganggttaggttgttgccgacatttctataact

SEQ ID NO: 9215 - DNA, 101 bp, rice(Oryza sativa)
  misc_feature (71): n=t or c
ttgacccagggtcgctaaggcccccggtgtctttccccggaaattaggttgaacgtggtggccgattgccnatttgctcccaccctccgccgcggccaaat

SEQ ID NO: 9216 - DNA, 101 bp, rice(Oryza sativa)
  misc_feature (71): n=a or c
ttttctatgagatggtctatgtggaggtcgaagtcatgaagttcgaacacgtggaagtctaggatgatctngacatcattgtgcctgattggcactctgct

SEQ ID NO: 9217 - DNA, 101 bp, rice(Oryza sativa)
  misc_feature (71): n=t or g
tctgtttggttttatttgtcgctaaacctaccaaaacgggcatgtccgggccaaattaaggtttttttgtntgtgtgtgtgtgttatatatagtgaagata

SEQ ID NO: 9218 - DNA, 101 bp, rice(Oryza sativa)
  misc_feature (71): n=a or g
tttgcaaaagaaaaaaaaagagaggaaaatacataatactaaaaaaaatgcaaatgccatttgacaattgncaatttggcatactttgtcactcctatcat

SEQ ID NO: 9219 - DNA, 101 bp, rice(Oryza sativa)
  misc_feature (71): n=t or c
aagcatgtgaaagattgctacacaacgaggattagaaggctgatgccattgtgtaatgaatggaggagagntgtgacaaggtgacaaaagaggctagcaac

SEQ ID NO: 9220 - DNA, 101 bp, rice(Oryza sativa)
  misc_feature (71): n=t or c
cgggcaacctgcctagcggcatcagccgcatgcggaggctgttacacaagacgacgattcgttgccggatngccggcggcagttcatcgaagcggggcagt

SEQ ID NO: 9221 - DNA, 101 bp, rice(Oryza sativa)
  misc_feature (71): n=t or c
acatcccatacatgctggtccactctggaaacaggggacgtattcggcctgcttcaagttatttttctctngttttttgttgctgccaggtgatgttaaaa

SEQ ID NO: 9222 - DNA, 101 bp, rice(Oryza sativa)
  misc_feature (71): n=t or c
attggagatcgatctactgcagtcccggccaccggcgatttttcccaatcgaagaaatcgatctaatcggnggcacgcgtagtcgtgttcgtcgtcccgtc

SEQ ID NO: 9223 - DNA, 101 bp, rice(Oryza sativa)
  misc_feature (71): n=a or g
gtggagctccaaggtcacagagaactccttatccccttcccctttcacccgactgccgttggtccccagcnactccaggagctccacgatgtcgcccatgg

SEQ ID NO: 9224 - DNA, 101 bp, rice(Oryza sativa)
  misc_feature (71): n=a or g
cggggagacagccttttccatcaccacaagggaagcaaacacaattacacgacgagctcgatcatcaagtngctctagctagctcgatcccacgagtgctc

SEQ ID NO: 9225 - DNA, 101 bp, rice(Oryza sativa)
  misc_feature (71): n=a or t
tgggcatcggcggtcgagccggtggcgttcaatccgttacgaatgccatagaccatggtgggtgggtgcangcatgcagtggtttaattaaggagcacacg

SEQ ID NO: 9226 - DNA, 101 bp, rice(Oryza sativa)
  misc_feature (71): n=a or t
aagaagatgcaaccaaaaatttaccctccaatccacacctccctgccaacaatttggccttgccactctgnattttttttttttggtgctggttttctgaa

SEQ ID NO: 9227 - DNA, 101 bp, rice(Oryza sativa)
  misc_feature (71): n=t or c
cttgcgcatcagtggcgagccatcttgattcaatgcattaccactatcttgtgcataatcaccatccttgntttgaaaagagaaatctggacatctcttta

SEQ ID NO: 9228 - DNA, 101 bp, rice(Oryza sativa)
  misc_feature (71): n=a or c
agaacctggacgccagctagatcagcaattattttatctcccttacgtgctgtcgagatactagaatcagntctcatcatgctcccatcagccccctgaag

SEQ ID NO: 9229 - DNA, 101 bp, rice(Oryza sativa)
  misc_feature (71): n=t or c
gacttcaaaccaatattattattggtgacattgtcattaatggttgactgaccagctgctgcatcaggagnacatgtggctccataatcctcttgacttcg

SEQ ID NO: 9230 - DNA, 101 bp, rice(Oryza sativa)
  misc_feature (71): n=t or g
aaatgcccaaagcgacgaagaaatctgcgtcacgcgtagctagcaaatcgagagtatccaagcgaaaaagntgatttttctgccttttttttctgctttca

SEQ ID NO: 9231 - DNA, 101 bp, rice(Oryza sativa)
  misc_feature (71): n=a or g
tggaatctgactgggtgtgctaaaatcagtgttagcagacattgccaatctagttctaggagtgccttggnctgcgacatcatgtatcctgttgacggcat

SEQ ID NO: 9232 - DNA, 101 bp, rice(Oryza sativa)
  misc_feature (71): n=t or c
ctaacatctcggcctctctgaaaaacatccttttgtcttctgcaaggttgattgaaaacttggaatatcangcataggaattttccttgatgaagtctgat

SEQ ID NO: 9233 - DNA, 101 bp, rice(Oryza sativa)
  misc_feature (71): n=a or g
gaggagtttggtggtggtggtgctgcccactactgttgtggttgacgctgttgtagggatggtgctgacanataatcatggtggaagatcgaacctgctgt

SEQ ID NO: 9234 - DNA, 101 bp, rice(Oryza sativa)
  misc_feature (71): n=t or c
agtcgagatattcgatgtttggggtattgacctttttctaagtcatgtaactgcgagttgcaagtttattntggtggcagtcgactatgtctccaagtggg

SEQ ID NO: 9235 - DNA, 101 bp, rice(Oryza sativa)
  misc_feature (71): n=t or c
tctaagccatctgttttcttccttttctcttatttctatctatcccctcaagatgaagtcaaggaatggtngcagtgtctccaatgacgccagtggcagcg

SEQ ID NO: 9236 - DNA, 101 bp, rice(Oryza sativa)
  misc_feature (71): n=a or g
cacccactaatggctccaattcagtcaggtctgccagctatgtcagctaagttagaacagcctgttgacgntcgttaccgataaatttcgacagtcactat

SEQ ID NO: 9237 - DNA, 101 bp, rice(Oryza sativa)
  misc_feature (71): n=a or g
atagtgaactacatggtatcaaaatacataccaccgggagaaaatcaaaggaagttgaaatacgatagccnccgtaacatatgggatgagccatacctata

SEQ ID NO: 9238 - DNA, 101 bp, rice(Oryza sativa)
  misc_feature (71): n=a or g
gaagtcagttgcaaggtgtcagcagacttacaccgatctcaagttatctgattgaattctgaggaacaccngtgaggccaggtcaatagctcagctttgag

SEQ ID NO: 9239 - DNA, 101 bp, rice(Oryza sativa)
  misc_feature (71): n=t or c
ttgtttccctttcggttagacctttctattttttggctgaccatgtcacctgtatatatacacgggtgtanggtcaggagagggcccccgaacaaaattac

SEQ ID NO: 9240 - DNA, 101 bp, rice(Oryza sativa)
  misc_feature (71): n=t or c
gtttatcacctacggtttagtctagacaaaattaacaagcagactgactcaagattccagaaaagaacaancggcacaaaatgaaactttaatcaagtttt

SEQ ID NO: 9241 - DNA, 101 bp, rice(Oryza sativa)
  misc_feature (71): n=a or g
ctgcaattgcttccattattcgaacctgaccgacttgtttctttaattcctactagctgaagtctcaccgngaatgttgccctgcttgttgatcttcgatg

SEQ ID NO: 9242 - DNA, 101 bp, rice(Oryza sativa)
  misc_feature (71): n=a or c
agcagttcaagttctaggtcaagcacaattgctggtagcttttggcacaggcgaaaatagacgcgaagagnaaatatagttttacgttgtcgacatcccgt

SEQ ID NO: 9243 - DNA, 101 bp, rice(Oryza sativa)
  misc_feature (71): n=t or c
gattttgacgaaggctacgaagacaactacacgcctcttttcttcagtgttttcatggcagacaacgaganggcagaaaaacgtcaagcccgagaagcaga

SEQ ID NO: 9244 - DNA, 101 bp, rice(Oryza sativa)
  misc_feature (71): n=t or c
gggagcatccttctcatacaagaaagtagtgctggttggtgacagagcaacttctacaaagatatgtggangactcaggtcatcatcatctaaccccaaat

SEQ ID NO: 9245 - DNA, 101 bp, rice(Oryza sativa)
  misc_feature (71): n=a or t
caattgagtttctatcgaatagttaaaactctccacgcaatgctctggttggagaagcttccgtcagtgcngaggatcaagttgctatcgtcccgaagctg

SEQ ID NO: 9246 - DNA, 101 bp, rice(Oryza sativa)
  misc_feature (71): n=c or g
gcaggcgagggcgagtcttcgagcaggtacaatagcaatagcaaactataagagcaaggttaataatacanccgacctgttgactataaggttttttatag

SEQ ID NO: 9247 - DNA, 101 bp, rice(Oryza sativa)
  misc_feature (71): n=t or c
ttgttcaggcgacagaccatgtccgagaaactagagtcaaggaaacctagcaggtgaatgcaataaacagnttcttgaagtatgccatgaagaaaatcatt

SEQ ID NO: 9248 - DNA, 101 bp, rice(Oryza sativa)
  misc_feature (71): n=t or c
gccatcgctgcttgggccgcccatcgccctcgcccttgcggagcccgtcatcgctgctttgtgtattccanggaccatgccgcagtggaaggagaagagtg

SEQ ID NO: 9249 - DNA, 101 bp, rice(Oryza sativa)
  misc_feature (71): n=a or g
tgtttctaagttattatttattaatttccttagcattagagtgtcacgtggtggtttagaagcattcgtangagtgccatgtggcgacataagagcgtttg

SEQ ID NO: 9250 - DNA, 101 bp, rice(Oryza sativa)
  misc_feature (71): n=a or g
atatgtgatggtgttgtttgctttgataccttactaaattatggtggagtttatgtgagtggaaggtcccngaattaccaaaatttggcaaaagtgcaatg

SEQ ID NO: 9251 - DNA, 101 bp, rice(Oryza sativa)
  misc_feature (71): n=a or c
ggcagcccgcgcacatgcgcgggcacctatttaatgtgtttataacaataaaaatatttatgtgtgagtgnctttttactgaaatattttttactcaattc

SEQ ID NO: 9252 - DNA, 101 bp, rice(Oryza sativa)
  misc_feature (71): n=t or c
aactattacatcctatatatactcctaagtcgcgaagtgacaccttacaaatgcttctatgtcaccaagcngtactctaatccgatcatcgattttcattt

SEQ ID NO: 9253 - DNA, 101 bp, rice(Oryza sativa)
  misc_feature (71): n=a or g
gttacagtggcgggttgatgggctggttgatctaccgagcttgttgcgctttgccagcgatcgagctaggnaccggggcgtgtgcacgttgcgatgagcgc

SEQ ID NO: 9254 - DNA, 101 bp, rice(Oryza sativa)
  misc_feature (71): n=a or t
tctgatttgactactatggagacgatgactgagtacgagaagaaaaaagaatgttgaaggatctgcaattncgactcgaagaagctgagcaacaaattttg

SEQ ID NO: 9255 - DNA, 101 bp, rice(Oryza sativa)
  misc_feature (71): n=a or g
accccgaacccaaaaccctgaacactgaaccctgaaccctgaaccctgaaccctgaaccctaagccctaanccctaagccctaaatcctaaaccctaaacc

SEQ ID NO: 9256 - DNA, 101 bp, rice(Oryza sativa)
  misc_feature (71): n=a or g
accctaaaccccgaacccaaaaccctgaacactgaaccctgaaccctgaaccctgaaccctgaaccctaanccctaagccctaagccctaaatcctaaacc

SEQ ID NO: 9257 - DNA, 101 bp, rice(Oryza sativa)
  misc_feature (71): n=a or g
gtcccgacctttcattacaaacatctgttcatcttaaattatgctctaattgattcaatgtctaattactncaatcggtgcaactaatgtattttcaatac

SEQ ID NO: 9258 - DNA, 101 bp, rice(Oryza sativa)
  misc_feature (71): n=a or g
accatagtgttcttctctttctgcagcattgctattatttcaccattcttcgttgcatttgtagattgctnttatactgttgcaaactagtgttgtattct

SEQ ID NO: 9259 - DNA, 101 bp, rice(Oryza sativa)
  misc_feature (71): n=a or t
acaaggttgatgttacaatgaacataaaaacaaactagtgcaactgcaaactacttgagaactacaatgtncagattccaattttctagcaaaatcaccaa

SEQ ID NO: 9260 - DNA, 101 bp, rice(Oryza sativa)
  misc_feature (71): n=t or c
ttttctttaaaagtaaactactgctagcttctgccaacagttaacaagtgtttctctagctagttaaattnctgttgctacgatgaaccgacaacagtata

SEQ ID NO: 9261 - DNA, 101 bp, rice(Oryza sativa)
  misc_feature (71): n=t or c
acatcaaccttgtaagttcttggatcagaaatgtagtctaaaatattctggattatttagcgtggatctanaaatcattgttgcagcgaggtttttttttg

SEQ ID NO: 9262 - DNA, 101 bp, rice(Oryza sativa)
  misc_feature (71): n=t or g
tccacctcctcctgtgagcaccggtcctcaccacctcctccatcttcgagcatgtgtttgtatgtgttttntattcttgtgatttgattttagatcttgca

SEQ ID NO: 9263 - DNA, 101 bp, rice(Oryza sativa)
  misc_feature (71): n=t or c
aagttgactaattttgattgacagacttaaaaagtagcttagttccatctgctatagcttgaagcagtccnagggggccagcatattcaggaccaatacgt

SEQ ID NO: 9264 - DNA, 101 bp, rice(Oryza sativa)
  misc_feature (71): n=c or g
acatcatatgtgcaagtgtaacattttcatggaccatctcttcttccatttttcttcaatgcacatcctanatatatctgaacataaagtcaagcattgca

SEQ ID NO: 9265 - DNA, 101 bp, rice(Oryza sativa)
  misc_feature (71): n=a or t
tatccaaatcaaatgtcattataattcagatagccttttaatcccatcccccgcagtcctaaccactacantcaagcatcagttggcgcagcgtgcacttc

SEQ ID NO: 9266 - DNA, 101 bp, rice(Oryza sativa)
  misc_feature (71): n=a or t
ttggtaacttttcttcctcctctcgtgcacgaacacaagcacggccgaacagaaacacaaccaactcagcnaccttatatgcaactcaacaactccaaaac

SEQ ID NO: 9267 - DNA, 101 bp, rice(Oryza sativa)
  misc_feature (71): n=a or g
acagagcccgtgcaatgcttctgcactgaagccgacgccgttttctcctacaaatccggcctcctctctcntgtatttccaaaattagttgagggaaaata

SEQ ID NO: 9268 - DNA, 101 bp, rice(Oryza sativa)
  misc_feature (71): n=t or c
gcgactatcctacccatgacaaggctacccaggcagcgctgatcctcctcacgcaagacatcccctactgnggtgatcctccatgtaatgaggcgaccggg

SEQ ID NO: 9269 - DNA, 101 bp, rice(Oryza sativa)
  misc_feature (71): n=t or c
tatacttcaaaatggtatctttttgctgcctaaagcaaatcctgatgcacattccagttcttgaaaatgtngcaaatatatgtaacttatgattttttttt

SEQ ID NO: 9270 - DNA, 101 bp, rice(Oryza sativa)
  misc_feature (71): n=t or c
gctctgaaggcggcgaggtactggtcgtggtcgacagtgacgactactttccggcaacgagcggcggcaanagaggggtgtacggggttctcctcgctgct

SEQ ID NO: 9271 - DNA, 101 bp, rice(Oryza sativa)
  misc_feature (71): n=a or g
tcagcgctgcctgggtagccttgtcatgggtaggatagtcgctaccaggatcaccatgtatataacaatcnaaaagttacctcgatattggcctttgttac

SEQ ID NO: 9272 - DNA, 101 bp, rice(Oryza sativa)
  misc_feature (71): n=a or t
acattgaattacatgactacatctaacaatgttcgacatactccataacacagattgacccaaaaagtgtnatcacatcagagaaagaaaatcggccacct

SEQ ID NO: 9273 - DNA, 101 bp, rice(Oryza sativa)
  misc_feature (71): n=c or g
ctacatctaacaatgttcgacatactccataacacagattgacccaaaaagtgttatcacatcagagaaanaaaatcggccacctacgaagcaggtaacga

SEQ ID NO: 9274 - DNA, 101 bp, rice(Oryza sativa)
  misc_feature (71): n=a or g
aaacaaagaaaatatggaccctactacatgcaaatatagagtttccaaggttacaaagagttcgtttactnaaaatgctgggaaagggacagcagcgaaat

SEQ ID NO: 9275 - DNA, 101 bp, rice(Oryza sativa)
  misc_feature (71): n=t or g
aatatatttcgctgctgtccctttcccagcattttcagtaaacgaactctttgtaaccttggaaactctanatttgcatgtagtagggtccatattttctt

SEQ ID NO: 9276 - DNA, 101 bp, rice(Oryza sativa)
  misc_feature (71): n=a or g
aaaagcatcatcattgttgcatacctcgcgtcggggtgaccacccatacctctacgattgttatgtagccntcgtcgatcacgagcatctcgatcatcttg

SEQ ID NO: 9277 - DNA, 101 bp, rice(Oryza sativa)
  misc_feature (71): n=a or g
gcaaaaaaaaggagccgacttgtaaacacaccccaccattcccctttgtcaccaccttccaccgttccgtnttatcaccacctttttcttgttatcgttgc

SEQ ID NO: 9278 - DNA, 101 bp, rice(Oryza sativa)
  misc_feature (71): n=t or g
tcgctctattttgcgtgtgcgggaggtgagtttacaaagggataatcacactctcgtagcgaaggtggatnatttacagcacaaatcaacaaagatggaca

SEQ ID NO: 9279 - DNA, 101 bp, rice(Oryza sativa)
  misc_feature (71): n=t or c
tttgttacttttttacatcttgtagaagctgactttagatttgtacgtttgtggagtaatatgtctaatgntaatctaatttgtcgatttgttttaatttt

SEQ ID NO: 9280 - DNA, 101 bp, rice(Oryza sativa)
  misc_feature (71): n=a or g
gtatatctaagaacgggattctatccaaggacaaaaattgatgattggatatgctagagaagactcctatngatttaactggataacttaaattaaaggta

SEQ ID NO: 9281 - DNA, 101 bp, rice(Oryza sativa)
  misc_feature (71): n=t or c
tgttgtcctttagatttcatatttactgtattgcaatttggtcataggcgatgacaaagttaactctaatnggtaaaattgaaaccacttctatttgaata

SEQ ID NO: 9282 - DNA, 101 bp, rice(Oryza sativa)
  misc_feature (71): n=t or c
acttaacatctcatcccaaaatttaggattcccataaccaaaattttggcatagaatttggagatgctatnggtgattctcctatatcaatcctactgaca

SEQ ID NO: 9283 - DNA, 101 bp, rice(Oryza sativa)
  misc_feature (71): n=a or c
gccgatttagatccattagaagataactacctctctcgtggacgaacgggagatttacgggacacacctanagttgagttctttccccaactttccgaact

SEQ ID NO: 9284 - DNA, 101 bp, rice(Oryza sativa)
  misc_feature (71): n=t or c
agctcaaggtgatggttctcagggatttcaaggtgagaatcttaatcaagatggtaacatggcacagctanagtttaacaacttccaggatcggaatgact

SEQ ID NO: 9285 - DNA, 101 bp, rice(Oryza sativa)
  misc_feature (71): n=t or c
cctcttcttcaccctcctcttcaccgttatgttcttcggcatcctcctcgtcatcagcatcagagtccgangaagcaggagccctacgcttcctaggggca

SEQ ID NO: 9286 - DNA, 101 bp, rice(Oryza sativa)
  misc_feature (71): n=t or g
actcattttgcaaaaaatataatacccaattagataaatagataaaataaaatccttagggtttatgtgtntgtgcgtgtgtgtgtgtgtatatatatata

SEQ ID NO: 9287 - DNA, 101 bp, rice(Oryza sativa)
  misc_feature (71): n=a or g
ccctaggggtctttttgcatattggcctcagactgacagtgcacccctaggaacaaaatctcaaattatanaagaacagtaactaaaacttgtaaaatcca

SEQ ID NO: 9288 - DNA, 101 bp, rice(Oryza sativa)
  misc_feature (71): n=t or c
tcaccaatttggagtggattgatacgccgcctctggctgctaccctgtgcctcatgggaaacaatccttcntctcttatagttgtccatcctgttcttctt

SEQ ID NO: 9289 - DNA, 101 bp, rice(Oryza sativa)
  misc_feature (71): n=a or g
ccgctctgctgtcacttatgaccgtagagtaatactattcaaacccgtacaatctcccaactcacttgtcnttatgctgcttgactgcggcatcgactgga

SEQ ID NO: 9290 - DNA, 101 bp, rice(Oryza sativa)
  misc_feature (71): n=t or c
cacctctgcagagactgtccagctttacccacacaatgagaacagtttgcaaggctgaaaacaccatagcngttcgagagtcctacttactactagttact

SEQ ID NO: 9291 - DNA, 101 bp, rice(Oryza sativa)
  misc_feature (71): n=t or c
cttagcatcagctaaccaacccagataattagtcgttatgccttagcatcggctaaccaactccaaatatntagccgtcgtgttatccaactctagcaccg

SEQ ID NO: 9292 - DNA, 101 bp, rice(Oryza sativa)
  misc_feature (71): n=a or g
aagccttggcgcccgcggtcaacttcacccactacacgaatattcttatctaatttaacgttgttatcctnttaattgatagaagaggtattgttagaata

SEQ ID NO: 9293 - DNA, 101 bp, rice(Oryza sativa)
  misc_feature (71): n=a or g
ccagcgtggagcataattttaatgcctaattaattataggtgccctcatagagaattgtctcctgggtagnaagttgagctctattgccaaaggtatcctc

SEQ ID NO: 9294 - DNA, 101 bp, rice(Oryza sativa)
  misc_feature (71): n=t or c
agtagaagacgacatcgccgtaggcggagatctgatcaaaagcgaaatcgcctggggatcgcttttgtgtnggaggaatcgccggagagacaaaggacaaa

SEQ ID NO: 9295 - DNA, 101 bp, rice(Oryza sativa)
  misc_feature (71): n=a or t
cattcttggacatcggatatattgtatttgtttggtgattggacattcatcttgatatatcatgtccgaanaaaaccagatatagattaatttccggacat

SEQ ID NO: 9296 - DNA, 101 bp, rice(Oryza sativa)
  misc_feature (71): n=t or c
atagtgcaatatatacttacatataaattaatttcgagtggttgaataacatgagtattataataaggtcntgagttcaaatctatatatgaacgaagggg

SEQ ID NO: 9297 - DNA, 101 bp, rice(Oryza sativa)
  misc_feature (71): n=a or g
gtgatgaatatgggaaattactgcctgtaatgcatgatgcatgtttgctatttctagatgacgttttacangacatttcataagctagaacaaaataacag

SEQ ID NO: 9298 - DNA, 101 bp, rice(Oryza sativa)
  misc_feature (71): n=a or g
tctttcctcaccctcatcgccgccgatattccgctcagcccgccgcccctaatgtatccatctgctcatcnttgcctggtgactttggactcgtggccagc

SEQ ID NO: 9299 - DNA, 101 bp, rice(Oryza sativa)
  misc_feature (71): n=t or c
tggaattgatctcctagcttgctctaccaaccttggcgcttattggggcattttgaagaggatgccgaggngatgaatgaggtgaggcgaccaagctggag

SEQ ID NO: 9300 - DNA, 101 bp, rice(Oryza sativa)
  misc_feature (71): n=t or c
tcggctgccaacttctctcccttgcgaaccatctttgctagatgaagccaaggctactctccgattccggngcgagctcctgcaactccggtgcaaaggag

SEQ ID NO: 9301 - DNA, 101 bp, rice(Oryza sativa)
  misc_feature (71): n=t or g
gtgggcaaaccaatcttcattcaacaggataatgcaccttcccatctaaacttggatgattcggatttctntgagcatgctaagcaagaaggatttgatat

SEQ ID NO: 9302 - DNA, 101 bp, rice(Oryza sativa)
  misc_feature (71): n=a or g
cctccgtatcacaattagaagatgttttgcgtggccgtcgtactttcacgtttagatgatgttcctagccncacgtacaaaagccgacgaaattgcccctg

SEQ ID NO: 9303 - DNA, 101 bp, rice(Oryza sativa)
  misc_feature (71): n=t or c
gaaggggcccttgagtggtgcatcacttttgagtgtccaggtgttagagcccgactccttgagccccaccnagtccttgccgcctttctccttgacctcca

SEQ ID NO: 9304 - DNA, 101 bp, rice(Oryza sativa)
  misc_feature (71): n=t or c
accttgatcaaattttttaatgtatccgccaaaactccagattgattgaacaatgcgcgatgaactacttnatcaactatatcttgaagtatttaacctat

SEQ ID NO: 9305 - DNA, 101 bp, rice(Oryza sativa)
  misc_feature (71): n=a or g
gcactatccttattatgattaattgcaggctagtttctagggttcaaagcaggactagggatgatgtatcncaaagtgtgtaaagaaaccaagagtctaga

SEQ ID NO: 9306 - DNA, 101 bp, rice(Oryza sativa)
  misc_feature (71): n=t or c
ggagagggaggaattggaccgagtccacaagggaggaaggaggatttaattcctttttctttttatttaantgattaagtaaactttgtgactttaaaatt

SEQ ID NO: 9307 - DNA, 101 bp, rice(Oryza sativa)
  misc_feature (71): n=t or g
cccttgatctttaggctggcaaataatatcccatcttgtcaatctttcatcatcttgccaaaagaaacagnatctataataatctatttttcgaagaaccc

SEQ ID NO: 9308 - DNA, 101 bp, rice(Oryza sativa)
  misc_feature (71): n=t or c
atatgacttcgacaacttcgacatgtatgatggttactgaagactatgaagactacaacgacttcgatgangactacaccccactcttctacctcgtcttt

SEQ ID NO: 9309 - DNA, 101 bp, rice(Oryza sativa)
  misc_feature (71): n=t or c
acctcttgattagtttgagtaaaatgaatatcatttctaattaatccacttgaagtttacaagtttagagnatttattactttacttcatatttttgtaat

SEQ ID NO: 9310 - DNA, 101 bp, rice(Oryza sativa)
  misc_feature (71): n=t or c
acttcatctctcaaatataatggaaggtctagagagcctacgatagacagattctgagtgtcaacttgttngatcaatttccgagaaccataggaaaggtt

SEQ ID NO: 9311 - DNA, 101 bp, rice(Oryza sativa)
  misc_feature (71): n=a or g
cacctgtccgctcttcctcccacctccagccaccccaccaccatggccagcaactattgcccaagccgccnccaaattcaccgcatcccgcatcccgcgcg

SEQ ID NO: 9312 - DNA, 101 bp, rice(Oryza sativa)
  misc_feature (71): n=c or g
agagaccgacggtgacattgtagatgtggatcttgcgcccaatccagttcatcctccacgaggaacccganacctgcagatcacctcgctcagatccggag

SEQ ID NO: 9313 - DNA, 101 bp, rice(Oryza sativa)
  misc_feature (71): n=c or g
gttggcgaaaatactttacgatgaagagaaggggcaaaaccaagcatatatttgtcaaacaatttgaatantacctttttttcgattttgctttatatgtg

SEQ ID NO: 9314 - DNA, 101 bp, rice(Oryza sativa)
  misc_feature (71): n=t or c
cggtggcaacgggacaccgtgatggaacggagggtgacgcggcaccgtgtctcctagagagaaacccgagngagggacatggtcggattccgccgggattt

SEQ ID NO: 9315 - DNA, 101 bp, rice(Oryza sativa)
  misc_feature (71): n=t or c
atacaaatcttgaggcaaattctaattgattaaaattatacgtgaaatttgcgttgtagttacataagtanaagttataattatgttatatataaatttaa

SEQ ID NO: 9316 - DNA, 101 bp, rice(Oryza sativa)
  misc_feature (71): n=t or c
tattcgaccaagacatgactttgagcctttgagcatatcctaacggaaggtgaacatttttcaacttctcnaacagttaaactagaagaagatcaagccat

SEQ ID NO: 9317 - DNA, 101 bp, rice(Oryza sativa)
  misc_feature (71): n=a or g
gacgctccggaacgaactgtatcaggttagataatctagagaaaatccaacacgccggaagcctctaggangggggctatagatccagcaacgaaaaggac

SEQ ID NO: 9318 - DNA, 101 bp, rice(Oryza sativa)
  misc_feature (71): n=t or g
acgagtgctttttgacatttccaccactactcaaggcacatttctagtgcaccctaggcatgtttggatanatgagtatagtgccttatctctttggcatg

SEQ ID NO: 9319 - DNA, 101 bp, rice(Oryza sativa)
  misc_feature (71): n=c or g
tccctgcaccttgatgctcgcgagtccaactcgatgttcggagtgaataggtcaattatcattttttttanaacatttgtgtttgtgagaacacgtcaata

SEQ ID NO: 9320 - DNA, 101 bp, rice(Oryza sativa)
  misc_feature (71): n=a or g
aggcaatcgctcaaccgctcagagagcccacattggagaactgaagatgctctctgcaggggcggagctanagcgaaatggagagtggtgccacttgctta

SEQ ID NO: 9321 - DNA, 101 bp, rice(Oryza sativa)
  misc_feature (71): n=a or g
tctgttgtcgccggttgccaggttctccatggtgctgcaccgtgaggtggagcacgtgcgtgaatggcacnatgccgaagaacttagcgaggaagcggccg

SEQ ID NO: 9322 - DNA, 101 bp, rice(Oryza sativa)
  misc_feature (71): n=t or c
ttacacatactccactgtacacatatttaacttaacaattatctttggttgcttgtcaaggatagaaactntgaaaaagctaaagctatcatatgactata

SEQ ID NO: 9323 - DNA, 101 bp, rice(Oryza sativa)
  misc_feature (71): n=a or t
cactgcgccccgggggcagattgggaaacgcgaggggggcaacaaagccaagcgtccagtacacacacacnctctctctctctctctctcgctctcgactg

SEQ ID NO: 9324 - DNA, 101 bp, rice(Oryza sativa)
  misc_feature (71): n=a or g
ccttttcgtcgcactgtatgttaccagtcagatgccattgtttcactgtaaaaagtatagctagttgatangtgttatggcacctatcaattgcatgcgac

SEQ ID NO: 9325 - DNA, 101 bp, rice(Oryza sativa)
  misc_feature (71): n=t or c
gaaaagagttaatgagttcctgaacatcagaaggtaaaggctccttagtcacaggatcagatgcagaaagntgtactatgtgcataattgacccctgtttc

SEQ ID NO: 9326 - DNA, 101 bp, rice(Oryza sativa)
  misc_feature (71): n=a or c
tgtagatacgatctccaatgatcaattgccatgagcattgccatacactccttttcataagtggataaacncttggttcggggaccaagtgtagcgcccgt

SEQ ID NO: 9327 - DNA, 101 bp, rice(Oryza sativa)
  misc_feature (71): n=a or c
tgaggcaccatcaacacatgctgggggcagatcaagacgataccaaccaagctatcgtcctcaacataatngccgcacattggctcctcggcatacacccc

SEQ ID NO: 9328 - DNA, 101 bp, rice(Oryza sativa)
  misc_feature (71): n=t or c
tcagaaatttagaagagcatatgtgtcagggactctcaagatcatccaggagatatctcgcaaggctcaantgcagaagaaccagaagaagaagaaggaag

SEQ ID NO: 9329 - DNA, 101 bp, rice(Oryza sativa)
  misc_feature (71): n=t or c
atgaaaaaaaataaaaaatcaatggaccccagtgacatcatctctcctccactgttatctccttccttctntctcgagagtttgccgctacagcactgcca

SEQ ID NO: 9330 - DNA, 101 bp, rice(Oryza sativa)
  misc_feature (71): n=t or c
cccatctttttggaagattgttaacactcaccaagtcaccaggctgatcggtcaaaggctaccttgtatgnatgtgaaaaaaaaatctgatattggtttac

SEQ ID NO: 9331 - DNA, 101 bp, rice(Oryza sativa)
  misc_feature (71): n=t or c
taatttatgttcatgatgataagcgttacatgcagacgattactaaatgtcaccatagcattagcacgganagattactagttattgaattcaaacgaaag

SEQ ID NO: 9332 - DNA, 101 bp, rice(Oryza sativa)
  misc_feature (71): n=a or g
ccccttagtagattcggcttgctccggccgaatcaataccttattgtcatcaaaattaattgtgttcaccngaaaaggatcatgatcaagcttcatcttgg

SEQ ID NO: 9333 - DNA, 101 bp, rice(Oryza sativa)
  misc_feature (71): n=t or c
gctcctccccaacgctggcagctccttcccacaccagcgggctcttcttcactcgccagcagagctcctcntcccgacgccggcgagctcctcctttccat

SEQ ID NO: 9334 - DNA, 101 bp, rice(Oryza sativa)
  misc_feature (71): n=a or g
accatcagacttcagattcgaggaaattaattctgaaaaatatgataagtccagggaggttttttctgctnctatcagtccctgtatccttccagttggca

SEQ ID NO: 9335 - DNA, 101 bp, rice(Oryza sativa)
  misc_feature (71): n=t or c
gatcaccgggggagccaatccacctccattaggcaggaggcctgctgcgtactctatgtctttgccactgntacttttgcgaggaggagatgattctgttg

SEQ ID NO: 9336 - DNA, 101 bp, rice(Oryza sativa)
  misc_feature (71): n=a or g
aatcatgatgacatcaagcaaggttggagtcattggtccttgactgaacataaaggcattaagggtattcnaccagaaataggctgcggaggctatcaatg

SEQ ID NO: 9337 - DNA, 101 bp, rice(Oryza sativa)
  misc_feature (71): n=a or c
acagaaactactgaacctatggattgaaatgttgtggtctactcatagaacagcaagagcccgcataaggncaatcacatctggaattttcccggtcagtc

SEQ ID NO: 9338 - DNA, 101 bp, rice(Oryza sativa)
  misc_feature (71): n=a or g
tgatgatgaaacagacgcaacaacaattcatgaactcattcacacagaccaaacagggaaaagtcattcanaagtataagctgaaactagtagccgatatg

SEQ ID NO: 9339 - DNA, 101 bp, rice(Oryza sativa)
  misc_feature (71): n=c or g
tctgggacacgagacaaatccacatccgcgacaggttttgcgtgaggctgattggtcatatatatcagcanagaaaagataacagtgtgagaaaaacaaat

SEQ ID NO: 9340 - DNA, 101 bp, rice(Oryza sativa)
  misc_feature (71): n=c or g
ctcttggtgacggtatttctagccgcccccttctcgtgtccatcatccaccaccactgccaccacctacancactccacctctatcagcaaccgtcggcgc

SEQ ID NO: 9341 - DNA, 101 bp, rice(Oryza sativa)
  misc_feature (71): n=a or g
acaatactgaaagagaatgcttgctctagtttctagagatatgtatgagacgaagtgtcgaggaacacgtngcgcaacgagcaggaaaagttttcaccgag

SEQ ID NO: 9342 - DNA, 101 bp, rice(Oryza sativa)
  misc_feature (71): n=t or c
tttcgggaaaaacagggtccttttttcaaaatcaccatgttcttcctttttcctttctttctccttctttncctttgcaggttcgtcgagccggcgtgtgg

SEQ ID NO: 9343 - DNA, 101 bp, rice(Oryza sativa)
  misc_feature (71): n=t or g
tctaagaacccggatgttattcttggaatgaactggttgaccaagcacagtggtattatagattgtgctanccgatccatatctttgattgggggtactgg

SEQ ID NO: 9344 - DNA, 101 bp, rice(Oryza sativa)
  misc_feature (71): n=c or g
gtcaatgccaacagtcctgaagagatcctgcaagcccttaaactcggtagtctcattaatgtctctccaanagatcaacttatgttctgcaaaagctttcc

SEQ ID NO: 9345 - DNA, 101 bp, rice(Oryza sativa)
  misc_feature (71): n=a or g
gttctatattagatttgcttgttatatacttgaacaaacattttcgtttacagatgtacttgcttggacgnaggaaaagaggccgagcataacgaatgcat

SEQ ID NO: 9346 - DNA, 101 bp, rice(Oryza sativa)
  misc_feature (71): n=t or c
gcaaaggctcaaactgaatctcaaatcaacacaagcccagggcaaagaataagaaatagagccagcagccntagcttgtgggtggagggggttatttatag

SEQ ID NO: 9347 - DNA, 101 bp, rice(Oryza sativa)
  misc_feature (71): n=a or g
aaaaataccagagggcaatttgctggccttatcaattttgaaaattccgaaaagatctttcggaaattccnaaaatcaccaaaatgtaaaatccaataatg

SEQ ID NO: 9348 - DNA, 101 bp, rice(Oryza sativa)
  misc_feature (71): n=a or t
ctttccccatgaaatccccaaaaatatctaagtaaatcgtgtggaatcgagctcgaactcggacactctcnatccggtagaaccctagtttttcccagcgc

SEQ ID NO: 9349 - DNA, 101 bp, rice(Oryza sativa)
  misc_feature (71): n=a or c
acgacagaaacaataaatataaagtccgaaagaattgtaatatatgcatatgcatataatatcggtaaatntaattggagaggcctctccaattagtctta

SEQ ID NO: 9350 - DNA, 101 bp, rice(Oryza sativa)
  misc_feature (71): n=t or c
gatttggttgaaggacaaatttgatcaaccaatggaagtctatccagaagataccgaattcaaaaaggatngtgaagaccatggcatggcatattaattct

SEQ ID NO: 9351 - DNA, 101 bp, rice(Oryza sativa)
  misc_feature (71): n=a or g
ccagaacaccgctattgacgatgacccgagctacaccgtcatttccacctcgtcgccttcaccgtccgtcntcgcaacgcctctcgatgagttcggctcgt

SEQ ID NO: 9352 - DNA, 101 bp, rice(Oryza sativa)
  misc_feature (71): n=a or c
acccaaagatcgccggcgaatcaggcacggcagcatgaacggagggtaccgagaggttgagtgtgacgagncgaactcatcgagaggcgttgcgacgacgg

SEQ ID NO: 9353 - DNA, 101 bp, rice(Oryza sativa)
  misc_feature (71): n=a or t
tcggataaacaatgagatatatgctatcatcggctagaactaaacatatgcataatcatcaataaaccacnccttattaaaacaatcttgatagattagac

SEQ ID NO: 9354 - DNA, 101 bp, rice(Oryza sativa)
  misc_feature (71): n=a or t
caatgcagaggtaaaattctgtcccattgttaatttcatgaagagctgtctctcccatacttttttcaganttttatttaatttctaaaagttgtagtaca

SEQ ID NO: 9355 - DNA, 101 bp, rice(Oryza sativa)
  misc_feature (71): n=a or t
tgctttcctgcaagcagaccaaaatatcacttagcttgaaaacatgacaaatataatagctgtggctatgnttttgacaatacaatgtattcaggttctga

SEQ ID NO: 9356 - DNA, 101 bp, rice(Oryza sativa)
  misc_feature (71): n=t or c
ttgggagggctgttggcttgagcttttgcttctggcatatctctattttgttcagtacccgactggtttcnagtcgggggctcctgatcagcaccgactcc

SEQ ID NO: 9357 - DNA, 101 bp, rice(Oryza sativa)
  misc_feature (71): n=a or g
tttttccattgttgccgggtgtttttagcaccagggagcttctccctctccagtagtggagctcttgtttngccaaaaatctgatgaggggctctctccag

SEQ ID NO: 9358 - DNA, 101 bp, rice(Oryza sativa)
  misc_feature (71): n=a or g
tcttcaactgctccctctgctacgaactactcatgcttgtagctttaaccgtcaattcctagcacttttcntatatatatagttgaacattttccaccctc

SEQ ID NO: 9359 - DNA, 101 bp, rice(Oryza sativa)
  misc_feature (71): n=t or c
ttccgaggacgacgctcgggttctcgtgagcctcgtcgtcatccatcgttgttttcccagtgtcgacctcnatcgtcgtcgtcattgcggcgtcgacctca

SEQ ID NO: 9360 - DNA, 101 bp, rice(Oryza sativa)
  misc_feature (71): n=t or c
agttgacaattttgatgtttgaattatgtactgataaatcataccttctttctgttgtgccaatgctctcngcttctttatcagtgtaaatactccaaata

SEQ ID NO: 9361 - DNA, 101 bp, rice(Oryza sativa)
  misc_feature (71): n=a or t
ttgtttgtaaaagataaacatagcacatagcaccctttgtttcagggtctcaatgacacctgaaacaaacntataaaatgcatcaacctgggatgtttctt

SEQ ID NO: 9362 - DNA, 101 bp, rice(Oryza sativa)
  misc_feature (71): n=a or g
ttcagcttagaaattctagttcgagaatttctgggcgtgacactcctcagattcctcatctctggaagagngatcgaagcaaatcccgagaagatcaaggc

SEQ ID NO: 9363 - DNA, 101 bp, rice(Oryza sativa)
  misc_feature (71): n=a or g
accaccttttctcttaggcttacacactttatcctaggctgccaaagatgttttattggagttgacctcanagcctctccaaagacaatgtcttcttgctc

SEQ ID NO: 9364 - DNA, 101 bp, rice(Oryza sativa)
  misc_feature (71): n=a or g
acagttgttctattaaatggtgttcctggtaaattttttcaatgtaagaggggtgtaagacaaggggatcnatatatcctttgtccccccttctgtttgcc

SEQ ID NO: 9365 - DNA, 101 bp, rice(Oryza sativa)
  misc_feature (71): n=a or g
ctggcaatggcaagatttgcaattgcaacagcatggcttctcatcatactgtttcaaacgtaccatgtgcnctagaatggcacaactcatcgttttatgaa

SEQ ID NO: 9366 - DNA, 101 bp, rice(Oryza sativa)
  misc_feature (71): n=a or t
ttcccgttaccggccgtaatggttttctggggtttactccttttcttctctcgaggaggtgatccgccagnagaaaatcatcatgcatatcccatcctaat

SEQ ID NO: 9367 - DNA, 101 bp, rice(Oryza sativa)
  misc_feature (71): n=a or t
gctggtctgtgtggtataagcgtgtattagccagcaagcaagttcattgggacgaactaggaatcggccangcccttgctcttacattagcaaattcggct

SEQ ID NO: 9368 - DNA, 101 bp, rice(Oryza sativa)
  misc_feature (71): n=t or c
catcacatatacttctaatttcctgatttattgaacctaagaattaaggattaatattattactcttgacntatattccttaatccctgattttataaatt

SEQ ID NO: 9369 - DNA, 101 bp, rice(Oryza sativa)
  misc_feature (71): n=a or g
tcaaccggtaataaaaatacatctttagtatgggctggtaacactaaccacgactaaagttgtctttaggnttagttaaaaagaagcatcactatccaagt

SEQ ID NO: 9370 - DNA, 101 bp, rice(Oryza sativa)
  misc_feature (71): n=a or g
ttgtatcataacctacagtcagggtctaaaatgcaaatactgtatctgtttcatagtataagtctattagnattatggataacacatatctaatagtagtc

SEQ ID NO: 9371 - DNA, 101 bp, rice(Oryza sativa)
  misc_feature (71): n=a or g
tctcaatttaaatagaaagctattatagaacccctcttgactggttgaggtggtagtgggacagccacacncgtgcgagctgggctgggccgggccgtggg

SEQ ID NO: 9372 - DNA, 101 bp, rice(Oryza sativa)
  misc_feature (71): n=c or g
tgtgtacacatcgttttgatatggatcaaacagctttctttcctgcttatcttcgggcctgtttgggaaanaaggacttaatccaagtctctgtacattgg

SEQ ID NO: 9373 - DNA, 101 bp, rice(Oryza sativa)
  misc_feature (71): n=a or g
tttaagagggggaacaaaggcaggtcgttaagcaacatagtcacggcggatgacgagactttaaaaaaatnaacacaaacgataattatttttatttttaa

SEQ ID NO: 9374 - DNA, 101 bp, rice(Oryza sativa)
  misc_feature (71): n=a or g
tcattttcgaccgttctcataaaaaaaaccgtttctaataatttctgactgttttcatctctctatataanattgcacatgattgattaacaatcattatt

SEQ ID NO: 9375 - DNA, 101 bp, rice(Oryza sativa)
  misc_feature (71): n=a or g
gggtcccacgttttttaaattaattttgggaatccaattgccacataagcaccatgtatgatgaggacctngtcaaacaaagtcacctagtaatcattatt

SEQ ID NO: 9376 - DNA, 101 bp, rice(Oryza sativa)
  misc_feature (71): n=t or c
tcaaatttagagttgcataatttttgaattttcattctaaagctatatttgaagcatgtgatcttaggggnattcttgtcttttttttaaaaaaaatattt

SEQ ID NO: 9377 - DNA, 101 bp, rice(Oryza sativa)
  misc_feature (71): n=a or g
aatacaacagcattagctgaagggcacaggcacagctgtacatgccttttaaattacaacctttaataatnattgttaatcaatcatgtgcaatcttatat

SEQ ID NO: 9378 - DNA, 101 bp, rice(Oryza sativa)
  misc_feature (71): n=t or g
tatatgccatatcgaacagcatagaaacaaatggtactaacataagcatagcaggtcttgcggacgacgcnggcggcctatattcctgatgtagtgtaaaa

SEQ ID NO: 9379 - DNA, 101 bp, rice(Oryza sativa)
  misc_feature (71): n=a or g
tctgtcataatgatactatcattatagacactgacatgtgtatcaatagaaaggtgagacctacataccantgactgtaatgatagtgacattatggtaga

SEQ ID NO: 9380 - DNA, 101 bp, rice(Oryza sativa)
  misc_feature (71): n=a or g
gaaattccgatcggcaattggaagtgcaagcaaagtaaaaacaccaattggtttgtaaggaaaacaggtcnattttgtcgagaaatcaacgagaaatttca

SEQ ID NO: 9381 - DNA, 101 bp, rice(Oryza sativa)
  misc_feature (71): n=t or c
cacgaagagaactggtaaatctattatccgcgcagagtaacatgggagacgaagcataaatcaaacagaantattttattctcatagcgtgctaggggcgg

SEQ ID NO: 9382 - DNA, 101 bp, rice(Oryza sativa)
  misc_feature (71): n=a or g
gacaaatctaggagagttttcttatgaccttgagaagaacaatgcacagaccttccaactggagagaaccncagattcacgagtcatcaacatggttcggc

SEQ ID NO: 9383 - DNA, 101 bp, rice(Oryza sativa)
  misc_feature (71): n=t or c
gtaacaccaactgggattaaaggctaaagatgaacatctttagtcttggattggacgtcctggtttgtaanccaggactaaaggggttacaaaccaagact

SEQ ID NO: 9384 - DNA, 101 bp, rice(Oryza sativa)
  misc_feature (71): n=a or g
atctgagtataaggttagttggagaatgatctttgtatgtacactaactgtctaagtgtcaactatacacnggtactcgggtccaactgtgcactttgtgg

SEQ ID NO: 9385 - DNA, 101 bp, rice(Oryza sativa)
  misc_feature (71): n=a or g
gcttctggagatttggcgcacaccatggttagggcattggcagcatttaggacatcgtcgtcgcaaccttngcggtgctggcgttggaggtgttggagtcg

SEQ ID NO: 9386 - DNA, 101 bp, rice(Oryza sativa)
  misc_feature (71): n=t or c
caagcatggaacaagatggagcctgaaacaaaattctcaaaacacctgttgaagtcaatttcagggccatntttttatgcgaacttggagcaggcttctaa

SEQ ID NO: 9387 - DNA, 101 bp, rice(Oryza sativa)
  misc_feature (71): n=a or g
aaactatgtatctgctcagccttcaatcggaacatggccttgcattgcctcggattcgccatcgtctccancatccaactaataccagtctgaaccggaac

SEQ ID NO: 9388 - DNA, 101 bp, rice(Oryza sativa)
  misc_feature (71): n=a or g
atatcacctaccgatagtgattgtagacagcatcagcaatgcagtcacgcaatgcgctcatagcttgctcnctatttgttgcgtagtacatatgaatgaag

SEQ ID NO: 9389 - DNA, 101 bp, rice(Oryza sativa)
  misc_feature (71): n=t or c
ccgaattgtgtggagagaagatggtatcccacttattagaagccagacaaatcccgatgagtacacttaantcattggtattatctcaaggattgctgcgc

SEQ ID NO: 9390 - DNA, 101 bp, rice(Oryza sativa)
  misc_feature (71): n=a or g
acaagtcctacactcaggttgattaaacttgtataatctttgacatggcaaactgtcacaaggtgtggccngtaaatgacttgtggtttttgaatctccta

SEQ ID NO: 9391 - DNA, 101 bp, rice(Oryza sativa)
  misc_feature (71): n=c or g
taacaaccagctgattttggatgggcgcattggattagtgtcatctctatgtcaagtcgaacctattcttngcaatccagaacgtaagcggaaggccgttg

SEQ ID NO: 9392 - DNA, 101 bp, rice(Oryza sativa)
  misc_feature (71): n=a or g
gcctcatcgtcagacaacgatcatgtgatgatcacgcgcggcaaggctggcatttgtcgcccggttgatcncctcaacctccatgccatgcctctctcgcc

SEQ ID NO: 9393 - DNA, 101 bp, rice(Oryza sativa)
  misc_feature (71): n=t or c
tggtctgaccaatggatctgcggctactcagtagcttccttggcttcggatctcctcttcattgtgccccngcatctacgtggttcgcacacggttgcttc

SEQ ID NO: 9394 - DNA, 101 bp, rice(Oryza sativa)
  misc_feature (71): n=t or c
ctagcaaagtagttagttataataccgtaaaaagttagttatatgtttcagttactttcctctaaaagtgntaacttctaatattatgaagagttacccct

SEQ ID NO: 9395 - DNA, 101 bp, rice(Oryza sativa)
  misc_feature (71): n=t or c
ccgttacacaaagaggaggccaccgcatcttcgaatctgttttggggagcttctagctcatgctattttcncctagaattagaagctctttcttttgcgaa

SEQ ID NO: 9396 - DNA, 101 bp, rice(Oryza sativa)
  misc_feature (71): n=a or g
aaaccgaggcatacatatacatatatgttgagatacagagcgtataaaaatacctggtaaagctaaccacnctgatttgcaatatcactgaatatttcaga

SEQ ID NO: 9397 - DNA, 101 bp, rice(Oryza sativa)
  misc_feature (71): n=a or g
gtcgtcaccggcaagtggatttttcgtcacaagtttcaagctgacaggactctggagagatacaaagctcnctgggtcttgcgcggctttactcagcgtct

SEQ ID NO: 9398 - DNA, 101 bp, rice(Oryza sativa)
  misc_feature (71): n=a or g
atgggcagacaatgcatggttttgtccagtcaacaaactaagcaatggttctggaggtggtctgtatggangtaaacgaacacttcctcccctacaacatt

SEQ ID NO: 9399 - DNA, 101 bp, rice(Oryza sativa)
  misc_feature (71): n=a or t
gcaacgggatcctactttattagaaacatataaaaatatatcgctatatcactattccctccgtttttttnaaaaaaaaacccttctgaccatgtatccac

SEQ ID NO: 9400 - DNA, 101 bp, rice(Oryza sativa)
  misc_feature (71): n=c or g
tgaagcgaaactttggggaccatattagctattcacccgctaaacatcacaaaactagagatttagtactnaaggtagcacaaaactacatattatagagt

SEQ ID NO: 9401 - DNA, 101 bp, rice(Oryza sativa)
  misc_feature (71): n=t or c
atgtcatgtgacttttctcagcaattttcttgcgcgcctctgctccttgtgttgtgccacggtgcagtggnggatgcagaattaaaataaagatggggcga

SEQ ID NO: 9402 - DNA, 101 bp, rice(Oryza sativa)
  misc_feature (71): n=t or c
aggaggaagaggtggtttctctgggttcgaagggatggtcgcgagatgatggaccgtggtggatgacaganacaggtgaacagtgaggcgatggcaatgcc

SEQ ID NO: 9403 - DNA, 101 bp, rice(Oryza sativa)
  misc_feature (71): n=t or c
taattttttccacgcgattttctgatcgtactaatatgttttcatctcattcattgcggtaaggagcggancagaaaattgattcattggtgttataacgt

SEQ ID NO: 9404 - DNA, 101 bp, rice(Oryza sativa)
  misc_feature (71): n=a or t
catgattagatgcggtggagattgggaggagacatggcagctttgaagatggggaaggatgatgcacatcnctggcgaggagggggtgaaggaagcggtga

SEQ ID NO: 9405 - DNA, 101 bp, rice(Oryza sativa)
  misc_feature (71): n=a or g
acaaagcatatccatattcatcatactagattatgtcttattcttagttaggttaatttgttttaggacgnaggatggcatgtcgtgtccagggtgtgaaa

SEQ ID NO: 9406 - DNA, 101 bp, rice(Oryza sativa)
  misc_feature (71): n=a or g
atactcctagatagtactaccgtaggtccacagcaaggccatgagtgcggtcctagtcggctagagtactntatggtaaatctctttttattactataata

SEQ ID NO: 9407 - DNA, 101 bp, rice(Oryza sativa)
  misc_feature (71): n=a or g
tggtgcagtagcgtgccacccatggcaaatgcaggctcttcacaagtaatactacactgacttccctatcnaaacttggaaactccatatccttgaagagc

SEQ ID NO: 9408 - DNA, 101 bp, rice(Oryza sativa)
  misc_feature (71): n=a or g
gaggcccctcaacgaatacgattttcgtcgttcaaccagaatccagaaaccggtgcaatacaggtctcatnatggtttggatggctttttttttttttctt

SEQ ID NO: 9409 - DNA, 101 bp, rice(Oryza sativa)
  misc_feature (71): n=t or g
caacacctataggccttttcctacctccgcacgctgaaaaaataagaaccgacacctttaaggaactatangtgccagttcattagtaaaaaccggtacaa

SEQ ID NO: 9410 - DNA, 101 bp, rice(Oryza sativa)
  misc_feature (71): n=a or g
agtttgaataagttggaaagtgtatccggtcgtacagataatctttgagtttgtttcagagttagctgccntatttaggaaggtttgtgaactttcctttt

SEQ ID NO: 9411 - DNA, 101 bp, rice(Oryza sativa)
  misc_feature (71): n=c or g
ggaaagagagtgaggggaagctccaaaaggagtgcccaaaattttggaattctttccgtggagtttagganttgtcagcactctctctattggagtcccgg

SEQ ID NO: 9412 - DNA, 101 bp, rice(Oryza sativa)
  misc_feature (71): n=a or c
attcctctttcagtttgtttttaattcactttatcccaaatttggtgaatttgttctgattttggaaaaanaaaattttgcggatttattacgattttggg

SEQ ID NO: 9413 - DNA, 101 bp, rice(Oryza sativa)
  misc_feature (71): n=t or g
gccaccctctgtatgtctacttgctgtcattcctttgcgatgtgttcatatgttcttgctacttaccgatnaaccgaatcttttatgctctcaaaacactc

SEQ ID NO: 9414 - DNA, 101 bp, rice(Oryza sativa)
  misc_feature (71): n=a or g
cctccagcctcccgtgccgccacaccagagcattggtcagccgcgctatctgcttcccctttaccgtgacntcgtctccttccccggccattgcacagttt

SEQ ID NO: 9415 - DNA, 101 bp, rice(Oryza sativa)
  misc_feature (71): n=a or g
agcatcaccatcacgtcagccgcagtccacttcacacatgcatgcagctttttttgtccaagatgcacgcncccaagtcatttttcatgtgccccttccgc

SEQ ID NO: 9416 - DNA, 101 bp, rice(Oryza sativa)
  misc_feature (71): n=a or g
gctggttgtggtaggaacgtacaagtgtacatcccctcctttagagttcaaagcggtcgatacatgcagtncgtgggtgtactgtacgccatggatgcgct

SEQ ID NO: 9417 - DNA, 101 bp, rice(Oryza sativa)
  misc_feature (71): n=t or c
gacatgcatcgaccagaacaggatgcatggtgagcatacatatttcagaccaactccatacatcaatgaanggtttcctttttcttatatttgcagtgctt

SEQ ID NO: 9418 - DNA, 101 bp, rice(Oryza sativa)
  misc_feature (71): n=t or c
caaatttgaccgtgtgttgtccagataacttgaatggatgccaacagcaattaggaattatgtttttgctnaaaacaaaaaggaaatgtggattttggtaa

SEQ ID NO: 9419 - DNA, 101 bp, rice(Oryza sativa)
  misc_feature (71): n=a or g
tttcttgtagtgtgtgtgacaaagctgaagatcaggctggccaggcagcacaagtaaggcgcaaaagcaanttcaggagcattgaacagctgaagggacat

SEQ ID NO: 9420 - DNA, 101 bp, rice(Oryza sativa)
  misc_feature (71): n=c or g
cagttgtgtaacccttgtattattcatgtagtacaatacatgtaaaatgatgtcggcttgtgatattcgantgtgccatgtgtgtaccacctactgattca

SEQ ID NO: 9421 - DNA, 101 bp, rice(Oryza sativa)
  misc_feature (71): n=c or g
caggtgtcaacttgtccggagtgatattcacgatattgtcttcatcaacttcagatagacccaacttctgnatcttagctttaacagagccaagttcacca

SEQ ID NO: 9422 - DNA, 101 bp, rice(Oryza sativa)
  misc_feature (71): n=a or t
ctatacacttgtcttcaatgtgttctcaacagtatggcatgcataaggtcgactccaactcctttctaaangatttaaattaagcaagggtgagtacgagc

SEQ ID NO: 9423 - DNA, 101 bp, rice(Oryza sativa)
  misc_feature (71): n=a or g
agacccatgtcagcaccatggtcaaaggaagcttcggatacctcgacccagagtacttccggcggcagcanctcacggagaagtccgacgtctactcgttc

SEQ ID NO: 9424 - DNA, 101 bp, rice(Oryza sativa)
  misc_feature (71): n=a or g
gatctgagtctagtcgttagtgtacttggagctatggttgctttcgatatcgaagtctatgtagccgtctnaggaatcaaaactattgacaatatccatga

SEQ ID NO: 9425 - DNA, 101 bp, rice(Oryza sativa)
  misc_feature (71): n=t or c
accccatccgtcccccatgcctaaacctagtttgttccaatcaaacaagagctgcttctgacccaaatcancccatccgtcccccatgcctaaaccctagt

SEQ ID NO: 9426 - DNA, 101 bp, rice(Oryza sativa)
  misc_feature (71): n=t or g
gccttcgtatggtttgacgggcacgtctcaggcgccttcatgtggtttgatgggcatgtcttatgctaaanttgactggcacgctgagtcccagcaataac

SEQ ID NO: 9427 - DNA, 101 bp, rice(Oryza sativa)
  misc_feature (71): n=a or c
tttgtaagaaaaactgttagctgatttgtatcctgaccaatcccttcttttattgtgcagacaacagaatnctctcctcctcacaaaagcaacagtggcaa

SEQ ID NO: 9428 - DNA, 101 bp, rice(Oryza sativa)
  misc_feature (71): n=a or t
tggttgttacaactttatatatatacccacactgccctgcagcaacgggggaaggaacccctagtaattanctattcgacactaacaacaacaaagattaa

SEQ ID NO: 9429 - DNA, 101 bp, rice(Oryza sativa)
  misc_feature (71): n=a or t
accttgtcgtccggctcagggtcgcccaacgtggacagctgcgtcacgatggtgttgagccgcatggcgangtcctcgaccgacaccccgtcgcggaacgc

SEQ ID NO: 9430 - DNA, 101 bp, rice(Oryza sativa)
  misc_feature (71): n=c or g
cgccaccgccattgtgccacggtcatcgcctttccacttgcgttccattatcacctctccaagcctatttnattcctctaagtttcatcccattggtgcag

SEQ ID NO: 9431 - DNA, 101 bp, rice(Oryza sativa)
  misc_feature (71): n=t or c
ttgccttcaccgatggcgagatgaattctagttgcattccgaagtggcatcacttgaataaacaccgactnagcctcaaacaacacatataatcattcaag

SEQ ID NO: 9432 - DNA, 101 bp, rice(Oryza sativa)
  misc_feature (71): n=t or c
tccataaggttttggtgtttgaaattagaagaaaaacaatagttattcgctagttgggctggctttcagcnagcccaaaggcccagctgccacctccacac

SEQ ID NO: 9433 - DNA, 101 bp, rice(Oryza sativa)
  misc_feature (71): n=t or c
catcacgttgcccattgaatccgtgccccgcctttagtgcacctatcagcggtacactcgaagtagggcangcaacggtcacgggcgcaacctgagcgaac

SEQ ID NO: 9434 - DNA, 101 bp, rice(Oryza sativa)
  misc_feature (71): n=a or g
cactcggtgcgtgctccagagcaacgatggcgaggtccacattcccgacgatccgctgcaccaatgggatnaaacttagaggaatcaaataggcttggaga

SEQ ID NO: 9435 - DNA, 101 bp, rice(Oryza sativa)
  misc_feature (71): n=a or g
gagctgctactacccccaccagtgagctcaacacagctgacgaccctggatctaccacatcgaaccatcanctttggatctggattagagaaagagggaaa

SEQ ID NO: 9436 - DNA, 101 bp, rice(Oryza sativa)
  misc_feature (71): n=a or g
catttgcagcgccgtccccgtcgagatgatctcgacgctagcgaccaaggagacgacgaaggcagcgtggnactgcatcaagaccatgcgcgtaggcaagc

SEQ ID NO: 9437 - DNA, 101 bp, rice(Oryza sativa)
  misc_feature (71): n=c or g
aagtctgcgacaaaaccttgaaatctgacttggctattctaatgtctgaccttcctgaaatcaatacttanaataaaatattaaatggaaatagcccccga

SEQ ID NO: 9438 - DNA, 101 bp, rice(Oryza sativa)
  misc_feature (71): n=a or g
ttacgtcccatccactaagtcgtttattcgtgctcatggcggcgacagttcaaacagcggctgcggtggcngcaccggcggtggcggcagaggcgtcggcg

SEQ ID NO: 9439 - DNA, 101 bp, rice(Oryza sativa)
  misc_feature (71): n=t or c
atctcctacacacctctatcgctccagtcttgtccccttcgctctggacccactttcaacctcacaagctngttccacctgagtacatgacgccctactgc

SEQ ID NO: 9440 - DNA, 101 bp, rice(Oryza sativa)
  misc_feature (71): n=t or c
acaagaacaaaagattagtcaagtaatgaatcggctgacaatcattcaggttgataatgacaaggtttacntgcggtatgacatcggggaatagatctgtc

SEQ ID NO: 9441 - DNA, 101 bp, rice(Oryza sativa)
  misc_feature (71): n=t or g
ttggactcgtaagcttgcggtccactgaagatatgattgagctctttgcgggaatcttgaaaaccagtcgngtcgtcatgttcatcatccttcttctttga

SEQ ID NO: 9442 - DNA, 101 bp, rice(Oryza sativa)
  misc_feature (71): n=t or g
cgagtttcaggacttagcgactttcacgagtttcaggacttagcgagtttcctgatttagcgagtttcagnatttagtgatttccaggatttagcgactta

SEQ ID NO: 9443 - DNA, 101 bp, rice(Oryza sativa)
  misc_feature (71): n=a or g
tattgttgcctaagtgttgacaaagtcaagcacattccttcgtaatgtgggacttcaacagcctattgctnctccaaaatctatttcaccgcagatgcagg

SEQ ID NO: 9444 - DNA, 101 bp, rice(Oryza sativa)
  misc_feature (71): n=a or g
ttatcttcgtagccgtcgtcgaaatcgtcaaggtttctgaagtcgtagttgtgccgaagtcatcatagtcnaggatctccgttggccatgagccgacgcat

SEQ ID NO: 9445 - DNA, 101 bp, rice(Oryza sativa)
  misc_feature (71): n=a or g
aatccttgctatgtgtaataataaaacatgtgacatctttatgtgggattttcatcataaacaccaagtgntttgtatagacatattcatgtttattaata

SEQ ID NO: 9446 - DNA, 101 bp, rice(Oryza sativa)
  misc_feature (71): n=a or t
caatagattaattcagcatttttcttggactgttaaatcattatttggaccggtgtttagatacattgacnggaaaaattaacaacgaaaattctttggca

SEQ ID NO: 9447 - DNA, 101 bp, rice(Oryza sativa)
  misc_feature (71): n=a or g
aaaacacactttactgtcttgataactagaatcctattatgccaaagaattttcgttgttaatttttcctntcaatgtatctaaacaccggtccaaataat

SEQ ID NO: 9448 - DNA, 101 bp, rice(Oryza sativa)
  misc_feature (71): n=t or c
atagtagtgtagtagtactactagtagttctgttgtagtactagtactgaactatactagtagtactgatnggctgatcgcgcgtctggagggccgcgcga

SEQ ID NO: 9449 - DNA, 101 bp, rice(Oryza sativa)
  misc_feature (71): n=a or g
caccgtgttctacgccactgtgaactcgaaaacaatggtcactccggctgggacgaagaagatggcgttcnggagtgtgaacattaatgttcgtcccgagc

SEQ ID NO: 9450 - DNA, 101 bp, rice(Oryza sativa)
  misc_feature (71): n=a or g
gatgaatattagattgaaattgggttcccttctattctaccgtggaccaatatatatagctaattgctctnatcttttggcatgtctactcggtcccacgc

SEQ ID NO: 9451 - DNA, 101 bp, rice(Oryza sativa)
  misc_feature (71): n=t or c
acaaatcatgtcggctgccatcctttttacttaactcatagtcccaatgtttctctttttcaagttttagncgacatgttctcttttgatatttggccatt

SEQ ID NO: 9452 - DNA, 101 bp, rice(Oryza sativa)
  misc_feature (71): n=a or g
ctgagtgctctctcttacatggcgcccttggagtcaccagacctttcgctcgttctccctcttcatctccncgcacacttttcgccatggctcctcgcaag

SEQ ID NO: 9453 - DNA, 101 bp, rice(Oryza sativa)
  misc_feature (71): n=a or g
cttagtccttgtgctgtccctattattcttgttccaaagaaagatagtacatggcgcatgtgtgttgattntagagcaattaatagcattactgttagata

SEQ ID NO: 9454 - DNA, 101 bp, rice(Oryza sativa)
  misc_feature (71): n=a or g
ttcccttaggtttcaaatcattaaaaaatggcttctagaatttgccttggttaacccggagaaaaccccanttaacaatatatttaataatcggagttatc

SEQ ID NO: 9455 - DNA, 101 bp, rice(Oryza sativa)
  misc_feature (71): n=t or c
tcttttggttttttggctcttattcccccttgaaaggtgaagggctgaaccatgtgtatagtactaatgcnggctaataggaaactcttttacgctccttt

SEQ ID NO: 9456 - DNA, 101 bp, rice(Oryza sativa)
  misc_feature (71): n=t or c
ggtgggttgtgggtacatgcatgattttggaagtcatgcccttgacaatttcatgtgaccatagctactanggatacaatcattgctcatatcatggatga

SEQ ID NO: 9457 - DNA, 101 bp, rice(Oryza sativa)
  misc_feature (71): n=a or g
acaaacgtgatctttttgaaagattgcagaatatgaggcaaggaacatgctttgtagaggagtactacatngagatggagaaagccatgattcgagccaaa

SEQ ID NO: 9458 - DNA, 101 bp, rice(Oryza sativa)
  misc_feature (71): n=t or g
cccaaagtttaacttgagcaagaacttcacctccagcaactctccttctctcaattcagcaagtaagaaanaggagagtacacaaagtgcaagcaagaaac

SEQ ID NO: 9459 - DNA, 101 bp, rice(Oryza sativa)
  misc_feature (71): n=t or c
taaaagatctcttgcttcatgggatttggtatgcaggccaaaggaaaaaaggtggtttaggagtcatcaanttgagagttcaaaatacaacacttctgctt

SEQ ID NO: 9460 - DNA, 101 bp, rice(Oryza sativa)
  misc_feature (71): n=t or c
aatctaagtgttcaaatcaaatcacagatcagcagacctggaaatacttaattcatgtgctacttctaacnatgtactgcatcaacagaaagggcaggcag

SEQ ID NO: 9461 - DNA, 101 bp, rice(Oryza sativa)
  misc_feature (71): n=t or c
gtgaaaatatactcatgtgttgctaccagatgaaaatgcttgaagttaaattgagagatggttcaaacaangaaagcccataaaatgtaagcgacattagt

SEQ ID NO: 9462 - DNA, 101 bp, rice(Oryza sativa)
  misc_feature (71): n=t or c
ctcccctcctatgatttttctccctcccctcttcctctgatttttctcatcatacatgccatctctccctntggttttttttctcaccttgtagagaaatt

SEQ ID NO: 9463 - DNA, 101 bp, rice(Oryza sativa)
  misc_feature (71): n=a or g
agcttggggacgaggtcactcagtggtggcatagacagccgacctatagatgtggccgatgaggtcgcccngcgacggcgtaggcagctgacctagagacg

SEQ ID NO: 9464 - DNA, 101 bp, rice(Oryza sativa)
  misc_feature (71): n=t or c
gccgtcgtactcattcgttcttcacatgtacttggcaaaccctatgtcaatccaaaaagtactagcaaccnggaaatctttctagcgtattgttccaatct

SEQ ID NO: 9465 - DNA, 101 bp, rice(Oryza sativa)
  misc_feature (71): n=t or c
aataaatgtggaagctaaaactaaacagggtcggattgtctgatattggatcggatagtcctatgtgatcngatagtctgaactgagattatactatatga

SEQ ID NO: 9466 - DNA, 101 bp, rice(Oryza sativa)
  misc_feature (71): n=c or g
ttattgtattgtggcactaggcaggattcagcttgtgagtaaaaaaattgtataattacatttgtaccaanaaagccacgtgtttatgataaaaaatttag

SEQ ID NO: 9467 - DNA, 101 bp, rice(Oryza sativa)
  misc_feature (71): n=t or c
agggccaggctgtagggccacgcgacaggatgggaagatgaattcccttcactacgcatacccctgggccnatatctccgatagtagcccccggcgcctca

SEQ ID NO: 9468 - DNA, 101 bp, rice(Oryza sativa)
  misc_feature (71): n=t or c
tcagcgtgcacctgtaaggcacgtcgatacctattgaatggaatcaaatttgaaaaagagtattgagcctnggtactaataaaatatatgatttttcatac

SEQ ID NO: 9469 - DNA, 101 bp, rice(Oryza sativa)
  misc_feature (71): n=a or g
gatgggcaagttcagaacacctctttggtgagctttattgatgatagactgaagcaaatcaacacccaaancaaagagcagaggtgataaaggatcaccct

SEQ ID NO: 9470 - DNA, 101 bp, rice(Oryza sativa)
  misc_feature (71): n=a or g
atgaaccacagcggccaactccaagtcatggataggatagttaccttcatagggtcatcgctggcgtgaancataagctaccacatgaccttcttgcatta

SEQ ID NO: 9471 - DNA, 101 bp, rice(Oryza sativa)
  misc_feature (71): n=t or c
atgccctcaacagttcggttctgatgttagtgccctggccaacatatatcctccctttgtacttcagcaanccagattcttgtctatattccccatttgga

SEQ ID NO: 9472 - DNA, 101 bp, rice(Oryza sativa)
  misc_feature (71): n=t or c
atatccatccacgaaataaggactccatatatcactactacaaaaagagccataggtgccggttgggaacnggctataagtgtcggtttcccaaccggcac

SEQ ID NO: 9473 - DNA, 101 bp, rice(Oryza sativa)
  misc_feature (71): n=a or g
ttctgtggtaagttgctctcatactagagtgaccaccaaaagaggatgcatgacatgccctcaacagttcngttctgatgttagtgccctggccaacatat

SEQ ID NO: 9474 - DNA, 101 bp, rice(Oryza sativa)
  misc_feature (71): n=t or c
ttttttttttggctcgagcaaagctaaaggtgccggttgaataattgtcataggagccagttactgttatnggtgccgatcaataggtgccggttgggaaa

SEQ ID NO: 9475 - DNA, 101 bp, rice(Oryza sativa)
  misc_feature (71): n=t or c
aggattccatactgcagaagaaacatgctctaaggcagcgttcgttccagtgagtttgaggaagaaagcanatcgttttccacgtgcacgcttcccaaact

SEQ ID NO: 9476 - DNA, 101 bp, rice(Oryza sativa)
  misc_feature (71): n=t or c
ctctgtctgggaggaagaaggatagagaaagaaagggaagaggagatgcggaaagaagtggccactaacgngtggctctaatttttatttttagttttatt

SEQ ID NO: 9477 - DNA, 101 bp, rice(Oryza sativa)
  misc_feature (71): n=a or t
ctccaaactacaatttcattttcctttagcaccgctttccaaagtaaacgatgcattttattaaaaaaaanatatatatatatagaagtatcttaaaaaaa

SEQ ID NO: 9478 - DNA, 101 bp, rice(Oryza sativa)
  misc_feature (71): n=t or c
tcatcctaattgggccaggatgtcatagttttcatctcccatctccgagatagacatagaactctctattntgttcattttcctgatactctggttctcat

SEQ ID NO: 9479 - DNA, 101 bp, rice(Oryza sativa)
  misc_feature (71): n=t or c
ccaaacaaccacactgagtcgatcttgattcacaacctaaggtcctatactccccatccccatctgcattncatccaccacctttgattacctccttcgtc

SEQ ID NO: 9480 - DNA, 101 bp, rice(Oryza sativa)
  misc_feature (71): n=t or c
ggcactatccgaatccattgcagcgaagtgagaggaatatcttcgaggaggataagtcaatgagcatgcgngtgccgccggtaagattgactggtaggatc

SEQ ID NO: 9481 - DNA, 101 bp, rice(Oryza sativa)
  misc_feature (71): n=t or c
ccgtcaacgcgctgctccggctgctccgagacgcggagcagcggtcggcgctggaggatgttaaagtatanagtagttagagttatattaggatagaattg

SEQ ID NO: 9482 - DNA, 101 bp, rice(Oryza sativa)
  misc_feature (71): n=t or g
taaagcacgcacacacacatatggatggatcagcagctatctgcacaagcaatagaaatacatcgccagcnagaacacgaactatctgcatcgatggcggt

SEQ ID NO: 9483 - DNA, 101 bp, rice(Oryza sativa)
  misc_feature (71): n=a or g
tcaggtccctcttggcgcttaggatggttttggccaaggtatctctcgttggacctagagttgtgtctggntccgatgacagcaagtgcggcagctgccag

SEQ ID NO: 9484 - DNA, 101 bp, rice(Oryza sativa)
  misc_feature (71): n=t or c
ggttagttcatttttcatttgcaaagtatctaggcttaaactctaatctatagtttgaaaagcgtgcgcgnggaaaacgagagagtaaaggggtacttcat

SEQ ID NO: 9485 - DNA, 101 bp, rice(Oryza sativa)
  misc_feature (71): n=t or g
ttctttgcagttatcctagagtctacagaaaagccaaaaaaaagttgtagtcgttagacaccttaacccanaccgtgtttagcctttgcatgatccttttc

SEQ ID NO: 9486 - DNA, 101 bp, rice(Oryza sativa)
  misc_feature (71): n=t or c
tccgagctccgccgcccaccgccgaccttcggtagccgctaaccgccactatggccgctgtctagcctcgncgctgccgccttcgcgatcgccggtgccgc

SEQ ID NO: 9487 - DNA, 101 bp, rice(Oryza sativa)
  misc_feature (71): n=t or c
gagtggcaagggagggaatacatgtactgctgttggaataaaggtgctggttcaaaacccaaaaccggcancttaatttctcttgtcaaccggcacctatg

SEQ ID NO: 9488 - DNA, 101 bp, rice(Oryza sativa)
  misc_feature (71): n=a or g
cttctgccacatgttctgtagagcagatagcatcacttgcagcatctatgctttgtcatgctggtggaatnaagttggttcgtcttctgtatgagcagatt

SEQ ID NO: 9489 - DNA, 101 bp, rice(Oryza sativa)
  misc_feature (71): n=a or c
atccttctttctagttttcaccctcattgttgctgctgcactttttggttctatactgaattagctatgtntaggttatacttctgtgatgcaaagtgagc

SEQ ID NO: 9490 - DNA, 101 bp, rice(Oryza sativa)
  misc_feature (71): n=a or g
taagttcattatattttatgcagtctaactagacagagctcagcaaaagctagtatatccggtttactatnttcaggttatgcatttgaaatcatatatga

SEQ ID NO: 9491 - DNA, 101 bp, rice(Oryza sativa)
  misc_feature (71): n=a or g
gttttcctttgtctcaaccatctgatcggctaaattttactcagctcttactctttccggaattgtatctncaggttctagccgatctcttctcttttgac

SEQ ID NO: 9492 - DNA, 101 bp, rice(Oryza sativa)
  misc_feature (71): n=a or g
gttttcctttgtgtcaaccatctgatcggctacattttactcagctcatactctttctggaattgtatctncaggttctagccgatctcttctcttttgac

SEQ ID NO: 9493 - DNA, 101 bp, rice(Oryza sativa)
  misc_feature (71): n=a or c
agctgcacgggtcaaattaagcaacataggcatgccattactatgtaggtactccctccgtttcaccttcngttttagattatatctaagattagatgaca

SEQ ID NO: 9494 - DNA, 101 bp, rice(Oryza sativa)
  misc_feature (71): n=a or g
tgcgcaattcaagagaaactctatcctcaccacctcgtgcatcactgatggcgatgatgagcgtcgttcantgttgctatgagttgacggggtcgtctgaa

SEQ ID NO: 9495 - DNA, 101 bp, rice(Oryza sativa)
  misc_feature (71): n=t or c
ggggcgcgctggggatacaggctatcctggaatatcttcaactttggtcgcgtttgcaatcattccagctngaggattgcctggatcgttttatttggaag

SEQ ID NO: 9496 - DNA, 101 bp, rice(Oryza sativa)
  misc_feature (71): n=a or g
ataaagacgaggtaaaacagacacgcctcttgtactggttgatacacagtgttttactgcaggttatatgnattaatacattttatacgttatagaaatag

SEQ ID NO: 9497 - DNA, 101 bp, rice(Oryza sativa)
  misc_feature (71): n=a or g
tgaaacatttttcattaagcaatcgaatatttttctcagtaatggaacatgtgaaatatttttcgttgaancaaattttaccatgtagtgaaatatttgga

SEQ ID NO: 9498 - DNA, 101 bp, rice(Oryza sativa)
  misc_feature (71): n=t or c
aaaaccggcagactttcaaactttggcaatttctcctattttaaataatcgagctaactagccaacagagntcttagataagcatagcatctcgaaatcca

SEQ ID NO: 9499 - DNA, 101 bp, rice(Oryza sativa)
  misc_feature (71): n=a or g
ttgatagtgtctgcattcttttaggtttaggatcctggtggaacaggaactttggaaaattttggaggttngagttgattgaaaagtatgtcatactttgt

SEQ ID NO: 9500 - DNA, 101 bp, rice(Oryza sativa)
  misc_feature (71): n=a or g
gggtgagcttgcaaagatgactctcaacggcttggagcagcctgacctcacctgctggctaatggatcgcnaagacccaaaatcgatgaccattgacatat

SEQ ID NO: 9501 - DNA, 101 bp, rice(Oryza sativa)
  misc_feature (71): n=a or g
tggcaattagaatgagcctggttttgagagcaatcctttgaggttttacaagtcaagggctgttgatcctnatcctagacacccaagagtgaactatctga

SEQ ID NO: 9502 - DNA, 101 bp, rice(Oryza sativa)
  misc_feature (71): n=t or c
gaataatttatatgtaactttacaattctaaaacacacacaaaaaaagggttaaagtgcgtagatatttcnaaacggctagcatgattaattgagttacaa

SEQ ID NO: 9503 - DNA, 101 bp, rice(Oryza sativa)
  misc_feature (71): n=t or c
gacctatcacgtgccgaccgactgataaactaatgaaccgaattgtacgcttagtacaccattagtcgatnaccccacaaaattagtctatcatccatcta

SEQ ID NO: 9504 - DNA, 101 bp, rice(Oryza sativa)
  misc_feature (71): n=a or g
agtagaccgtaggcaagaaaaggttctatgataatgactacaaagctgtagcggaagcttttagcagtgtnccgcaacaactagccatcctcgagccatac

SEQ ID NO: 9505 - DNA, 101 bp, rice(Oryza sativa)
  misc_feature (71): n=t or c
tctacgtaccattcgaatattgacctatcacgtgccgaccgactgataaactaatgaaccgaattgtatgnttagtacaccattagtcgatcaccccacaa

SEQ ID NO: 9506 - DNA, 101 bp, rice(Oryza sativa)
  misc_feature (71): n=a or g
tgatccttaatcgggtcaactatatactcaacctcctcattgatgatggccactggtaaaaaaaacccatntaggtgccagttagaaccaattggtgtcgg

SEQ ID NO: 9507 - DNA, 101 bp, rice(Oryza sativa)
  misc_feature (71): n=t or c
ccaattggtgccggctgggaaaccgacaccaattggttcctaactggcacctatatgggtttttttgtacnagtggccatcatcaatgaggaggttgtgtc

SEQ ID NO: 9508 - DNA, 101 bp, rice(Oryza sativa)
  misc_feature (71): n=t or c
ctggcctaaagcccaggacattactcccctatttttgagcagctcgtcctcgaggaattaaatccctgtcnaggaatcagtcagggcacacaaaacaacaa

SEQ ID NO: 9509 - DNA, 101 bp, rice(Oryza sativa)
  misc_feature (71): n=a or g
tgacggttggttccaacggtttgtcccctaagcaatcgagtgcaaatgttgcggacataatacagagcacngaccaaattacctccaatgaaacacataat

SEQ ID NO: 9510 - DNA, 101 bp, rice(Oryza sativa)
  misc_feature (71): n=t or c
catgaagttctggcctgtttctttttctttttactgcaaagcccagcccccacaccaacatctctcatagnagtttctgctcatctttcacgtagctccaa

SEQ ID NO: 9511 - DNA, 101 bp, rice(Oryza sativa)
  misc_feature (71): n=a or g
gtacatgtcggttctgaaagggtatgtctgtaacccagctcatcagaagggatcaataataatggggtacncaactgaggaggtggctggttgaatgctgt

SEQ ID NO: 9512 - DNA, 101 bp, rice(Oryza sativa)
  misc_feature (71): n=a or g
tgggggaaaaacgaagtttttagggttactctctgatctctaaatatttgaccaattaaacgaaaaaaaanaggaatggtgtagtatatgctgctcttcaa

SEQ ID NO: 9513 - DNA, 101 bp, rice(Oryza sativa)
  misc_feature (71): n=a or g
tcgtccctcggattattgaaattggacccgtatacctacatcagatgtgggtgtctgagaggtacatgtcngttctgaaagggtatgtctgtaacctagct

SEQ ID NO: 9514 - DNA, 101 bp, rice(Oryza sativa)
  misc_feature (71): n=t or c
ggctaggaaaccgacaccaattggttcctaactggcacctatatgggttttttttaccagtggccatcatnaatgaggaggttgagtatatagttgacccg

SEQ ID NO: 9515 - DNA, 101 bp, rice(Oryza sativa)
  misc_feature (71): n=t or c
cccgtatacctacatcagatgtgggtgtctgagaggtacatgtcagttctgaaagggtatgtctgtaaccnagctcatcagaagggatcaataataatggg

SEQ ID NO: 9516 - DNA, 101 bp, rice(Oryza sativa)
  misc_feature (71): n=t or c
ggcggcaaacaactgggcagcgtcggtgttaatttcgcccgcccgcccggtgcttatgtaaccatattatngcctgcggataatcgatattcccatgcggg

SEQ ID NO: 9517 - DNA, 101 bp, rice(Oryza sativa)
  misc_feature (71): n=t or c
tatactcaacctcctcattaatgatggccactggtaaaaaaaacccatataggtgccagttaggaaccaantggtgtcggtttcctagccggcaccaattg

SEQ ID NO: 9518 - DNA, 101 bp, rice(Oryza sativa)
  misc_feature (71): n=t or c
ttctaataatactaactctatacacgattgcacatgcacttatacagatttgttgtattagaaagtgacgngcaatcatgtatcatgtagcaacattttag

SEQ ID NO: 9519 - DNA, 101 bp, rice(Oryza sativa)
  misc_feature (71): n=t or c
ctacatgatacatgattgcgcgtcactttctaatacaacaaatctgtataagtgcatgtgcaatcgtgtanagagttagtattattagaaaaatagagaat

SEQ ID NO: 9520 - DNA, 101 bp, rice(Oryza sativa)
  misc_feature (71): n=a or t
gcactactgtacatcgataccgcttgtttattcgctgtgtaaaagaaatttcatccggtataatttttttnaaaaaaaagatgaacggtactatatttttc

SEQ ID NO: 9521 - DNA, 101 bp, rice(Oryza sativa)
  misc_feature (71): n=c or g
agggacctcagatgaacttattccactaataaacagagaaaaagaaatactaacaagccaacccatatganatgcggcccactactgaaaaggcccaacac

SEQ ID NO: 9522 - DNA, 101 bp, rice(Oryza sativa)
  misc_feature (71): n=a or g
gaccgccgcactgccgcttctctcccctcctcctccgacaataatcaatcgccaaccccaccgccgccccnaccattgccccctccgcggccgccgcatgc

SEQ ID NO: 9523 - DNA, 101 bp, rice(Oryza sativa)
  misc_feature (71): n=t or c
tatcgagaatctcatatgatggaactaaaaacatttaaagaaatacaaaatggagtaggatgaccaatccnagaataccatcaaacttattagtattgcag

SEQ ID NO: 9524 - DNA, 101 bp, rice(Oryza sativa)
  misc_feature (71): n=t or g
gcaaatcgcgcgctttaattaatttttcttagattaaaaaataatcgctgaatcttttggttgaataagcnctggctggcgtgtcggccgccctgcctccc

SEQ ID NO: 9525 - DNA, 101 bp, rice(Oryza sativa)
  misc_feature (71): n=t or c
agtgaaacgcaagagatcagttcgaattgagaaagaggagacgaagagatcgagtcggagaagcgtccctnggagaagcgtgggacgggacggacaggtca

SEQ ID NO: 9526 - DNA, 101 bp, rice(Oryza sativa)
  misc_feature (71): n=a or c
tcgttggcctcctctccgtcgccgacgaggagagaagcttcctgctgttcatcgtcgtcccgagagccccngcctgggatgacgtcacccacctgttcgaa

SEQ ID NO: 9527 - DNA, 101 bp, rice(Oryza sativa)
  misc_feature (71): n=a or t
aagtaaaatgctgattcacttgaaggcgtgagtaaaacttacctcacacaaaagctacctgcctacccccntctttttcttttagttgatccttgagtgtg

SEQ ID NO: 9528 - DNA, 101 bp, rice(Oryza sativa)
  misc_feature (71): n=t or g
atgcaggaagctttacatcacaatcgcttgcagtgacaagtaaacaatacacatcatgttcgcttcttttncaaagctgttatgccgctgccagttaattg

SEQ ID NO: 9529 - DNA, 101 bp, rice(Oryza sativa)
  misc_feature (71): n=a or g
gatgggatttatttttctattatgttaggctcttgtggaagctagtttagcttttgttttctttccgcacntcgaaacgagaaatatcattaacttatgac

SEQ ID NO: 9530 - DNA, 101 bp, rice(Oryza sativa)
  misc_feature (71): n=t or c
gtcaatgggaggttcactggcagcattcctcaaaatatttgggctttagatagacagggtaccaaacacgntggtagaaacggcgggtgacagtagcggag

SEQ ID NO: 9531 - DNA, 101 bp, rice(Oryza sativa)
  misc_feature (71): n=a or g
ttttttggtggattggttttgcaggcttgtagctttatagtatggggttgtttcacttacacgttttaacnagggattatttgcgaatttatagaccaaca

SEQ ID NO: 9532 - DNA, 101 bp, rice(Oryza sativa)
  misc_feature (71): n=a or g
ccattatacacgtgtctgtgttccgtactgttacttcacatgcgtccatgtatatttcataatagctagangatccaaacaaaagattcattgaaagattc

SEQ ID NO: 9533 - DNA, 101 bp, rice(Oryza sativa)
  misc_feature (71): n=t or c
cattctgaagatgatatgtttgaagaggaagaagaagaggaagattctgaaagtgatggcgctgagtatanagatacagatgatgaaagtgacatccaaag

SEQ ID NO: 9534 - DNA, 101 bp, rice(Oryza sativa)
  misc_feature (71): n=c or g
ggtactttgttcagtctgagtactattcaaaatttatatctgtgtcatactaattgtgtgggtagcctacnagagaggtgctatggtgcgggtttaatgtc

SEQ ID NO: 9535 - DNA, 101 bp, rice(Oryza sativa)
  misc_feature (71): n=a or t
tgctgttccttttgacttaatcagcaattatgctagagatttagagaaaacgatccaatgacacattgacnaatcaacattttttaactaatttctgggta

SEQ ID NO: 9536 - DNA, 101 bp, rice(Oryza sativa)
  misc_feature (71): n=c or g
cctttgtgttggcgaagatgtaatttatctttaagcttggctgtaaagccgttgcttcgttcgtctgtatnatatttgtaggacgtgtattctttgattat

SEQ ID NO: 9537 - DNA, 101 bp, rice(Oryza sativa)
  misc_feature (71): n=t or g
gaaaatggttcatgttgggggctgagtggaagctaggtagaggtgatcatatttatttttggcatgatttntgggttgggtcatgtcctctgaaagtgagg

SEQ ID NO: 9538 - DNA, 101 bp, rice(Oryza sativa)
  misc_feature (71): n=a or g
gttggcttagttattgtgtttcgatcctacagtagcaaatagcctcactgatatgcacctacattttctgnctttaagttaaagataaatagcaaggatgg

SEQ ID NO: 9539 - DNA, 101 bp, rice(Oryza sativa)
  misc_feature (71): n=a or g
ttagaccgacattcttcaggcagtcagtccggcgcttttacttcggccagaccgcgattcatcgaatttgngggtaacttttaattccgctaaaagttttg

SEQ ID NO: 9540 - DNA, 101 bp, rice(Oryza sativa)
  misc_feature (71): n=a or t
ttgcaggaagttcagaacattaaacaaaaggaggagaacgatgaatttgtgaaaaaagaggagaagcatgnagcacctgtaaaatctgaagaaagtttgca

SEQ ID NO: 9541 - DNA, 101 bp, rice(Oryza sativa)
  misc_feature (71): n=t or c
catcttggatttcagttgtctagtgcaccgtgctcttgtttctgtcgcgcgaggaagaagagaggataatnggttgttggaggatattttgcagattagat

SEQ ID NO: 9542 - DNA, 101 bp, rice(Oryza sativa)
  misc_feature (71): n=t or c
gcccataggcctattacaggtgatgcagcaacttgttccatcaattgcgcacgactgtgaaggcatttggngatgaggctggatccgtttgaaagaggact

SEQ ID NO: 9543 - DNA, 101 bp, rice(Oryza sativa)
  misc_feature (71): n=t or c
ggatccagcctcatcaccaaatgccttcacagtcgtgcgcaattgatggaacaagttgctgcatcacctgnaataggcctatgggcttgtaacttcgtttg

SEQ ID NO: 9544 - DNA, 101 bp, rice(Oryza sativa)
  misc_feature (71): n=t or c
ccactgtcatcgccaccgccgtgtgttagttgttgtcgggatctacaaaagcggaatcggctcactgccanggttctatttttgtagttttcagaagtttc

SEQ ID NO: 9545 - DNA, 101 bp, rice(Oryza sativa)
  misc_feature (71): n=a or t
atacctactcttaaatttttttatgtcggccttgactcagccgccccaatagaagcgacaaaactgctgtngttgcaagagttggattccttcaagaaagt

SEQ ID NO: 9546 - DNA, 101 bp, rice(Oryza sativa)
  misc_feature (71): n=a or t
ttttaatgactatttgtccttgtgagtaaggttgccattcctcggctgtattgcctttagcgtggctatangtctcccaagactaagaatacaaggaatgt

SEQ ID NO: 9547 - DNA, 101 bp, rice(Oryza sativa)
  misc_feature (71): n=t or c
gaacgagccttcaatcaactccgatgcccggaagacctagaccgttgtgctaagtcattgccttagatcgntgtgttagtttgcttgcttaagtttggttg

SEQ ID NO: 9548 - DNA, 101 bp, rice(Oryza sativa)
  misc_feature (71): n=a or g
tataggcagaagcattatgtgatgatgtggataaggtgcaaatggatcgtcctggtatggataaggtgtgnatggctgcctacttgtatattgtggatatg

SEQ ID NO: 9549 - DNA, 101 bp, rice(Oryza sativa)
  misc_feature (71): n=t or g
actaagccattgcaccagatgatagagtaaagtatgtttaacattctgacctagagattttgcaagatganttatggtttaattttggtgaaggtgcaaag

SEQ ID NO: 9550 - DNA, 101 bp, rice(Oryza sativa)
  misc_feature (71): n=t or c
tcattgtcattttcatagccttcatcatggcgttgcgaatattatgaatataccaatggatcaacctgcangccctaagtgtgcgcattcttaaaactcca

SEQ ID NO: 9551 - DNA, 101 bp, rice(Oryza sativa)
  misc_feature (71): n=a or c
tcaacaagttcagggaatgaactcagaaatgaaccggtaccacctagaatattaagttcaggtacatcccnggataagatcagaaaatactatagcaaatg

SEQ ID NO: 9552 - DNA, 101 bp, rice(Oryza sativa)
  misc_feature (71): n=t or g
cgtcagatgtttgcattatctgcctgacggccgcatatatatatgatctgctcgtccacgcatgtatttcncatctatagcatatcatcaaccacaactaa

SEQ ID NO: 9553 - DNA, 101 bp, rice(Oryza sativa)
  misc_feature (71): n=t or c
aggtgattcttgaatgtaaggtgctgctgctatttataggcagaagctttatgtgatgatgtggataatgngcaaatggatcgtcttggtatggataaggt

SEQ ID NO: 9554 - DNA, 101 bp, rice(Oryza sativa)
  misc_feature (71): n=t or c
taattacgtactgtccaactatagccttgtgaacaagataattaaattgagcagaagatgttctgttcttnctctctatatatacctattcaaagaataat

SEQ ID NO: 9555 - DNA, 101 bp, rice(Oryza sativa)
  misc_feature (71): n=a or c
tatgtactaaaaggtgtttttattctatttaggagggatcatatggaggttagtttatcaacattctaaantatcaatattgatgctcatgattttgttaa

SEQ ID NO: 9556 - DNA, 101 bp, rice(Oryza sativa)
  misc_feature (71): n=t or c
ggagtaaccaggtttggcacactgcttatgtggttggccaaacacttgcccgttgccgcaaaaggccgaangtgcctaacttgtttctggggaagtttggg

SEQ ID NO: 9557 - DNA, 101 bp, rice(Oryza sativa)
  misc_feature (71): n=a or g
ttccctctggcttctggaaaactgcctgttctggtgacaaaattagcttagccgattcttcttcaacctcntcaatatcggcttgcttgatcccaaactca

SEQ ID NO: 9558 - DNA, 101 bp, rice(Oryza sativa)
  misc_feature (71): n=a or c
agctagactcaatatgactcctctcatcctctattgatgcattattctttatctcattaagattggtctantaactctctccctgcgtcactttctctctc

SEQ ID NO: 9559 - DNA, 101 bp, rice(Oryza sativa)
  misc_feature (71): n=t or c
gactcctctcatcctctattgatgcattattctttatctcattaagattggtctactaactctctccctgngtcactttctctctcattctagtttgtgca

SEQ ID NO: 9560 - DNA, 101 bp, rice(Oryza sativa)
  misc_feature (71): n=t or c
atatgtactcgaaagtaaccagcccacaaatattttgtttagctagcctgcactgggcatgaattaagtanaattagattttataatcatttatctaaagc

SEQ ID NO: 9561 - DNA, 101 bp, rice(Oryza sativa)
  misc_feature (71): n=a or c
ctagactcaatatgactcctctcatcctctattgatgcattattctttatctcattaagattggtctactnactctctccctgcgtcactttctctctcat

SEQ ID NO: 9562 - DNA, 101 bp, rice(Oryza sativa)
  misc_feature (71): n=t or c
tccggttattcgtcaaacgtggatttcttgaagataccggtttctaaaagcaaggcaagtcactacgctcncttccttgagcatattgaacccagtttata

SEQ ID NO: 9563 - DNA, 101 bp, rice(Oryza sativa)
  misc_feature (71): n=t or c
gcggaggggggagctgtttgactctacctcggtttcgacatggtcagggcttggagttgcgatgtagctgngcatctcggtgtgggtgtcggtggcctcgt

SEQ ID NO: 9564 - DNA, 101 bp, rice(Oryza sativa)
  misc_feature (71): n=c or g
ttgtaccttaattagtgtgtagagatctggaggcggcagcgcagcatcgcaagctgcaggatttggattanatggatctatcaagaactgaagtatgaaat

SEQ ID NO: 9565 - DNA, 101 bp, rice(Oryza sativa)
  misc_feature (71): n=a or g
ctgaaacgaaaatcaggatgtgacaatagttttgatcaccattggagttgtgagtttttaagattctgctngaatgaggggataaggctgccatcaattgg

SEQ ID NO: 9566 - DNA, 101 bp, rice(Oryza sativa)
  misc_feature (71): n=a or t
gcctaatcttcatagcaatcaccatccgacaaattatctgcttctagaggattgggaaaaataaagcaagnctgagtacaaccaccgtactcaacaagtca

SEQ ID NO: 9567 - DNA, 101 bp, rice(Oryza sativa)
  misc_feature (71): n=t or g
acggtggttgtactcagtcttgctttatttttcccaatcctctagaagcagataatttgtcggatggtgantgctatgaagattaggcttgtgccagacgt

SEQ ID NO: 9568 - DNA, 101 bp, rice(Oryza sativa)
  misc_feature (71): n=t or c
aaaaaggcattgaatgatctattgtacaatgaggcaaagggctgtgagaaggatttcacattgttgtgganggtgcttgagcttatgagattgaaggccag

SEQ ID NO: 9569 - DNA, 101 bp, rice(Oryza sativa)
  misc_feature (71): n=t or c
tcttgacgaagagggagagaatcacggacggacgacatcgatcttgacgaagaggggagagcaccacaganggatgacatctcatcttggcgtgatgaaga

SEQ ID NO: 9570 - DNA, 101 bp, rice(Oryza sativa)
  misc_feature (71): n=t or g
tgctatattaaatataaataaataaaacatagttacaaggatgcaagaatttacaaaaagggaaaaagganaagtattaagtaaagttagctatccatgat

SEQ ID NO: 9571 - DNA, 101 bp, rice(Oryza sativa)
  misc_feature (71): n=t or g
tgcagaagtacaacaggttccagatggtacaactcaatcaagtgataaaggtgttgcagatggttttcaanggattcaaggtgatggctctcaaggggttc

SEQ ID NO: 9572 - DNA, 101 bp, rice(Oryza sativa)
  misc_feature (71): n=t or g
tatacctgaaatgctgtggggttggctaaattgttgaatgaaagcttgaagctgcgcttgcagagccgaanccccttctgccatcgcttgtgacacttggc

SEQ ID NO: 9573 - DNA, 101 bp, rice(Oryza sativa)
  misc_feature (71): n=a or g
ggcatgaacgtccctgcctgttgctacgtgacgatgttctttatcttgacagctacctcgtggagcttctnatccttgaatactacatccccctcaggggt

SEQ ID NO: 9574 - DNA, 101 bp, rice(Oryza sativa)
  misc_feature (71): n=c or g
cactccggcccacggcccacgcgcgcagcccccaccacgtcgtattcccttctttttttttgttttttttnttttttctccttttctgattttttttcgcg

SEQ ID NO: 9575 - DNA, 101 bp, rice(Oryza sativa)
  misc_feature (71): n=c or g
attgtccaaagcaaagcagcacgtaaattaaaagtctcctttgaggaagcatcatttgcttccacaccatnccacaattgcatcaactcatcaattaatgg

SEQ ID NO: 9576 - DNA, 101 bp, rice(Oryza sativa)
  misc_feature (71): n=a or g
tcccaaattatcggccattaatcactcacaatcaaccagttgcctagtcaatccccctcaatgcaccatcngctcagccgatggcaccagtatcggctccc

SEQ ID NO: 9577 - DNA, 101 bp, rice(Oryza sativa)
  misc_feature (71): n=a or t
taagtgcatcgattaacatggttttcatgttacctactgaatttggagccaaacacgctgatgttgatgangttgaggaagcatcagctaggttggttttg

SEQ ID NO: 9578 - DNA, 101 bp, rice(Oryza sativa)
  misc_feature (71): n=t or c
tgtagtatgcttgtatgctaattttcttatcttcttttttttgcgggaaatagcaggacaatctcctgcantgctatatatttttcatatgtcatatcgca

SEQ ID NO: 9579 - DNA, 101 bp, rice(Oryza sativa)
  misc_feature (71): n=a or g
tacaggagtcagctggccgtgccttgcttgctttgatgaccttgaagtttaaccggaaggaattggtcagngatgagaagagtgtgactaggttattgcac

SEQ ID NO: 9580 - DNA, 101 bp, rice(Oryza sativa)
  misc_feature (71): n=t or c
tatgtgcccatcggttagatcccttttctccgcacattagatcggttttctccatctcatcttgttttctncttctctattccctttggattcgtagcatc

SEQ ID NO: 9581 - DNA, 101 bp, rice(Oryza sativa)
  misc_feature (71): n=a or g
attgcggcgccagcgccggtggctccgcagtctcttctcctcgtccgtgtcgaacggtagcagtgacatcntcttcagcgcagggacgaacagagcaggca

SEQ ID NO: 9582 - DNA, 101 bp, rice(Oryza sativa)
  misc_feature (71): n=a or g
gtgtccttttaaaaatgtttatgggttcaaacctacttcaccaatcgatttgttacctcttccattgcagnaaagaactaacatggatgcttcgaagcgtg

SEQ ID NO: 9583 - DNA, 101 bp, rice(Oryza sativa)
  misc_feature (71): n=t or c
ttctcctttgatatcaaagattattttgatgaagagacagaagatgatcccaccagcaaagctctagctcncttgtccgatgacgtgaagaaaactcttga

SEQ ID NO: 9584 - DNA, 101 bp, rice(Oryza sativa)
  misc_feature (71): n=t or c
aagggaagtgcagggatgacgtgcgcaaacaagggctatcattcctgcaggtagaactccatggacggctngatgtggcgctgccccagctggtcacgcat

SEQ ID NO: 9585 - DNA, 101 bp, rice(Oryza sativa)
  misc_feature (71): n=t or c
taatgattacgggggcgaagatgtaatttacttatgaagtgaattgtatcgggttgtgaaccaaattcttngattattttttcgaagttaataaagaacgt

SEQ ID NO: 9586 - DNA, 101 bp, rice(Oryza sativa)
  misc_feature (71): n=a or g
tcatcatcttttgtaagctttgtacttttatttctcaagggtaaatcactcaccttaactccttgtaatcnttttactcgtagccgatcacttataaatat

SEQ ID NO: 9587 - DNA, 101 bp, rice(Oryza sativa)
  misc_feature (71): n=t or c
ataagtctctcatattggtccgcaacatcagccccgacgtgttcctcttcctcgctacctttgttgttagntgcaagcaatccaagtgtatcttcatcgaa

SEQ ID NO: 9588 - DNA, 101 bp, rice(Oryza sativa)
  misc_feature (71): n=t or c
ggaccaatatgagagacttattgtgcaacgtgtcttgagtgcacaaatgggcaaagtagagcagaaccagnggcataacctttttcagacgaagtgtgtcg

SEQ ID NO: 9589 - DNA, 101 bp, rice(Oryza sativa)
  misc_feature (71): n=a or t
ttgactaagctagctaattgaatccataggaatacttgactaagctagttaattgaatctataggaatacnctagccaatccagtgcccgaagcattggat

SEQ ID NO: 9590 - DNA, 101 bp, rice(Oryza sativa)
  misc_feature (71): n=c or g
cattggcacactatgtaacgaggaggccttcacagttggaaaacatgcaacttgatctcaagtagagtacnactcacttgttagctttactttagtatgtc

SEQ ID NO: 9591 - DNA, 101 bp, rice(Oryza sativa)
  misc_feature (71): n=a or c
taagcggcacgtagtgacaacccagtctatcctttgtatccctccatgttcggtacatcatagagctgacnggacttggcctgacaaaccaggggaggacc

SEQ ID NO: 9592 - DNA, 101 bp, rice(Oryza sativa)
  misc_feature (71): n=a or g
caccagattggccagagagtattcctatggattcaatgaactagctactctatccaatgcttcgggcaccngattggctagagagtattcctatggattca

SEQ ID NO: 9593 - DNA, 101 bp, rice(Oryza sativa)
  misc_feature (71): n=a or g
tgcaacttgatctcaagtagagtaccactcacttgttagctttactttagtatgtcagtttagtaatagtntgaggggaagctcggaaggagtgccccaaa

SEQ ID NO: 9594 - DNA, 101 bp, rice(Oryza sativa)
  misc_feature (71): n=t or c
catcctaattgggctaggatatcccagttgagcacacaacaaacgaatgtaactgctaacctagacaccangcctaagttattgattactattctagcctt

SEQ ID NO: 9595 - DNA, 101 bp, rice(Oryza sativa)
  misc_feature (71): n=a or c
tatgaattcaattaactagcttagtcaattataggattggctagagagtaggattggctagaaaggattcntatggattcaattagctatgttaatcaata

SEQ ID NO: 9596 - DNA, 101 bp, rice(Oryza sativa)
  misc_feature (71): n=t or c
agtttagtaatagtgtgaggggaagctcggaaggagtgccccaaagtatcggagttctctcctagaatttngagaggagtgttggatttgtcactattctt

SEQ ID NO: 9597 - DNA, 101 bp, rice(Oryza sativa)
  misc_feature (71): n=a or c
ccacttacggtcctcctggaaacaaaagggtccgccgtcgaggaaaatctttcctgtagtagtgtctaccnctaaaagagtaattagccgtaaatatgagc

SEQ ID NO: 9598 - DNA, 101 bp, rice(Oryza sativa)
  misc_feature (71): n=t or g
acaactctccctccagaaccgtgtagccagcccatccgacggatggatccaattacacataccaccccacntacacttttgttctcgcttcgtgtaaaaga

SEQ ID NO: 9599 - DNA, 101 bp, rice(Oryza sativa)
  misc_feature (71): n=a or g
actaggaaggtggtactaagcatacgcacagctcttatgggccacacaggtaaaatcttaattgggctacnatgttacagggactgaagaagttatcaagg

SEQ ID NO: 9600 - DNA, 101 bp, rice(Oryza sativa)
  misc_feature (71): n=a or g
acacaagccagatcctaattgagcgaagatgttacatacacccccatcaaaggacctgatgtctccgtcgntccaacataccctttatccacataggcata

SEQ ID NO: 9601 - DNA, 101 bp, rice(Oryza sativa)
  misc_feature (71): n=a or c
tgtaaccctgaccaccccatctccaggtctctgattttaacaagaccatgaaacatcttgggaagaacacnatcttgtaactttgctctaagatggaatgt

SEQ ID NO: 9602 - DNA, 101 bp, rice(Oryza sativa)
  misc_feature (71): n=t or c
taacatatcaaatagatcacaaacattttttactgacggaatacctgagtggattgcaagctaggaacacngcatggattaattgtattccctccgtccca

SEQ ID NO: 9603 - DNA, 101 bp, rice(Oryza sativa)
  misc_feature (71): n=t or c
acctcacaatctgtagtgaccacttgagcaaatgcgcgtggcacgctgttggtgtattcaggagcttgcanttcaaattccccagggtcatcattcaaatc

SEQ ID NO: 9604 - DNA, 101 bp, rice(Oryza sativa)
  misc_feature (71): n=a or t
gttatgtcattattgtgcactaatttagaacaattttacttgtatggatcattttggcccggttcgcaccnactagccaagttattatatcaaagtgagca

SEQ ID NO: 9605 - DNA, 101 bp, rice(Oryza sativa)
  misc_feature (71): n=a or g
tccaactgggtccgttgagcagtactcgatgagcatgtcatccattgcagaaagtgccgcggtatcctctnggagaagagcgaggttgttctctggttcaa

SEQ ID NO: 9606 - DNA, 101 bp, rice(Oryza sativa)
  misc_feature (71): n=t or c
tataataacttggctagtaggtgcgaaccgggccaaaatgatccatacaagtaaaattgttctaaattagngcacaataatgacataacagcatatacgta

SEQ ID NO: 9607 - DNA, 101 bp, rice(Oryza sativa)
  misc_feature (71): n=t or c
gatcgccggagaataggatgaaggaagtgagctagggtttttttttgtggggagcggagaagacgaagagngctagaaggcaggagagttttcttgcaaac

SEQ ID NO: 9608 - DNA, 101 bp, rice(Oryza sativa)
  misc_feature (71): n=a or g
tccactctgggatcttttctggctggtcctcaggaataacaaggacggggtccaagttctctatctggagntagaaccatctcgtttgccacttgctgcga

SEQ ID NO: 9609 - DNA, 101 bp, rice(Oryza sativa)
  misc_feature (71): n=a or c
tctcgcagcaagtggcaaacgagatggttctacctccagatagagaacttggaccccgtccttgttattcntgaggaccagccagaaaagatcccagagtg

SEQ ID NO: 9610 - DNA, 101 bp, rice(Oryza sativa)
  misc_feature (71): n=t or c
gaacgagaactcgataagttagaggaaacagatgcacttgaaacaaatttagaaatacgaggataaatacnccgaggagagacccgggtcacgtcatctgg

SEQ ID NO: 9611 - DNA, 101 bp, rice(Oryza sativa)
  misc_feature (71): n=a or g
gacccgggtctctcctcggggtatttatcctcgtatttctaaatttgtttcaagtgcatctgtttcctctnacttatcgagttctcgttctcgatttacag

SEQ ID NO: 9612 - DNA, 101 bp, rice(Oryza sativa)
  misc_feature (71): n=t or c
agaaaactctcctgccttctagcactcttcgtcttctccgctccccacaaaaaaaaaccctagctcacttncttcatcctattctccggcgatcctccggc

SEQ ID NO: 9613 - DNA, 101 bp, rice(Oryza sativa)
  misc_feature (71): n=a or g
cttctccgctccccacaaaaaaaaaccctagctcacttccttcatcctattctccggcgatcctccggcancaatggaccttgagaaatcttcctcgaaca

SEQ ID NO: 9614 - DNA, 101 bp, rice(Oryza sativa)
  misc_feature (71): n=a or g
cctgccttctagcactcttcgtcttctccgctccccacaaaaaaaaaccctagctcacttccttcatcctnttctccggcgatcctccggcagcaatggac

SEQ ID NO: 9615 - DNA, 101 bp, rice(Oryza sativa)
  misc_feature (71): n=t or c
ggtttagcagtccactctgggatcttttctggctggtcctcaggaataacaaggacggggtccaagttctntatctggaggtagaaccatctcgtttgcca

SEQ ID NO: 9616 - DNA, 101 bp, rice(Oryza sativa)
  misc_feature (71): n=a or g
agcagcacccacagcccggcctgcgtgcgccgccgtagctgctcctcgtactcgtccatctgccacgtcangtagaggaagaaccccacgatggcggagac

SEQ ID NO: 9617 - DNA, 101 bp, rice(Oryza sativa)
  misc_feature (71): n=a or c
agatctaggaaaatccttaaagcgatctgcaaggcagagcaaccgatggcagactgccgagtagcattccncagcgatgctgaaagcgccggccactccaa

SEQ ID NO: 9618 - DNA, 101 bp, rice(Oryza sativa)
  misc_feature (71): n=t or c
ttaaaaacatagggttcaaactataaaacttcagccgtttacatgtggacctatggacctaaatgcagttnatataaagcccagggacctttttgtatatt

SEQ ID NO: 9619 - DNA, 101 bp, rice(Oryza sativa)
  misc_feature (71): n=a or g
taaactgcatttaggtccataggtccacatgtaaacggctgaagttttatagtttgaaccctatgtttttnatcatttacaggacaaagtcctcatcttca

SEQ ID NO: 9620 - DNA, 101 bp, rice(Oryza sativa)
  misc_feature (71): n=t or c
gcgatgtgaagcctgtcaattccacagcaaacacacaaaactacctacacaagcgcttcaaacaatccctntgacttggccgttctcgtgctgggggctag

SEQ ID NO: 9621 - DNA, 101 bp, rice(Oryza sativa)
  misc_feature (71): n=t or c
gcaggttttgatgcatatcggcggtttgtagagcacataggatgtgaatgacatatatatgtgaatgggtntgtggatgtgaatgtgcatatgtttgattt

SEQ ID NO: 9622 - DNA, 101 bp, rice(Oryza sativa)
  misc_feature (71): n=a or g
tttgcaggttttgatgcatatcggcggtttgtagagcacataggatgtgaatgacatatatatgtgaatgngtttgtggatgtgaatgtgcatatgtttga

SEQ ID NO: 9623 - DNA, 101 bp, rice(Oryza sativa)
  misc_feature (71): n=a or g
tgcacaacctaacgacaaggaggaaattaccaagggagtttccgccttgcggcgatttccgagtacagacnagaatttcctcgccttagtcggagttttgc

SEQ ID NO: 9624 - DNA, 101 bp, rice(Oryza sativa)
  misc_feature (71): n=t or c
cgcgaacattaacgaacgtgaacgaaacgcgaacttgaacaaaatttaatgaaatgcgaacgaacgtgaangaaacgtgaatgaaacgtgaaagaacgtga

SEQ ID NO: 9625 - DNA, 101 bp, rice(Oryza sativa)
  misc_feature (71): n=t or c
ccggccatctccctcactccctttgctttccaccaccctcctcggttgcgcgttactcgggaacacactcngccgccaacgccatcattccccttcctccg

SEQ ID NO: 9626 - DNA, 101 bp, rice(Oryza sativa)
  misc_feature (71): n=t or c
ctgtcaagattggtattcccttaagtgttagacatatactttttttaagagagtttatatttgtgatcttnatatactaaattaattgttgattgggataa

SEQ ID NO: 9627 - DNA, 101 bp, rice(Oryza sativa)
  misc_feature (71): n=t or g
acatagaaggtagtgccaccgcatcgatctacgtgctgtggttggagtaggataagtggaagaatctgaanaagagagctaaaattccatgaccattgttg

SEQ ID NO: 9628 - DNA, 101 bp, rice(Oryza sativa)
  misc_feature (71): n=a or g
agtagcttcagtagaattttgtacatgtctctaatactgattactgattgcatacctgttcccttaggtcntaaaagaacttctcacggaatctactgcga

SEQ ID NO: 9629 - DNA, 101 bp, rice(Oryza sativa)
  misc_feature (71): n=t or c
ataatcgaccgaagaaacaaacccaaggcacatcatcaatggaaagttggaacaagaaccggagttcctgntcctatggtactctcaactctgagggcaag

SEQ ID NO: 9630 - DNA, 101 bp, rice(Oryza sativa)
  misc_feature (71): n=t or c
ggtactctcaactctgagggcaagcggatcccagaactggacatcatcagtgtatctcccggttttcaggntcattctggtgctagcatcaccctggctac

SEQ ID NO: 9631 - DNA, 101 bp, rice(Oryza sativa)
  misc_feature (71): n=a or g
attgaagaagggaggtgagcttccatcggagaagaaggatgattctgtgtcaacgattgctgagaagcctnacgatgacaagtcctcgggtgaggctacaa

SEQ ID NO: 9632 - DNA, 101 bp, rice(Oryza sativa)
  misc_feature (71): n=a or g
tcctctttctctgctcatgctcctcttagacccaaatcccgttgttggcgatgcttccctgctgctctccnattgggtcgacccatctgcgttcgccgccg

SEQ ID NO: 9633 - DNA, 101 bp, rice(Oryza sativa)
  misc_feature (71): n=a or g
ctttggattgaacaattcggtggatagacgtgtagactccagaagaagaggaaaggacgagaagaagaagnaaagaagagcaaaataaagcccaaaacaaa

SEQ ID NO: 9634 - DNA, 101 bp, rice(Oryza sativa)
  misc_feature (71): n=a or g
gattagctggcaaactgtctgcaaaccgaaggttgaggggctggtctcctggaattagaacgcttttccanggcattacatcttcgttggttatggcttaa

SEQ ID NO: 9635 - DNA, 101 bp, rice(Oryza sativa)
  misc_feature (71): n=t or c
atgccagttgggcagtttattttcatacttcgttccaggctacatttgtctccagggacagcgttgtttgngtttgtcaacaacactttgccccagactgg

SEQ ID NO: 9636 - DNA, 101 bp, rice(Oryza sativa)
  misc_feature (71): n=a or g
aactagactagaaaagagagtatggcccgaatggcatggccaaaatggtaagtcccactggtatagaaccnggcatcaaagtcgttcgcacatcactcacc

SEQ ID NO: 9637 - DNA, 101 bp, rice(Oryza sativa)
  misc_feature (71): n=t or c
ttaagtctggatttttgttcttcgatggcatttgggaggttggctaacttttgcttctccagatccagttnggcgttgcattcttcaagttaagctattag

SEQ ID NO: 9638 - DNA, 101 bp, rice(Oryza sativa)
  misc_feature (71): n=t or c
tttacgctccaccttgatccctacaatgtcaagctccactagtgtaccaactcatggaatctatctctgtnatttctatattactaaccatgtttataaac

SEQ ID NO: 9639 - DNA, 101 bp, rice(Oryza sativa)
  misc_feature (71): n=a or g
ggctggacaggactcggtttaaaggatatccaaaaggagcatgatttttcacttccatacactaaacaaangatgggtggccgaggccggatagaagatct

SEQ ID NO: 9640 - DNA, 101 bp, rice(Oryza sativa)
  misc_feature (71): n=a or c
ggatcacctccacaatgtataaatgcttctcaaggggcttaagaccctccttatttctacattgtgcatgncctaatcaacttgcccatgtatgtactttt

SEQ ID NO: 9641 - DNA, 101 bp, rice(Oryza sativa)
  misc_feature (71): n=t or g
ttattgtttgaacttgagaccatcacaaaaagcttccgtgctgactaccttcttggtgaaggagggtttgngactgtttacaagggctacatagatgagaa

SEQ ID NO: 9642 - DNA, 101 bp, rice(Oryza sativa)
  misc_feature (71): n=t or g
caacttcttctcctgaaactgccctcgattgagaagcctggaacatggccagtacgatctgacgaagcatnggtacatcctgacatgtgcacttctgcttc

SEQ ID NO: 9643 - DNA, 101 bp, rice(Oryza sativa)
  misc_feature (71): n=t or c
tgaatcatgaatgattagaagatagacaagtgtatatacctgtggggtgagggcgaggagaggcgagccangtccatccatgagcagcaggtcgccggaga

SEQ ID NO: 9644 - DNA, 101 bp, rice(Oryza sativa)
  misc_feature (71): n=t or c
cgacattgtgtccgagctggtcattaagtgccccttgaactatacgctggaaagtgtttccctcagttatnagtccaaacagcatcttaacgtagcagaat

SEQ ID NO: 9645 - DNA, 101 bp, rice(Oryza sativa)
  misc_feature (71): n=t or c
gtattttccaaaatagacctacaattaggctatcactagttgagaattcaggaagaagatattcccgaganagccttcaccactcggtatgggttgtttga

SEQ ID NO: 9646 - DNA, 101 bp, rice(Oryza sativa)
  misc_feature (71): n=t or c
atgcctcccttcttaggcactacttgaacagggctaacccactcattatatggcacgggatagataatccnggcatgtaggagtttcaagacttccttttt

SEQ ID NO: 9647 - DNA, 101 bp, rice(Oryza sativa)
  misc_feature (71): n=a or g
gcgcggctggagttggcgacggtggagaaaagagatggtgaatgtggcggcggcatttcggtgatggattngggacgaggagcggtagacggggtgcggtg

SEQ ID NO: 9648 - DNA, 101 bp, rice(Oryza sativa)
  misc_feature (71): n=a or g
gccttgttaagaccggtgaaatcgatgcacatcctccacttccgtatggcttctcgtatggcttgtttccngtctggtgcaaatctccgcagtttttgctt

SEQ ID NO: 9649 - DNA, 101 bp, rice(Oryza sativa)
  misc_feature (71): n=t or c
catcacttcctcaattggctcgggaacaggaagagctccgtcgaagaattggttgattgcaacataggganggaggtggcgattcttcctattttcaggtt

SEQ ID NO: 9650 - DNA, 101 bp, rice(Oryza sativa)
  misc_feature (71): n=a or g
ggcatgacggtcattgaaaactcgaacaatgagttgatcccacaacgaaccttcacaagatggaggatgcntattgactataggaaactcaacaaggctat

SEQ ID NO: 9651 - DNA, 101 bp, rice(Oryza sativa)
  misc_feature (71): n=t or g
gacgccggcccaacatatcagaatcctcaatgcgatattgagcgaaagccctttcgatcccgtcctgaacnctgatctcgatcaatggacagaacgactac

SEQ ID NO: 9652 - DNA, 101 bp, rice(Oryza sativa)
  misc_feature (71): n=t or c
gtagccgcgcaattgcgcgggccaccctgctagttaacttaatgagtaatagaaaaataaccttcacgttngctctcacaacataaaaattaccacgttaa

SEQ ID NO: 9653 - DNA, 101 bp, rice(Oryza sativa)
  misc_feature (71): n=t or g
ctttcacaaccttctgaatagataaaagcactcgggagactatgtcaaagatgatagaaacactcggcttnggagtaatctagctcgggagaaaattattt

SEQ ID NO: 9654 - DNA, 101 bp, rice(Oryza sativa)
  misc_feature (71): n=t or c
tagcaggtgtacgaacgtacgtatgtcccaattatctgctcatcttattgtgcgtaccattgcggtgattntaggactaccttcattctaaaatgtttgac

SEQ ID NO: 9655 - DNA, 101 bp, rice(Oryza sativa)
  misc_feature (71): n=a or t
gaggcgcctacaatgcattattgatttcattcacacacacacattctacattaggatctcatcatccaaantaaacactcatgtatagcagcaggatatag

SEQ ID NO: 9656 - DNA, 101 bp, rice(Oryza sativa)
  misc_feature (71): n=c or g
atatgtgagtggacgtgagtaagccaaaactcacatgtacactccaccttatcctcttccacaacaaaacnctcctcctatcctctacacgtgatgtaccc

SEQ ID NO: 9657 - DNA, 101 bp, rice(Oryza sativa)
  misc_feature (71): n=a or g
atgtttatccaatttaaccaaaccatgaaatgattaccttccagtgtcaccagatcctaatggttttactngcctaaaatgttttaaaccaatactttcac

SEQ ID NO: 9658 - DNA, 101 bp, rice(Oryza sativa)
  misc_feature (71): n=t or c
ggagatacaatttttcaccggttttcttcccaacaagaaaataagagattaaaaaagttgtgatccgtaanaactaattagattcctaatcaaaattggcc

SEQ ID NO: 9659 - DNA, 101 bp, rice(Oryza sativa)
  misc_feature (71): n=t or c
ctagtatatcggtaagtaaatcaagcgtcatttttttttaagttggagaagttaaatcagtttgagttttnaggtcagcctagcggcgaggcagctaatgt

SEQ ID NO: 9660 - DNA, 101 bp, rice(Oryza sativa)
  misc_feature (71): n=a or g
tcagatttcctgctagtatatcggtaagtaaatcaagcgtcatttttttttaagttggagaagttaaatcngtttgagttttcaggtcagcctagcggcga

SEQ ID NO: 9661 - DNA, 101 bp, rice(Oryza sativa)
  misc_feature (71): n=t or c
taattcaggcataaatactgcatcgtggtgccaaatactaaattaagtaaagagaaaaaatgttttacgtntgttttaattaaaatgacaaatttaaaagt

SEQ ID NO: 9662 - DNA, 101 bp, rice(Oryza sativa)
  misc_feature (71): n=t or c
gcccacccaaggcttttcttcctctttccaattaagccataaccaacgaagatgtaatgccctagaaaagngttctaattccaagagaccagcccctccca

SEQ ID NO: 9663 - DNA, 101 bp, rice(Oryza sativa)
  misc_feature (71): n=a or g
gcccgcatggttcgctcggtcgaacagtgggccgcgaggatctggttcaaaggtaagagagatagagcgantgttaaagacaaggtgtcgaaaggtggcga

SEQ ID NO: 9664 - DNA, 101 bp, rice(Oryza sativa)
  misc_feature (71): n=a or g
cccagaaaacccctcaatttcttaactgacacaggtacagcccaatctaatacatcctgtattttagaggnatcagtggaaacaccatgtactcctataat

SEQ ID NO: 9665 - DNA, 101 bp, rice(Oryza sativa)
  misc_feature (71): n=t or c
caccgcagaatcaagagaatttgagaagcaagagaggctctgataccagattgtcaggatctcaagaaatnaacaagagaaacaagaacacacaaggattc

SEQ ID NO: 9666 - DNA, 101 bp, rice(Oryza sativa)
  misc_feature (71): n=t or c
caaactagatctctggtctgggtaccaccaaatcaggatggcggccggagaagagtacaaaactgcttttnagactcactcaggacactatgagtataagg

SEQ ID NO: 9667 - DNA, 101 bp, rice(Oryza sativa)
  misc_feature (71): n=a or c
ttgttgcagaactgatacccctgcatccaccatttgcagttagtaatttcatgtgtgcaactcatagttcntccatcagcaatcctaacaatgagaggttg

SEQ ID NO: 9668 - DNA, 101 bp, rice(Oryza sativa)
  misc_feature (71): n=a or t
cgacttctcttcttgctcgactctggtgtgtctctgttggttgacttcttctcaacacccaccttgctctntccctcctttcatcttagcgcgtcgtctgc

SEQ ID NO: 9669 - DNA, 101 bp, rice(Oryza sativa)
  misc_feature (71): n=t or g
gatgtgtggccaatatgatgtaatgaggtcctttattatgtgttagctatgctctggaaagacaatgtgtntgatgagatatatgtatcagttgtgctatc

SEQ ID NO: 9670 - DNA, 101 bp, rice(Oryza sativa)
  misc_feature (71): n=a or g
aggtgggtattaattccttgatttgctttgtactgacttattttctgttgtgtcaacttccactacatctntctgattaaattttgcaattctgtttggta

SEQ ID NO: 9671 - DNA, 101 bp, rice(Oryza sativa)
  misc_feature (71): n=a or g
gccagcagatggtgttatcaaatacacaaggcagttctgctcacagcaagaagaggaaatctgtcagcctnactaccacaaacactacaagccaatccagg

SEQ ID NO: 9672 - DNA, 101 bp, rice(Oryza sativa)
  misc_feature (71): n=t or c
atgcacatatgtgcttctaaatgcatccacatagtaacaaggtgcaatatagtcatctagcttgttcgttntatagaatatgcatgatatagcatgagggt

SEQ ID NO: 9673 - DNA, 101 bp, rice(Oryza sativa)
  misc_feature (71): n=a or t
gtactacttagtactataagaagacttcatgtttgcgagtccaccctcatcgatgccaaaccatcaccaancaatgtagttataggttaacatcatcaacc

SEQ ID NO: 9674 - DNA, 101 bp, rice(Oryza sativa)
  misc_feature (71): n=c or g
cattatgcaaaattggttgatgatgttaacctataactacattgattggtgatggtttggcatcgatgagngtggactcgcaaacatgaagtcttcttata

SEQ ID NO: 9675 - DNA, 101 bp, rice(Oryza sativa)
  misc_feature (71): n=a or t
ttagtactataagaagacttcatgtttgcgagtccaccctcatcgatgccaaaccatcaccaatcaatgtngttataggttaacatcatcaaccaattttg

SEQ ID NO: 9676 - DNA, 101 bp, rice(Oryza sativa)
  misc_feature (71): n=t or c
ttgatgatgttaacctataactacattgattggtgatggtttggcatcgatgagggtggactcgcaaacangaagtcttcttatagtactaagtagtacta

SEQ ID NO: 9677 - DNA, 101 bp, rice(Oryza sativa)
  misc_feature (71): n=t or c
gcacgaagtgagcattccagtgccaaaaggcgtgcacgccgaatcccgggattaagagaagcactggtttnggattctggttggatttgttcgagtcattt

SEQ ID NO: 9678 - DNA, 101 bp, rice(Oryza sativa)
  misc_feature (71): n=a or g
ccgaaacggccgcggacgagcctgctgatgaccgcaccgagacatgcggctacacccccactccaagcccngaccatgtcgaaactggggtggagtcgaac

SEQ ID NO: 9679 - DNA, 101 bp, rice(Oryza sativa)
  misc_feature (71): n=a or g
aaagcgtaaccccttttccgggtacgaaacaatgtaagcatatgtaccaaaggcatcaaacagaataattngctaaacttggttcatctatttcatatatt

SEQ ID NO: 9680 - DNA, 101 bp, rice(Oryza sativa)
  misc_feature (71): n=t or c
gtcttgaaggcgaaggtagcgccactctgacgcatgctgtgtatatgcttagcgccatggatgtagtaagngtggagcaggagaaagcagctcatgatagg

SEQ ID NO: 9681 - DNA, 101 bp, rice(Oryza sativa)
  misc_feature (71): n=a or c
gccgaagattcgcgctggtgtcccacaagaccaaaggcatcttgggcaaagagtaaatggtgaagggtgtntgccgaaggaagaagactttgccataacaa

SEQ ID NO: 9682 - DNA, 101 bp, rice(Oryza sativa)
  misc_feature (71): n=a or c
aagttgtacttggacgaatgattgaacccgcgtatagagaaaaattattaattaaattaaattactacagnaatcaaatcacatgcgaaaaaagggaaaga

SEQ ID NO: 9683 - DNA, 101 bp, rice(Oryza sativa)
  misc_feature (71): n=t or c
cggttaccagtagcgagcaatcctttcctacaaggtaaggccatggacaaaggttttttatctaccccagngggggcagttttaggagtcttttcaatcca

SEQ ID NO: 9684 - DNA, 101 bp, rice(Oryza sativa)
  misc_feature (71): n=t or c
ggttcccagggttagggtattccctatattgagcctactcagatcagaacaaaacttttggattctctttngcctatcggccggctttaagcaaccttcac

SEQ ID NO: 9685 - DNA, 101 bp, rice(Oryza sativa)
  misc_feature (71): n=a or g
ggattattaatttaggcgatttttagggcgtgacagatatggaatgggtttcgaggatttccaagagcagnttgaaatctgtgttatggtttcaaggtttg

SEQ ID NO: 9686 - DNA, 101 bp, rice(Oryza sativa)
  misc_feature (71): n=a or g
atgaaatgctcttctttatatatcaacggtactttgtttagtctaggtacggttcttactttatatctgtntcgtaccgattgtgtgggtagcctaccaga

SEQ ID NO: 9687 - DNA, 101 bp, rice(Oryza sativa)
  misc_feature (71): n=t or c
cacacaaatagcctaagttctggatggaagtccacatgtcggcagtaagtgatactcaagaatttgagctnttcaagacatcaaataaagctaacttatga

SEQ ID NO: 9688 - DNA, 101 bp, rice(Oryza sativa)
  misc_feature (71): n=a or g
agcggcttcatctctcattggaagcgagttccaggtttcttgatatgttggaggaagacaggagtactcangaagtgctggctcgggattttgcacataga

SEQ ID NO: 9689 - DNA, 101 bp, rice(Oryza sativa)
  misc_feature (71): n=t or c
ttgttcgcgagaatggattcctcgtcaagtcagggggggggtgtggacacacttgcgcgaattcgggtaanggctacaagggataaaaataaaggaaactg

SEQ ID NO: 9690 - DNA, 101 bp, rice(Oryza sativa)
  misc_feature (71): n=a or g
aaaaagtgctggtaaagcttcaattgcaagtccactaccaacacaaattagtggccctttgctccgcatcnatgttgtagagctgcttcgacacaagggaa

SEQ ID NO: 9691 - DNA, 101 bp, rice(Oryza sativa)
  misc_feature (71): n=t or c
cgaagacgaggttctagacaaattatatgagcttgggtatctggatgcagctgtatgggctgaccagaatnaagttgagttgattgtgaagaatgaacagc

SEQ ID NO: 9692 - DNA, 101 bp, rice(Oryza sativa)
  misc_feature (71): n=t or c
gcacgctggaggaagaaggtggataattaggtgagttgggggcatgcgggggattgggtatccccttttcncaaaccctctccctcatttttcacacgcac

SEQ ID NO: 9693 - DNA, 101 bp, rice(Oryza sativa)
  misc_feature (71): n=t or c
tgaggtgcgaatcttcaggatcatttctacatctatcggccaaaagtgttcctgcactttatcaaccctcnaagttccatcatcctgtagcaaatccgaca

SEQ ID NO: 9694 - DNA, 101 bp, rice(Oryza sativa)
  misc_feature (71): n=a or c
gtggttgctcatatttctgtactatttgataaaacatcaacgttttctagtgcacactgcacagcagcatnatactgtagtctcagtttaaaatctttaag

SEQ ID NO: 9695 - DNA, 101 bp, rice(Oryza sativa)
  misc_feature (71): n=t or g
ggaggaggtgggggaggagaactcggccacaaagccttcagaacggatggagctttgtgccgtttcaacanggaggagacaggtaggtacgagttttatag

SEQ ID NO: 9696 - DNA, 101 bp, rice(Oryza sativa)
  misc_feature (71): n=t or g
tgtcgcagcactctttccgcctccaaaccactggagcagccgcagcaagcaacctcttcttcttgttcttncgccgcctcacaaatcacaatccccccggt

SEQ ID NO: 9697 - DNA, 101 bp, rice(Oryza sativa)
  misc_feature (71): n=a or g
gtcggggacgcggatgatcgcaagagcaccacaggcggcatctacttcctcgcacaaagtcccatcatctngcaatctcagaaacataaggtggtggcctt

SEQ ID NO: 9698 - DNA, 101 bp, rice(Oryza sativa)
  misc_feature (71): n=t or g
aagattgcattgatactagaaatgtactgcttttggatgtttgcatgatgctcatgtgctaatatttccanttaccaatgtggtgcttcttgagtttagat

SEQ ID NO: 9699 - DNA, 101 bp, rice(Oryza sativa)
  misc_feature (71): n=a or g
cgtgtaggccctacctaacgaggaacatgtgaagttgtgacccaaattgactatgtgatcttgaagagttntgtgattagacgacgtggatataaatattt

SEQ ID NO: 9700 - DNA, 101 bp, rice(Oryza sativa)
  misc_feature (71): n=a or g
tgcgagttgagttggggcgcaggagagcggcagaagcaaagtggcgaaaggaggggaagaaaaccccttcntgcgccctttatcctccctctgcacctcgg

SEQ ID NO: 9701 - DNA, 101 bp, rice(Oryza sativa)
  misc_feature (71): n=t or c
cgagaaatccatgaaaaatcgagggtaatctccgctcggtggcttcaaaaacttcgaatccttccccaatntcatcggctccgcagtttttttctcgaggt

SEQ ID NO: 9702 - DNA, 101 bp, rice(Oryza sativa)
  misc_feature (71): n=a or g
cttactaagtaccagctatacgatgggtgataacttttgattgatccctttcgaatatcttagctaacccnaaatcagaaatcttaggattataagcagaa

SEQ ID NO: 9703 - DNA, 101 bp, rice(Oryza sativa)
  misc_feature (71): n=a or g
agaattgcacgtagcgtaaaattctttttcaccttggcatcccatgtttcaactccttcagtgcatagctntttaagctcatcgatcagcggctgcaaata

SEQ ID NO: 9704 - DNA, 101 bp, rice(Oryza sativa)
  misc_feature (71): n=t or c
tcttccaccatcggatggcatttgacacaggaaagattaggacagagaaatctgagctgaagaacctcatnttcgcatcattcagaccattttatctgatg

SEQ ID NO: 9705 - DNA, 101 bp, rice(Oryza sativa)
  misc_feature (71): n=a or g
ctgttgcagcagcagagaggtctccacttccctttcctcccaccccgagaaagccaaaaaaagaaaaattntttttcaaaaaaaaagctcgcctcgccctc

SEQ ID NO: 9706 - DNA, 101 bp, rice(Oryza sativa)
  misc_feature (71): n=t or c
cgcacatgtggatggatggatgcaggccaatccacagataatttcactatcacaggacaacacatcagtgnctcctcatcagtgtcggttgataaaaccca

SEQ ID NO: 9707 - DNA, 101 bp, rice(Oryza sativa)
  misc_feature (71): n=t or g
agcagaatcacaaggatccagattttctaaggtaccattacattacaccaaacacggtcaaatcaattcangacttgcaatgtgaatcgtcaacacattac

SEQ ID NO: 9708 - DNA, 101 bp, rice(Oryza sativa)
  misc_feature (71): n=t or c
aatggattggctaatgaaacacagtccaatgtcagtggattggtctctgaaaactatcactttaagcttgnagggaactaccgtcacactgcaaggggtgc

SEQ ID NO: 9709 - DNA, 101 bp, rice(Oryza sativa)
  misc_feature (71): n=a or g
tgtagtgtagtatgatgtgattgatatgttcatctattttgagctgacagtaccgatatcgtaggatctgntgccaacttattctccagctgctttttttt

SEQ ID NO: 9710 - DNA, 101 bp, rice(Oryza sativa)
  misc_feature (71): n=t or c
aataaaggtgacacatccattgccgcgccttctatacttacgagtcacatactgtgatataaccaagttanaacttaatgccatcaacctcaaagctttta

SEQ ID NO: 9711 - DNA, 101 bp, rice(Oryza sativa)
  misc_feature (71): n=t or c
ttcttggtggcacacttatgctcctcgccgtcctcacgccttggcaaaagagcggcaacaagctcgacaangaccacgacgagggtgggagctcgggaagg

SEQ ID NO: 9712 - DNA, 101 bp, rice(Oryza sativa)
  misc_feature (71): n=t or c
ttatttcagtgggctaccgtttcttttccctagcccaactccttcccctctatctctttctctcccagtcnagacacccctatcctcttccctgtggggga

SEQ ID NO: 9713 - DNA, 101 bp, rice(Oryza sativa)
  misc_feature (71): n=t or c
gtatctgcgcgcggtcgagcacatcccccaagacgagcttcatcaccccgatagggtatattgctacatcnagaagccatttggcctccggaacgctggcg

SEQ ID NO: 9714 - DNA, 101 bp, rice(Oryza sativa)
  misc_feature (71): n=t or c
cctacgcgtagtgaatctgctctctgcttttgcctaattggaacagattttccgccgcttcgtaggctcgnagccaacactggcctctgcctctgaactct

SEQ ID NO: 9715 - DNA, 101 bp, rice(Oryza sativa)
  misc_feature (71): n=a or g
cactgctgatttccacattagctgccttctcttccatattatctctctctatatatagctaggcctgcctnaaggttgcaactggctatccagctagcatt

SEQ ID NO: 9716 - DNA, 101 bp, rice(Oryza sativa)
  misc_feature (71): n=t or g
cttgtttgtcctctggaagttgagtagaggaagagaggaacagacaacagaaacaagcaagcatcttggtngttgttttggatacatatacaaggttagtt

SEQ ID NO: 9717 - DNA, 101 bp, rice(Oryza sativa)
  misc_feature (71): n=t or c
tttattttactcggcctgcatagcggagaggtagcgagaatgctagatagatatctggagtcgtcgtcgtngtcgtcgtcgacttgtcatccatagccatt

SEQ ID NO: 9718 - DNA, 101 bp, rice(Oryza sativa)
  misc_feature (71): n=a or g
tttctttataaaatcacaatgcgaggcaaagccctggcagttattcaagtcaaaaaaaaattatgcaaatnatatgagggggtgatgattgaatatgctta

SEQ ID NO: 9719 - DNA, 101 bp, rice(Oryza sativa)
  misc_feature (71): n=t or c
taaagtgaagaaggacacccaaggtgcgatcgctaagtaccaagctcgtctcgtggcgaagggatatgtgnagcaagccaacgtcgactttgaggaggtgt

SEQ ID NO: 9720 - DNA, 101 bp, rice(Oryza sativa)
  misc_feature (71): n=a or g
aaacaaagggataaagaaaatgggaaaatggttgtctgaccaacctgataacatctcactacgctggatcnggtcacctctgacaggctcacacccttacc

SEQ ID NO: 9721 - DNA, 101 bp, rice(Oryza sativa)
  misc_feature (71): n=t or c
ttttttttttttttttgctgatgctagggaagcggttctgtaacattagccgattggcgtccgctatctgngacggattccaccatttgtcaataaattat

SEQ ID NO: 9722 - DNA, 101 bp, rice(Oryza sativa)
  misc_feature (71): n=t or g
gggattacgttcccgtgtccttcaatatgtgttagcaaggcgatatgaccgatcgccgtgccggttttgtngggggagcttaatctagggttgctgtttgt

SEQ ID NO: 9723 - DNA, 101 bp, rice(Oryza sativa)
  misc_feature (71): n=a or g
tgtatcgtcaaggatttcattcccatcaagtatagacattggaaaacaaatgatgtaacacaactcgactngacggtgccacataacctgaaggaagaatg

SEQ ID NO: 9724 - DNA, 101 bp, rice(Oryza sativa)
  misc_feature (71): n=a or g
gtaaggcaccctttttgaagatatataggatccatgtaatcaatacttccttttacattcagagtgtgtcnagtgatcccaccagaaagaagccttgacaa

SEQ ID NO: 9725 - DNA, 101 bp, rice(Oryza sativa)
  misc_feature (71): n=t or c
tgccgacgatagcaaccggatcgactacacgtgcatgggtgtgcgggaaggccatccaacacaacatcaanagggtgttgggcatcaagagcgtcgcgcta

SEQ ID NO: 9726 - DNA, 101 bp, rice(Oryza sativa)
  misc_feature (71): n=t or g
agagagagagtaaattggaaggagcagtagagtagagtggagtattcttcttcttctagttaaagaggagnagcggattcgagcttttagctaggggaggc

SEQ ID NO: 9727 - DNA, 101 bp, rice(Oryza sativa)
  misc_feature (71): n=t or c
gaaaagagtgggtcaaagaatgataggctctgaatgttcctgcacccataaagttcaagtgaagtcagcantttcaggcagtctggctggagccagctggg

SEQ ID NO: 9728 - DNA, 101 bp, rice(Oryza sativa)
  misc_feature (71): n=a or g
aagcgagatgagtgttccttcaggtatcaacaaccttaaagagcttacagaggtaacactatgctacaacntacggtacatcaacagccccaacattaaga

SEQ ID NO: 9729 - DNA, 101 bp, rice(Oryza sativa)
  misc_feature (71): n=t or c
tcctctgactttgcgaggttttcaggcagggatatcggtacaaatcttccaaatctattaaatggaattgntgctgagcttcctgcggacagaagcacgat

SEQ ID NO: 9730 - DNA, 101 bp, rice(Oryza sativa)
  misc_feature (71): n=t or c
tactaaaggtgctagatctagaaggttctcagtgctttggtgttaagaaccagcggtacctcaaggacatntgcagcaagatgttactgctcaagtatctg

SEQ ID NO: 9731 - DNA, 101 bp, rice(Oryza sativa)
  misc_feature (71): n=a or c
aaatccataatgtcttgatggtggggatttgactaagctcagcagggagggactgcagtttttcgcagcantaaaattctaggtcctcaatggaggtgaga

SEQ ID NO: 9732 - DNA, 101 bp, rice(Oryza sativa)
  misc_feature (71): n=a or g
cttgaaaatctccgtgaggtgcatctcaaagttagcgatggggcagaagcaataaccaagttcctagtaantgatttgaaggataatactgagaaaccaaa

SEQ ID NO: 9733 - DNA, 101 bp, rice(Oryza sativa)
  misc_feature (71): n=a or g
acttgtcaaagctttattttgatttgtactgatttctgtctccccactccttcagaactactcatccatcntaactgtccatccggagagcatcgatggaa

SEQ ID NO: 9734 - DNA, 101 bp, rice(Oryza sativa)
  misc_feature (71): n=a or g
aagaaatgacttcttcccagacttcgatgagaaggctaaacgaaaacaacgattccgggagtaaacagcantatccataaagagatgatcagcatgacctg

SEQ ID NO: 9735 - DNA, 101 bp, rice(Oryza sativa)
  misc_feature (71): n=t or c
gatcgatgcacttcagatggagtatgatcttctagccaaagaagtgccaaagaaggagaaagaggaggtgngccttgagaaaatcatcgttgaggctggtg

SEQ ID NO: 9736 - DNA, 101 bp, rice(Oryza sativa)
  misc_feature (71): n=t or c
ccgcacctcctcctccgcctccgccgccgccgccattgccttcggtgaagattttccttttttctttttcntttttcttttttttttcatctttttacgtt

SEQ ID NO: 9737 - DNA, 101 bp, rice(Oryza sativa)
  misc_feature (71): n=t or g
tggactaaccccgctccatcactctaattcactttttcagatcgctctaccccacaccgctcccatttttntttaatctggaccatttggttgggctcaag

SEQ ID NO: 9738 - DNA, 101 bp, rice(Oryza sativa)
  misc_feature (71): n=t or c
atcaaagaaaacaatgcactacatcaccttcacagtgtttccattatgtccagttgaggcatgaagtctcnacttgcagccatcactcctttgtgcgcatt

SEQ ID NO: 9739 - DNA, 101 bp, rice(Oryza sativa)
  misc_feature (71): n=a or g
gtcatgaacaccttagcttccttgtcctcatctcttcaatgttgaccaagggaggaatcaatgattgtccnccgatgaggtggaaggcctggcatagaggc

SEQ ID NO: 9740 - DNA, 101 bp, rice(Oryza sativa)
  misc_feature (71): n=t or c
tttgtggttgtgccccccaatctgagccctcactgagcacttcatacagaactgcaaagcaccagccaaancattgccaactagaacaacttcatctacaa

SEQ ID NO: 9741 - DNA, 101 bp, rice(Oryza sativa)
  misc_feature (71): n=t or g
aatcattcagtgagtgagtcagtcaatcagtccacaagcaaccaaatcactccattaaaaaaaaagaaganattcacaagcgcgcacacgcaggcagcaag

SEQ ID NO: 9742 - DNA, 101 bp, rice(Oryza sativa)
  misc_feature (71): n=a or g
acagttttttttttctgttaccagaaaagatatatggagcttactaaaggcgcagctgacaattatcatcnctcttggtggaaaagacatggagttgtgct

SEQ ID NO: 9743 - DNA, 101 bp, rice(Oryza sativa)
  misc_feature (71): n=a or g
tatgttcttctttcatgtatggtgattttcctgattgaaggttgaactccccgagcacgtccgcgatttcnctggagttgctgggccatcggctgcacatt

SEQ ID NO: 9744 - DNA, 101 bp, rice(Oryza sativa)
  misc_feature (71): n=a or g
acattcggttttgcatcaatgagaaggagaagaaattcaagttcaggccgaggatggagcaatgctcaatngtcaagatcaagtatgagccgaatccacaa

SEQ ID NO: 9745 - DNA, 101 bp, rice(Oryza sativa)
  misc_feature (71): n=a or c
tactatcaatagtttattccagcctgctatgcttgtagaaaacgagttgcaggaacatcaacgaaagaacnagagaaattttggcacatcctgcatgccaa

SEQ ID NO: 9746 - DNA, 101 bp, rice(Oryza sativa)
  misc_feature (71): n=a or g
ccagccatatcataccacttgtgttttctgcctcttcgcattatattccccactcgattcatcctcgaacncaacacactcataagtcatgcaactctcat

SEQ ID NO: 9747 - DNA, 101 bp, rice(Oryza sativa)
  misc_feature (71): n=t or c
ctagttacaatatatgccgcagcttggcgtgattgaaaacttcctgtgatttcttagctgcaacttattgntgctaataatagtttggatatctgtcctct

SEQ ID NO: 9748 - DNA, 101 bp, rice(Oryza sativa)
  misc_feature (71): n=a or g
cttcctgccgtgaatttatggctgatggcaagtaatcagtcactgtgtgggatgtggatttttatcccttnagagaacatttaattttatattaatattaa

SEQ ID NO: 9749 - DNA, 101 bp, rice(Oryza sativa)
  misc_feature (71): n=t or c
tcccaagaggcatagcaagaggatcattagagatgcggtgtcgatatctatgaaggctcagaagaggacanaggcgaagaatgatatctcagataaaaata

SEQ ID NO: 9750 - DNA, 101 bp, rice(Oryza sativa)
  misc_feature (71): n=t or c
tacactagctcttcttcacaacagctaatcgagtagctagaaccattatatactcttctctcgacgctttntgtgctaggttaaccgatccatcttctggt

SEQ ID NO: 9751 - DNA, 101 bp, rice(Oryza sativa)
  misc_feature (71): n=t or g
aaatgatttgagttttccagatgaaattgtaagcacgcaagcaattgaacgcgagattttagggcggtatntgcaaacaatattacgcggtaacaaaaccg

SEQ ID NO: 9752 - DNA, 101 bp, rice(Oryza sativa)
  misc_feature (71): n=t or c
cataaaagacgggatgcaacagagaaaggaattatgtagaggggccttcgattgctctaacttgtctcggntttagcgtccgactcctgggattttccggc

SEQ ID NO: 9753 - DNA, 101 bp, rice(Oryza sativa)
  misc_feature (71): n=a or c
tcttcaagaaatcattagcaagacatggctgatccatttctgggaaaggtgaagtttcattccgtaccacnataggcctttcaactgatgtatctccttca

SEQ ID NO: 9754 - DNA, 101 bp, rice(Oryza sativa)
  misc_feature (71): n=t or c
gtcggaaactatccgggactttttgccggatatccgcagctccccatagcctaatagcccaaatatttttnggcccaagtccatagccaggttaaccctag

SEQ ID NO: 9755 - DNA, 101 bp, rice(Oryza sativa)
  misc_feature (71): n=a or g
gtctactagaccagcatgactacaagctgagagtagagcaacaaacgttacatagtctggctttctacccnttgcaaccatttgcttaaatgtttcctcag

SEQ ID NO: 9756 - DNA, 101 bp, rice(Oryza sativa)
  misc_feature (71): n=t or g
gcggcgaccaagaagcggatgtcctccaggagcttgcccaggtcttcaagacgagaagaggggagaaactnagaaagagagagagagatggtgtgtgatga

SEQ ID NO: 9757 - DNA, 101 bp, rice(Oryza sativa)
  misc_feature (71): n=a or c
gcgctcacgccgtgcctgtaagctttcaattgggccgtatattcattctagtaatggatacggcccagccnggtatcagatttcaattgggtcggaatatg

SEQ ID NO: 9758 - DNA, 101 bp, rice(Oryza sativa)
  misc_feature (71): n=a or g
ctctcccactgagctccctccctccctcactctttcccccacaaattccaaagagaagctcacacgaaccncgcctaaaaacctcaagcggcctccgcgaa

SEQ ID NO: 9759 - DNA, 101 bp, rice(Oryza sativa)
  misc_feature (71): n=t or c
caggcctcgtgtttttcgtcaacagataggttcttcagatatgcaacaatctcgttcctccaatcatccgngtcaacatttgcaatcccaattaggcaaac

SEQ ID NO: 9760 - DNA, 101 bp, rice(Oryza sativa)
  misc_feature (71): n=t or c
aatccgaacgagttcgacaacgccacctttacatcacatctctctttttgtgatcccactagaatgctganatcctacatcaatattgaaaccacaagcat

SEQ ID NO: 9761 - DNA, 101 bp, rice(Oryza sativa)
  misc_feature (71): n=a or g
cacatatatatatgcatacagatacagtcgtcgtgcgatcagctcgcctgagctccgtattcagattcagngatcaccatctggcgcctagccatgacggg

SEQ ID NO: 9762 - DNA, 101 bp, rice(Oryza sativa)
  misc_feature (71): n=a or c
atccatatcagaagcccatttcccttgagcaagagcttggcttggtggacttgatgattgatggcaatganaaactgtatgaagacatgtgctctggagtt

SEQ ID NO: 9763 - DNA, 101 bp, rice(Oryza sativa)
  misc_feature (71): n=t or c
atactcacactttgataggcgggcgcgatatgaccacaataacctgcaaatcctcatgctcatcagaattncaaacctgcgataaaaaatcgaaacataat

SEQ ID NO: 9764 - DNA, 101 bp, rice(Oryza sativa)
  misc_feature (71): n=t or c
agctttgtttcgagatcggcgatggcttgattcagatcggagatctgcttctcactgctaatggatgcttntgatttctcggcgtggagttgctggagctg

SEQ ID NO: 9765 - DNA, 101 bp, rice(Oryza sativa)
  misc_feature (71): n=t or c
ttgttccagtcaatctcatcataggggtcattgtatagttcacttcttagctctagcacaactggtgttantgggccaacaaacctttttccataaatgta

SEQ ID NO: 9766 - DNA, 101 bp, rice(Oryza sativa)
  misc_feature (71): n=t or c
ccccgctatagatgatatgaacttgctgtctcaaaagatgggctacctcaactcaagcagcaccaaatcgncacagtagtagctctggtctgatcttgctg

SEQ ID NO: 9767 - DNA, 101 bp, rice(Oryza sativa)
  misc_feature (71): n=a or g
tttgcatgattgtatgcttaacaggcaggtctcaatatcatcagtcctgaatcagtcttacaagaagatgntggaaaagctaccgaggacaatctacaggg

SEQ ID NO: 9768 - DNA, 101 bp, rice(Oryza sativa)
  misc_feature (71): n=a or g
gatgatatgatgttaaaattaattacaggagcagttaatttactactagtctctaacccgtacattgcacnagttacgtttggatatttctttaagtggga

SEQ ID NO: 9769 - DNA, 101 bp, rice(Oryza sativa)
  misc_feature (71): n=a or g
gtggaaactgagatgatgggtgacgaaccacggtcaatgttgtagggggttctaggcaaaagcctcgcccnatgttgcactggggcggcaacaattacacc

SEQ ID NO: 9770 - DNA, 101 bp, rice(Oryza sativa)
  misc_feature (71): n=a or g
aaatgagacggaggagtaactatttaataccaccacttacgggtaatagctataactttttctactcgtgntataacatagaaatcaacagttaacatcat

SEQ ID NO: 9771 - DNA, 101 bp, rice(Oryza sativa)
  misc_feature (71): n=t or c
ggtgggcaacccctctcactaaactgaacaccagaacccaacttagaaccgtttcctgaatcatcaagacnagcttccttcccaactttctgatttatatt

SEQ ID NO: 9772 - DNA, 101 bp, rice(Oryza sativa)
  misc_feature (71): n=a or g
ttcttggagccaattgacaggttcgaagtattcactgtttgttcatcatctttagtttctacattgttggncccaaacatatgatctaaaatagtcttaca

SEQ ID NO: 9773 - DNA, 101 bp, rice(Oryza sativa)
  misc_feature (71): n=a or g
aaggtattgtcctgaacctactccaccagattttcaaggaatgagagcgcttgttgttgacggaagatgtnctcgtgctgaggttaccatgtaccatctgc

SEQ ID NO: 9774 - DNA, 101 bp, rice(Oryza sativa)
  misc_feature (71): n=t or g
agtcagcgcggaggacgagctcctaaaacctccgagagaagaggtggaatagcaaatgttaccgtcggtgncgccggcctcggcggcggtggagaagacgc

SEQ ID NO: 9775 - DNA, 101 bp, rice(Oryza sativa)
  misc_feature (71): n=t or g
ccaacactagcatcactctttttgcagattgcctatatgcgctatgcgaatctgaccttccctactccatncacatcaacccagccaacggagaagtcacc

SEQ ID NO: 9776 - DNA, 101 bp, rice(Oryza sativa)
  misc_feature (71): n=a or c
attgccacgcgttggaaggaatattgaaggacgaggaagagcggatgacaatttggtctcagatagtattntagcgtgctgttcacaggttgagaatggta

SEQ ID NO: 9777 - DNA, 101 bp, rice(Oryza sativa)
  misc_feature (71): n=a or g
aaggttcaaaatgcaggtaataggagatccacgcttttaggtttggatgataagctgagggagaagagtangaggataagccgatcggattctcacaggtt

SEQ ID NO: 9778 - DNA, 101 bp, rice(Oryza sativa)
  misc_feature (71): n=a or c
ccacccttcactcgcgggcagcaatgataggtcttccaacctagccaagcaggagaaggagaaggggacgntgggatgacaccaccacaaagccacaccgg

SEQ ID NO: 9779 - DNA, 101 bp, rice(Oryza sativa)
  misc_feature (71): n=a or g
gcggaggtgcaggaagccgaggtggcattggcaaatgcagcacacggccatcccaaccgtccagtccttcnaactgatagggcatatgagaggatgatgcg

SEQ ID NO: 9780 - DNA, 101 bp, rice(Oryza sativa)
  misc_feature (71): n=a or c
attgagcgattgtggcacaatgtgaaacatgatagcgggcgctctatcattcgtcttacagcagttgcagncaaggcattgccaaggtggggagggggcag

SEQ ID NO: 9781 - DNA, 101 bp, rice(Oryza sativa)
  misc_feature (71): n=t or c
cgtgtggacgtgtactactctagttggtgcatccgtccaggtaattttgcagttccatcgctccattttgngggatgacacattttgtgaggccaatgaat

SEQ ID NO: 9782 - DNA, 101 bp, rice(Oryza sativa)
  misc_feature (71): n=t or c
gggagaacaataccaacaagaatatccagacctgaaaatgaatgaccctgcatttagtttgcacaaggagnctggaattgttccattcagttggttgcctg

SEQ ID NO: 9783 - DNA, 101 bp, rice(Oryza sativa)
  misc_feature (71): n=a or c
gaagcacttctaggctcagaagaatgcaaatgcagtaccaccaagcaccactaagagatatctggaatttntaatagattgggaggtattataggaggttc

SEQ ID NO: 9784 - DNA, 101 bp, rice(Oryza sativa)
  misc_feature (71): n=a or g
ggacgatgcaccgttctccatggagccatcgagcgatgcaagtatgggggaggtggtgggatccacttttngctagtggaggaggctggtaacatttgacc

SEQ ID NO: 9785 - DNA, 101 bp, rice(Oryza sativa)
  misc_feature (71): n=t or c
tactcggcgtcccgcagcactgcacatggtaagccgaggaggccgtgtaatgcccgttgtttgtgaacttncaaataatctgatccggttctccaacgtct

SEQ ID NO: 9786 - DNA, 101 bp, rice(Oryza sativa)
  misc_feature (71): n=t or c
atctagttacccaagaatgagaggaagaaaatgcctgcaaatcaactagtttcaatgtgtacctatgtttntaaccttcctttatctgtcccgtggaccca

SEQ ID NO: 9787 - DNA, 101 bp, rice(Oryza sativa)
  misc_feature (71): n=a or c
tctctgcctctctggtctaaaatggtagcaacgggctcttttaatttgatttgcaggaaaccccaatccgnaaacaatcatcgacatgaaggcattggttg

SEQ ID NO: 9788 - DNA, 101 bp, rice(Oryza sativa)
  misc_feature (71): n=t or c
cgatgtcatacgacagatccctgacgtccctagcccagatcttgacttggcggtcaggcggttggtcgatnggcgcctcagaaaccttgaggagtgcagcc

SEQ ID NO: 9789 - DNA, 101 bp, rice(Oryza sativa)
  misc_feature (71): n=t or c
ctacctgatttcaagcaaaggcttgatcagaattaatccatttaattctgctctgccttgcaaggaacttngcctgcaggcttctccatggattccaactc

SEQ ID NO: 9790 - DNA, 101 bp, rice(Oryza sativa)
  misc_feature (71): n=t or c
ggtgatgaagttgaacactcctcaagtggttcttccataaagactatatcatcatcacatttggacttgtngcatctctccttaagcgtggtccaaatgag

SEQ ID NO: 9791 - DNA, 101 bp, rice(Oryza sativa)
  misc_feature (71): n=a or g
gtgatacctttgattatgccaagcctcatagcccaacctatagtaggtgtgttatcctgatcatgtaagtncttatcgaggctgccattgggcatatagtc

SEQ ID NO: 9792 - DNA, 101 bp, rice(Oryza sativa)
  misc_feature (71): n=a or g
cacgctgcccctgaatccgcaccatggatttgaccgctggcgagctcttcgactccagcacaacagatccnactcccgcgagcagatgaggtctccgatga

SEQ ID NO: 9793 - DNA, 101 bp, rice(Oryza sativa)
  misc_feature (71): n=t or g
ctagcatccagcatggtctgacaaatgagatccggaaccgtagtaccaagaaaaatcttcaggttgcaaangcgctatccgaggatactttcattgtaaga

SEQ ID NO: 9794 - DNA, 101 bp, rice(Oryza sativa)
  misc_feature (71): n=t or c
gtcatgccttgtgcggcagaactccacgaggcaggaattcatttcaagttgagtgatagaaagggatttgnagggggggtcagctttgaaggaggtgtact

SEQ ID NO: 9795 - DNA, 101 bp, rice(Oryza sativa)
  misc_feature (71): n=a or g
agtggatttctcgaataggtcaagtaacctaaaggctcggttcttggcatcaaccaaatctagagcagagnacatctccttgacaactagctcagcccatt

SEQ ID NO: 9796 - DNA, 101 bp, rice(Oryza sativa)
  misc_feature (71): n=t or c
tcaaataggtatattggccatttgaaggaaagaagactcaaggaccagatggaaaaagacccaactgaagnaattcgcaaagctgtcatgcgcatgcttcc

SEQ ID NO: 9797 - DNA, 101 bp, rice(Oryza sativa)
  misc_feature (71): n=t or c
aagcgcacctaaaccgtaatgtggactttaaagttagggggaatatgattctcttcatgtgcacctaaacngtaatatgcagtgaaacgaacgctatgata

SEQ ID NO: 9798 - DNA, 101 bp, rice(Oryza sativa)
  misc_feature (71): n=a or c
agcttgaggaccttagcaagcgtatacttgacagaaaggtcaacaatgagaagactgtctgggagaagcancaagagaaaatgaaagagaaacgtaaatct

SEQ ID NO: 9799 - DNA, 101 bp, rice(Oryza sativa)
  misc_feature (71): n=a or g
tactcaatactgtaatcgaactccattaatttcatcaatagtttgtgctgaataccttctgttaatctctnggttgccatgaacttcaaactttgctgatc

SEQ ID NO: 9800 - DNA, 101 bp, rice(Oryza sativa)
  misc_feature (71): n=a or g
ctgccttgtcttcaacttcaagatcccatctcgcttcacttcacttccgtgcaagttttgattttataganaacagtggcagcaactgacttgtaaatttg

SEQ ID NO: 9801 - DNA, 101 bp, rice(Oryza sativa)
  misc_feature (71): n=t or g
ggcttgctcacaaatgcaagattcagtggagagggactcaagaagttgttggtctagctcatcaggacganaatgcactgtattacgtggattattttcac

SEQ ID NO: 9802 - DNA, 101 bp, rice(Oryza sativa)
  misc_feature (71): n=t or c
ctgctttgatgcaaaaagaaaagtctatataagcactacagaaacactaacctgtttctcaaggttgcctntatgtttgaaatttgaaggtgatgataaac

SEQ ID NO: 9803 - DNA, 101 bp, rice(Oryza sativa)
  misc_feature (71): n=t or c
ttatttcggcctgtcaattctctgtgatcaccatcccatgtcaagggcaagctctccctaatagccaccanggcaggagctagtgccaatatcgatgaggg

SEQ ID NO: 9804 - DNA, 101 bp, rice(Oryza sativa)
  misc_feature (71): n=a or c
tgttgaacacggcggtggcgtgctggagctcatcagcaagcctcatattttgaaagctcaagtatcggtgntgtactgttggaatagcaggaacaaccggg

SEQ ID NO: 9805 - DNA, 101 bp, rice(Oryza sativa)
  misc_feature (71): n=a or g
ttttagtcatttgtttaattaatcccgtctcctcattcgtcgccgccctcgcattttagcatcgtcgtctngctcttgctgtgcgagcgacggcacctcgg

SEQ ID NO: 9806 - DNA, 101 bp, rice(Oryza sativa)
  misc_feature (71): n=a or c
atgaatccttgtataattaaattccatgatactgtatctggatctggcatttcccagaacagtttctctgnttctttcatatctgacgcttgagtataccc

SEQ ID NO: 9807 - DNA, 101 bp, rice(Oryza sativa)
  misc_feature (71): n=a or g
tttcctttatggaatgaatgtgtgcggtgactttcaatgtaactttctgggtcatagtggtaggccaagcngtataactaaacgccagcccacgagcttgg

SEQ ID NO: 9808 - DNA, 101 bp, rice(Oryza sativa)
  misc_feature (71): n=a or g
cttggtacctcctgaattagtgggaaattaaaagaatcatgttacattaattcatgcagctatgggtgccngggctggggagccgtggttctacttccgcc

SEQ ID NO: 9809 - DNA, 101 bp, rice(Oryza sativa)
  misc_feature (71): n=a or g
cttcacaatgattgtttttccccttacaaaaaactcatcataaaatttgtgaagtgcgaggggtatgaagnaaaatacatcttaacccgaggttgtccgtt

SEQ ID NO: 9810 - DNA, 101 bp, rice(Oryza sativa)
  misc_feature (71): n=a or c
ccaaccctcatcgctgtaagtagtcttgcagtaaaccttgacaattttcttgcagtattgacaatcactgncttttacatttcccagtggcccctgtggcc

SEQ ID NO: 9811 - DNA, 101 bp, rice(Oryza sativa)
  misc_feature (71): n=t or c
ggacttccccatctgaaaattcaggtcaggatcctgtgtagttgccacttaaacatttgtatgtgcatcgnatgatcttggtccggtttagtttccctgtc

SEQ ID NO: 9812 - DNA, 101 bp, rice(Oryza sativa)
  misc_feature (71): n=a or g
tggacttgggggtctagaacaggatcctggactgatgtcatcctagctgaagggagaggtgtggccatctnctgaggtagaattagttgtcctgggttttc

SEQ ID NO: 9813 - DNA, 101 bp, rice(Oryza sativa)
  misc_feature (71): n=a or g
tgcaattattggtaactaacagcacatttattctttcttgatgcaagatggacgggggagggggggcaagngacgccgacttacccagcctttgaggagta

SEQ ID NO: 9814 - DNA, 101 bp, rice(Oryza sativa)
  misc_feature (71): n=t or c
gcggtgaaacgcatcttgtgttacgttgccggcacggttgatttcggctgctactacaataggatggagangccacctgagcttgtcgggtactgtgacgc

SEQ ID NO: 9815 - DNA, 101 bp, rice(Oryza sativa)
  misc_feature (71): n=a or g
attttttttattcttgggcaccccgggagtgcacatgttaaatcgtgtacggattgattgatacagtttgntctatttattgaaatagaagctagatgata

SEQ ID NO: 9816 - DNA, 101 bp, rice(Oryza sativa)
  misc_feature (71): n=a or g
ccacatctcggactcgataatgacagtttttcttagtgatcgggtgaaaaggttcaatgctaatgctgccncaggtattgacattgacctgaaaaagttag

SEQ ID NO: 9817 - DNA, 101 bp, rice(Oryza sativa)
  misc_feature (71): n=a or g
atttgatagatcgatcactctgctttctttagatcctgattatgaatggattgccgtgtgcagctgcgacncgcagacgttggcgtcgatcaacatcacca

SEQ ID NO: 9818 - DNA, 101 bp, rice(Oryza sativa)
  misc_feature (71): n=t or c
agagcaatacaatccaagcctaagcaatgaaaccaggcaatcaatcatgactttgtattcatccgtggtangaagttcattctcaaggtgcaaagatagct

SEQ ID NO: 9819 - DNA, 101 bp, rice(Oryza sativa)
  misc_feature (71): n=t or c
gatggatggggtgcctgatgcccaacgcacaacatcaccatcaatgataaaacaacaaaactacttcaacnacccctacgcattcaactccattctactct

SEQ ID NO: 9820 - DNA, 101 bp, rice(Oryza sativa)
  misc_feature (71): n=t or g
gctacctggaaaaccatggttccaagctcaattgtggaaattttatggcttagatagcccaatgttttcantttcggtgcttgagtaacccaaataacaaa

SEQ ID NO: 9821 - DNA, 101 bp, rice(Oryza sativa)
  misc_feature (71): n=a or g
atatggttgttattcaagtacatagtctcaggatttatctctgatgtttgctctgcagcaacttaatgcancaagtaatggggattatactattgatgatc

SEQ ID NO: 9822 - DNA, 101 bp, rice(Oryza sativa)
  misc_feature (71): n=a or g
tcaggcagctgctgatctgaccagcggtgcttcaagtaaaggtttagcgtttgagcacatcaaattatttngctataaaaattacagacttttgatattgg

SEQ ID NO: 9823 - DNA, 101 bp, rice(Oryza sativa)
  misc_feature (71): n=t or c
gatactctagggtttaaccgatattacaaagaagaaaagcaatatgcaacagtccagcaagcccagccatnatccacaaatattgtacttcgattaaagat

SEQ ID NO: 9824 - DNA, 101 bp, rice(Oryza sativa)
  misc_feature (71): n=a or g
ttgtactggttttagagttgaaggacatgttatatatgttagttgggtttagcggtgaatttcagactcgnggtcaaataagggaccaaaagtgaactttg

SEQ ID NO: 9825 - DNA, 101 bp, rice(Oryza sativa)
  misc_feature (71): n=a or g
attcaaacaaggaaatgtcagttcgtctcatggaaaaacgaagggagatacaatcttcataccggggattnactaggctaaagatcatacaaacgatagct

SEQ ID NO: 9826 - DNA, 101 bp, rice(Oryza sativa)
  misc_feature (71): n=a or g
attgatgtatataagatggttttttgttggacattgataaaggggcatggcgatcgaatgcgaggatggcnagctggagctgacgatagaggactacccgt

SEQ ID NO: 9827 - DNA, 101 bp, rice(Oryza sativa)
  misc_feature (71): n=t or c
catttcagcacctcggtctcactgtagtttcttcctaaggaatgatcaatcatctctgcaattgctccctnttcccagtgcctccgtacctagcaacatta

SEQ ID NO: 9828 - DNA, 101 bp, rice(Oryza sativa)
  misc_feature (71): n=a or g
aatttcggtgcaagtctgtttgcaaggagtttggcaatgatctttgcagagctgtgcattaagcttatagntcggaaatcttcagctttggaagcatcagt

SEQ ID NO: 9829 - DNA, 101 bp, rice(Oryza sativa)
  misc_feature (71): n=t or c
atggaatggaaaaaagaatggtgcccgatgaaatggctggaataattctgagctaaccttcagatgttctngaagtatccttctgacttcgctcagatctg

SEQ ID NO: 9830 - DNA, 101 bp, rice(Oryza sativa)
  misc_feature (71): n=a or g
gaaaagaaaacatttgtggatgtaatagaaagaccataagatctcgtgtcgctctccacatgggcaacacnagaggtgacgccaccgccaactccctcctc

SEQ ID NO: 9831 - DNA, 101 bp, rice(Oryza sativa)
  misc_feature (71): n=t or c
aatcaagatagatctactgatcatctagcgaatgttgtgcttaacacggccttattatcaaggctgtaaancccactggtgcttcccgtatccagaaagct

SEQ ID NO: 9832 - DNA, 101 bp, rice(Oryza sativa)
  misc_feature (71): n=a or g
tagctgatactgcgtggcttcatttcattaacttttgccttcttgaagctgccctgcccgacagaagatgncaatgagccagcacacggtgtctctttcac

SEQ ID NO: 9833 - DNA, 101 bp, rice(Oryza sativa)
  misc_feature (71): n=t or c
gcctcgctcaactcagcagctgcttcatcgacagcttcttcaatctcttcctcagccaagacttcttccangtctggatcaatagcaggcagattatcggc

SEQ ID NO: 9834 - DNA, 101 bp, rice(Oryza sativa)
  misc_feature (71): n=t or c
ccgccggcggcttctcccccaacgccgttgtatcttgccttgttttccaatttccatcttgagcccacggnttatttcaccaaagaaatttcatatgccat

SEQ ID NO: 9835 - DNA, 101 bp, rice(Oryza sativa)
  misc_feature (71): n=a or g
tttttcttattttctcctcttcaaggaggttgtcagtggcaaattggggcgaggcagccggtcgagctctntcgccgcaccaacgcgcacatgccactgcg

SEQ ID NO: 9836 - DNA, 101 bp, rice(Oryza sativa)
  misc_feature (71): n=a or g
cccggccggctgtggccgccagacatcacaccacaacaccagcacaaacaacccacacgcaccctcaaaanagtcagcctcgcgtgtcgcactcgaacgca

SEQ ID NO: 9837 - DNA, 101 bp, rice(Oryza sativa)
  misc_feature (71): n=a or g
agcattcctttgtagactttaccgaatgaaccttttcccagtaaaatgctataaccacgggtgatttgccntatctcattttccgtaaaatatcttaggct

SEQ ID NO: 9838 - DNA, 101 bp, rice(Oryza sativa)
  misc_feature (71): n=a or g
atttcttcccgtcttcatgtatgatctctcagctgattggtcgagatgaaaaagtgatgacgtcaccaacntgtcatgctaccagtggtggacgaaacgag

SEQ ID NO: 9839 - DNA, 101 bp, rice(Oryza sativa)
  misc_feature (71): n=t or c
gttcttccgccgatttcgattgcctcacccttcgttttgtttcttgattgatctcgcagagttcgtagatnagctcgagctcgccgccatgtcgtccagcg

SEQ ID NO: 9840 - DNA, 101 bp, rice(Oryza sativa)
  misc_feature (71): n=t or c
ccatcagtgctggatggatggagagatttatcaagcagactacttgcacagctacaattaacttgtcctgntgttgttccttcagctgttctaggattcag

SEQ ID NO: 9841 - DNA, 101 bp, rice(Oryza sativa)
  misc_feature (71): n=a or g
gcttttttgatcttcgattgatgcaaaagaagaggtcagagggttaatgcatgtgtgtgctcgtgtgtctntagttttagtttcatgttcttcagaattcg

SEQ ID NO: 9842 - DNA, 101 bp, rice(Oryza sativa)
  misc_feature (71): n=t or c
aactagctaccagatctcaaccaaggtctccaagtctcaaggtacggatgtaagtgcgctgtcgcactacncatataaaaacccgtgttttagtttattta

SEQ ID NO: 9843 - DNA, 101 bp, rice(Oryza sativa)
  misc_feature (71): n=a or g
gcaaaatatgaactgaaaggaaagctttataaggctgtttgtagggaccctgatcttccagcagatatgcnggaccagtttcgctataagctgtccaagtt

SEQ ID NO: 9844 - DNA, 101 bp, rice(Oryza sativa)
  misc_feature (71): n=a or g
tagcagaaaaaaattcagagaatgcgaagaaccagatcgagaaagaaagaaagggctagctaggtttttcntatacgaagattaatttctttagatgctga

SEQ ID NO: 9845 - DNA, 101 bp, rice(Oryza sativa)
  misc_feature (71): n=t or g
gatcctaggagcatctttgctctccttaggacaagtagcaagatgaagtatccaaagagcatctttcaccnccttgtgccatgtgtccatgcttatgacgg

SEQ ID NO: 9846 - DNA, 101 bp, rice(Oryza sativa)
  misc_feature (71): n=a or c
gcactgtaacgacacttctgtctccagcacgattcataaagctcttgctaccggcacggctaaaatctccncggctgaatttgtacctatatatattataa

SEQ ID NO: 9847 - DNA, 101 bp, rice(Oryza sativa)
  misc_feature (71): n=a or c
ggaaaaaacgaatttcgaagaggacgcgtcgccctcaaaaaaattttccgaaccaatccaaacaaataacnaaaaaaaaaaaatctctggatcaatcccgc

SEQ ID NO: 9848 - DNA, 101 bp, rice(Oryza sativa)
  misc_feature (71): n=a or g
ttcattgcattgattgaattcagagtcttcctgagtctgtgtctttgaacaacccatacttcataaaatcntcccaacctgcgtatgagaacatatattcc

SEQ ID NO: 9849 - DNA, 101 bp, rice(Oryza sativa)
  misc_feature (71): n=t or c
ggtgctaaaacggctatagttgttgccaagctgatgtaatcacagccgtttactgctagaaatgaaatgangttgtctattggtagtattatactaccaat

SEQ ID NO: 9850 - DNA, 101 bp, rice(Oryza sativa)
  misc_feature (71): n=a or g
ttggaccctaaaaattagaaaatgcagtggaaggcacactactggagaataagtgatctttggagagtcgnacgatttccataatagtcctggttctttag

SEQ ID NO: 9851 - DNA, 101 bp, rice(Oryza sativa)
  misc_feature (71): n=a or c
gtgatcgatgggtctgtttaggagattttggtaggtgcagcctcttccagaattagaagcttccttaaacnattcagtatttcattcagattctcaaaaac

SEQ ID NO: 9852 - DNA, 101 bp, rice(Oryza sativa)
  misc_feature (71): n=a or g
gttgttcctgaaacttacctttggcatagatttcggatgcccttagaattccctttctttgaggcgaactnttaatattggtaatctgcggacctgacgct

SEQ ID NO: 9853 - DNA, 101 bp, rice(Oryza sativa)
  misc_feature (71): n=a or g
gtatggaatcacatataaactgcattgcgtcatcaagaagtccagctcttccatacatatcaaccatagancagtagtgctcggcacgagggacaagtcca

SEQ ID NO: 9854 - DNA, 101 bp, rice(Oryza sativa)
  misc_feature (71): n=a or g
gcctgcctttctcgtgtttgccaattcctctttctttgttctaatttgcttctctgctacttgttggtacntatcggcagcattcatgaacagctggcccg

SEQ ID NO: 9855 - DNA, 101 bp, rice(Oryza sativa)
  misc_feature (71): n=t or g
tgagcattctggaaacacctttatcatttgaagtcacgaccgtgcataccagtaacgttgtccaaatcatntccttgcctatatatgattagtctacctat

SEQ ID NO: 9856 - DNA, 101 bp, rice(Oryza sativa)
  misc_feature (71): n=a or g
ttgttgcatttatattaggatgaagctgatgagatcacatggcaaacctacaaaggtcaactcactgatanacaggagaaaacacgaagcaaaataataaa

SEQ ID NO: 9857 - DNA, 101 bp, rice(Oryza sativa)
  misc_feature (71): n=a or g
cagctcagctcaggctcagctcctctattaattcctccccgaccacacagcaccaaccaactaaaccaccnccaccaccaccccccgccgagacagtgaca

SEQ ID NO: 9858 - DNA, 101 bp, rice(Oryza sativa)
  misc_feature (71): n=a or g
accattttggtctcaccatcttgtttctccttttgggatgggttcagatccttcatttcctcaccctgctnttgtttccatatcatgtcatatacttccat

SEQ ID NO: 9859 - DNA, 101 bp, rice(Oryza sativa)
  misc_feature (71): n=a or g
tagctagttaaggcaatgaagatcaatacctttgtatctgttgtacagatcttcaagatgccgagagttcntcagagaaatttgtggttggctgtagaaaa

SEQ ID NO: 9860 - DNA, 101 bp, rice(Oryza sativa)
  misc_feature (71): n=t or c
cttctcaatcggttggcatctgactgtacttgagaagaatgtccctctagcagcagcatccaggtgatccnaggacaagggggttaattcgttcaagaaac

SEQ ID NO: 9861 - DNA, 101 bp, rice(Oryza sativa)
  misc_feature (71): n=a or c
ctttaaatactttaatcatgttggtatttaccacaagtgaatcagtgtttggctcgggctccaaatcatcntcatcctcatcctcatctgactcaggcttc

SEQ ID NO: 9862 - DNA, 101 bp, rice(Oryza sativa)
  misc_feature (71): n=t or c
tcaacccgacaagcacgctccacgcgcgcagcgttgtgtatcggccgtgcacagtgcacctcttgtattgnataccaccgacgtccatgccgccagcatgc

SEQ ID NO: 9863 - DNA, 101 bp, rice(Oryza sativa)
  misc_feature (71): n=t or c
aatgcgaatgcaattaaagattcaacacgagttcatccttgaagcatctttgaaagtatgactaaaatggnatagtaaaatggtgtgatgctcagggggcc

SEQ ID NO: 9864 - DNA, 101 bp, rice(Oryza sativa)
  misc_feature (71): n=a or g
acgaatgaagcgtgaactcgtggcacttgaatctgcaaatgtttatgcacttatggaaactgaaaccgtgntagaagaggtaggcaacaatccaaccattt

SEQ ID NO: 9865 - DNA, 101 bp, rice(Oryza sativa)
  misc_feature (71): n=a or g
caaatttgagtgcggttgagcaaagaagaaagagctactgcaattggaagaacaaaacaacaatccagcanagccagaagtggtgatagttgaagatgatg

SEQ ID NO: 9866 - DNA, 101 bp, rice(Oryza sativa)
  misc_feature (71): n=a or c
tctgaataactgcatcattatgtaattcggtaactcggacgacttaagaacctttttctcatttcagtatnaaaaaataatgaagttcatctcaacagcaa

SEQ ID NO: 9867 - DNA, 101 bp, rice(Oryza sativa)
  misc_feature (71): n=t or g
tgtcaaagccaagctataacatctattcctcatatccctgaatcgctgaacgtaatcttgtacagtttcancatgcctttgcctgactgctgttaaatcat

SEQ ID NO: 9868 - DNA, 101 bp, rice(Oryza sativa)
  misc_feature (71): n=a or c
gcttcctgtggcaggtctgtagagacgacatgcttgctcggcagtggatcccatccgatgtggagttcagnaaactttgacttggacgccatgttgaatgc

SEQ ID NO: 9869 - DNA, 101 bp, rice(Oryza sativa)
  misc_feature (71): n=t or g
gtactgcagcttcagtcggaaccgttggcctgtccttcaatcctcattctcaacaatggactccgtaactnaagcaatgtaacctgttttatatagattca

SEQ ID NO: 9870 - DNA, 101 bp, rice(Oryza sativa)
  misc_feature (71): n=t or c
gccaaatccggtctcgagttcaccagatagcgcagggagccaacgatccaccggtaatcagtggcgtcganggagggggcgttgctcatcttgctgagctt

SEQ ID NO: 9871 - DNA, 101 bp, rice(Oryza sativa)
  misc_feature (71): n=t or c
atattggccatatgcacttcaagttccttatctgcagtggacactagacagacaatcagagtctcagctcntcctttggcgctgctagcttccatttctct

SEQ ID NO: 9872 - DNA, 101 bp, rice(Oryza sativa)
  misc_feature (71): n=t or g
aacttcctggaccatcaagctattgtcagccccaatctcacttgcttcactactagaaatactgataatanaaccagagttacctgaattgacagctaaaa

SEQ ID NO: 9873 - DNA, 101 bp, rice(Oryza sativa)
  misc_feature (71): n=t or c
aaatggtagactcattcactaccattgtagcacccagatgcttagatagactcttaaataactacgcgtcngtggaatggattctcttcattggagattta

SEQ ID NO: 9874 - DNA, 101 bp, rice(Oryza sativa)
  misc_feature (71): n=a or g
attagatatatgcctaatgccatgaaactaatgttgcaacattggttccgatcagtggaaagttgctgagntgtgccagaaactagagcacagcttagaga

SEQ ID NO: 9875 - DNA, 101 bp, rice(Oryza sativa)
  misc_feature (71): n=t or c
ttagtatattgtttggttggttgtcacacttgtgtcatgcctcactttactagtcattgggcctatgcgtnatagactcaaattcttaccaaacttagcca

SEQ ID NO: 9876 - DNA, 101 bp, rice(Oryza sativa)
  misc_feature (71): n=t or g
atctttcttccaaatgtaaaacagcaactcgctgcagaggtcaacatcagaaaactaccaaaatcttcatnaataatgaaaatacattgcctatgatgtaa

SEQ ID NO: 9877 - DNA, 101 bp, rice(Oryza sativa)
  misc_feature (71): n=t or g
atacctcattatggcgggttttgggtccattgtgcttgggaagaatgccatggatgtagtgatgccacganatacgagtggacaagagagaagccaaaaga

SEQ ID NO: 9878 - DNA, 101 bp, rice(Oryza sativa)
  misc_feature (71): n=t or c
tggattcatgggattgtttaggaaagtgcatgcggcccccacaaaacatgtttcctatcattaaaacttgntacacgcgagcagtggtagcgcgtggaaac

SEQ ID NO: 9879 - DNA, 101 bp, rice(Oryza sativa)
  misc_feature (71): n=t or c
cttcacagactagcagagccctacttcgctgtcaatagggtaagtgcctcttgtaaagtgttaggatcacntgtaagctccgaggagatggacgtgctaaa

SEQ ID NO: 9880 - DNA, 101 bp, rice(Oryza sativa)
  misc_feature (71): n=a or c
gaggcaaaatgaccaacatgtagatgatatcgctcattagaggtgacaaagatgtcggtggtagtaaacanaatgacaccaatcaaagatgatgaagtcgc

SEQ ID NO: 9881 - DNA, 101 bp, rice(Oryza sativa)
  misc_feature (71): n=a or g
ctcaaacaatttgataaaccctaaagtagagcagtgtcctactgatcccagagattgaagaggattgctcnactagaagcgccgcaagcagaacgaaacgc

SEQ ID NO: 9882 - DNA, 101 bp, rice(Oryza sativa)
  misc_feature (71): n=t or g
tggattagaaatagtttgtaagaatggcctaaaatcatgcttttcagttagtttgctggatgctatgcttntgttcaatgtgtggattaaatgatgtaaat

SEQ ID NO: 9883 - DNA, 101 bp, rice(Oryza sativa)
  misc_feature (71): n=t or c
aaagcggcagcacaatacaaagacaagaagatgcctcctcgcgcggcgtttgctctgatggctcacctggngtcgtcggaggtgggcacgagcttgacctc

SEQ ID NO: 9884 - DNA, 101 bp, rice(Oryza sativa)
  misc_feature (71): n=a or c
aaactgattgtttgatctatgctacataataaggtagagttgaatttccttttttcaagttgaatactccntccatcccaaaatataagaacctaggaccg

SEQ ID NO: 9885 - DNA, 101 bp, rice(Oryza sativa)
  misc_feature (71): n=a or g
tgatctacctcagctctttgccttgcaacaatcagcgcaagcttttcaggaatatttggcaatgtcagctncagataccttggagcatcttaatgatgaga

SEQ ID NO: 9886 - DNA, 101 bp, rice(Oryza sativa)
  misc_feature (71): n=a or c
tttctttgtgccaaagaaatgtggttaattcctttcttttcccacgtttacgaaaaaataaatctacctgnacaattcaaattgtaattcagagtatttga

SEQ ID NO: 9887 - DNA, 101 bp, rice(Oryza sativa)
  misc_feature (71): n=a or g
ccttgcatgccatccaaagtccttacacgccatccaaagtttatgagtttgtttcctaatatgccatgtcnaaattattgttccattcaccaatgcctaaa

SEQ ID NO: 9888 - DNA, 101 bp, rice(Oryza sativa)
  misc_feature (71): n=a or g
cttgacttcatctacacagacatttggccggagataggtcatggagaagacaatgtagctatggctcaacngttgcttgctgctgcagacatgtatggctt

SEQ ID NO: 9889 - DNA, 101 bp, rice(Oryza sativa)
  misc_feature (71): n=t or c
tatattctgttgtttatccatcttccttgacagttcttgcattgtatgtgtcagctcatgtgtgaagtgtngtggttacaaattagtttttgacttttatc

SEQ ID NO: 9890 - DNA, 101 bp, rice(Oryza sativa)
  misc_feature (71): n=t or c
ttataccacgctcgaggcgcttactttaatccatataatgcctttttaagtatgaataccttgttttctcncccttgaactgaaaacccttcaggttgttc

SEQ ID NO: 9891 - DNA, 101 bp, rice(Oryza sativa)
  misc_feature (71): n=a or g
gaaaaagacactttttccgggcgcgacaaatacctaaccaggacgcccattttttacaatctatcacgcanagtgaaattgtattgaaaaccaaacatatc

SEQ ID NO: 9892 - DNA, 101 bp, rice(Oryza sativa)
  misc_feature (71): n=a or g
tcgtcagctagccaagaacaataagcaacttcatagtgtcctagcaacggcgtcaccggccatggcttccngccatctcgtcgccgtcgccgtcgtcatcg

SEQ ID NO: 9893 - DNA, 101 bp, rice(Oryza sativa)
  misc_feature (71): n=a or c
atattttccttatttaaaaaacataccgtttaacaatttgagaattgtatgcacatgcggaaaaaaagtanttcatccattttataatataagacttttag

SEQ ID NO: 9894 - DNA, 101 bp, rice(Oryza sativa)
  misc_feature (71): n=a or g
agactcgacactacgttgcagttcctttctgagaagaaagaagccgaggggtatattcctgatggacctcngtatgacaagcttacgtatcgcttgcttcg

SEQ ID NO: 9895 - DNA, 101 bp, rice(Oryza sativa)
  misc_feature (71): n=a or g
ctagaatgtcgactacagtttcagatatgaaaatgtcaggtttctgtcgatcaaagatccatcacatgagncgtctactccatccgtccaaaaaaaaagat

SEQ ID NO: 9896 - DNA, 101 bp, rice(Oryza sativa)
  misc_feature (71): n=t or g
catctacaagctcaacgtcagaagaggagataaaccttttgagaatctaatatcctccatcgagtacctcngtggctactctctgcacaccctcgtaatcg

SEQ ID NO: 9897 - DNA, 101 bp, rice(Oryza sativa)
  misc_feature (71): n=t or c
aagatggacgaaatgggagttcttgctaagatggaaggacaagcctaaaacaacatatttgcattgctacnagtcttaatgcctttcataagaatatgttg

SEQ ID NO: 9898 - DNA, 101 bp, rice(Oryza sativa)
  misc_feature (71): n=t or c
ctgaggtagttaaaacaactaggttaaagaccatgtttggtgcttgaactattctagaagtcctttttcangctaaactcaataaccagttttttttttca

SEQ ID NO: 9899 - DNA, 101 bp, rice(Oryza sativa)
  misc_feature (71): n=t or c
ccctgcctccagcgagatgtccttgatctctatggtgcccgtgtacggcctgggagggctaaagctatggntgcatttgatggtgaagcccggccaggcgc

SEQ ID NO: 9900 - DNA, 101 bp, rice(Oryza sativa)
  misc_feature (71): n=a or g
ggataactgagagtattctctgaaactccggaagctgggaaaaaaaggcagacgtgttcaaattttgtttntcaacaagtactggctagcagtcgatatca

SEQ ID NO: 9901 - DNA, 101 bp, rice(Oryza sativa)
  misc_feature (71): n=t or c
cagagtaactcttggctaatttaggaacggagaagcacgtgcgtaagctcttacgcacactgtgcagcgangcttgcagtgagttgtatggtactagcatt

SEQ ID NO: 9902 - DNA, 101 bp, rice(Oryza sativa)
  misc_feature (71): n=a or g
tgtgaaatgctatagcggtatccatacgattgcggatttatctgagcccgaagtagaagacgacctccccnacattaacctagaagtggaacaagtccttg

SEQ ID NO: 9903 - DNA, 101 bp, rice(Oryza sativa)
  misc_feature (71): n=a or g
ttacccatttctccaacaattagtccttcagacatccatctccatactagtttgtcactctcaatcacttngtcctccggaaatatactgaggtatagcaa

SEQ ID NO: 9904 - DNA, 101 bp, rice(Oryza sativa)
  misc_feature (71): n=a or g
aggaagcaaacaaaacattcagaatattaacatgacccatgaaaaaggtcagattccaagaagaggcagcngagtccatgattcatgccaagttagtgcaa

SEQ ID NO: 9905 - DNA, 101 bp, rice(Oryza sativa)
  misc_feature (71): n=a or g
aatggttaataaaacacaaatcaaaatgtaccaaaacttcatatgataacaacctcagtgtagccgatctncacggtcttctcctggagcgacttgatgtg

SEQ ID NO: 9906 - DNA, 101 bp, rice(Oryza sativa)
  misc_feature (71): n=a or g
tgagagaccagaagacccacttttcacaggttctccagtacaatggcaaaatggagccaacgctaaagttncaatatttgaaaatgggagtcaaatcacac

SEQ ID NO: 9907 - DNA, 101 bp, rice(Oryza sativa)
  misc_feature (71): n=a or c
tccctcctcgctgcacggttctgagggattcttggggcgtttggagaggatggtgaggcgaagctggtggngcagcagctcagccggattcgcctcgaggc

SEQ ID NO: 9908 - DNA, 101 bp, rice(Oryza sativa)
  misc_feature (71): n=a or g
agattgtttggtatcaagccaatgaggtagttcctacggagattaatactactaaggttctgcaggttctncagatctgctgggattggaccagatagact

SEQ ID NO: 9909 - DNA, 101 bp, rice(Oryza sativa)
  misc_feature (71): n=t or c
accaccttcggctccaggccaattggtcaatccccgattgctgataagagaacagtctcaacacgctgganagaatgtggatcggctaacacaagaccagg

SEQ ID NO: 9910 - DNA, 101 bp, rice(Oryza sativa)
  misc_feature (71): n=a or g
atggacacgtacgaggaggtgcggagcatcgggtcaggcaacttcggggtgacacggctgatgtgcaaccncgacaccggggagctcgtcgccgtcaagac

SEQ ID NO: 9911 - DNA, 101 bp, rice(Oryza sativa)
  misc_feature (71): n=t or g
tggaaatggattttctctttttgttggtgtcacctttgagtgcaactgctttggtagacatcatctgtttngacttatgttaaatctgttcgccagtccta

SEQ ID NO: 9912 - DNA, 101 bp, rice(Oryza sativa)
  misc_feature (71): n=t or c
attagtgattacctcaaggtgtggcagatggttaatttcagatgaaacccacacttttcccaactcgatanacgagcgcagctagctgcatcggtccgcgc

SEQ ID NO: 9913 - DNA, 101 bp, rice(Oryza sativa)
  misc_feature (71): n=t or c
ttgatatccctgtgaaggatgtatggatcactatcatggtgaaggtaaacaagagcgctgataatgccctntactattttatacctgaaaagacaacattg

SEQ ID NO: 9914 - DNA, 101 bp, rice(Oryza sativa)
  misc_feature (71): n=a or g
gttcgactcccttaggggcgtcatggagatacccaccatattgatcgacgacgcgaagacgccgctgctcncgaacctgatcgcgttcgagcagagcctgg

SEQ ID NO: 9915 - DNA, 101 bp, rice(Oryza sativa)
  misc_feature (71): n=a or g
aacgagagtgacaacggaggaggtggtttatacgatttggtcagtttaaaaaggacccaagacatgttttncacgaggacaaaaacatccatataactaac

SEQ ID NO: 9916 - DNA, 101 bp, rice(Oryza sativa)
  misc_feature (71): n=t or g
attttcttttacttcagtcacttgggtgaatcatagcttgtcccttttttgcaaagtgatgctgtctgaanaggagaaaattgtcttgtgttctctgcttc

SEQ ID NO: 9917 - DNA, 101 bp, rice(Oryza sativa)
  misc_feature (71): n=t or g
aaatcccaatcagaacacttctaggatagaaatacagcatcattaaaagcaattactgagcttactttctnggccaaagtgctaagtccaaaatcagaaac

SEQ ID NO: 9918 - DNA, 101 bp, rice(Oryza sativa)
  misc_feature (71): n=a or c
gcattatgcatagattattcttcatctgtttgtaaaatatataacgacattgacttttaagcattcgtttnatcattcgctttattcaaaataatcgtgta

SEQ ID NO: 9919 - DNA, 101 bp, rice(Oryza sativa)
  misc_feature (71): n=t or g
gaacaaccacaattcaacaaggtacctatcaaactgcggttgtcttcaacagggtacctatcaaactgtgnttgttcggcagggtataaaaaataccctat

SEQ ID NO: 9920 - DNA, 101 bp, rice(Oryza sativa)
  misc_feature (71): n=a or g
cctggggacgttcgtcgccaacaatttgatcagcgcgtatgccaggttcgacgaggtttcggatgccaggnaggtgttcgacgaaatgccggagaggagtg

SEQ ID NO: 9921 - DNA, 101 bp, rice(Oryza sativa)
  misc_feature (71): n=a or g
aagaacaccggaagaatgtgtatatgctggagagcatcgtaaaacactggtaattagctgatgtacactcncgacattattttattatttctggagaaaat

SEQ ID NO: 9922 - DNA, 101 bp, rice(Oryza sativa)
  misc_feature (71): n=a or g
ttatgccatattccttcaagtgcatttttgatatataagattacccgcatcacagcaatccatagcaaaancaattgaagaaaaagtaactggcgagcagc

SEQ ID NO: 9923 - DNA, 101 bp, rice(Oryza sativa)
  misc_feature (71): n=a or g
cccgagtgatttttctttctttttttttactgcggtaggtttgctcttcgatagcgaacggagggtggtcnagggctaggggtgggtgacatgtggcggga

SEQ ID NO: 9924 - DNA, 101 bp, rice(Oryza sativa)
  misc_feature (71): n=a or g
tccaagatctattctagattatcatcctctatgaatgtaacactattctctaatggcatatgtacatgganacgctcaatagcaggatcagtatagtgaat

SEQ ID NO: 9925 - DNA, 101 bp, rice(Oryza sativa)
  misc_feature (71): n=t or c
tcccttagataccacttaccaactcacccttgcatacaagttttacatcaatgaggatctcgccttgccgncacgctcgcctcctccgccgccgcttgcca

SEQ ID NO: 9926 - DNA, 101 bp, rice(Oryza sativa)
  misc_feature (71): n=t or g
agcacagcagctgatcctgcctcacacaatggtcagtcaggaattcagatgcctccaccattgccccaatntcaacctggggccagtttaccatcatggaa

SEQ ID NO: 9927 - DNA, 101 bp, rice(Oryza sativa)
  misc_feature (71): n=t or c
gggtatgtttgtaaaagacaaagttttcaaaaaaaatactaaaatgtaaaaaaaaatccaggggcttgggntctagagtcatagagttgtagtccaattgt

SEQ ID NO: 9928 - DNA, 101 bp, rice(Oryza sativa)
  misc_feature (71): n=a or g
ctctttttcagcttgctctctgttttaattcttgttctataataaccagatccattgacctagatagctantcatcaagttaaagggcatcgtcatcgatc

SEQ ID NO: 9929 - DNA, 101 bp, rice(Oryza sativa)
  misc_feature (71): n=a or g
tcaaatcccaaatcacaaacatccataaatcatcccaagatggattcaaatcacaaacatgttgggatacncgtaggctccgatagcataagtcaaaattt

SEQ ID NO: 9930 - DNA, 101 bp, rice(Oryza sativa)
  misc_feature (71): n=a or g
aatttgagtctctatttgcatttatccttaacagtgttttattaacaactgatcacagcagcataatgttnacatatttaccacatgtttcacaatatccc

SEQ ID NO: 9931 - DNA, 101 bp, rice(Oryza sativa)
  misc_feature (71): n=a or g
ttccatccattgcagaactcgtcgaataccaaggctcataaacaacgccgacgctgacgccaaattcaccnaaaccaatctacgtggccaccaaacgatgt

SEQ ID NO: 9932 - DNA, 101 bp, rice(Oryza sativa)
  misc_feature (71): n=t or c
attgctcagctgcttcgctgtttggcccgatattttctttccttcttttcttttctgcgagtgagttcttntgaacaactccaaaaatagcaatttcctca

SEQ ID NO: 9933 - DNA, 101 bp, rice(Oryza sativa)
  misc_feature (71): n=a or g
cttactttacatacacgtaaagtcttaaggcgctagctactagtagttcatttttaactgacgtgtcatanaagcttaatctgtactttttgtatatattg

SEQ ID NO: 9934 - DNA, 101 bp, rice(Oryza sativa)
  misc_feature (71): n=a or c
ttttttctagtgggggcccacctcctcatcgcctccctccctcacgcatcaatccctaaccacgctcccancctcccccccccccccctgctataaaatcc

SEQ ID NO: 9935 - DNA, 101 bp, rice(Oryza sativa)
  misc_feature (71): n=a or c
gtttcccaaactctctgaacatgagtaataaaagagatggatcagcattagatgtactgttcatcaccatntttgggtctatttgggagagcttccagccg

SEQ ID NO: 9936 - DNA, 101 bp, rice(Oryza sativa)
  misc_feature (71): n=a or c
atgagagagctatagataccacctaggccccactgctggaaaggctcggcttcaaaaccctgtagacatantattaaggtgatttactattaatcgagttt

SEQ ID NO: 9937 - DNA, 101 bp, rice(Oryza sativa)
  misc_feature (71): n=t or c
cacacggtatgcgcttgatgattcctgagtttattactttacgcacgataagttaccatgtgacacccggnaatattggcatgcacacgggagccttccca

SEQ ID NO: 9938 - DNA, 101 bp, rice(Oryza sativa)
  misc_feature (71): n=a or g
tcgacgaagccccaccgctggtgcacctgggcgcgcttgaatgtggcaattgttgactgagggaggaggcngagcggcgactcacggagctccggtgcgtc

SEQ ID NO: 9939 - DNA, 101 bp, rice(Oryza sativa)
  misc_feature (71): n=t or c
actgctgatcaacctcctatagatccaatagggtccaaaaccaacggagcggcgttcgtgaccggttcgancgggcctgacggccggtcagaccgcgacac

SEQ ID NO: 9940 - DNA, 101 bp, rice(Oryza sativa)
  misc_feature (71): n=t or c
tcaattctttattttatcttaattgttgttcgtacaggaatccttcttgtttgatttggtgatttgaggantgtgagatgtgagatttggatttggggcaa

SEQ ID NO: 9941 - DNA, 101 bp, rice(Oryza sativa)
  misc_feature (71): n=a or g
atcatccagccaattcaggcattttacttgctctcccactcggacgacgccgacaatggcagcgaaggganacccagcggatgcggtcgccatcgtggccg

SEQ ID NO: 9942 - DNA, 101 bp, rice(Oryza sativa)
  misc_feature (71): n=a or g
tattcatggatcttttaggatattttatatagcaacaaaagtttttcccactgcgtcgctggatctaggcnggaggaggcaagccgccatcgtgggaaaag

SEQ ID NO: 9943 - DNA, 101 bp, rice(Oryza sativa)
  misc_feature (71): n=t or c
aagctgccgagtttgacggctaggtcaacaaggtcggcggatgaactctccactgcaggcggcgcgcgagngtggtagcgtcaatcttggtgaaggggatg

SEQ ID NO: 9944 - DNA, 101 bp, rice(Oryza sativa)
  misc_feature (71): n=a or g
cactcctcgcattacccagttgtaaacctcagccagattagttgtcattatgtcatatcgagaaccatcgntgttgtacaagaggacccactactcctttg

SEQ ID NO: 9945 - DNA, 101 bp, rice(Oryza sativa)
  misc_feature (71): n=a or g
agtcctcaagcatgtatcaagtgtaacaacagcctcgaggcaaacaaaaatcaagggaaatggagaaaaantgaaacaaaaactcaaccatgtataacact

SEQ ID NO: 9946 - DNA, 101 bp, rice(Oryza sativa)
  misc_feature (71): n=a or g
gctcgcgtgtcagcatccttttctttctgctcttttcttccgaagcttgggaggtaaggggaggcgcccancgggacaaggggagagaggcagaggcggga

SEQ ID NO: 9947 - DNA, 101 bp, rice(Oryza sativa)
  misc_feature (71): n=t or c
gagatcaacgttgtgcttgcctgcttggtatatctttattaagcgtattggattagaaatagtactacacnactagttgtttccaattttccatccacatc

SEQ ID NO: 9948 - DNA, 101 bp, rice(Oryza sativa)
  misc_feature (71): n=t or c
taccggcactacctggtgatggtggtggccatcccgacattcttcgacctcaccggcatggtcgtcatcgncgtcttctcgccggtgctgttccggacgct

SEQ ID NO: 9949 - DNA, 101 bp, rice(Oryza sativa)
  misc_feature (71): n=a or g
gtttacgtcactaaaataaatgagacccatatgtagtaaaacaataaatattttttaggcccacgtgtcanctaccttttctcctctttaacctttctctc

SEQ ID NO: 9950 - DNA, 101 bp, rice(Oryza sativa)
  misc_feature (71): n=t or c
gcgctagccgcgtcgcaagccatcgtcaccgcggccattgcatgccatcatcgcctgcgtgagccatgccnacctccctcctccactgtggccgccgccgt

SEQ ID NO: 9951 - DNA, 101 bp, rice(Oryza sativa)
  misc_feature (71): n=a or g
tagcgggatggcgaggacgacacatagacttagcggggagatcaaccctagtcaaatcagtgcttacctcncaaccagtcttcctcccaacgggcctgaag

SEQ ID NO: 9952 - DNA, 101 bp, rice(Oryza sativa)
  misc_feature (71): n=a or g
gatgtcagcagcgtcgctgccaccagtgaacacttggctctgccccaccttgatcccattgctaaggtccntcatgctcccctcatctagtacccgcatca

SEQ ID NO: 9953 - DNA, 101 bp, rice(Oryza sativa)
  misc_feature (71): n=a or g
cactgcaccatgccattcattgtggtcacaaggaccttgcactggaattgatattaaaagagcctgccctntcaaaagctgtgaacaaatacagtgagtca

SEQ ID NO: 9954 - DNA, 101 bp, rice(Oryza sativa)
  misc_feature (71): n=a or c
acaatgcgaacgaatgtgatcaagtgctccacaatcaaagcaacaagttagatctcctcttttcttgtacntgacattgttcatagctcgagaaatcttgt

SEQ ID NO: 9955 - DNA, 101 bp, rice(Oryza sativa)
  misc_feature (71): n=t or c
ataaaaaaaaggaaaaaaatcaaattgaggccgaaaactttacacacctcaactattattctaaataacgnccctcaactttaaaaccaggatacccaata

SEQ ID NO: 9956 - DNA, 101 bp, rice(Oryza sativa)
  misc_feature (71): n=t or c
ctgtgtttgtcgttcctgctccaatctgagtcgttcggcttcttgtcgtgtccactgttcattagcttcgngagcgaggtgctgttcctcggtctcgttgt

SEQ ID NO: 9957 - DNA, 101 bp, rice(Oryza sativa)
  misc_feature (71): n=t or c
cactccctcgacgaccacgccttctccctctccgtttcttgccaccggcctccccgccctctcgttggctnacctcctcctctcccacccatggcaactgc

SEQ ID NO: 9958 - DNA, 101 bp, rice(Oryza sativa)
  misc_feature (71): n=t or c
cattgtgtgtagtagggtaatttgaagaccaaggtcactgtattcagagatttcttcccggacaaattcgncattcctatcaaaaatacaaaaacaggcag

SEQ ID NO: 9959 - DNA, 101 bp, rice(Oryza sativa)
  misc_feature (71): n=t or c
gatgtctatggtcaaatgtttggacaacttgccaattgttaccgaatcttgtatctggcaaataaaacacntttctagcctgagtagctagaattaaagaa

SEQ ID NO: 9960 - DNA, 101 bp, rice(Oryza sativa)
  misc_feature (71): n=t or c
ccttgctaacttcgccgtcgctcttggcctccgagtgttcaacaatgtattgcatcacacatcaagaacangagtcaactccacccctacgacgcctatag

SEQ ID NO: 9961 - DNA, 101 bp, rice(Oryza sativa)
  misc_feature (71): n=a or g
aagtctgaattggaatgtttgagtcgttctttgcttgatggaacagacatatgtgatgcacttggtgttcnggtcttttttctgtgtgggggtggactcgt

SEQ ID NO: 9962 - DNA, 101 bp, rice(Oryza sativa)
  misc_feature (71): n=a or c
gacgcaatgacacagcaactcggttaattagcgcgcaactgctcccttaatttcttctccataattagagntttttttacttaaacttattgacttagatt

SEQ ID NO: 9963 - DNA, 101 bp, rice(Oryza sativa)
  misc_feature (71): n=a or g
catcgatgaagtgatgtggtatgtcgacgccttcttcagttgatcggatcggctcggcgtcggtggagacntgggttatatcgtcgatccatcgatggtcg

SEQ ID NO: 9964 - DNA, 101 bp, rice(Oryza sativa)
  misc_feature (71): n=t or c
aaaagggtagttttcttagtgacaaccatttactaagggctccaacgagattctagtaaagcttaggtttngttcgtttaaaactaattagctcgtaatta

SEQ ID NO: 9965 - DNA, 101 bp, rice(Oryza sativa)
  misc_feature (71): n=a or g
aaaaaaagggagcgtgagagccaaatgaattgaaagattcatgtttggttcaggaagagatctatatcagncgatatctctgaggtatcatcccgtacgaa

SEQ ID NO: 9966 - DNA, 101 bp, rice(Oryza sativa)
  misc_feature (71): n=a or g
taaagcatggcaggagcttgttagacttgcatattcatctagccatgtcatgatcaaggagctcataactngcagaaaagaggtgagcaaatatttcctaa

SEQ ID NO: 9967 - DNA, 101 bp, rice(Oryza sativa)
  misc_feature (71): n=a or g
tattcgatatggatcgtactcaccaaacctaaaactcaacgtagtacgtgtactccctcgtacttccttcntactcataaagaaagtcgttttggacagtg

SEQ ID NO: 9968 - DNA, 101 bp, rice(Oryza sativa)
  misc_feature (71): n=t or g
tattcgtgtggatcaatttgactttacggagagacattgagatgataccatatgtttttgggaaaaaaaanaaattaactattttttttaggaaattaact

SEQ ID NO: 9969 - DNA, 101 bp, rice(Oryza sativa)
  misc_feature (71): n=t or c
gcttgctctcattaggaaaaattcaaggatgttgtcaattggattaggcaaaataaaacaggttcagcagnggtgttgtccccaggtccacccaatgatga

SEQ ID NO: 9970 - DNA, 101 bp, rice(Oryza sativa)
  misc_feature (71): n=a or c
gaagtaaaggtctccaccatcgccttcctccatgctcagcagggggtacactggctcggtctccggtaatncatccttcttgaagtcatccagttcccaca

SEQ ID NO: 9971 - DNA, 101 bp, rice(Oryza sativa)
  misc_feature (71): n=t or c
gagcctcgtggccgacgcatacagatatccgacaagcaagccaaagagggtaaggctgtgtttgtaagagnaagtttccaacactttctttttaattttcg

SEQ ID NO: 9972 - DNA, 101 bp, rice(Oryza sativa)
  misc_feature (71): n=t or c
tcaacttatttgggtgtagtgaagataaactgtaactagtaccatgtaagacggtaaatacaggttggtanggctttaacaaaaagagtgttcaccatatt

SEQ ID NO: 9973 - DNA, 101 bp, rice(Oryza sativa)
  misc_feature (71): n=t or c
ccactgccccgaccattgccggtcgctgcagccatcatcctccatcacaaccggtggattctttcggttcngcttcttcccggtgaggtcttactgctgcc

SEQ ID NO: 9974 - DNA, 101 bp, rice(Oryza sativa)
  misc_feature (71): n=a or g
aatagactatgaggacacgtttagtcatgtagttaaggctactacaattagaactatcctttccattgcgntgtctagaggttggagctttcgtcaactag

SEQ ID NO: 9975 - DNA, 101 bp, rice(Oryza sativa)
  misc_feature (71): n=t or g
gccagcgagttgcccatcgaaatcggcgataatgcgcggtgactctcactcactcactgagatcttggttnctgatggatcggatgcttagcttgctttgc

SEQ ID NO: 9976 - DNA, 101 bp, rice(Oryza sativa)
  misc_feature (71): n=t or c
tcatattggactctacaaaccatgttgtgtagtgtagcctcatgtcacatccaatccaccaattattaaanaatgagaatatatattggccttaccaactt

SEQ ID NO: 9977 - DNA, 101 bp, rice(Oryza sativa)
  misc_feature (71): n=t or g
gggccatacgctaaaagattgctttgtggtgaagaatgttattcaaaagttgatagatgatggggtaattnatgcggatctcctcaaaagtttgaagatgg

SEQ ID NO: 9978 - DNA, 101 bp, rice(Oryza sativa)
  misc_feature (71): n=a or g
cccttcttcgctaatgtggaatatcacgaaaatgctttgcatctaccgtctgatggagcaaaaaatatcgnacggaacagaaacgaaaggtggggcccact

SEQ ID NO: 9979 - DNA, 101 bp, rice(Oryza sativa)
  misc_feature (71): n=t or c
gggaggggagaaaaaagagtgccaagagagaggggtatttttttgatgagggtggacctgttaagacaccnggatgcgaaaattgattttcgtaagctgtc

SEQ ID NO: 9980 - DNA, 101 bp, rice(Oryza sativa)
  misc_feature (71): n=t or c
gctatgtatgagtgtactgactgctcttatatatgtgactgtggtgtaggatttgattggaactgggatcntcttctctgcgtttggggtgattgcagtgg

SEQ ID NO: 9981 - DNA, 101 bp, rice(Oryza sativa)
  misc_feature (71): n=t or c
actgtaagtatcagccaggataaccaatcagagtatggttgtatgctctcacagctcacatgctgcacaanaattggacgcatttgcaggttaagcatcag

SEQ ID NO: 9982 - DNA, 101 bp, rice(Oryza sativa)
  misc_feature (71): n=a or c
gcctcaacttgttactttacaccatcttttttagaaaaaaatttcgagttaagttacaatcttaggatgantcttaactaagattcatgaaataattgcac

SEQ ID NO: 9983 - DNA, 101 bp, rice(Oryza sativa)
  misc_feature (71): n=a or c
ctaattacgcagctagtgttggggaaccattcatcactgaactattgtataataccacaagtacaactaancgcaatatcactagtacagctaaagaaatg

SEQ ID NO: 9984 - DNA, 101 bp, rice(Oryza sativa)
  misc_feature (71): n=t or c
tattgaagccacatgtctcctctgtagggtacgttgacatgctgtaaaccacttgccttttttcctctctnctccacagcagcttggcatcgacgtggatt

SEQ ID NO: 9985 - DNA, 101 bp, rice(Oryza sativa)
  misc_feature (71): n=t or c
acgaggccatccacgccgggtgggaaacgggcgcgtcgccatccgtcacagcgctgcaggttggttggctngccacccgctggggcctttgcacaaatctt

SEQ ID NO: 9986 - DNA, 101 bp, rice(Oryza sativa)
  misc_feature (71): n=a or c
ctaaaattaaaattatgtttcggtgaactaaacacacccatacatgacatagccgcaattattcaaaactngggccccatgtgtcagcctcagagctgcca

SEQ ID NO: 9987 - DNA, 101 bp, rice(Oryza sativa)
  misc_feature (71): n=a or g
cactgtggatgctatgaacaactactactacccagttactatggcccacactaatactcacttcggtaagntacattggtcgcgggcctcgtattcggtgt

SEQ ID NO: 9988 - DNA, 101 bp, rice(Oryza sativa)
  misc_feature (71): n=a or g
ttccagactcgttgcctccaataccaaagagctgctccacggatacaggagaggaaggtgttctaacatcnccgaggctattaagtgcatcaacatacctc

SEQ ID NO: 9989 - DNA, 101 bp, rice(Oryza sativa)
  misc_feature (71): n=a or g
ctttggacatgttgtgaattgaatgtgatgggatgtcgatagaagcacaatgtggatcatctgaaaacaancctgacacccatttatgcatcaatgtctca

SEQ ID NO: 9990 - DNA, 101 bp, rice(Oryza sativa)
  misc_feature (71): n=t or c
tttctaaataacccctctgagattgtttaatggtggttttcgccacatggcagctgatgtgatgttgggtntccaaataaagttaaaataattccactaga

SEQ ID NO: 9991 - DNA, 101 bp, rice(Oryza sativa)
  misc_feature (71): n=t or g
ggcacactgcaggctgtcctgttgtgttgccatccattggaacttcgaagaatccctgatcagccaaaaangcctcttctaatgccctctggaaatcacca

SEQ ID NO: 9992 - DNA, 101 bp, rice(Oryza sativa)
  misc_feature (71): n=a or c
agaggagaagaaagaaggacggccgtcgccactgtctccgtgcctagccctgtcatcgaggttgatggggngacgggaagggtaagagtcgtcatcgtcgc

SEQ ID NO: 9993 - DNA, 101 bp, rice(Oryza sativa)
  misc_feature (71): n=t or c
atgagaggtcattcaagacggtagatataccgcataatctagcctaacgtcgaagcctaagcctgtcggcngtttccgatgatagaggctaggcgatgaag

SEQ ID NO: 9994 - DNA, 101 bp, rice(Oryza sativa)
  misc_feature (71): n=a or g
taaatcagcaataagaatcctcttcataaccgctttcaaatgctcctatatcaagcaatatacctcgaganctctgaatcaattgccttcacctcccccat

SEQ ID NO: 9995 - DNA, 101 bp, rice(Oryza sativa)
  misc_feature (71): n=a or g
ataatctaaaaacaaaactggtggttactgctgccttactagaaatggaaacaaacagttttatgagttcncgatgaacattcacaagaaattacttgcaa

SEQ ID NO: 9996 - DNA, 101 bp, rice(Oryza sativa)
  misc_feature (71): n=a or g
agaacactgagatgcgaaagaaaaaaactctgaagttacatctaacgataacaactccaacacttgacatngagatccacacgaggacacggtttacatgt

SEQ ID NO: 9997 - DNA, 101 bp, rice(Oryza sativa)
  misc_feature (71): n=t or c
aaagaccgcaatcctgtgataaaaccgtaaaactagagtgccttagaatattgagaaaattggaaccatgncattataatttgcaaaatttgagatgtacc

SEQ ID NO: 9998 - DNA, 101 bp, rice(Oryza sativa)
  misc_feature (71): n=t or c
acaaagacggcacacagcagtaccaatgaaagacggcacacagcatagcaagttccaaaattcggcagtanttatcccctcaaaaaaaatcagcagtattt

SEQ ID NO: 9999 - DNA, 101 bp, rice(Oryza sativa)
  misc_feature (71): n=a or g
taggtccttaatgcatgcgttctatcacagcagtggaaaggggtattttgggtgtttcagcaaatgagaangaatagtttgatacctacaggagcaacatt

SEQ ID NO: 10000 - DNA, 101 bp, rice(Oryza sativa)
  misc_feature (71): n=t or g
tcccgtgcacagttgccgtcgatttcccctctaaatccggtctcctttctcgtgttatttcaaaattagtngaggggaaatattcctcttatcctcctcta

SEQ ID NO: 10001 - DNA, 101 bp, rice(Oryza sativa)
  misc_feature (71): n=a or g
tttgaagggaaataattgatcctatacaggaaatcgtggtggctgaaaaagccagaaacgtcacggcaatnctgagttcatagaataaaaactgacatggt

SEQ ID NO: 10002 - DNA, 101 bp, rice(Oryza sativa)
  misc_feature (71): n=t or c
atgacctagttgctctcatcagacggtccaaggatctgtttgatttggtgccaaatttttacctatgtgtnaaaatctttacaagttttaacattatcaaa

SEQ ID NO: 10003 - DNA, 101 bp, rice(Oryza sativa)
  misc_feature (71): n=a or c
atttactcaccaggattggatggctaaatcaaattactgtagagtttagttggaactgatcaatcgacctnatcgtcttaagtgcacagagaattaacatg

SEQ ID NO: 10004 - DNA, 101 bp, rice(Oryza sativa)
  misc_feature (71): n=t or g
ttttatgttgtttctataagtgctagcttaaggagaaagagaagagaagcacatgatagaggaaaagctgnctagacttgttaggcggagtccatttgtgg

SEQ ID NO: 10005 - DNA, 101 bp, rice(Oryza sativa)
  misc_feature (71): n=a or g
atgcaccgcatcgatctcctcctctggcccatgtggatagaggatcagaggtgaatatggacatatgcttntctaaattcgtagctaggatttactttttt

SEQ ID NO: 10006 - DNA, 101 bp, rice(Oryza sativa)
  misc_feature (71): n=t or c
ttttattttatgatagtttctatatttccatcatatgtatgtttttgattatatattttctccagtttacnggctaacaatcacatggaaataaatatctc

SEQ ID NO: 10007 - DNA, 101 bp, rice(Oryza sativa)
  misc_feature (71): n=a or g
tatgttgagggcctatcgaacaaatagtcaaaacaaaatttcataaccacatctaaggctgagtttggtanggaggttggcttttgtaacttcatcatttg

SEQ ID NO: 10008 - DNA, 101 bp, rice(Oryza sativa)
  misc_feature (71): n=a or c
ttacttatcagcgacacacgtgccagtttcatctttctctcatagactatggtatgtccttttctccaacnaaaattggatgaacttttagatactcgtgg

SEQ ID NO: 10009 - DNA, 101 bp, rice(Oryza sativa)
  misc_feature (71): n=t or c
aagaaacaagggaatgtagttatgctagtcttgaaactccagatgcaatgaaatggcattactgctttctnacaagttcatatatagtattattattacat

SEQ ID NO: 10010 - DNA, 101 bp, rice(Oryza sativa)
  misc_feature (71): n=t or c
agcacgcgtcgacgacgcactcgacacgtgggccccacggtataaacaccctctcactctcactggcgcgncggccccacagatcaacctcatcgtctccg

SEQ ID NO: 10011 - DNA, 101 bp, rice(Oryza sativa)
  misc_feature (71): n=t or g
agaataactctaaaattgccttttgttactttggtcaagtatcctccgtttacagcatataaaaaatgcancccaagccggctgataaagtggcgccccac

SEQ ID NO: 10012 - DNA, 101 bp, rice(Oryza sativa)
  misc_feature (71): n=a or g
aagtcaacggtgtcaaacatttagggaaggagggagtaccaaatgttgactacttgtcaaattagccgctngtttcctcttatacagctggaaagaatttt

SEQ ID NO: 10013 - DNA, 101 bp, rice(Oryza sativa)
  misc_feature (71): n=t or c
aagaaagtccgagaaagagctagctagccatcagggaaaagatatattgtaggttggaaagaatcctgctncctcatatgatatgatgggagagggtgagg

SEQ ID NO: 10014 - DNA, 101 bp, rice(Oryza sativa)
  misc_feature (71): n=t or c
acagaaatgtcaaatttgtttacaagctaaacctaacagggctaagtatcatggtctcctgcaaccccttnctattccagctggagcatggcaagtcattt

SEQ ID NO: 10015 - DNA, 101 bp, rice(Oryza sativa)
  misc_feature (71): n=t or c
atgccagtgcatacctagttccggctcaattctatgtgagtgagtgcatgcatgagtggctataggactcntggagacttacaaaatgtcgtccgagaatc

SEQ ID NO: 10016 - DNA, 101 bp, rice(Oryza sativa)
  misc_feature (71): n=t or c
acatttatgatatgtcattgatatttttattgtcttatttaatgaaacaaactatatgcagtagacgctcncgtcatatggtagattgtgttatgaaacta

SEQ ID NO: 10017 - DNA, 101 bp, rice(Oryza sativa)
  misc_feature (71): n=t or c
ttgtccgacatgtcgacttagtgagtcaatcgtggtcaaactgatacatcagcaggaatcgcttttcaaancactgaaggagtcaatttgtatcggtttta

SEQ ID NO: 10018 - DNA, 101 bp, rice(Oryza sativa)
  misc_feature (71): n=t or c
gcacacgagcacacgagcaaccgagggtcatggtgaacctctcggctatctacattctataatattggaangacccaacgaccagcgttgtgttgggcaag

SEQ ID NO: 10019 - DNA, 101 bp, rice(Oryza sativa)
  misc_feature (71): n=a or g
ggaaacactagaaatggatgatatttgtttttcctgctttcctttttttacccctttccttgtgttaagcnatcgaccttactatatactcttgcattttg

SEQ ID NO: 10020 - DNA, 101 bp, rice(Oryza sativa)
  misc_feature (71): n=a or g
acatgattcagtttcaaaagagtatcaagcctatagtgttaacaaaaaaacgcttgagtagttggcaattncagtatccataactagtatttttaacatcc

SEQ ID NO: 10021 - DNA, 101 bp, rice(Oryza sativa)
  misc_feature (71): n=t or c
aaaagagagagggtacggaaattcagtttggctcttgtacataatttgtgatgaaaaatcttacatggtantccatccctccctaaaaaactaacatagta

SEQ ID NO: 10022 - DNA, 101 bp, rice(Oryza sativa)
  misc_feature (71): n=a or c
tagtttcatttgcagaggtggtacttcagcctggatatacacggtgcaagcgtagaatagtttacactcanacagctcacaagttcaatgagcaggattac

SEQ ID NO: 10023 - DNA, 101 bp, rice(Oryza sativa)
  misc_feature (71): n=a or g
caacgtgttcatcaagagagattgtgaaatcaatgtgttatctatcatgttaaaattgcccactactaccncttgtaagtgtagtagaaagactttttttt

SEQ ID NO: 10024 - DNA, 101 bp, rice(Oryza sativa)
  misc_feature (71): n=a or g
gaacataccaaatttcatgcagccaccaaattgcaaactgaacatcaacaagccttcattcggttgcagcncgcgtcaagtactcaagtcgatctgatatt

SEQ ID NO: 10025 - DNA, 101 bp, rice(Oryza sativa)
  misc_feature (71): n=a or g
actagcataataacattttaatgccagtagcaaatctggctagtgtttttatgtgatatgcttaatcatgnttaataacttcagaattgagaagtaaacat

SEQ ID NO: 10026 - DNA, 101 bp, rice(Oryza sativa)
  misc_feature (71): n=a or g
gactctagtcaccttctcacatggtatcctgaccgcaatagatctctgctcctcctagagtatagtcccgntcctcaccattgaccaaggctgacctcaag

SEQ ID NO: 10027 - DNA, 101 bp, rice(Oryza sativa)
  misc_feature (71): n=a or g
acatgcacgcacacacatcgctacacacacgtacactgcccatcgcaagtgtgctcctttcacatgctcanagaaatggaggctagcgataatttcaaata

SEQ ID NO: 10028 - DNA, 101 bp, rice(Oryza sativa)
  misc_feature (71): n=a or g
cactggtcatgttatgcatgtagaccaatcgtgcatgccttgcattgcatgcaaccaagacggacggcctnatcgcgaaatcgcgcgaggtcgtgtgcggc

SEQ ID NO: 10029 - DNA, 101 bp, rice(Oryza sativa)
  misc_feature (71): n=t or c
aaaatatgtccaagcaaaaacaaaagatatcattaatgtatggacttcgtttctcctttcggaatcaaagnaatgcgcataatactgattttcctcttttt

SEQ ID NO: 10030 - DNA, 101 bp, rice(Oryza sativa)
  misc_feature (71): n=t or c
aaattttgcttcatgtaccacgtgaataccacgttagatgaaaaacgagttaaattagcaatgtaggcgcnacatcagctaaaatcatcatccaaactgcc

SEQ ID NO: 10031 - DNA, 101 bp, rice(Oryza sativa)
  misc_feature (71): n=a or g
gtaaataccctctcttgtgagtggtgaggttaccctcataaagtttacatctgtgtagtgaggttactccntgaggttgtgttaaaattttatttggtctt

SEQ ID NO: 10032 - DNA, 101 bp, rice(Oryza sativa)
  misc_feature (71): n=a or g
ggccaaaatcccggccctgtatttggtgatggcctgggatttcagtggacttagcaagtcagaagcctgtnagagcccaataagccctacgctgtggacaa

SEQ ID NO: 10033 - DNA, 101 bp, rice(Oryza sativa)
  misc_feature (71): n=a or g
cggtaatatctctagtaggaacctagaaagttctatcttgtaagactaggaacctagaaaaagaatgcagnccaagaaaaaaatatctctttttcgatcac

SEQ ID NO: 10034 - DNA, 101 bp, rice(Oryza sativa)
  misc_feature (71): n=a or g
cggtagcactggtattgcttttgacaatagtggtaactgcagtgcagactacagaggctgaatcaggcgtntttattcggctacatttatgatattgtaga

SEQ ID NO: 10035 - DNA, 101 bp, rice(Oryza sativa)
  misc_feature (71): n=a or c
aagcagcaaaatcgcgtaagagaaatcagggagaacgaaccttgccggtgctctcgtagtagtcgttgagngcccattggtacttggattgatccagccca

SEQ ID NO: 10036 - DNA, 101 bp, rice(Oryza sativa)
  misc_feature (71): n=t or c
aacagccaaacgaggccttatatggaggaacctagaaggagatgagtcctacccatatgctcaaccttgantacgtatgacccgagcttttcctccatgtg

SEQ ID NO: 10037 - DNA, 101 bp, rice(Oryza sativa)
  misc_feature (71): n=t or c
acaaaaacatccactgtgcagcaatctacacatcagttatcagttctagcttctaaacaaatgtctaccangagacaatattgttgggtcataacagcacc

SEQ ID NO: 10038 - DNA, 101 bp, rice(Oryza sativa)
  misc_feature (71): n=t or c
tcagggaaagtcaggttgcagcaagggagactctgggagggagccttatattgtagctcacaatcaacttntggctcatgcagcagtagttcagatttaca

SEQ ID NO: 10039 - DNA, 101 bp, rice(Oryza sativa)
  misc_feature (71): n=t or c
gaccatcaaaacgacagtcgttttattttactaagtaggccaaccagcaaagtgacatcgatcgttgaagncagcaacagcaaaagtctataagttaagac

SEQ ID NO: 10040 - DNA, 101 bp, rice(Oryza sativa)
  misc_feature (71): n=a or g
gaacaaaagatagataataaagtggatcaccaaactcttcgtcgctttgtctttctcatgccataagatcntttcgtcttcttcaagccacgcaaaggatg

SEQ ID NO: 10041 - DNA, 101 bp, rice(Oryza sativa)
  misc_feature (71): n=a or g
ttccagtctcaagatgaatgatcgagtaagtaaggaagaaaacattacaaggaataaggttgctgatacangaaatcccctgcaaaggtaaaattataagc

SEQ ID NO: 10042 - DNA, 101 bp, rice(Oryza sativa)
  misc_feature (71): n=a or g
gcttataaatttaaactttgagttccggatccggttatccatatactctctccgttccttattgaccatcntaaactaaaaatttccgttcaaaaaaaatt

SEQ ID NO: 10043 - DNA, 101 bp, rice(Oryza sativa)
  misc_feature (71): n=t or c
ttaagaatttcacttacctgctggcaggcagcttcaacgtcctcctctttggaggaggagccagactaccngtatcccgcgtaagatagcaaatcatgacc

SEQ ID NO: 10044 - DNA, 101 bp, rice(Oryza sativa)
  misc_feature (71): n=a or g
gcttgttggagacaaactttctgcaatagtaccattcatatggtgagttttctgcttttcatctaattcantacctttagttatctaaatgtccctatcac

SEQ ID NO: 10045 - DNA, 101 bp, rice(Oryza sativa)
  misc_feature (71): n=a or g
tggagaatagatataaataaattaggaaagatgatatgatggatgggaagcgatgagagataaagaaaaangaatcagaagaccttggcgacgtccttcat

SEQ ID NO: 10046 - DNA, 101 bp, rice(Oryza sativa)
  misc_feature (71): n=a or g
ttttaaggatttagtcatatcggcaacatttctaatggccgatttcagcctagacttctgttcttcaacancacttggaagatcggctagcttttgctttt

SEQ ID NO: 10047 - DNA, 101 bp, rice(Oryza sativa)
  misc_feature (71): n=t or c
ctttggaatttgttgaaacctcaatttcgggatctgttgaaacttgaaactaaggccctgtttctttcagnttgggattattataatctagattattgagt

SEQ ID NO: 10048 - DNA, 101 bp, rice(Oryza sativa)
  misc_feature (71): n=a or g
aaatgctatatttcaaatggaacataataaagctccagggcctgatggttttccggcggagttttatcaantgttctgggaggtaattaaggatgacctaa

SEQ ID NO: 10049 - DNA, 101 bp, rice(Oryza sativa)
  misc_feature (71): n=a or g
ctataatatgagacgggtagttctatgtctagtgtgcatgcatgtaataatataggtttacttaaaagccnagtgatcgcttgaagattaggagcgccaca

SEQ ID NO: 10050 - DNA, 101 bp, rice(Oryza sativa)
  misc_feature (71): n=t or c
ggacgcctgtgaaaatgatttttgtaggcgaactgaaggccacctgtgaaaatggacgtattttcgcaggncttgaagtacagatagagtgaatgtccgcc

SEQ ID NO: 10051 - DNA, 101 bp, rice(Oryza sativa)
  misc_feature (71): n=a or g
cagcccacacagttgagggacgaaaaatagactttttcttggagaagcacgataggccatcgtgtcttcgngctggcccggcacggcccaagttgtattgg

SEQ ID NO: 10052 - DNA, 101 bp, rice(Oryza sativa)
  misc_feature (71): n=t or c
cgctacgctcatgatccaccagctcgtatctctcttagttacgctgcaatgctgcgtctgatatgtgttgntgttaatcttagtagctctgattcatctga

SEQ ID NO: 10053 - DNA, 101 bp, rice(Oryza sativa)
  misc_feature (71): n=a or g
agccatagtagtacttttcttggggacatcctcctccaggtggtagcaagaagtcttccagaaatcctcanatttcaaggtggactgtatcagagccttct

SEQ ID NO: 10054 - DNA, 101 bp, rice(Oryza sativa)
  misc_feature (71): n=a or g
tcactgccgcatccacatgtctggctggaattttgaaatcttggctcacacctgtggatgggccaggatcnaggcacacttaaaagaggcctaagctgttt

SEQ ID NO: 10055 - DNA, 101 bp, rice(Oryza sativa)
  misc_feature (71): n=t or c
caaaaattgactttgactcttagtatagtactgctccctccattacatttcaagtgcagccatcaatttcngtgtccaacgtttaactattcgtcttattt

SEQ ID NO: 10056 - DNA, 101 bp, rice(Oryza sativa)
  misc_feature (71): n=a or c
tggaagtcgagactgcggtggcgtcactgagctaggcgccactgcttcattgataagtcccctaccacagngctaggtccattgacgttgaggttgggagt

SEQ ID NO: 10057 - DNA, 101 bp, rice(Oryza sativa)
  misc_feature (71): n=a or g
tcgaaaaaattgttgtcgactatgtgcgtgcgtgacagtacagtgcacggttgaaaagcaggggagaggcntcagtataccagaggtcagaggaaattggt

SEQ ID NO: 10058 - DNA, 101 bp, rice(Oryza sativa)
  misc_feature (71): n=t or c
atatctagatcaaatttgaccttcgataattgtagagggataaaacataataatccatattatctaatttntttaaaaaaatcaaaatcatttgaactaca

SEQ ID NO: 10059 - DNA, 101 bp, rice(Oryza sativa)
  misc_feature (71): n=a or g
agaaaactaaatctttccctccaacagaacacacaaataaggtaactgaaatctaatgctctgaatctacntaagtgtttttttttttttgcgcctccatg

SEQ ID NO: 10060 - DNA, 101 bp, rice(Oryza sativa)
  misc_feature (71): n=t or c
atagaggttaaaagtcgttcctaagcaattattaactgtagcaacgacgttggcctctcctcacttctctnccttccatatcatcaaatattcctaattag

SEQ ID NO: 10061 - DNA, 101 bp, rice(Oryza sativa)
  misc_feature (71): n=t or g
atgttgaatgggatgtatatatatagatgtcgtgcatagcattgcttttctacaatttgttttgttctcanaagtcattttcgatgtctattataagtgtc

SEQ ID NO: 10062 - DNA, 101 bp, rice(Oryza sativa)
  misc_feature (71): n=a or g
cggtagtgcccttcctagacctttttcgttttttctacgaactccagtggatggaggccggcagggtgtcnggatgctgcaggtgcaggggctaaccgggg

SEQ ID NO: 10063 - DNA, 101 bp, rice(Oryza sativa)
  misc_feature (71): n=a or g
ttcctctagctcggggtctctctcctccaaccttcctccctgtgtggggccgtgttacgggataggacacntggcgcgattttatcatatgtaaaattgct

SEQ ID NO: 10064 - DNA, 101 bp, rice(Oryza sativa)
  misc_feature (71): n=t or c
ccttttcaatattttcttctcggtgttgattgttactattactaagataatagtaccttgcacgttactgngtaaatatgtataaataaaagaaaaaaaag

SEQ ID NO: 10065 - DNA, 101 bp, rice(Oryza sativa)
  misc_feature (71): n=t or c
ccttctggaagctgttaaaatatgtgcaaccatatctagttatacctcaaaagagcttttgccatccgtanggcttattaataggtcaacgtagttcaata

SEQ ID NO: 10066 - DNA, 101 bp, rice(Oryza sativa)
  misc_feature (71): n=a or g
gtggaagatggagaaaagagatggactcctgaggagatgaggaggaagatattttagagtagaaatatggncgatcctcaatgaaaatgatatctcgagat

SEQ ID NO: 10067 - DNA, 101 bp, rice(Oryza sativa)
  misc_feature (71): n=a or g
tttagtcccggttcaaaagagggcaggtagtggacccctatattttctttagtttcggttgtccaaccggnactaaatatctatttgggttgtttcttttt

SEQ ID NO: 10068 - DNA, 101 bp, rice(Oryza sativa)
  misc_feature (71): n=a or g
acactgatgttattgttgctgaagtccgtgaaacaagcagaaaacctgatgaggtacactcgcttctttgnttcatggttctatactcgccgcaaaagcat

SEQ ID NO: 10069 - DNA, 101 bp, rice(Oryza sativa)
  misc_feature (71): n=t or c
gacactccccaaatgcctttacactacaataaagacattttcaagtgtcaaatggttacaaacgaagatgntgtcatggttacaaatagggcataccttct

SEQ ID NO: 10070 - DNA, 101 bp, rice(Oryza sativa)
  misc_feature (71): n=t or c
cgtaccagagacagcagcagcgtacaccgcggccaaaagcaaaagggtgatcgttctgggcttctggcctntttgcacaaagctggcactcgcaagctgtg

SEQ ID NO: 10071 - DNA, 101 bp, rice(Oryza sativa)
  misc_feature (71): n=t or g
aagccattttgcaagaagtaaagcaatattagtagcttcctaagctttagtttcagtttctttatcagtgntagaatgctgaccatgatgccggggacggc

SEQ ID NO: 10072 - DNA, 101 bp, rice(Oryza sativa)
  misc_feature (71): n=t or c
tccagcatattatagcgcttatcaaagttacaagttacaacggctcacagccggccgtcaccggcagctantctctctcgttatgctaagtcgatatgagg

SEQ ID NO: 10073 - DNA, 101 bp, rice(Oryza sativa)
  misc_feature (71): n=a or g
aattagcttaaaaacttggtagcttcaaccgcacattatttacttaaagttaaagaagtgatcatgaaaanaatcaggtagtaatccgtagtttttttgtt

SEQ ID NO: 10074 - DNA, 101 bp, rice(Oryza sativa)
  misc_feature (71): n=a or g
atgaagtattgcgatacaaatgacatctatggtatgctatcgtttaaatgttagttttgaactgtagagtngaataacttaaaatcatagctggaaggggt

SEQ ID NO: 10075 - DNA, 101 bp, rice(Oryza sativa)
  misc_feature (71): n=t or c
aaggttctcttcgatatacagcgtctgataaggactaacgatgtaggcgaaacaactgcggtggatagttncactttcatatgttcttgtacctttatctt

SEQ ID NO: 10076 - DNA, 101 bp, rice(Oryza sativa)
  misc_feature (71): n=t or c
cgacgtgtgggccccaccaccacgcagcgccccatcatctcctgacatgagccacctgatcccgattgganagctgttgctgccgcccgcctcctctctcc

SEQ ID NO: 10077 - DNA, 101 bp, rice(Oryza sativa)
  misc_feature (71): n=a or g
gggcttactatcgtgatcaagtccagcagaattagcagctcctccttctgaatgtgcatggtgaaactcanaaacgaaaacaaattagtgaaattccaatt

SEQ ID NO: 10078 - DNA, 101 bp, rice(Oryza sativa)
  misc_feature (71): n=t or c
tatgtgcaacgaaggtgcgatggcagtgagggcgcacgatgtcagtgttcagaacaccaacgggcaccacnggtgccatcaccactatcgcaccggcaaac

SEQ ID NO: 10079 - DNA, 101 bp, rice(Oryza sativa)
  misc_feature (71): n=a or g
aaaaccagttagatgtccaagaaagcgaacaaaacaaccagcttctatgatgttgcaaacataaccctacntaaaaatggatgtcaaccaatttgcccata

SEQ ID NO: 10080 - DNA, 101 bp, rice(Oryza sativa)
  misc_feature (71): n=a or g
cacgctatattcgcactaccgcattttctatacttcattgaaatattgtaagggcactgaaatccacgtanacatgaagtatatactttctccgtctcaaa

SEQ ID NO: 10081 - DNA, 101 bp, rice(Oryza sativa)
  misc_feature (71): n=a or c
tcggacgcggcggcgacgctcgatagcctcgactgtattggtcccttcgtccttggtgacctgtcacgaanagagatttcccttggcgtgacatgaccacg

SEQ ID NO: 10082 - DNA, 101 bp, rice(Oryza sativa)
  misc_feature (71): n=t or c
ctccatcctgcccctgaattcacactctctgtagaactcttcatgtcctaaaataaattgatttctcgtgngtaaaataaaatttaatacttaaagaaaaa

SEQ ID NO: 10083 - DNA, 101 bp, rice(Oryza sativa)
  misc_feature (71): n=t or c
atagagaaatgcttcagattttcattctagtttgtagcagccaaactttatggtcgaggaaaggggcaggnagagtgaaactggcatatccttaagacggt

SEQ ID NO: 10084 - DNA, 101 bp, rice(Oryza sativa)
  misc_feature (71): n=t or c
ttctatgattcttttttcgagatttcattatcgatactctccatgtgacactgatgtagtagtacttcttngagaaatgtcacaaaacattatgcagtttc

SEQ ID NO: 10085 - DNA, 101 bp, rice(Oryza sativa)
  misc_feature (71): n=t or g
ctgttttaccttttcattagttttcacgtcaacaatcatatatcgtgttgagctgacctgttttttttttnttttttttactttgtttgagtgttctgtaa

SEQ ID NO: 10086 - DNA, 101 bp, rice(Oryza sativa)
  misc_feature (71): n=t or c
ccttcttactcaaaaatgccatccaaatcttgaatggaagatcaaacggccttaaaatcaaactcatatangtactccttccgtttcaggttataagacat

SEQ ID NO: 10087 - DNA, 101 bp, rice(Oryza sativa)
  misc_feature (71): n=t or c
cttaaaaatcatctaaacggttataaaatattctggaaaattttgataggacttatgcaacatatctatanaactttataaaatcttagattcaaactcaa

SEQ ID NO: 10088 - DNA, 101 bp, rice(Oryza sativa)
  misc_feature (71): n=t or g
ataccatttctaacatctgaaagaatctactccgcatccattccgaatccacttaaaagatatggtttatnatacggtattaccactatccgtctgaatcc

SEQ ID NO: 10089 - DNA, 101 bp, rice(Oryza sativa)
  misc_feature (71): n=t or c
agtacatggatgatggatgatggtgattatgtcccacttccattagataactgaacttaatgaaagataantgaactttaaacttaacataatatgtaaga

SEQ ID NO: 10090 - DNA, 101 bp, rice(Oryza sativa)
  misc_feature (71): n=t or c
tcgccatggcgaccatggaacggatcgtgcgattccggcttgacgaacggctttggccttggccggctcgntcgcttgctgctgctacctgccaaggagat

SEQ ID NO: 10091 - DNA, 101 bp, rice(Oryza sativa)
  misc_feature (71): n=a or g
ttaaaataacttttgtatagaaatttttttatagataacacaccgtttataaaccgtttgaaaagcgtgcncgtgaaaaacgaggtacgtgagttgggaaa

SEQ ID NO: 10092 - DNA, 101 bp, rice(Oryza sativa)
  misc_feature (71): n=t or c
atgggcatacatatatatgagtcaatcatgcctatatgatataggccatatacatgtatatatgccagtangcgcatggctcgtgcatgaatcaatattta

SEQ ID NO: 10093 - DNA, 101 bp, rice(Oryza sativa)
  misc_feature (71): n=t or g
actcagaaaaaaaaaccccatcaggttggggttctccaaaatccctagttttggggagccattcgaaaganatttcacaccattctaaaagcctcaatttg

SEQ ID NO: 10094 - DNA, 101 bp, rice(Oryza sativa)
  misc_feature (71): n=t or c
gactttcaagtcaactttcaaatgtaactaattcattaacatttcttggtctaaagcaacatcatggaacnataacatttcaatgttacagatggtacaga

SEQ ID NO: 10095 - DNA, 101 bp, rice(Oryza sativa)
  misc_feature (71): n=t or g
aaacggtacggatcaagcatccagagattcaagatgctgccggataaacgctcttggtgaccgcgttgaanatgtcggtgtaccccacgacgccgacgagc

SEQ ID NO: 10096 - DNA, 101 bp, rice(Oryza sativa)
  misc_feature (71): n=t or c
cagatacgcttaaccaaacaagcgtgttgtattcggcaatgtatcaggtgcactcaggctgttccgtgcanacatgcactcgtgcaaacacattcatccga

SEQ ID NO: 10097 - DNA, 101 bp, rice(Oryza sativa)
  misc_feature (71): n=a or c
gccgttgccgactatacacggttgcattgcaccgctgctgtccgctttgcgtgttcgttcaaaaccagtcnagcgtcgtggcagaggcgaacgaaccatcc

SEQ ID NO: 10098 - DNA, 101 bp, rice(Oryza sativa)
  misc_feature (71): n=a or g
cagctggtacaacagcgtttttacaggtcaggatcgcaggacattgtattggctaattttgtcgttgcatncctaattactagttaattccacgtttagtg

SEQ ID NO: 10099 - DNA, 101 bp, rice(Oryza sativa)
  misc_feature (71): n=a or g
agcaacaaagaccactgttgtgcccaataagtccccttgaagataacctgcaaaaaaggaattagttttgnagccattaaagacaacatcatttctattta

SEQ ID NO: 10100 - DNA, 101 bp, rice(Oryza sativa)
  misc_feature (71): n=a or c
cacttcaaaccaaacaaatatttcattttgaaccgggaaaatttacatttatggcactttggactaccctnaactattttatctatatgcatcaacttgtc

SEQ ID NO: 10101 - DNA, 101 bp, rice(Oryza sativa)
  misc_feature (71): n=t or g
atgttagacacgaaacctacctcgtcatcctccggaagccaccaaatgccggcgccatggacgaagatgcncaccgccgttggcacgtgtctttcctgccg

SEQ ID NO: 10102 - DNA, 101 bp, rice(Oryza sativa)
  misc_feature (71): n=a or g
cgacactaatcaagccgatgctgatgatatggaagaagcttctgctaagttgattttgtcacgagaacaancaatttttgagaaaccagaggggacagaaa

SEQ ID NO: 10103 - DNA, 101 bp, rice(Oryza sativa)
  misc_feature (71): n=t or c
atttaactgtctgctacgtttgcgcaatgcagtgaagttaagtatagttcaatgctcccatgttttttttntttttttttttttgagaaactttcatggaa

SEQ ID NO: 10104 - DNA, 101 bp, rice(Oryza sativa)
  misc_feature (71): n=a or g
tgaattcaaatattcgccgacgaaattcacacggttttaggtggttaccacatggtaaccgccttactgcnggggctagggatgctatgtggtaaccgcct

SEQ ID NO: 10105 - DNA, 101 bp, rice(Oryza sativa)
  misc_feature (71): n=t or c
ggaatactcctctataggctgtgattagttccttggccaaaatctttttaagtacacggaaagtattaaanatagtctaataacaaaataaattatagatt

SEQ ID NO: 10106 - DNA, 101 bp, rice(Oryza sativa)
  misc_feature (71): n=t or g
ctagctagcgatacacagatacaggctgcaggctgcagctgctcctgttttgtgatcaccaggaacgttgncactcacacaccatatccttcctggtctca

SEQ ID NO: 10107 - DNA, 101 bp, rice(Oryza sativa)
  misc_feature (71): n=a or g
atagaggatgcgagaaaatccatgtaacaatattgctaccttaactacaacttacaagagatttgaccaanggcctgtttggtacagctccaactcctaaa

SEQ ID NO: 10108 - DNA, 101 bp, rice(Oryza sativa)
  misc_feature (71): n=a or c
tttttgtggaactcaggaggatggatcggagtggatttgtaaaccctagcttccgccagtgtggtttgcantgtagcagagaatggggaaagtggcgagag

SEQ ID NO: 10109 - DNA, 101 bp, rice(Oryza sativa)
  misc_feature (71): n=t or c
acaaactattattcttcgcgtttggatgtatgcatgcatagcttgaagcctaattgaacagttaattacanctcgttcgtctcaaaatataaataatttta

SEQ ID NO: 10110 - DNA, 101 bp, rice(Oryza sativa)
  misc_feature (71): n=a or c
tatactattatctcaatcaatcacaactatcttttatttaatttttccgcgttctcttcttcgtatcaacnaacttcaatacattaattgttataaatatg

SEQ ID NO: 10111 - DNA, 101 bp, rice(Oryza sativa)
  misc_feature (71): n=t or c
cccttctcttgtgtttctcaccttaggctagggaatacgataaagagtgcatgttaaacacaactcattcntgatctagcccaaccatgcacttggaccat

SEQ ID NO: 10112 - DNA, 101 bp, rice(Oryza sativa)
  misc_feature (71): n=a or g
tgctgttcttgttgtccccatgaagatcgtggagccaagttaaaccacaagttctttgtcaaattttaaangactggcccacgctcgtgccctgtgccgct

SEQ ID NO: 10113 - DNA, 101 bp, rice(Oryza sativa)
  misc_feature (71): n=a or g
aaattaatattgaattttaaagtacttatacactaattaccacccacttacattcacttacacggcacttncactataattacatatgtaatttattcact

SEQ ID NO: 10114 - DNA, 101 bp, rice(Oryza sativa)
  misc_feature (71): n=t or c
tttttattttattatcttcttacgtatcttactctaattacagctaattttccctattttctactcccatnagataatatactccctccgtctaaaaaaaa

SEQ ID NO: 10115 - DNA, 101 bp, rice(Oryza sativa)
  misc_feature (71): n=a or g
taacaggtgcattggagctataaggctgagatcataattattactagcttataagaacggttagtttcttntttatggtgagcatatttttccaaattacc

SEQ ID NO: 10116 - DNA, 101 bp, rice(Oryza sativa)
  misc_feature (71): n=t or c
gccagtcttaaccaaaatgtcaactccgcatatccaatagccacatgctgtcaatttttaaatctcacatngatgtttgttaagaggtggtgaggctagcc

SEQ ID NO: 10117 - DNA, 101 bp, rice(Oryza sativa)
  misc_feature (71): n=a or g
attgggagggaggcgtacgtacgcgctcgtcagatgaggggtggactaattaactttttctttaatctaanctaatctaatggtctaaaataatggaccca

SEQ ID NO: 10118 - DNA, 101 bp, rice(Oryza sativa)
  misc_feature (71): n=a or g
gtagccaggtaggtgtgaggaacgggaggaccgtaattggtataggtagtactaatgaaatcgcacattgnatttcagctcagcccaggtccaagcaactg

SEQ ID NO: 10119 - DNA, 101 bp, rice(Oryza sativa)
  misc_feature (71): n=a or c
caactgcatctgtatgtctctagcctggatgagggagaagagccaggctagatccatacgagcaaccaaanacaccctatgctatccggcttacgttttcc

SEQ ID NO: 10120 - DNA, 101 bp, rice(Oryza sativa)
  misc_feature (71): n=t or c
aggaggtcgtctccctgctgccaatgggccacagctaagcttgaggacgacttcaaggcgcgatggacgangaggcgaggagccgacgccgccccatcctc

SEQ ID NO: 10121 - DNA, 101 bp, rice(Oryza sativa)
  misc_feature (71): n=a or g
aacttccaattttaatgtgaactaaacacagccgtattctaacaatcctgattattttttaaagtataatnatctgcatctgttattatgtgtatgtgcaa

SEQ ID NO: 10122 - DNA, 101 bp, rice(Oryza sativa)
  misc_feature (71): n=a or g
cacttagtccatgaactattgatattcacttctccttttattttaccatttctttttctcgaaaacgcagnagaaatgcgattcgtttcattaaggaaaag

SEQ ID NO: 10123 - DNA, 101 bp, rice(Oryza sativa)
  misc_feature (71): n=t or c
cagcagttattcctgtagacattgtccacccttgccggacatatcttggtccttataccaaagatgagcangcgaagtaccaatccttgcaaaatggttta

SEQ ID NO: 10124 - DNA, 101 bp, rice(Oryza sativa)
  misc_feature (71): n=a or g
atcgtgcaaatacttgcatgcaggtactgaatagttatcctttcgtagcatatataatttttaggaagttnagagatttcagtccttcagaggagttatct

SEQ ID NO: 10125 - DNA, 101 bp, rice(Oryza sativa)
  misc_feature (71): n=a or g
taaccatccgatatcagatgtgcgctctccatgttgatctccgacttcaatagccagagttgatctattcnccttctgatcggctgttgagctacccatca

SEQ ID NO: 10126 - DNA, 101 bp, rice(Oryza sativa)
  misc_feature (71): n=t or g
tcaaaggttacatgttctatctttgggtttgtatggacatggtatactatccccttaaattaaaataaatntttgccctagagtttatcaacaaatctcaa

SEQ ID NO: 10127 - DNA, 101 bp, rice(Oryza sativa)
  misc_feature (71): n=t or c
ctgatttcgagactgatggacagtgatgtatgatggtgtgatcacgagatttgtttctactccctccgtcncataataagtgacgtttttgactttttatt

SEQ ID NO: 10128 - DNA, 101 bp, rice(Oryza sativa)
  misc_feature (71): n=t or c
gagatcatggagtacgacgaattcggcttccgcaacaacaatcaagatcttgacgacttcgacgaaagctnggaagataactacacccctttctatttcag

SEQ ID NO: 10129 - DNA, 101 bp, rice(Oryza sativa)
  misc_feature (71): n=a or g
gtggcagttaaggcggtttctggatagttacacctgacttgtgggccctcttatccacaagcttgcttacnaatgaggttttcttcactctctttatattt

SEQ ID NO: 10130 - DNA, 101 bp, rice(Oryza sativa)
  misc_feature (71): n=a or g
gattcggtgttcgtttgtcgaccacgtgttcccatctgtgaaggtctcatgaccaaaacgagccagtcccnacgtcccaaccatgactacttcgtcaagcc

SEQ ID NO: 10131 - DNA, 101 bp, rice(Oryza sativa)
  misc_feature (71): n=a or g
gactctataactcggctaccccttaaatatagaggaagtgtcataatgcaaccatgtatggcaactataantactgtaaacatgcagggagagagtgacgg

SEQ ID NO: 10132 - DNA, 101 bp, rice(Oryza sativa)
  misc_feature (71): n=t or c
catgaggagcaaacaaaaacaatctgctcccacgatgacgggcacaagccaacagaagaaaaaacgggtangtctttttacatgaaattttcactctcagc

SEQ ID NO: 10133 - DNA, 101 bp, rice(Oryza sativa)
  misc_feature (71): n=t or g
tgcctgtccgcacacaggccactgagccgagaggcactggccatgcatatgcatgcaggcagctttgatcnatcggtcggtggcggtggccgatcggtgga

SEQ ID NO: 10134 - DNA, 101 bp, rice(Oryza sativa)
  misc_feature (71): n=a or g
gttaattttatggtctagacaatctagtactatctttaaccatctagatggtcaaacagtctaattcacgntttagtctctaaactagacgataacacatt

SEQ ID NO: 10135 - DNA, 101 bp, rice(Oryza sativa)
  misc_feature (71): n=t or c
ttcttcactgccccgtgacctccccaaatcgccctccataatccccacgacatcagacatgctagtaattncagatcgaaaaaacatccatcttgaaagaa

SEQ ID NO: 10136 - DNA, 101 bp, rice(Oryza sativa)
  misc_feature (71): n=t or g
aatttggagcttctcacggtagttcccgtctggagctagtttggggcgtgacaattcgacttttagaattntatacctacacagactcttgtctactcttt

SEQ ID NO: 10137 - DNA, 101 bp, rice(Oryza sativa)
  misc_feature (71): n=a or g
aggaacccaaccgccgctttattggatttaggagttggttccattgtgcaacatgtgtgctagtaggggtnaaaacggtacggaaaccatctttatcgttt

SEQ ID NO: 10138 - DNA, 101 bp, rice(Oryza sativa)
  misc_feature (71): n=t or c
cacggcccaacaaggaccaagcccaatacgccaaaattggtatctaagtactccctccagtccaaagtgangaggttatcctgatcctccatatcatctgg

SEQ ID NO: 10139 - DNA, 101 bp, rice(Oryza sativa)
  misc_feature (71): n=t or c
tcctaatttggcgcatccgccacttttggagggcctgttagcgtatctgctggagctgatttttccccttntatacggcaaatgaaggatggatgaccggt

SEQ ID NO: 10140 - DNA, 101 bp, rice(Oryza sativa)
  misc_feature (71): n=a or g
tagccgccatatccaccaccatacccaccaccatttcctccgccgtacccagatccataaccgccaccatngcctcctccatgtccatatccatcaccatg

SEQ ID NO: 10141 - DNA, 101 bp, rice(Oryza sativa)
  misc_feature (71): n=t or g
tttagataaagaagcaacagatatactgacagacaagcctgcaatcgatctgaaactgaaatgcgacattngtgagattgattaaaacaaaaaaccaaaaa

SEQ ID NO: 10142 - DNA, 101 bp, rice(Oryza sativa)
  misc_feature (71): n=t or c
ccacaaagggaacaagattgggatggctcagtttgctgatcactttgatctcattatcataatctcgtgcngctcgttcatgatctgcaaccctcataatc

SEQ ID NO: 10143 - DNA, 101 bp, rice(Oryza sativa)
  misc_feature (71): n=a or g
aaacacatgtccaacaaataacacaatatttattcatcgaggagtaggtcaatagggtatacacattacanaaattggtgacacgacacaacttttttgca

SEQ ID NO: 10144 - DNA, 101 bp, rice(Oryza sativa)
  misc_feature (71): n=a or c
aaaaaggatatctccgattttcttatcgtcctcgcgcaaaaattcatatccaattttcctcgcgcacgtgntagcttatagatgggccagctttgcacgtc

SEQ ID NO: 10145 - DNA, 101 bp, rice(Oryza sativa)
  misc_feature (71): n=a or g
ggcgactagtatccataatccattgatttccatcagagattgttgttttccaccatcaacttgtggtccancttccaaggaactatatacttggactgatc

SEQ ID NO: 10146 - DNA, 101 bp, rice(Oryza sativa)
  misc_feature (71): n=a or c
ttccggcccgtcacaggtgatgggatacctatgacgggtcgcggccgaattccccaccgataacggcaaanctagcgacccgtcaaaggtgacggtcatct

SEQ ID NO: 10147 - DNA, 101 bp, rice(Oryza sativa)
  misc_feature (71): n=t or c
gtctcttctaaccactaagttacgtgcctttaaattcatgtatataaaaagatttggagagacgtcgctcnaaatatattttaagaagaaatcgtgagcat

SEQ ID NO: 10148 - DNA, 101 bp, rice(Oryza sativa)
  misc_feature (71): n=a or g
acaaatagttgtgaaaaattattgaaaaaaaatgacaatataaagtacagtgacatctattggtctatcantaatcaacttgaaattcgacctacacataa

SEQ ID NO: 10149 - DNA, 101 bp, rice(Oryza sativa)
  misc_feature (71): n=t or c
gaaaactggagcagatcgagtccatcggctgtttggatagcatttttgtcctacatggcactcatgggacngacatgtcagtaaaaaaaaaacaacccaca

SEQ ID NO: 10150 - DNA, 101 bp, rice(Oryza sativa)
  misc_feature (71): n=a or g
tagactagtagtagactcatgtaagccaatataatctaggattaagggccctttgaatcaaacaaattatngaggaaatttcataagattgaaatcctacc

SEQ ID NO: 10151 - DNA, 101 bp, rice(Oryza sativa)
  misc_feature (71): n=a or g
atgagacaaaattgccccttatcaacttagccgaagctcgtcatcatcggggaaggtggtggcagcgggcnccagaggtcgcgccgtcgcctgtgcccgtt

SEQ ID NO: 10152 - DNA, 101 bp, rice(Oryza sativa)
  misc_feature (71): n=a or g
acctggtgtaggaacataattcctttgcctctcagcttcaattctagcttgctcagctctctcatcctcanttctaagtccaacaaatgtatacatttcat

SEQ ID NO: 10153 - DNA, 101 bp, rice(Oryza sativa)
  misc_feature (71): n=a or g
atgggctttaggcaacgcgacacagtggctcaatcaaaccatctccgcgctcacccacttttggaatggcngttccaaaaaaacgtacttcgatgtcaaaa

SEQ ID NO: 10154 - DNA, 101 bp, rice(Oryza sativa)
  misc_feature (71): n=t or c
ttgagagaattcaaatacaggggcatacatgcacacaccgtgatcaattaccagatctccattcgcttganacggtgttgtccaaaaaaaaagacagctgg

SEQ ID NO: 10155 - DNA, 101 bp, rice(Oryza sativa)
  misc_feature (71): n=t or c
tcgtatgtgtcctagcggtagattcacccgcctgcgaaaaacattacagcgaataaaaaaaatggcgctgncgccggcctccccctccggccgacggctct

SEQ ID NO: 10156 - DNA, 101 bp, rice(Oryza sativa)
  misc_feature (71): n=a or g
caaatgggccaaaaactcaaaattgacacgatcaaaaagtcccataattcacaattctaagtctagaagcngaagaggagacggccgccgagtactgggct

SEQ ID NO: 10157 - DNA, 101 bp, rice(Oryza sativa)
  misc_feature (71): n=a or g
ttggcgtgaggagagaagaacgcaaaaattggcattcctctctcctgttttagcgcatccgctggtggccnatttttcacccccatccgctatttctcaga

SEQ ID NO: 10158 - DNA, 101 bp, rice(Oryza sativa)
  misc_feature (71): n=a or g
tcagggcatcacggatggaacagatgccaagaaggtggacatggcagcaccggtggaatccttcctcaccnctgcccgtgaccatccctcctcgcttcgag

SEQ ID NO: 10159 - DNA, 101 bp, rice(Oryza sativa)
  misc_feature (71): n=t or c
cacggaatcgtgacaatctattgaattatgaaaatggccctcaaaccaaatgttattggtagtacacacgnatcaatgtcagttggttgtgatatcacaat

SEQ ID NO: 10160 - DNA, 101 bp, rice(Oryza sativa)
  misc_feature (71): n=a or g
ttatcggtcaaccccaatatccgatataacgtgtccctcaacttacaatacctaggtacctgaggtcctangataattttgtgtctggttttgactgatgt

SEQ ID NO: 10161 - DNA, 101 bp, rice(Oryza sativa)
  misc_feature (71): n=a or g
tcgttcgcttgtgtacgtgtggggcgcagcgtctgcagaatatgaaaccgactcgagaagggtgacgtacnaaagtttctaggaaaaaaacatcttaaact

SEQ ID NO: 10162 - DNA, 101 bp, rice(Oryza sativa)
  misc_feature (71): n=a or c
agaacgcagcctaaacgcccatgcgttgcaaccggaattaaaaaaagaaccttactgtacactttaaagcntcaaaaattaaagtaaaactattttcattg

SEQ ID NO: 10163 - DNA, 101 bp, rice(Oryza sativa)
  misc_feature (71): n=a or g
ataggcaatggaagcattggtgttatattttgagctaaccctgccacttgatgtattataaaccaaggaancttacatgaccgtgtcaaggtcagctgggg

SEQ ID NO: 10164 - DNA, 101 bp, rice(Oryza sativa)
  misc_feature (71): n=t or g
ctcgtcgtggtggggcccgccggcttggctccagcttggcttggctcggctctatttggctcgatttttgnggtgtcagtttttaattaaccgacacctat

SEQ ID NO: 10165 - DNA, 101 bp, rice(Oryza sativa)
  misc_feature (71): n=a or g
gggagtgcggaaaactcttggctcgagtcgagtcctctcttttttctaaataatagaatataatatctcgncctttactcaaaagagctgcagccaattat

SEQ ID NO: 10166 - DNA, 101 bp, rice(Oryza sativa)
  misc_feature (71): n=t or g
tgtttgtaaccaaaagaataaaatattgtctgggagtgtatttgtatttcttcttcttgcaaacataagantaaatttcacaaaaatacatatatatattg

SEQ ID NO: 10167 - DNA, 101 bp, rice(Oryza sativa)
  misc_feature (71): n=t or c
gtgatacatgcgatgtgctatgcagttttttttgttgctttgcttggttgttgcttcgtgagagaagtagntggtctattggtggatgagaagacgggaaa

SEQ ID NO: 10168 - DNA, 101 bp, rice(Oryza sativa)
  misc_feature (71): n=t or c
ggagattgcttcacaggtctcttggacgcggaggtctcacatgacttggccaaggaaattggttcgcggancagaggccacgtgaatctcatcatgacctt

SEQ ID NO: 10169 - DNA, 101 bp, rice(Oryza sativa)
  misc_feature (71): n=a or g
tgtatttcaataggcttcatattagttgttggttcagtacttattgttcgaaatttatgatagaaagcctnctgaaattattatatgtattatatgttgtc

SEQ ID NO: 10170 - DNA, 101 bp, rice(Oryza sativa)
  misc_feature (71): n=t or c
cggcttcgtctctctctccatcagcccgtctcgctcttgctccgcgttccgcttggctttccggctttagnagagtagtgagagagagagagagagagaga

SEQ ID NO: 10171 - DNA, 101 bp, rice(Oryza sativa)
  misc_feature (71): n=a or g
ttgtgtgtatccaaaggagtgatgttctcatcaattcacgcatgcacacacaaggtctccgagttcctctncctcccccgcatgtcgcctggggcttgcta

SEQ ID NO: 10172 - DNA, 101 bp, rice(Oryza sativa)
  misc_feature (71): n=a or c
gttcgcaagaaaatcctatctttttcgttctggcgagcacggacatcaccgctagccatagctagcttctntgttagaatgcatggatatccactgtgaat

SEQ ID NO: 10173 - DNA, 101 bp, rice(Oryza sativa)
  misc_feature (71): n=a or g
cacattttctttctatcatataacatttcactctatactattgtaaacccaagtaattgaaacgtagcacnagacaaatagaaaaatgacaccacatttaa

SEQ ID NO: 10174 - DNA, 101 bp, rice(Oryza sativa)
  misc_feature (71): n=t or g
ttttaagacggagaaaataatagtactccctctgtcccactgtcccagaatataatgcctcctccaacaangatgagtcagctagctcataaatctccaca

SEQ ID NO: 10175 - DNA, 101 bp, rice(Oryza sativa)
  misc_feature (71): n=a or c
gtttgtcagatctgaattacagtcagtactaacacacatgatattaatctagaacattacgtgtaaactantgaatttcacctaataatttttttttaaga

SEQ ID NO: 10176 - DNA, 101 bp, rice(Oryza sativa)
  misc_feature (71): n=a or g
ctcacgatttaaccacacctagaacacgaccactcacaagctgaaataagtggcgataggaaaaaaaaaanggaaagcaaagcttctgcttacaacatttc

SEQ ID NO: 10177 - DNA, 101 bp, rice(Oryza sativa)
  misc_feature (71): n=a or g
gccccagttgccttatatatactgataaattactgagatactctctctgatcctataggcaggcatgcagnacagcataatgtacgtatatgatatggagc

SEQ ID NO: 10178 - DNA, 101 bp, rice(Oryza sativa)
  misc_feature (71): n=a or g
ggaggtatgtttcccctgatgcagtagctccgtctgggtcgttaaggactaaatattttgacgtctattcnagcaccctacgtacttaccacatgccgtat

SEQ ID NO: 10179 - DNA, 101 bp, rice(Oryza sativa)
  misc_feature (71): n=t or c
gcccacgagaatttatactatttaccatcaaattcgtactcctcaacttttttaccacctaatccgcatgnttttttataatatgtcattagaagtgctaa

SEQ ID NO: 10180 - DNA, 101 bp, rice(Oryza sativa)
  misc_feature (71): n=t or c
atccagtacagttactattgcaactgcacaatagcaactcaacacaatttgagccctctatttctagattnaatgatccaaatcgcttgctacagtgaatt

SEQ ID NO: 10181 - DNA, 101 bp, rice(Oryza sativa)
  misc_feature (71): n=a or g
tggtacaagctttaatcttgagttatttttgattggttactactactagtactactaagagcaagagcaangataatagtagagctcaccactattagtct

SEQ ID NO: 10182 - DNA, 101 bp, rice(Oryza sativa)
  misc_feature (71): n=t or c
tctaagaaactctagatttttggtattttctccatgacactctagtttcgacgctttgctataggacactnagggtgtgtttggttgggcttttcaatttg

SEQ ID NO: 10183 - DNA, 101 bp, rice(Oryza sativa)
  misc_feature (71): n=t or g
agagtcttcacaaacaaaatgtgagatgaaattagatttatcatccggccaaaactcaataagagcgaaanggcctataatctagtggttacaaaagtctt

SEQ ID NO: 10184 - DNA, 101 bp, rice(Oryza sativa)
  misc_feature (71): n=a or g
ttaatcctaagaaaatcttgatatattttttgtttcactttgctgattgatcgaggagaggaagaaaaaangtacaggagggccgagggcgggagcctggg

SEQ ID NO: 10185 - DNA, 101 bp, rice(Oryza sativa)
  misc_feature (71): n=a or g
ggagcaaatagtttggataattctccgaagaaaaacaaatatggatacctttcagggcggataattctcgnatacttcggattttgatatgagtacatata

SEQ ID NO: 10186 - DNA, 101 bp, rice(Oryza sativa)
  misc_feature (71): n=a or g
tcaccgtccaccatcttcgtgcgggcggatattgccgaatcatggcaaccgcgtccgacgctgcctccacntgacccactgccggcgtctccctccaccgc

SEQ ID NO: 10187 - DNA, 101 bp, rice(Oryza sativa)
  misc_feature (71): n=t or c
agagtggtctttgccaccacccccgccgtctcgtaggatccacgcactaccctttcttgcctgctctcttnctatggggctacgtgttccccgccttcggt

SEQ ID NO: 10188 - DNA, 101 bp, rice(Oryza sativa)
  misc_feature (71): n=t or c
gttcaattgaagttggatccgccgcccctgcagatttggtcgcctagcttccttacctatggcggttcaanctgcagagcgcggcgtggaggctccacctc

SEQ ID NO: 10189 - DNA, 101 bp, rice(Oryza sativa)
  misc_feature (71): n=a or c
ggaggaggaggaggaggcagggaggtggttgaggagggtattgtaggttagagaatccctgggcgtggagnggcagcgcaggtggtggagcgcgagatcga

SEQ ID NO: 10190 - DNA, 101 bp, rice(Oryza sativa)
  misc_feature (71): n=a or g
cccatacgtaaaaaactatcctaatgtttagcatttgcgatacactaaagaaattctcgtgcgccactagnaatgttacttccgcactcattttgctcata

SEQ ID NO: 10191 - DNA, 101 bp, rice(Oryza sativa)
  misc_feature (71): n=t or g
ctccgttgctgagattacagattcggccaagtcggccagctatactctccggcttgcccttcatgagttgngcgcccaggccaaaggcgttccaggcaaaa

SEQ ID NO: 10192 - DNA, 101 bp, rice(Oryza sativa)
  misc_feature (71): n=t or c
gccacgctcttacacgccatcaaccgcgagacacgactcacacgagactccccacccatcctcctccgtgngcgctggaggaggtggaggtggaggtggtg

SEQ ID NO: 10193 - DNA, 101 bp, rice(Oryza sativa)
  misc_feature (71): n=a or g
ctgacaggttacctgtttgtactagtagtgattattaggaaaagagtttgaaggtaacaaatataaagaantctatgggcctgtttagatcctagcaaaaa

SEQ ID NO: 10194 - DNA, 101 bp, rice(Oryza sativa)
  misc_feature (71): n=a or g
ccacgcctgatgtaactaactctgcaagctatatgacaaattggtcagatttaggtatagcttatgcatgntactttcaaggtgatgcttgataatcgctg

SEQ ID NO: 10195 - DNA, 101 bp, rice(Oryza sativa)
  misc_feature (71): n=t or c
ctatgttaattggttgataactccaaactcccggtcatgtagataaaatctcaaacctgatactggaaaantttggagtagattctggcggcgtggagaag

SEQ ID NO: 10196 - DNA, 101 bp, rice(Oryza sativa)
  misc_feature (71): n=a or g
agctcagctagctagcggttgacgcaccaggttcagtgggtcaccacggaagaagctcatcggacgtactntcttttttttttacgtgggttagtaacgta

SEQ ID NO: 10197 - DNA, 101 bp, rice(Oryza sativa)
  misc_feature (71): n=t or c
gagaaggctaaagtggccaacagacttgaggaactaaaccacataccattttcccaaaatggacagctccngataaatggttgactttcatagcaacaaaa

SEQ ID NO: 10198 - DNA, 101 bp, rice(Oryza sativa)
  misc_feature (71): n=t or c
ttttttcaaaaaaacaatttatgcttattttttgggagaaattgtaagtcagcatgtggtttttggacacngtaatgttctgcaaagttgaacattaatag

SEQ ID NO: 10199 - DNA, 101 bp, rice(Oryza sativa)
  misc_feature (71): n=t or g
tagccagaatacataaatgatcattggatggatctcaaaatggtaagaaaaatcagatttactatatgaangtgagaaatactaaaatgacttacattgtc

SEQ ID NO: 10200 - DNA, 101 bp, rice(Oryza sativa)
  misc_feature (71): n=a or g
catagagatttgagaccaacgcaagaacgccaacatcgtcaggttgcaattcaaggatattgtctgctatnctttctccaagctccagcttcttgttattc

SEQ ID NO: 10201 - DNA, 101 bp, rice(Oryza sativa)
  misc_feature (71): n=t or g
ctgaattcacactctgctgcagacacgattaggagatcgtgcattgccaccatcgacgtctcactcgtaanagcatccgtgtcttatagcaccaggctagt

SEQ ID NO: 10202 - DNA, 101 bp, rice(Oryza sativa)
  misc_feature (71): n=t or c
ttatctatgtcggttcttagctatattgggcacagattgggtgggtggatgcgaaactccttatcagtgcnaggttttcttcatccaatagtaaaaggact

SEQ ID NO: 10203 - DNA, 101 bp, rice(Oryza sativa)
  misc_feature (71): n=a or g
tttcgtaatcctacgatttaaagaggtcctaaaaagaaagttatctaaaaaaaaggttaaaaagcaagtcntgttggtgtgtgtgagagagagagagaagc

SEQ ID NO: 10204 - DNA, 101 bp, rice(Oryza sativa)
  misc_feature (71): n=a or c
atcctgcttgaccgttctgttctccgctcccgcatctctaacacacgcttcttcctcactcccgcattacngcggcgcgaattaggtatatttttaaaaat

SEQ ID NO: 10205 - DNA, 101 bp, rice(Oryza sativa)
  misc_feature (71): n=t or c
aatttttttagggaaagggctaaatggctggcgaatgatttttgaagccaaaatcatgcagattactgatnttgggatttgcttcgcgattcgtgctctga

SEQ ID NO: 10206 - DNA, 101 bp, rice(Oryza sativa)
  misc_feature (71): n=t or c
tgggatacggatgtcgagatcgagttcccggctgctccagccttgttgagcgtggattttcgtgttccgtngacgaggcgaacgaaggtaggagatagagg

SEQ ID NO: 10207 - DNA, 101 bp, rice(Oryza sativa)
  misc_feature (71): n=t or c
gagagaagaacgaagaaaagagaagaatgaggagatgtgggtccctttttttctcacttacatgtgggtcncgcagttttttaattttttgttttgctgat

SEQ ID NO: 10208 - DNA, 101 bp, rice(Oryza sativa)
  misc_feature (71): n=a or g
cgtgaaaatagcatgttatcgcaagatcttttaaaattatatacaagttgtatttatattgtagttacatntaagttatgatgtaattacacaatgatcac

SEQ ID NO: 10209 - DNA, 101 bp, rice(Oryza sativa)
  misc_feature (71): n=t or c
aatatgaaccgtcagtggtgagcttacatccagaaaaaaaaataatttcccctaggatttgctatccatgnctctggaaaaacaaaacatacacatgcaat

SEQ ID NO: 10210 - DNA, 101 bp, rice(Oryza sativa)
  misc_feature (71): n=a or g
gctttgagaaaccattcactgatacaacaaaaggcgattatgctagttaggaactggctatacgtgctggntttcctaaccggcacctttgaggatttaag

SEQ ID NO: 10211 - DNA, 101 bp, rice(Oryza sativa)
  misc_feature (71): n=a or g
acttgatgaaatgtatctttttttttgcgtacgtaccgatcagtttaacgggcgaaagcaaaatggtgctncggctttcatttcagcccgatcggttcaca

SEQ ID NO: 10212 - DNA, 101 bp, rice(Oryza sativa)
  misc_feature (71): n=a or g
cagcattgctgttactcctaattttcttagttgagttgcaagcaataactacatcttcaacaccgtctccncccattatagaccacccatcatcattgaaa

SEQ ID NO: 10213 - DNA, 101 bp, rice(Oryza sativa)
  misc_feature (71): n=t or c
taagtcgttctttccagatccaatggctcatattttacagtatacgtggctcaatcaggaaacaaataaanattcttcattgatgatgatgatgatgatga

SEQ ID NO: 10214 - DNA, 101 bp, rice(Oryza sativa)
  misc_feature (71): n=t or c
ccttcggtcgcggagggcctcagtgatttgggtgtcgagtcttatcgtgtgtcgcgtgggtgtattgtaanaagtaacaggtcgttggtagtagttagttt

SEQ ID NO: 10215 - DNA, 101 bp, rice(Oryza sativa)
  misc_feature (71): n=a or g
gcgtcacaaagcactcgggcacgaccgagctccacttgcgcatgttgctgcatccagatggcgtggacacnaagcgatcacgcgcagccgaattccatctc

SEQ ID NO: 10216 - DNA, 101 bp, rice(Oryza sativa)
  misc_feature (71): n=t or c
cccctgtcccgcagtccagtaggctaacataccataccacgtagttattggcaatgcaaaaacagatttgntaaagaagtgttcacagttatttcccccca

SEQ ID NO: 10217 - DNA, 101 bp, rice(Oryza sativa)
  misc_feature (71): n=t or c
ctttaactactaaatttaactctaaaagttggatctggagtgaagctgtgaaacagcctaaatctagttcnacctctctcctagtttagatagagctgaaa

SEQ ID NO: 10218 - DNA, 101 bp, rice(Oryza sativa)
  misc_feature (71): n=a or g
aaaatcagaaaagcatgttgtgccaacacataaagccttgagttccttcagaaagacacaggacaatatgntcagccattcctttatctctatttgaagtt

SEQ ID NO: 10219 - DNA, 101 bp, rice(Oryza sativa)
  misc_feature (71): n=t or c
gaaaaaatgggtaaaagctagaactcctaagatcacgcaagaaggcgaattttcgtttgaagacctcgagntgcaaggggttgccaataaaatagagtctt

SEQ ID NO: 10220 - DNA, 101 bp, rice(Oryza sativa)
  misc_feature (71): n=a or g
gcaagaagcctttcgctttcttgaaagcaacttgcagctgacaatcttatgcccttctttatgagcattgnccgaatcaaagaaacggacgatactggtat

SEQ ID NO: 10221 - DNA, 101 bp, rice(Oryza sativa)
  misc_feature (71): n=a or g
tgatacacaaccccttgggcccaaataaggtgattgtggccactccagaacagatattggacatgaggttngatctatttgaaagtatacttgctaagctt

SEQ ID NO: 10222 - DNA, 101 bp, rice(Oryza sativa)
  misc_feature (71): n=a or g
gcgtgacataattatgttgtataaactagatgaaaccccgcactagggctgtaaaaatagctcgaggctcncaagctactcaaattcggttcgttctagac

SEQ ID NO: 10223 - DNA, 101 bp, rice(Oryza sativa)
  misc_feature (71): n=t or c
ctagacagataccgtaacagtgtctgtcttacctggattactggaacattgcagtatttatacctacatanatatatatgtgcacacaattcattatgaat

SEQ ID NO: 10224 - DNA, 101 bp, rice(Oryza sativa)
  misc_feature (71): n=a or c
tcggacttcctcaagatttttgcatgtttcaaatatgtcatgcgtaagatctcggttctaaccaaccaaancatggttaaatccaagttttatataagtta

SEQ ID NO: 10225 - DNA, 101 bp, rice(Oryza sativa)
  misc_feature (71): n=a or g
tttttgtttcgcgcagcaaaaatgctaaagctgaacgatctttcaaacgaacccgtcccttttttaattcnttggcttgattttgcctcttttaccacttc

SEQ ID NO: 10226 - DNA, 101 bp, rice(Oryza sativa)
  misc_feature (71): n=t or g
tgtgtggtccagattgagtagatccactccacggcgtgaggtgtcagcgacttgtttgggccgtggtgttncttgctgggcttgaggtccagcacggacac

SEQ ID NO: 10227 - DNA, 101 bp, rice(Oryza sativa)
  misc_feature (71): n=t or c
ctacaatgcatgcattgattaaaacaccacgccaattacaccattgtcatgcacacattctcccttgctanattaattatattcgatggaattcgtgtcca

SEQ ID NO: 10228 - DNA, 101 bp, rice(Oryza sativa)
  misc_feature (71): n=t or c
tccgctactaagctgaccttaaactttgcaatttgagaagatatactacaatacgtacaccatgtgtgtangaaacctggtttatttttcctatataccta

SEQ ID NO: 10229 - DNA, 101 bp, rice(Oryza sativa)
  misc_feature (71): n=a or g
aatccaaaatccgttatattatggaacggagggaatagctaggcttggtttgaattggattggatataacnaaagaagtaaagcaggagtattggcttggg

SEQ ID NO: 10230 - DNA, 101 bp, rice(Oryza sativa)
  misc_feature (71): n=a or g
tttaaaaaaaatagtacgtataaaccggtcctcctgaaaaacctccgtgctcgaaaaaaaaaacaagcacnaacaaaggtacccgttttccttaaaaaaag

SEQ ID NO: 10231 - DNA, 101 bp, rice(Oryza sativa)
  misc_feature (71): n=t or c
ttgcgatggcagcgtttactccggcaaagatggcacagttttgtagcatgtgcggcgagcgagaggcaaanggtgacacatttttcggttgaccacacgtg

SEQ ID NO: 10232 - DNA, 101 bp, rice(Oryza sativa)
  misc_feature (71): n=t or c
tcttttccaatttctgtcccaaaaaatcaaaatcatggttaagaattttttctgggctaattggaaggccnaggtatttcatgggaaaagcacctacaggg

SEQ ID NO: 10233 - DNA, 101 bp, rice(Oryza sativa)
  misc_feature (71): n=a or c
tgctgactagatgagagggccccacttttttacatgccttgaacaaattgccctttctctctctctctctntcttcttcctctctctccccctcctctctc

SEQ ID NO: 10234 - DNA, 101 bp, rice(Oryza sativa)
  misc_feature (71): n=a or g
catatcatatttcacagctgaggttttatgccgtgtagcagattgtatcgggaggtacagaaacaaatccngccgtccatcgtaaggggggtatgattgga

SEQ ID NO: 10235 - DNA, 101 bp, rice(Oryza sativa)
  misc_feature (71): n=a or g
gtcaacctcgaattcggttaggttaacgaatcaaaagcaacatggttaagtatactccaagataggagcangtttgcttaggtaggcgtgactcggtgaga

SEQ ID NO: 10236 - DNA, 101 bp, rice(Oryza sativa)
  misc_feature (71): n=t or c
catgtagatctagggagggggggcattgctctgggtggtggggttcgcgagatggctcgacgatgagtggngagtcgacggacaacgactaagcgatttgt

SEQ ID NO: 10237 - DNA, 101 bp, rice(Oryza sativa)
  misc_feature (71): n=t or c
tgctggcaaagctctggaatggagtacatcgtgcttttgctgctatgcttggcctacacaaaactgatgcnccgctaatgcagcccacatgaagcctccag

SEQ ID NO: 10238 - DNA, 101 bp, rice(Oryza sativa)
  misc_feature (71): n=t or c
aggtaccatgttttgtacacagaattttggtacctcagatactaagtagcttgagataccaaatttatacnggaaagtacctcaagtacaaaaatttcatt

SEQ ID NO: 10239 - DNA, 101 bp, rice(Oryza sativa)
  misc_feature (71): n=t or c
tcaagagagttggttctcactcacttgaatggactgacctttggatgcatgtttcgccaggatctgaaccngcgttcaaaggcagatgcattttcaatccc

SEQ ID NO: 10240 - DNA, 101 bp, rice(Oryza sativa)
  misc_feature (71): n=a or t
cctctcttgcatacatctagtgagaagtacaagctactaaatttgccctcatctaacctaagatagaaagnactcccaggattggacctccttagttcatt

SEQ ID NO: 10241 - DNA, 101 bp, rice(Oryza sativa)
  misc_feature (71): n=a or g
ggactaaaacttttataaatattaaacgtagactataataaaatctattcataattttggactaattcgcnagatgaatctagtgagcctaattaatccat

SEQ ID NO: 10242 - DNA, 101 bp, rice(Oryza sativa)
  misc_feature (71): n=t or g
gtaaactcgatgtacctaagatcataggacattatagtgcccagtttcggctgacgtggcagcttaatctncatagaatccatatgtcagaacaattcagt

SEQ ID NO: 10243 - DNA, 101 bp, rice(Oryza sativa)
  misc_feature (71): n=t or c
tactttagtatttaaagaaaatctagatggtcatagtttcttagatgtaagccaattacttcaaaaatctntggctcaagaaagccgagttagagaagcca

SEQ ID NO: 10244 - DNA, 101 bp, rice(Oryza sativa)
  misc_feature (71): n=t or c
actctctccatcctgtcctagtgtcctctatcgccgcctccttcgaccactgccatcggtgccattccccngcttccctttgagagaacaaagaggcccaa

SEQ ID NO: 10245 - DNA, 101 bp, rice(Oryza sativa)
  misc_feature (71): n=a or g
acttcttgcttaaagttgaacagaggcggaaacggacggccatttggcagttttgcatgtggttctcgtanctcatcaaaaaatgaatgagcacatgcctc

SEQ ID NO: 10246 - DNA, 101 bp, rice(Oryza sativa)
  misc_feature (71): n=t or c
atttgaagcaattgatcgccgatttcgtcgcacccatgcctggctccatctcttactaatcccgtttgttngatccagtgctggacactcctagttgggac

SEQ ID NO: 10247 - DNA, 101 bp, rice(Oryza sativa)
  misc_feature (71): n=t or c
atggttgtgaccatgttgaggattttcctcaaaccgtgaagaaggattggcccaaaaatgcccaatccgtngcgtcggctttgaaggcctgccgaaagggc

SEQ ID NO: 10248 - DNA, 101 bp, rice(Oryza sativa)
  misc_feature (71): n=t or c
aatgagaagtatctccccgtgacttgcgtgatgcctgccttgcgtctagtagctagtactagctgccctantactactaccccgcctcggcagtcggcaga

SEQ ID NO: 10249 - DNA, 101 bp, rice(Oryza sativa)
  misc_feature (71): n=t or c
gacgggtagtcaattactagtagccatgagatcactccggccgtaatccttcgcgggactatttagtttgngaaaacaaaatttttgatgtcgcatcgaat

SEQ ID NO: 10250 - DNA, 101 bp, rice(Oryza sativa)
  misc_feature (71): n=a or g
ttcaccacccctccttttatttgtccgtgcgccaccaaaaaaatggattgggtgtaccgctgatggatctngagatccccatgccatgatgccagtcctca

SEQ ID NO: 10251 - DNA, 101 bp, rice(Oryza sativa)
  misc_feature (71): n=a or g
ctgttgtgaatggctcaaaccttcttcagtttgtagtcatggtgatcataaagagcctatttggtttgaanccaatttgtgccaacaagttttggcataac

SEQ ID NO: 10252 - DNA, 101 bp, rice(Oryza sativa)
  misc_feature (71): n=t or c
cccagatcgaaaaggctaacggactatcgatcgcttggagcgatcaactctcctcctccacgtggttttanttttttggcaccacattacttttctattta

SEQ ID NO: 10253 - DNA, 101 bp, rice(Oryza sativa)
  misc_feature (71): n=a or g
gtttggtgtgtgtggaatagtattgtttgtttcatcggtgcaatatctttagagttgtggcagaattgganccattgcattggatgtggctaactaggcaa

SEQ ID NO: 10254 - DNA, 101 bp, rice(Oryza sativa)
  misc_feature (71): n=a or g
ggtttgcttggaatcactttgcacatatgttctctatttacttgttgctctccttatgggatgctattganatacccttttctttaggtactgcataggct

SEQ ID NO: 10255 - DNA, 101 bp, rice(Oryza sativa)
  misc_feature (71): n=a or c
tcgcccctcccaaaagttatttgactgagatattttttttaagctcttgctacaatatacgggtataacantagttgtaataaacttatggtcattttgca

SEQ ID NO: 10256 - DNA, 101 bp, rice(Oryza sativa)
  misc_feature (71): n=t or c
tgatgcagtcgataacatcaccgtcgtcagcctaacacagtagaagccttaatttgctttatcttgtatanatacttgtttaggaaaatttggatgctaat

SEQ ID NO: 10257 - DNA, 101 bp, rice(Oryza sativa)
  misc_feature (71): n=a or g
cctacacatacttgcctctgtacttaggcttggagtccctgtctatggccggcttcccgtcggcggcggcngcggcctgatcggcggggctgaacacggcg

SEQ ID NO: 10258 - DNA, 101 bp, rice(Oryza sativa)
  misc_feature (71): n=a or c
gttcattgtgtggatttccagaaagctcacagcccttttccatccttttcagagttcagaccagcctaatnaagaatgattcctattgccactgcaaacgg

SEQ ID NO: 10259 - DNA, 101 bp, rice(Oryza sativa)
  misc_feature (71): n=a or g
gtattctggtaaggtattacctaaaaaacttccacaacgttatttaggtcaaagattttcaaatttaactntacataaaaaataagaaatgtttccttcat

SEQ ID NO: 10260 - DNA, 101 bp, rice(Oryza sativa)
  misc_feature (71): n=t or c
gaagaatataagtacgcataatatttctggaaatatgtacacacaaaattgagcaggtcattttagtaaancatcagtaattgttaaacaagtcacattac

SEQ ID NO: 10261 - DNA, 101 bp, rice(Oryza sativa)
  misc_feature (71): n=t or c
aaaatcctaaaaatcatgaaaccctaaccctagaagctgccgctgcgccatcctcgtggtggccgttgtcntcgtcgtcgcatcgtccttgttgtcaccgt

SEQ ID NO: 10262 - DNA, 101 bp, rice(Oryza sativa)
  misc_feature (71): n=a or c
gcgagtcatggaggagatgccttccccggttactagccacgcgcgttcgctcgaagagtaattacgggggntataatcgatctgtgtattactactactac

SEQ ID NO: 10263 - DNA, 101 bp, rice(Oryza sativa)
  misc_feature (71): n=t or g
agctcctggatatggtagaagtcaatctttaagagaaaaaaaacttttgaaatatggttatttgctgctgnacaacatgctcattacaatatttattttca

SEQ ID NO: 10264 - DNA, 101 bp, rice(Oryza sativa)
  misc_feature (71): n=t or g
cctctagattttaaaaagaaaagagcaacacttggttgggtttgttaaatgcatattttctcttagcaaanttaagatcaacctgtagttaacatctcaca

SEQ ID NO: 10265 - DNA, 101 bp, rice(Oryza sativa)
  misc_feature (71): n=t or c
tgtagatcctcgtaccaacttatcccaatacccacattatccggtctacgggtattgtcacaccccaatcnggcaccgccgtacaacggcacctgatagga

SEQ ID NO: 10266 - DNA, 101 bp, rice(Oryza sativa)
  misc_feature (71): n=a or g
attttggcgatgaagtgagtgcactacggttgcattgcgcagtgcacaaactgcatattatttccagccanttcatccacagattgtgcccgatccatctt

SEQ ID NO: 10267 - DNA, 101 bp, rice(Oryza sativa)
  misc_feature (71): n=a or g
cgatcagtagcaaaaggggagtcaggttaacacaagacggcatgatcctaggcaattaagtgaataaatcngcataagagagagggggcagcctggcagtt

SEQ ID NO: 10268 - DNA, 101 bp, rice(Oryza sativa)
  misc_feature (71): n=a or g
gaacgggtgaaactttgtttttttttaaccatggcatacaagaggactagttcgcactatccggataacanctctatgaaacaacgtgaaaccaagcaact

SEQ ID NO: 10269 - DNA, 101 bp, rice(Oryza sativa)
  misc_feature (71): n=t or c
gtcgacggtgatgacgcagatatttgtgaaagggctgacagggaagacgacggctctgaggatggagccgncggatacggtggagagcgtgaaggtgaagc

SEQ ID NO: 10270 - DNA, 101 bp, rice(Oryza sativa)
  misc_feature (71): n=t or c
acagggggatagcagcgttgtgcataccgatatggtaattgaactctagaaagaagcaactcacaggagcnttctgggaagaaagggaaccaaataagggg

SEQ ID NO: 10271 - DNA, 101 bp, rice(Oryza sativa)
  misc_feature (71): n=t or c
cctgtaaattcatacacacaccctatccttatgaacacctccttcgaatgactggaccaacatatcaccangggcgtcttgttgtcgacggatatgttgtc

SEQ ID NO: 10272 - DNA, 101 bp, rice(Oryza sativa)
  misc_feature (71): n=a or g
ttccaagcggttcataagtagaaccgcacagaaaaatgaagggaccggcatggggctatcgcccgcacagnaaaatcaattttcccatgcgggcctcctaa

SEQ ID NO: 10273 - DNA, 101 bp, rice(Oryza sativa)
  misc_feature (71): n=t or c
tgaagttatctacgatttcaccgttacatagtatatggtgtttccccgtgagctgcaccgcactgcattgntttaaaatggcgttcccacacttaagttcg

SEQ ID NO: 10274 - DNA, 101 bp, rice(Oryza sativa)
  misc_feature (71): n=t or c
ccgcaaccgcaaccaccttccttttctccaccctcttccttcctcttcccgcggcttcgcctcgcctcgcntcgcttcgcttcgcttcggagtccagcctc

SEQ ID NO: 10275 - DNA, 101 bp, rice(Oryza sativa)
  misc_feature (71): n=t or c
cctgggtggttggtagcggctgggaggataagtcgaagggttggaggggattagggataaggttttcttcnttcttttttttaaagcttctttctgttgct

SEQ ID NO: 10276 - DNA, 101 bp, rice(Oryza sativa)
  misc_feature (71): n=a or g
atctacactagccttgcaatctcgcagagccgtcgcgcggcaggggattggattggggagataagcgagcngcgagtgaggaggagagtgtgagagagcgt

SEQ ID NO: 10277 - DNA, 101 bp, rice(Oryza sativa)
  misc_feature (71): n=t or c
aagtaagtgtttcaaagatggatgctatgacattttatagcttatgtaacctcagaatttctggtaaagancttaagtgcaatattagacatgacaatgct

SEQ ID NO: 10278 - DNA, 101 bp, rice(Oryza sativa)
  misc_feature (71): n=a or c
ctagagggacttcatcaagcaagatgcctaaacaagaggaccaagacagtagtcctttcaaacaggtaatnaccgtatagtacttttcaacatgtgatagg

SEQ ID NO: 10279 - DNA, 101 bp, rice(Oryza sativa)
  misc_feature (71): n=a or c
actttcaatgtcatagaaccaattttgcctagcatatatactgtgcgcatctaatgagactttgtctctantatattaaatgcaaagtgaaagaattgttt

SEQ ID NO: 10280 - DNA, 101 bp, rice(Oryza sativa)
  misc_feature (71): n=t or c
tcaattttgacgaaaaatgtcttactttcatgcatatctaaagactttttaggcttgctctctacactttncgaaccatgtttcagagttccaaatttatt

SEQ ID NO: 10281 - DNA, 101 bp, rice(Oryza sativa)
  misc_feature (71): n=a or g
ataaaggggaaaaaggaagatcaggcatgtaaatcatgtaggatattgttttgcccatgctaatagaaaanccagaaatctaaatatcttatacacagtga

SEQ ID NO: 10282 - DNA, 101 bp, rice(Oryza sativa)
  misc_feature (71): n=a or g
tttgaaaacatgatgctaactctcatgcatgttagaattcctccaaacatgttaggtggactttcaacagnaatttagtgagattagggatacgacgctgg

SEQ ID NO: 10283 - DNA, 101 bp, rice(Oryza sativa)
  misc_feature (71): n=a or g
gatggcaagcccgcaggtttgtgttggccccctatgtttagctctactaccatatcagcataatatataantcttcaggcagaaagaagaaaagatatgca

SEQ ID NO: 10284 - DNA, 101 bp, rice(Oryza sativa)
  misc_feature (71): n=a or c
gctttacgaatagattacaatgaatgtttcagtgtgagatgtgggcggtctttataactcttgttaacttnagttgtcgtattagatctttttattttaaa

SEQ ID NO: 10285 - DNA, 101 bp, rice(Oryza sativa)
  misc_feature (71): n=t or c
gtgaccggccgcatcatgtcaccgctcacatggcttgtccgcttgttcacttccggggctgtttggtttanagagacttattccaagttcctgtcatatcg

SEQ ID NO: 10286 - DNA, 101 bp, rice(Oryza sativa)
  misc_feature (71): n=a or g
gaaaaatgcataattaagtttcatgcatgcaaagttagctatcctccttcacctggtcgtctcattcatcnatccatgccgatcgcgtgctctctcctggc

SEQ ID NO: 10287 - DNA, 101 bp, rice(Oryza sativa)
  misc_feature (71): n=a or g
agcagcggtactgtagctagaacaaacccacctcgccaattcaacctgagggagaccagcttaaatagganggcagcccagtcactattcctgaatttttg

SEQ ID NO: 10288 - DNA, 101 bp, rice(Oryza sativa)
  misc_feature (71): n=t or c
cctcagccgatggaatcgtatgaccaggaggaagctggatctacttttctcgaagcagtagatcaaaaatnttgtcagccttggtaatatcaaaatcatac

SEQ ID NO: 10289 - DNA, 101 bp, rice(Oryza sativa)
  misc_feature (71): n=t or c
cggcgaggttcgcggcgaagcacgggtgcgcgtaccacagggcgctcatggagaagaaccagaagtacgtngccgacccgcccaccatcgagaggtgccag

SEQ ID NO: 10290 - DNA, 101 bp, rice(Oryza sativa)
  misc_feature (71): n=t or c
tcgaaatccacaagttcggccattcgcttgagaacccaaaaatcgttcgatggatttaatggtcgtgcgtngacccgtatatccttgattccatctctacc

SEQ ID NO: 10291 - DNA, 101 bp, rice(Oryza sativa)
  misc_feature (71): n=a or g
aaatctccagcttcccccaaacagtccatattgtcatccatattctaagaatatatagttgtggaatccanaaaatgaactagaactcagaagctggaaaa

SEQ ID NO: 10292 - DNA, 101 bp, rice(Oryza sativa)
  misc_feature (71): n=a or g
atgttggtgttgcccacattcgcgaagagcctggctgaaccgctgccccagccatgtgcgtaaccacgacncgcgcggtcgaccattctcagctgcccgag

SEQ ID NO: 10293 - DNA, 101 bp, rice(Oryza sativa)
  misc_feature (71): n=a or g
gcttatttgtacccggatgcagagacatgcatggatcgatcgatcggtcgctcgattacgcttgttggatnagggagctaggctgggaggatgcaggcagg

SEQ ID NO: 10294 - DNA, 101 bp, rice(Oryza sativa)
  misc_feature (71): n=a or g
atcccaaaactcaccaattttcccccaaaaaaaagattggatccaatttcgcagccacaaatcagagactncaagcccagcagcaaccgtcagaacggcaa

SEQ ID NO: 10295 - DNA, 101 bp, rice(Oryza sativa)
  misc_feature (71): n=a or g
actcagggacgaagcaaccgccggggtgccactccgcatcagacaagtatccacatgcatgctggtcctcngtgagtaactggacgccgtcggcgccgagc

SEQ ID NO: 10296 - DNA, 101 bp, rice(Oryza sativa)
  misc_feature (71): n=t or c
ggcgtgtgttggtgtctattctgacttgtgtgtgtgttccctctctccccctatgggtcttgtatttatanctatagatgttcccttgtacaagtagtatt

SEQ ID NO: 10297 - DNA, 101 bp, rice(Oryza sativa)
  misc_feature (71): n=t or c
tcgaaattggcagaagctctagtaaaggaagtggtataaggaaggcggatgtggcggccaagctggcaggngtggcacaggccagagagcccatctttgga

SEQ ID NO: 10298 - DNA, 101 bp, rice(Oryza sativa)
  misc_feature (71): n=a or g
catctgctatagcttgaagcagtcccgggggccagcatattcaggaccaatacgttgttgtatcgatgcgnatatttctctttctaaccacacaattacga

SEQ ID NO: 10299 - DNA, 101 bp, rice(Oryza sativa)
  misc_feature (71): n=a or g
gaatctagacattagaaaatttcacatctcgtttttacgggacggagggaatactcctacgccaacacatnattaatttcatatgtatctatacaccaaaa

SEQ ID NO: 10300 - DNA, 101 bp, rice(Oryza sativa)
  misc_feature (71): n=a or g
ctaattagtttggtcagggcactgacagtgtctttgtgtcactgactcagcagtgtggtgtgtatgcacanttttggtgattgtttccagttgggtaccgg

SEQ ID NO: 10301 - DNA, 101 bp, rice(Oryza sativa)
  misc_feature (71): n=t or g
ctatatattaatatgaatattgttccagcaaagattaatgaattaacgacaaaaaaaggaagctttacaanaccattttgaaggcaatgcagatcatagtg

SEQ ID NO: 10302 - DNA, 101 bp, rice(Oryza sativa)
  misc_feature (71): n=t or c
tattatcaaaccttaagttcctaatgggaacagagaagcaactcaagacacagataacagatcatgtgttngactttctaaaacactaggcattatagtct

SEQ ID NO: 10303 - DNA, 101 bp, rice(Oryza sativa)
  misc_feature (71): n=a or g
taaaacggatcatttatgtgatggacgcaccttaaacaatatggacaaataatttttaagtcattacacanttatctgtcaaattaagaattttgacggtt

SEQ ID NO: 10304 - DNA, 101 bp, rice(Oryza sativa)
  misc_feature (71): n=t or c
ctccagaaaattaaagcttttactttgataataccagtggagcatgatcaaagattacccatttagctagntgatcacatatactcaggttaccatttaac

SEQ ID NO: 10305 - DNA, 101 bp, rice(Oryza sativa)
  misc_feature (71): n=a or c
tatgtaaatatatatgctattatatgaaaaaaaaatataaggatgcaatctacgcgggtgttcaaagtgantgccatattttaacatttacaaaatttata

SEQ ID NO: 10306 - DNA, 101 bp, rice(Oryza sativa)
  misc_feature (71): n=t or c
tgagtggcactgtattgatgtcacatatgaaatttaactattactagagaaatttgcaatataatagtcgngcaatctacacatgactgtagattttgtga

SEQ ID NO: 10307 - DNA, 101 bp, rice(Oryza sativa)
  misc_feature (71): n=t or c
cacaactcattaattatttttcccacatatacgaatcctcaaatcaacctgccactggtcacctttcccgnggttactgtataaaactgagaaaaaccgga

SEQ ID NO: 10308 - DNA, 101 bp, rice(Oryza sativa)
  misc_feature (71): n=a or g
tgtataaatacatggcgcgcgctgcagcttggacaagatacgtgcagagttggaatttggaaggcgagacnaagaaatcacacaagaaaagctgccggacg

SEQ ID NO: 10309 - DNA, 101 bp, rice(Oryza sativa)
  misc_feature (71): n=a or g
tcagtcaatcagtttacaataacatatctgaaagggagttctctgtaggtgtttgattttacttcagcctncagcctcccaagcgtcaagcacatcaaata

SEQ ID NO: 10310 - DNA, 101 bp, rice(Oryza sativa)
  misc_feature (71): n=a or g
aatagtagaaataaaaaaaacaaaaaaataggtaaaacatagaatcctaatatatgtttatgtgtaaaacngatgattgtaaaactcagaaaaaacacaaa

SEQ ID NO: 10311 - DNA, 101 bp, rice(Oryza sativa)
  misc_feature (71): n=t or c
acatatcaggttggctggaagttccggaccgttgaagggtgaaaatttcctaaatgttgtctggaacttcntggaaattccagacctgttttctagttcaa

SEQ ID NO: 10312 - DNA, 101 bp, rice(Oryza sativa)
  misc_feature (71): n=a or g
cattggggcatggtaatggttgcgcgaaggaggactagctattttacaggtggctcctctaggtctaacgntaatactttgaataataataagaaaaaggt

SEQ ID NO: 10313 - DNA, 101 bp, rice(Oryza sativa)
  misc_feature (71): n=t or c
gtagctgggacggttgatggtgccatgggatacatgcgccaggggaggagctcgagctgcttcctagtggnggtggcgctagggactgggggcgcgagatg

SEQ ID NO: 10314 - DNA, 101 bp, rice(Oryza sativa)
  misc_feature (71): n=t or c
acttatttcttaatcccatttgtatattttttgcaggtttatggacatttttgctcttgggcttacctgtnagatccaaagcgagaaatctctctctggat

SEQ ID NO: 10315 - DNA, 101 bp, rice(Oryza sativa)
  misc_feature (71): n=t or g
ggcacccacccttgaggggcgaggccgttaggtgtatgttgtgccattcaatgggaaacatattgcacgcnccacatgctcgcgtgcaaattaaccgccgg

SEQ ID NO: 10316 - DNA, 101 bp, rice(Oryza sativa)
  misc_feature (71): n=t or c
cctagttaaatcacttatcaaaccgcacgcgatgcgaacataaattaataagggaaaattgtaaccatgcnattataattttgtaaaatttgagatatgcc

SEQ ID NO: 10317 - DNA, 101 bp, rice(Oryza sativa)
  misc_feature (71): n=t or c
ttgcagtaagttcagtattatgcagacacggaaggacaccatgaccagactagctgtgtttagtttcacgncaaaattaaaagtttgattaaaattgaaaa

SEQ ID NO: 10318 - DNA, 101 bp, rice(Oryza sativa)
  misc_feature (71): n=a or c
tttcctacgaaacattcattattctgtcctgatgccaggttggaacataggggtgattccagtggcggatntagaaataaatagcagtggggtctgagcaa

SEQ ID NO: 10319 - DNA, 101 bp, rice(Oryza sativa)
  misc_feature (71): n=t or c
taagtttctttcggtcttttgggttttcggtttttcccctttcccctagcaatggccattcggtttgttgngttgtgtaattgaaacattgctttcctcta

SEQ ID NO: 10320 - DNA, 101 bp, rice(Oryza sativa)
  misc_feature (71): n=t or g
tggacggatggaggaggaagtaatatactacatctttacttctttaatagccttatcgattcgcttattcntgtaagaagccaaacgttatatttgcaaac

SEQ ID NO: 10321 - DNA, 101 bp, rice(Oryza sativa)
  misc_feature (71): n=a or g
ttaatgcatggtcccacctgtcatacaatcattgtgtcttgaaatctatattatagctggctataagtctntaatctagtgctcttcttttctctattgtc

SEQ ID NO: 10322 - DNA, 101 bp, rice(Oryza sativa)
  misc_feature (71): n=a or g
agagtttgtatcatatttttgaatcataatagatataatgcgtccctcaaattttcaaaccagtgcagacnaggtcccaaagcggtttggatggcgttttt

SEQ ID NO: 10323 - DNA, 101 bp, rice(Oryza sativa)
  misc_feature (71): n=t or c
ttgttgcactttgtttttcttttcttggtatgttgctctttcttttattaaagataatagttctattagtnttggtttgttgcactttgtttttcttttct

SEQ ID NO: 10324 - DNA, 101 bp, rice(Oryza sativa)
  misc_feature (71): n=a or g
ttgatcgaatccctccttcggctttcaatcttgtttctttggtcctggccttttatctgacgatcgagcgnggctgtctgaataagttacggttttggctt

SEQ ID NO: 10325 - DNA, 101 bp, rice(Oryza sativa)
  misc_feature (71): n=a or c
tgctactttttttagggattgctacttactgtaaacagtgggcaacatgtagtgtagtagtttccgaaatnctattacaatgttactaaaaataaataaaa

SEQ ID NO: 10326 - DNA, 101 bp, rice(Oryza sativa)
  misc_feature (71): n=a or g
gtgtaaatatacaatttagtgatcaaattaatatactactagttataaaaaaaatcctccggaaagcaatnattttttccattattttacgatctgaggag

SEQ ID NO: 10327 - DNA, 101 bp, rice(Oryza sativa)
  misc_feature (71): n=a or g
tcgaattgggtgaaacctctgtgcagagttaatttagcagtcggtccaatagccctagattgccaaaaacngatttcccaaagtttgatggagataaccca

SEQ ID NO: 10328 - DNA, 101 bp, rice(Oryza sativa)
  misc_feature (71): n=t or g
ctcgagttctcgtcgccgttagggttctagaagattcttacaaccgcgtgcccctctttccgattggggcnattcgttacttgccgcgctctgagcgtgcg

SEQ ID NO: 10329 - DNA, 101 bp, rice(Oryza sativa)
  misc_feature (71): n=t or c
tatttgatccccaaccatcattctccacatacacctatattcctcctccccatccgtttcttcattgtccncgtcgtttcacggtgcgtgccttctctcta

SEQ ID NO: 10330 - DNA, 101 bp, rice(Oryza sativa)
  misc_feature (71): n=t or g
agcgtatgtaaaatggccggtatcaatggctataagcacatctcattcatgggaatcagattaccttttantttcttcgacaaggatgcgtatcttttttt

SEQ ID NO: 10331 - DNA, 101 bp, rice(Oryza sativa)
  misc_feature (71): n=t or c
tcatctggattgatggaaaatctagctttaataatatcctctgttagcttgaactctttctttttggcacnttttgttaaatattgggagtaaatcaagtt

SEQ ID NO: 10332 - DNA, 101 bp, rice(Oryza sativa)
  misc_feature (71): n=a or g
caccatattcaccacaaccgtatccgtggcgcttgcccgttcacccaccagctaagctcccactccacgangtccgctgccgtatcctcccctgagatctg

SEQ ID NO: 10333 - DNA, 101 bp, rice(Oryza sativa)
  misc_feature (71): n=a or c
taaggattaaccaactgcatggcgtaatagttcatcgcatggtgaggtgccagtttggtgccccagtgccnaaaaaaaaaaaaaaaaaaaagaagaagaag

SEQ ID NO: 10334 - DNA, 101 bp, rice(Oryza sativa)
  misc_feature (71): n=a or g
aattatcaaatcatcgccatttaatatctccctacatttgtatcgcgagtcaagtgaatacctttattccnaccgtgacaccggccattccggtcacagct

SEQ ID NO: 10335 - DNA, 101 bp, rice(Oryza sativa)
  misc_feature (71): n=a or g
ctatctctccctgaggctagcggcacaaattgtgccaaagagaccacaagtaatcgatgttacacacctcnctggctacaacatggccgtggaggcccctt

SEQ ID NO: 10336 - DNA, 101 bp, rice(Oryza sativa)
  misc_feature (71): n=a or g
ctttggaatataaaggaagatgctatttacaataggaaaaaaattcaaataaccctctaaactttacatgnaagtccgtctagcaccctaaactttaaaac

SEQ ID NO: 10337 - DNA, 101 bp, rice(Oryza sativa)
  misc_feature (71): n=t or g
ttctgtccaggtgtgtcaaacaccggtaaaattttcttttggtgtcggattcaatatccgtttgcaaaaanggaacctgtaggacgagagcattccatttt

SEQ ID NO: 10338 - DNA, 101 bp, rice(Oryza sativa)
  misc_feature (71): n=t or c
atgagacataggcacatatcacagggaaaaggaattcttattttttttattagtagcttaccattgagggntgtattatatgatgtcaattttgaatataa

SEQ ID NO: 10339 - DNA, 101 bp, rice(Oryza sativa)
  misc_feature (71): n=t or c
gacccgaggccccacgtgtcatcttcctctttctcctcgggccggctccatggctgccgaaacagtcccangctgccacctttttcatgcctccccgcgct

SEQ ID NO: 10340 - DNA, 101 bp, rice(Oryza sativa)
  misc_feature (71): n=a or g
ggagggagtgggccggccgggaaggagggaatgaaggaaaagagagggagggaggagagactttgggtcanccttggcccaaaggaggaaggaggattatt

SEQ ID NO: 10341 - DNA, 101 bp, rice(Oryza sativa)
  misc_feature (71): n=a or g
tgctcaggggatacacttaggacatttggaaagcaaatctcctgtgtattattatctaaagagaaggtcantaatcatgttgtattctcttcatgctactt

SEQ ID NO: 10342 - DNA, 101 bp, rice(Oryza sativa)
  misc_feature (71): n=t or c
ttttgatgttagtttcaaccataccattttttttcaaagttacctaaaaatggctatgtttagtttgttgncaaatttgatcaatacataagaaataatac

SEQ ID NO: 10343 - DNA, 101 bp, rice(Oryza sativa)
  misc_feature (71): n=t or c
tacgttttccgacgatcgattaatattatttataggtgtcaacggccatcaacaatgatcaaaacactacngacggagcccgggtggccgcacgacctgcc

SEQ ID NO: 10344 - DNA, 101 bp, rice(Oryza sativa)
  misc_feature (71): n=a or g
agacctaaacgtacatctgattgggatcgtatgacatgaaatcagaggaacgtggtcactgacaggttagncccaccgcttatgggccgacctatcaatga

SEQ ID NO: 10345 - DNA, 101 bp, rice(Oryza sativa)
  misc_feature (71): n=t or c
gcatcgtgaaataaataatcaaagcacacactttgattttacaacttagtccatgatcttgtaaacccganatttagatccacaatcttgttttaatgtac

SEQ ID NO: 10346 - DNA, 101 bp, rice(Oryza sativa)
  misc_feature (71): n=a or g
atcaacacatgttactgctagcctgctaggtggtcgtaacagctactctcttcgtacccaaaaaaaaaaantaaaccctcggttttttatgtccaacgttt

SEQ ID NO: 10347 - DNA, 101 bp, rice(Oryza sativa)
  misc_feature (71): n=t or c
aaagtatatcacaagtgaaatagcaaaaaccattaatttaatcttacatataggtactccctccgtcccanaatataagggattttgagttttttgtttgt

SEQ ID NO: 10348 - DNA, 101 bp, rice(Oryza sativa)
  misc_feature (71): n=t or c
atcatatagctcaaactatcacacttcactatacaaaagaaactgccgagtttcaagtttcatgggggttnaaacaaagtattcaggtaagtttctcaaat

SEQ ID NO: 10349 - DNA, 101 bp, rice(Oryza sativa)
  misc_feature (71): n=a or c
tttcacccatgtcaacatatgacaccaactataaaaagatatcccttttattctctgtagtatcaaagaanaagcagggtatttatctgtacattctttta

SEQ ID NO: 10350 - DNA, 101 bp, rice(Oryza sativa)
  misc_feature (71): n=a or c
aagtgctggcttgctctcggccgtccatggtcgatccaacggctgactaggggaatcacctgatccccttnggagggcctcatcgtttggctttttttttt

SEQ ID NO: 10351 - DNA, 101 bp, rice(Oryza sativa)
  misc_feature (71): n=a or g
aaatttgggctgcgaaaaaaaaattcacatgggctgcacaaattcacgtggactgcacaaagcatctgctngcccgaaaacgcacctgtgctgcatataca

SEQ ID NO: 10352 - DNA, 101 bp, rice(Oryza sativa)
  misc_feature (71): n=t or c
tcgaagcgacgcatcatcgcgccggttcgttctctgtgcttgttgttcctcctgacgatagccgacgcgangacgtcaacgccaaatgatgcccccacaca

SEQ ID NO: 10353 - DNA, 101 bp, rice(Oryza sativa)
  misc_feature (71): n=a or g
tgccgcgcccgaccctggtctcctggaactgcatggtcgctgcgtacggcaggagctcccaggtggaggantctgttgcggtgttcaacgcgatgcggcgt

SEQ ID NO: 10354 - DNA, 101 bp, rice(Oryza sativa)
  misc_feature (71): n=a or c
gtatccctcgttggccgcgcgagacagctcggtctcgcgactttgccgcgagaccgcacacgtattcgccncgcgagatcggggctatcatcgtgccactt

SEQ ID NO: 10355 - DNA, 101 bp, rice(Oryza sativa)
  misc_feature (71): n=t or c
catcccctcccctagatccccaaaaggaggcgacaaaccctcccggattccagtcccccctccccatggcngccgtctcgacgaccaaatcaaaccccgcc

SEQ ID NO: 10356 - DNA, 101 bp, rice(Oryza sativa)
  misc_feature (71): n=t or c
acttccttttctaattcttattttcttgcaaagctctttatcttctacaagaatagagaataaattgttgnaattagtcaaacaaatctgtaccttgtctt

SEQ ID NO: 10357 - DNA, 101 bp, rice(Oryza sativa)
  misc_feature (71): n=t or c
atgccatagtcaagctcccaaatgtcttgtattatccgtagtatgacttattctcccctattgcgtccaangcctccacacgaactccactattctaacct

SEQ ID NO: 10358 - DNA, 101 bp, rice(Oryza sativa)
  misc_feature (71): n=t or c
cagcggcgacgatggagtctctttctcttttttttttggataaggcagcgatggagtcgagactggggatngcatcggccgcgggaggaactgagaaagtc

SEQ ID NO: 10359 - DNA, 101 bp, rice(Oryza sativa)
  misc_feature (71): n=t or c
tagttgcgttctccttgggcacggtggcgaaggaaggtccggtgaagaagatctcccaaaagaaaggactngtcgacatcgcccgcattttcagcgacgac

SEQ ID NO: 10360 - DNA, 101 bp, rice(Oryza sativa)
  misc_feature (71): n=t or c
ctggttaatataatccattataaaaaaaatcacctttcttttcagaaaacatttgtagtttgcattggtgnagttgagggtatattgctccgtatctctac

SEQ ID NO: 10361 - DNA, 101 bp, rice(Oryza sativa)
  misc_feature (71): n=t or c
aaagatgttgctagagttagggtttggtttcagttgttagggataggttcgggcgacctcggctgtagttnatttgttggcctagcggcggccggtcacgc

SEQ ID NO: 10362 - DNA, 101 bp, rice(Oryza sativa)
  misc_feature (71): n=a or g
agaagcgagaaaaaaaggaaaaaaaaggaagagatgggacgcgcgtgggggtgggccagaaactcgcgccncttgtgctaatagcgcatacgcgctaatta

SEQ ID NO: 10363 - DNA, 101 bp, rice(Oryza sativa)
  misc_feature (71): n=a or g
gaagtggtaaggtgtggaggcaatggatccgacggtggggaggcgcaacagctatcgcaagcgcggattcnatggcggccgcactccccctgcacggcggc

SEQ ID NO: 10364 - DNA, 101 bp, rice(Oryza sativa)
  misc_feature (71): n=a or g
tctgcatatgttagttataagaaatttactggaatagtcggagcaattggttgaacttcttcttctatgtnatgactccctacagctgatggggttcgatc

SEQ ID NO: 10365 - DNA, 101 bp, rice(Oryza sativa)
  misc_feature (71): n=a or g
ccaaatacatcctaatatacactcaatagacgggattagtagtaaaggtcgctacgattattttatatatntgtgttatattttattaggccgtgttcttt

SEQ ID NO: 10366 - DNA, 101 bp, rice(Oryza sativa)
  misc_feature (71): n=a or g
gaggaaaccgagctcccacccctacaagggctaaggggcttacgcctcctcctcccctctcagcctctcanccggtcagccctccactccacctctccaag

SEQ ID NO: 10367 - DNA, 101 bp, rice(Oryza sativa)
  misc_feature (71): n=a or g
gagctgggccggcaaacgagctgatcttgtgctcggcgagtgccgtgcagaggtcttgttcaggcaggctngagctgaactgacccagagcctcaagctcg

SEQ ID NO: 10368 - DNA, 101 bp, rice(Oryza sativa)
  misc_feature (71): n=t or c
aattttcatttaaacaaatcttcattagtacttcctccgtatactccctccggattttaatattttaatanatgacactattgcttttttaaccaacgttt

SEQ ID NO: 10369 - DNA, 101 bp, rice(Oryza sativa)
  misc_feature (71): n=t or g
agtaagaattttctgaatcatacaatttagatattgtagtttattcatctggcaatagtcagaacacatangtgcatttctggtcccaatgaaatcgaaga

SEQ ID NO: 10370 - DNA, 101 bp, rice(Oryza sativa)
  misc_feature (71): n=t or g
ttcacgtataatgcatgtcatggccaatatgaattgaatttgatcattggcatgatctaagtatctttttnaaatattatcaatgtctagaatatgttttt

SEQ ID NO: 10371 - DNA, 101 bp, rice(Oryza sativa)
  misc_feature (71): n=t or c
tgggtatgcatggtatatttaaatatctaataattggtatataccacagaaaacatatcgaggaagaaatntttaatttatgtatgcatgtacaaacttca

SEQ ID NO: 10372 - DNA, 101 bp, rice(Oryza sativa)
  misc_feature (71): n=t or c
gcggcggcaagcggagtggtgcggctcgaagggacaatggcagagcaatcgggaggaggcacctccgtcgnctccgcctccctgacagcttgactggacag

SEQ ID NO: 10373 - DNA, 101 bp, rice(Oryza sativa)
  misc_feature (71): n=a or g
tgcataattttcctaaatcatgaagatttgtgtgccaagtatgcaccgacaggaaattagtgcataaaccncatatagttctagcatccctgaactggatt

SEQ ID NO: 10374 - DNA, 101 bp, rice(Oryza sativa)
  misc_feature (71): n=t or c
tcggctatgaataaaatgattacaagatggaatcaaggtgagtggtttaaccttgagaaatgagctggggnagcaggagttggaggagtttgcttgggtga

SEQ ID NO: 10375 - DNA, 101 bp, rice(Oryza sativa)
  misc_feature (71): n=t or g
gataaatttggaagagaaaaaaaaaggaaaaagagaaaagagaggagattagaagggatcagtatggctgngagaaaagaaaagaagaaaaagaaaacaaa

SEQ ID NO: 10376 - DNA, 101 bp, rice(Oryza sativa)
  misc_feature (71): n=a or c
tatacagatttggaagaccttcattgtttgctgaagatagaccaaacctgtttacttgaacaaaaaatagntggttgtgagagaccattcatctttacatt

SEQ ID NO: 10377 - DNA, 101 bp, rice(Oryza sativa)
  misc_feature (71): n=a or g
tcatattatagaaattggacattctgccattgccaaaactaggtttcaccgaaatgccactccgcaaaagngatttgttaaaatgccaatatcaactcatg

SEQ ID NO: 10378 - DNA, 101 bp, rice(Oryza sativa)
  misc_feature (71): n=a or g
gttgcactgttatggtctatgctaagtcctctgtaaaaaagaaaaggaaaaagaagggaacaaacagagtnaattattttttgcctggacaggcaatagta

SEQ ID NO: 10379 - DNA, 101 bp, rice(Oryza sativa)
  misc_feature (71): n=t or c
atcctctccacaaccactcattttcctcacccttctctctctcatttccggctccctcccctctcagatcnggtggaggggatgggcggcagcgacggcac

SEQ ID NO: 10380 - DNA, 101 bp, rice(Oryza sativa)
  misc_feature (71): n=a or c
acaccctaacagccgctatagagcaccaaatcttgccagaaagacaccaataggttagcacggttgttctntacactttttgttttgggagcttgagctga

SEQ ID NO: 10381 - DNA, 101 bp, rice(Oryza sativa)
  misc_feature (71): n=a or g
tatcggctcagccgatggcatcgccattgacttctttgcctgctccatcagcgtcgacaccaggtcagccnattaatcctcggctattgatgagggagtag

SEQ ID NO: 10382 - DNA, 101 bp, rice(Oryza sativa)
  misc_feature (71): n=t or c
tccccttttttctttctccaaaacattgatccggtgacaactactttttttcaaaaaaaaaaacatagatntatcctgttaaatcaaagatgttgtagcag

SEQ ID NO: 10383 - DNA, 101 bp, rice(Oryza sativa)
  misc_feature (71): n=t or c
tcatatgagttaattatctctattttttttcttctcaatatctctcacatacttatgcattttatgtattnatcttaaaatatactccctccgtctcaaaa

SEQ ID NO: 10384 - DNA, 101 bp, rice(Oryza sativa)
  misc_feature (71): n=t or c
acattggttttaagagttaagaaacacattatatctggtattgcgatgcagggactgatttcagattcggngataaattgagagatctaaagtgaacttat

SEQ ID NO: 10385 - DNA, 101 bp, rice(Oryza sativa)
  misc_feature (71): n=a or g
atttatcttgtattggcgtttatgagtttgtgtctgcttcatgtttgaaagagttttttttaagttttctntcgaaacaagatttcggcaataataaaagg

SEQ ID NO: 10386 - DNA, 101 bp, rice(Oryza sativa)
  misc_feature (71): n=t or c
cacaaagtcaccaggaaaagagaagttttatattattgaccgtagatggaccaaagttggatgtacgatgnaaaagggcatatagcctagtggttataaga

SEQ ID NO: 10387 - DNA, 101 bp, rice(Oryza sativa)
  misc_feature (71): n=a or c
atttgtgtttttctgcatctcggtggtcaaactgatgctggtggtgcggtcagaccgacgagcggtgcaanaggtagcaacgaagtagattggactgacga

SEQ ID NO: 10388 - DNA, 101 bp, rice(Oryza sativa)
  misc_feature (71): n=a or g
ggacgttggtataaaaatcaggaatgagataagggtggagaactacctaagagtaatacatttactaaaanaagaaatcaacagagagtaatacatctatt

SEQ ID NO: 10389 - DNA, 101 bp, rice(Oryza sativa)
  misc_feature (71): n=t or c
aattaaaaccctagctaggtgagggactttcccgccattgtcgtcgtcgaccctcccctccttctctgggntcctctcgccaccgctggcggaaccgcgcg

SEQ ID NO: 10390 - DNA, 101 bp, rice(Oryza sativa)
  misc_feature (71): n=a or c
atagctgtcacaggtgacataaaaaaaaccaccgccccacccggccctttcttctcccatccgccccaccnggcaccttctcttctctcttcctctaactc

SEQ ID NO: 10391 - DNA, 101 bp, rice(Oryza sativa)
  misc_feature (71): n=a or c
ttagatctattataaaaaatgcaattaaatttatctcaaaaactcgcattgtatgtgcacgtataggtatnaaaaaaaacaagtacgtcccacataattat

SEQ ID NO: 10392 - DNA, 101 bp, rice(Oryza sativa)
  misc_feature (71): n=a or c
gtcgtcccatggatctaccatgccgacacccggccaccgttctcatccctggccgacctccattcctctcntcttttagctcctctctatccaggctgcct

SEQ ID NO: 10393 - DNA, 101 bp, rice(Oryza sativa)
  misc_feature (71): n=c or g
atcacatctgtaagagaaggacctagttgtaaatagaaaaaagttaggggtgttttgcgagaatcgaactnatgacctctcgcacccgaagcgagaatcat

SEQ ID NO: 10394 - DNA, 101 bp, rice(Oryza sativa)
  misc_feature (71): n=a or g
caaggtgattctcatttttgtcagggcttatgaagttaaaaaacgtatgggttcttggattgtgaatgatngtcagcagataagattctgggaggataaat

SEQ ID NO: 10395 - DNA, 101 bp, rice(Oryza sativa)
  misc_feature (71): n=c or g
attttatctatagtaatcctatgtttatcaatcccctcagttcagttaagtgtaccctcaacacagcaggnaaagcaggctgtgtacattctttgagtgta

SEQ ID NO: 10396 - DNA, 101 bp, rice(Oryza sativa)
  misc_feature (71): n=c or g
ccaagaacaagttagaagtagcaggaagctgcaagaggaactgaggaaggaagcaagaaagcaaaccaaancaaaccaaaccaagaagcaaatctcagttg

SEQ ID NO: 10397 - DNA, 101 bp, rice(Oryza sativa)
  misc_feature (71): n=c or g
ttcaaactaatcaaaagaggaaggagggagtatttgagaagcaacctgaagcatatgtaactgtgattaanccaactctataattcctatcacatatttat

SEQ ID NO: 10398 - DNA, 101 bp, rice(Oryza sativa)
  misc_feature (71): n=a or t
gccgtgcggtgggggttctctgtggtggcggtgtggaacgtcttggcggttgcacggaacacggggcagtnggacgggcggaggcttcaacggaggtggcg

SEQ ID NO: 10399 - DNA, 101 bp, rice(Oryza sativa)
  misc_feature (71): n=a or t
tgcacacatgcaatccagtacactagcaccgtagtaggacgttagctgctacattcttcgcccctccgtanaaaaaaaaaaaaacaaacctagtttccgtg

SEQ ID NO: 10400 - DNA, 101 bp, rice(Oryza sativa)
  misc_feature (71): n=a or t
attttgcggtacatccgtggcaccctggatgatggacttcaaatctagcgctcccaggccgctgatcttgncaactcgcaagtccacctccggctatgtgg

SEQ ID NO: 10401 - DNA, 101 bp, rice(Oryza sativa)
  misc_feature (71): n=c or g
gtgtatgttagtccaatttacttttttcttaaagagatttgaaataaccttgaaggcatgatgtggttttntaaggaaaattgataatataacacgaaagt

SEQ ID NO: 10402 - DNA, 101 bp, rice(Oryza sativa)
  misc_feature (71): n=c or g
ccatatgcctctctcccatcaaatcatccgccgcttgtcgctgctgctacgtactccttgttaataatcancttgattagttaataatcagcttgattagt

SEQ ID NO: 10403 - DNA, 101 bp, rice(Oryza sativa)
  misc_feature (71): n=a or t
ggattttctagatcgagactagaaaaaggattctccctaaccatgttgattagttcatggcgaatttcatngccagttgtataaattggctccgatgaagg

SEQ ID NO: 10404 - DNA, 101 bp, rice(Oryza sativa)
  misc_feature (71): n=a or t
ctccaaaatggactcgtacagtctgaacgccaacgtccctcacctctctacgtattttgttcaaaacacanaacacatgtacatgttctctgttgggttgt

SEQ ID NO: 10405 - DNA, 101 bp, rice(Oryza sativa)
  misc_feature (71): n=a or t
ttggcgtttctgtggaaaactggatgagagaaaccggcagcttagctagcgtatttgttcaggcgcaggcntaaattcttataaatgacagtaaatggttt

SEQ ID NO: 10406 - DNA, 101 bp, rice(Oryza sativa)
  misc_feature (71): n=a or t
tttggggattccgagaagtccctagaacacacaattcacctacatgttgaactacactgaaatccaaaatntcattttgagacgtgcaatgcagagtctag

SEQ ID NO: 10407 - DNA, 101 bp, rice(Oryza sativa)
  misc_feature (71): n=c or g
aaggggagattggagggtttaaatagcgagagggttgtgcttgtgcactgtctcgagtaacaaagggcctnttcactttgatgaaaaaaaaaaattggtag

SEQ ID NO: 10408 - DNA, 101 bp, rice(Oryza sativa)
  misc_feature (71): n=a or t
ctcccttctgtagcagtcggtggcaagttgatgcaaataagaatgcaagcatatactctgaaaaacactcntatagtgactctgtggaacagcagtcttat

SEQ ID NO: 10409 - DNA, 101 bp, rice(Oryza sativa)
  misc_feature (71): n=c or g
ctctttcaaaaaacaaaccttcccgctggcctgccagttgttgctgctctctgcaaacctgctcgctcccncggcgctgctgctgcacggctgctcctcct

SEQ ID NO: 10410 - DNA, 101 bp, rice(Oryza sativa)
  misc_feature (71): n=c or g
gccaaggaaaacattctctaaagtagggtatatgttagataaggaatgcaagaagtcttcagatgtagacnaaggtacaatattttggagtgcattatgta

SEQ ID NO: 10411 - DNA, 101 bp, rice(Oryza sativa)
  misc_feature (71): n=c or g
atatatatatatatataaaaagttgatgaataaaacgacaccttgatcgataatcatccatggatcggacnatatcgatgcaggtggagatatcccttctt

SEQ ID NO: 10412 - DNA, 101 bp, rice(Oryza sativa)
  misc_feature (71): n=a or t
tacagagtatttgagctgccagagttacatggaaagaactagcagtctacccaaagcccttttcatctggntctaggctaactttactatattgaagaaga

SEQ ID NO: 10413 - DNA, 101 bp, rice(Oryza sativa)
  misc_feature (71): n=a or t
cagcagcagcaaagcgacgagcgcggtggtggcagaaccaacaagcgggtggctggaaggtgtgtgtgtgngagagagagagggatcacggaagagaagag

SEQ ID NO: 10414 - DNA, 101 bp, rice(Oryza sativa)
  misc_feature (71): n=c or g
tcaaggataattacacacagcacacacacatcaaatcttgtaatagtagtagtagaaacctggtatcagangcagtaacaaattagttcaacgtgcatcac

SEQ ID NO: 10415 - DNA, 101 bp, rice(Oryza sativa)
  misc_feature (71): n=c or g
ttttctgaactaatcaatggggaaaagaacttcaataccggcctactaccaaaatttatcatatacccctncatcctaataagtcaattgttatacacgaa

SEQ ID NO: 10416 - DNA, 101 bp, rice(Oryza sativa)
  misc_feature (71): n=a or t
tgctgctagtattcttttcaaattcctgaaagagttgttctattagggttccagattgggagagaggaaantctgtttatgccagttgataattttaataa

SEQ ID NO: 10417 - DNA, 101 bp, rice(Oryza sativa)
  misc_feature (71): n=c or g
tcctgatcggctagtcgatcgatatatgcaatgaaattatattcaaccctttatagcattttagttttccntttgataaaactctagctctcaacttcaac

SEQ ID NO: 10418 - DNA, 101 bp, rice(Oryza sativa)
  misc_feature (71): n=a or t
ggccagttgcttcgcgctctacggggatgttagattgacattatttttaatcctgtactccatccatcgtnaagagttagacacaattgttaagaaagtat

SEQ ID NO: 10419 - DNA, 101 bp, rice(Oryza sativa)
  misc_feature (71): n=a or t
aagggtttttattatatgtttttacctgttttcaaacatgaaaaatggtgcaggtaacacagagagtagancagaagcaaacatggcttgtatgatagaaa

SEQ ID NO: 10420 - DNA, 101 bp, rice(Oryza sativa)
  misc_feature (71): n=a or t
agtgaatttctagacgtgacaaagatcttttcgataacctttttggagcagaggagcgtgtgcctattatnaagttgacccatgatctgacccagaatcga

SEQ ID NO: 10421 - DNA, 101 bp, rice(Oryza sativa)
  misc_feature (71): n=a or t
tttttcttttttttttcctctcccacgccggtttgttcgaggctcctgcaaattggacgcctgattttttnaaaaaaaaaatcgagcgttattccattata

SEQ ID NO: 10422 - DNA, 101 bp, rice(Oryza sativa)
  misc_feature (71): n=a or t
tgcacaagcctgtacaaatagaagcccatacattccaatcctgagatagaccaacagcagtcttcccatangcaatggagaaattgagcattttggccttc

SEQ ID NO: 10423 - DNA, 101 bp, rice(Oryza sativa)
  misc_feature (71): n=a or t
gcttataaactgatagacaaatgatggggtcacatatggtttttggtaaaggttgcgtttctttttttttnaaaaaaaaagcatgtgctacaaacacaacg

SEQ ID NO: 10424 - DNA, 101 bp, rice(Oryza sativa)
  misc_feature (71): n=a or t
tgtggaagattttgctcttcctaatagttcagtgggtatcttgaactagtagtccaatcatgtcttttttnaaaaaaaacaatcataacccaattaagatg

SEQ ID NO: 10425 - DNA, 101 bp, rice(Oryza sativa)
  misc_feature (71): n=c or g
tgttagttctttttttgtatgattttttccctcctcctatgtgcagtaatgcaaacataacacatacacanagagagagagagagagagagagagaggggg

SEQ ID NO: 10426 - DNA, 101 bp, rice(Oryza sativa)
  misc_feature (71): n=a or t
ctctattattcgagaacatataaagtagttttgaaaaggccggcttatcatttttaaggcatatttttttnaaaaaaaatgttcacagtagttttaagatg

SEQ ID NO: 10427 - DNA, 101 bp, rice(Oryza sativa)
  misc_feature (71): n=c or g
tagctagcttagctactactacactctctgattgatgatactaatggttagctagctagtaagagagtgtnaaattaacaagctagagagagtgagatgga

SEQ ID NO: 10428 - DNA, 101 bp, rice(Oryza sativa)
  misc_feature (71): n=c or g
tcacttcacatactaaaattttcgaacaccacaaaatctatatatgctagaacaaatttagttaaatgatnacacaatatagtaataatacaaatttacaa

SEQ ID NO: 10429 - DNA, 101 bp, rice(Oryza sativa)
  misc_feature (71): n=a or t
agcatatatgaaatgtgtaaatagtataaagttttctattaatcaggccgtctggtaatcaacaaacaatnttttttttcctctctactttctcttgcctt

SEQ ID NO: 10430 - DNA, 101 bp, rice(Oryza sativa)
  misc_feature (71): n=c or g
cttccgatctgaactgaaagaaacccgtcatctacccaacaaaaaatgaactaatctggtggtacgagtgngcgcgcgcgcgcgtgcggtcaaagtgtcaa

SEQ ID NO: 10431 - DNA, 101 bp, rice(Oryza sativa)
  misc_feature (71): n=a or t
tgttcgacgactagctgacccatgttcttctagctgtgccggcaaaatacctaatgaactatattagcagntgttctaaaatatcatattaatccaatttt

SEQ ID NO: 10432 - DNA, 101 bp, rice(Oryza sativa)
  misc_feature (71): n=a or t
tgcagcaaaatggagtagtaccctggaagaagagctgcacaggaggcggtcctcacacaaaaacacacacnctctctctctctctgtgtgtaggggagagg

SEQ ID NO: 10433 - DNA, 101 bp, rice(Oryza sativa)
  misc_feature (71): n=c or g
tcagtgtgtaatatgtagaattgtaaattgattgtacttttttattggaaatggctatccctgttagcttnatatgcttgtatcacaggcaatgatgtgtc

SEQ ID NO: 10434 - DNA, 101 bp, rice(Oryza sativa)
  misc_feature (71): n=a or t
gccgcacacgtgtgttgggtgtgatattggtcacagatcgcaataggtagctgaattgtctcttttttttnaaaaaaaaaaagctgaattgattgttgagc

SEQ ID NO: 10435 - DNA, 101 bp, rice(Oryza sativa)
  misc_feature (71): n=c or g
taactttgtatttatggaaacaggagaaacaatagatataggctcctgcatatagagtcatacaaggatanaaggatagagtctgaccatatcgattagat

SEQ ID NO: 10436 - DNA, 101 bp, rice(Oryza sativa)
  misc_feature (71): n=a or t
aatggtgattttactgatacaggtgatatcttagcaacgctgaaagaaaaatttgctcgtcatgttgcatntgagcggaaagcagattcttcaaaattttt

SEQ ID NO: 10437 - DNA, 101 bp, rice(Oryza sativa)
  misc_feature (71): n=c or g
tctaggcaaacatcgattcgctgaaagcttcagcaaaggagcacttgaagaataagtgatcgccatctttntcttgatgcaagcagattttgtattttgct

SEQ ID NO: 10438 - DNA, 101 bp, rice(Oryza sativa)
  misc_feature (71): n=a or t
tcgtccgaaattgaggtgaccatcgtccttctacacgcgatgaatctcctttaccctctcttttactggcnagatcgccatggctcgctggagcgactcca

SEQ ID NO: 10439 - DNA, 101 bp, rice(Oryza sativa)
  misc_feature (71): n=a or t
aatgtgacacatcataatactatgaatttggatagaaagccaaaggccttgtttagattcctaaaaaaaantggccaaaaacatcacatcaaatgtttgga

SEQ ID NO: 10440 - DNA, 101 bp, rice(Oryza sativa)
  misc_feature (71): n=a or t
gccacttgtacgatccatagttcataacagtgtatgtactgtatggagggtctacttttgggtcctgaagnccaacaagcaagacaacagatctaatagta

SEQ ID NO: 10441 - DNA, 101 bp, rice(Oryza sativa)
  misc_feature (71): n=a or t
atcaggcaactacagatcttacagctgatgcaaggtcaagacattaatgtttggcatactctttttttttnaaaaaaaaaggtagaaatgaattccggcct

SEQ ID NO: 10442 - DNA, 101 bp, rice(Oryza sativa)
  misc_feature (71): n=c or g
atcgaaataaaattatccaaaataagagctagaactagaagttctcagccaggcaaaaaatacagactaanagagtgagaaataatccagagataatggat

SEQ ID NO: 10443 - DNA, 101 bp, rice(Oryza sativa)
  misc_feature (71): n=c or g
gttaatttatcccgctggcctcaccttatctgttggtgataattaatctaggagcatttggttgcaacctncgcaatcagataaaaattaaaccacttatt

SEQ ID NO: 10444 - DNA, 101 bp, rice(Oryza sativa)
  misc_feature (71): n=a or t
gtggaccagctttataaaatttggcacggttcgatcgagtacgtatttcataatccgatgataattttttnatacacgtgaaatcaaaccaacgagagaga

SEQ ID NO: 10445 - DNA, 101 bp, rice(Oryza sativa)
  misc_feature (71): n=c or g
accccaacgctaatcgatcattgcacgaaatcaaattaatatattatgccaagttgatctgcaaattggantccaatcgatctgattgccaagtcttcagc

SEQ ID NO: 10446 - DNA, 101 bp, rice(Oryza sativa)
  misc_feature (71): n=c or g
ctgggcaaaggttgcattgctcggcagtggccgatccttctttacacttatgttagccgatcaaatctaanagtggctcaagcgctggtacagcacactct

SEQ ID NO: 10447 - DNA, 101 bp, rice(Oryza sativa)
  misc_feature (71): n=a or t
ggcgaggatggcggagagcgagacgtgcattccaccgctcatcggtgcgggggtgttcttgtcgtcttcgnctcaacggacaaactggcggcgagcgacga

SEQ ID NO: 10448 - DNA, 101 bp, rice(Oryza sativa)
  misc_feature (71): n=c or g
gcgccacctggtccaaacgtcgtgataccacccaatagtatcccaaagtcccggtttgtggaggatagtcnacgtgtgtagccaccgggtaactaaagtaa

SEQ ID NO: 10449 - DNA, 101 bp, rice(Oryza sativa)
  misc_feature (71): n=a or t
gggatctactcatttttaggagaaattagagatttgaacaggttaattcggagttcaaacggttaagatanggccatttgaagtttaggtgctgtttaaat

SEQ ID NO: 10450 - DNA, 101 bp, rice(Oryza sativa)
  misc_feature (71): n=a or t
gatgaaatggatcggcatctgatttgccattgctgatcgacacagatcgagcagctgcacaagatcttcangctgtgcaggtcgccgtcgaaatagtattg

SEQ ID NO: 10451 - DNA, 101 bp, rice(Oryza sativa)
  misc_feature (71): n=a or t
acgaaggtacaaaaacttcaatattacgttgtgcacttttattcttgctctttcccatgcatctgactgcngccatcgttttttccagggccatcctaaat

SEQ ID NO: 10452 - DNA, 101 bp, rice(Oryza sativa)
  misc_feature (71): n=a or t
catggactgaagaagctcggaacagtgactgtgcaggaactgccgttctttgacactgtcaaggtcaaggncgctgatgcgaatgcgattgcccaggaggc

SEQ ID NO: 10453 - DNA, 101 bp, rice(Oryza sativa)
  misc_feature (71): n=c or g
atacctcaatagccccgactcaatagctccatttttagtctcggtttaaaactaaatgatctttagtcccngttcattcattgtcaggccgtggcaggcat

SEQ ID NO: 10454 - DNA, 101 bp, rice(Oryza sativa)
  misc_feature (71): n=c or g
tgagtggagaggagaaagagatagaggagagatgaatgcatgggtgggtgggtggcagcctctggcagtgngtgggtgggtgaaggaatctcgtgtgcatg

SEQ ID NO: 10455 - DNA, 101 bp, rice(Oryza sativa)
  misc_feature (71): n=c or g
atggacgccctccccgtccaggtcccacctttccccctttctctgatttcggtctgggtgattgatgaatngtagttttagttcgtagttccactctaaat

SEQ ID NO: 10456 - DNA, 101 bp, rice(Oryza sativa)
  misc_feature (71): n=a or t
tgctcgatcgctttgctctgcctgaggtcgatgcagtttgcttctatgctttttgccttttttttttgttnatgtactagctagctactcccttcgttcta

SEQ ID NO: 10457 - DNA, 101 bp, rice(Oryza sativa)
  misc_feature (71): n=a or t
gagaggtacaagtgggagtacggcttcaggtacggccaccttttcgtttccctcttttttgcttttatttntatttttttatataaaaaattatgtcttgt

SEQ ID NO: 10458 - DNA, 101 bp, rice(Oryza sativa)
  misc_feature (71): n=a or t
ctttactagcttttaagggtggaaatttttgaaattttagtagggtgacaacggtaataatatatttggtntgttgatttctattaaaacttgataatcat

SEQ ID NO: 10459 - DNA, 101 bp, rice(Oryza sativa)
  misc_feature (71): n=a or t
tgatattgcagtgaatcatttttaaagaaaatagccatacacgtgcgtcctccatcctaaaatatagtaanctagtactgaattatacacccttaacctaa

SEQ ID NO: 10460 - DNA, 101 bp, rice(Oryza sativa)
  misc_feature (71): n=c or g
cagtcccagcctctgcatgattaagatgcacacgacttacgattattacaaaagaaaagcggcacaacaanaaatatcatgccgcagcgaactacaaacac

SEQ ID NO: 10461 - DNA, 101 bp, rice(Oryza sativa)
  misc_feature (71): n=a or t
gacataatagcgtgatctaccgagtgattggaccggcccccacacatatgtgtgaaccaattctagccttncagtctctctcttttaaatcgagattgtgt

SEQ ID NO: 10462 - DNA, 101 bp, rice(Oryza sativa)
  misc_feature (71): n=c or g
tacctttttgctggatccacagcaatgtaaggtacaaaagaaattattgcatagatgattattatacgtanttgtgtgcttcaacttgtttccttttactc

SEQ ID NO: 10463 - DNA, 101 bp, rice(Oryza sativa)
  misc_feature (71): n=a or t
actgtccatgtcatctgttttgtattattgagctggttagagcatgtttaatagtagataaccggctatangcttatattagagctaacttgtatatacat

SEQ ID NO: 10464 - DNA, 101 bp, rice(Oryza sativa)
  misc_feature (71): n=a or t
agcttagttccattcaattctgtcagtaccacacagctagcaaacaacctcacgtgattgcccaaagtgtntcgatcgatcgatcgaccgttgtacgtact

SEQ ID NO: 10465 - DNA, 101 bp, rice(Oryza sativa)
  misc_feature (71): n=c or g
aactaaatatacttacacaacacgatattacggacttaaaccaaacgagtatcctcaataaaaaaccagangaacagtcatcacgagaacggattgggatc

SEQ ID NO: 10466 - DNA, 101 bp, rice(Oryza sativa)
  misc_feature (71): n=a or t
gattttgagggtgaaggtaaggattggagaaggttttgaaggctaggatggtttgagcacttactcttggngacggagcgtggggctcctcaccgggagac

SEQ ID NO: 10467 - DNA, 101 bp, rice(Oryza sativa)
  misc_feature (71): n=a or t
tatagtcactagcctcaagaatgctcattccctagctagtacaccacatatggaaatttcagttttccganactttgcttcctgcagtctgtagtcaagct

SEQ ID NO: 10468 - DNA, 101 bp, rice(Oryza sativa)
  misc_feature (71): n=a or t
taaaatgtgctctatattcatagatcgtacgtacgcgatgagcgcatacgtttatacgttttatttttttnaaaaaaatcatcgactttccgaggagatcc

SEQ ID NO: 10469 - DNA, 101 bp, rice(Oryza sativa)
  misc_feature (71): n=a or t
ataacacaaatcccattatgcgggttgggctaggaggagaactagacttttccgtgaattctttcgaagtnaactcttttcaaattttagttcgtaaatag

SEQ ID NO: 10470 - DNA, 101 bp, rice(Oryza sativa)
  misc_feature (71): n=a or t
agacaattattttaggacaacttttaaatgttagaaatgtaagtactgtgagacggaggaaatattaattnattttttattttctttaattttttataact

SEQ ID NO: 10471 - DNA, 101 bp, rice(Oryza sativa)
  misc_feature (71): n=a or t
cagcgtggaccccatacgtcagacctagtcatcatctctttcccctcttctcttctctctgtttctcttcnctttctcagttttctcctcatgccgcccgg

SEQ ID NO: 10472 - DNA, 101 bp, rice(Oryza sativa)
  misc_feature (71): n=a or t
cggcctgccgctggccatagtcagtgtgggaggaatgctggcccaggcggagaacaagacgccggtggagnggacgaaggtgtgcggcaagctgggctccg

SEQ ID NO: 10473 - DNA, 101 bp, rice(Oryza sativa)
  misc_feature (71): n=a or t
catatccatcgaatcacgccaatctctctgctggtttacactcaattgaaaatgacattgctttcggtgtnaattattaactttgcaatgcaaaaccaggg

SEQ ID NO: 10474 - DNA, 101 bp, rice(Oryza sativa)
  misc_feature (71): n=a or t
tttttggacggagggagtaactctgaacatacgtcgggctatgaaaaagctgtagtctgttgtgttcaaantttagttctgtgaaccaaaacccttgaaaa

SEQ ID NO: 10475 - DNA, 101 bp, rice(Oryza sativa)
  misc_feature (71): n=c or g
aataattgatcaacctagtgtcgtctcatgtgtccattctacaatacagtcatacagataagatgaaatcnctatatatccttgtgtgtgtgttttttctc

SEQ ID NO: 10476 - DNA, 101 bp, rice(Oryza sativa)
  misc_feature (71): n=a or t
gctatggatcatcaggggatgggcggcaggtgtaaacctagcttggtcttccctctcgggggcattatcangccgcccatttccctttgttggggttgctg

SEQ ID NO: 10477 - DNA, 101 bp, rice(Oryza sativa)
  misc_feature (71): n=c or g
gtgtgcagtctgtctccgatcgatcaaagaattgattcccacgaattggaccagtggtttcctgtagccangtaagagctaggctagctagctaagctact

SEQ ID NO: 10478 - DNA, 101 bp, rice(Oryza sativa)
  misc_feature (71): n=a or t
ggccattgacattgggcatatgccaaactacttgcagatggatcaatttatatgcacaggaccaagctaanttttttgccgacttcaaggatgcatacatc

SEQ ID NO: 10479 - DNA, 101 bp, rice(Oryza sativa)
  misc_feature (71): n=a or t
gctcacaattggatttccacatctgaggattggcaccattgaattgaggacatagcatggggtgtatagtntcactcagatccacagatgcagtaggctca

SEQ ID NO: 10480 - DNA, 101 bp, rice(Oryza sativa)
  misc_feature (71): n=a or t
atgccaaattattacatggaatgcagtgatcaaagttagcttgtgcataaatgcaaaaggaagagacaacnacttgtagtactatctggtgatagagcaaa

SEQ ID NO: 10481 - DNA, 101 bp, rice(Oryza sativa)
  misc_feature (71): n=a or t
cagtctctcgcctgggcctccagcccgcagacaacagatagagaccacgcaatttaacacacacagtcgtnttcaccaaaattgtcaacttccgtactctc

SEQ ID NO: 10482 - DNA, 101 bp, rice(Oryza sativa)
  misc_feature (71): n=c or g
ttacgatccaaacctaggggatgcatggcacggtaacatcacatcatctcaacagtagatgatcatatagntaggtgtatatatatgggtatccattattg

SEQ ID NO: 10483 - DNA, 101 bp, rice(Oryza sativa)
  misc_feature (71): n=a or t
ctttagttttgttatcttgatgagaacatgttattttattgatcttatagtgcaacatgtggatcttctgngtgtctttgttgtggacactgtgaaggata

SEQ ID NO: 10484 - DNA, 101 bp, rice(Oryza sativa)
  misc_feature (71): n=c or g
ggcggccatggttggatggacaacgacagtgaagattgaacatgggaagagataaaggaagaatatggagnaggaagaagatggaagaaaaacgtgacggt

SEQ ID NO: 10485 - DNA, 101 bp, rice(Oryza sativa)
  misc_feature (71): n=c or g
aaacaccaggatgaaaatgggcaaggcccaatttgtcaggcccagggatctggtttacgcttccaatcctngaaagcgtaaatctgtccgctcccagggtg

SEQ ID NO: 10486 - DNA, 101 bp, rice(Oryza sativa)
  misc_feature (71): n=a or t
tttggaatcaaaatttacaagtcttctctcagatttcagtgactgcgcagaggatgctagcgacaacttcnttgagatacatgaaaacaaccacaccatta

SEQ ID NO: 10487 - DNA, 101 bp, rice(Oryza sativa)
  misc_feature (71): n=c or g
attgtctttgtctgattatgtatgtcgagaatgtggtcgggttgttgctctctgagaagagtgtccaaaantgtaatttccgcgaccgcgttctgttgtgg

SEQ ID NO: 10488 - DNA, 101 bp, rice(Oryza sativa)
  misc_feature (71): n=a or t
gttacacaggtttattcatgacctcctattcaacatatatatcttgagatgagtatattacatttacagcntaggacgcttgttagcgaagttttattttg

SEQ ID NO: 10489 - DNA, 101 bp, rice(Oryza sativa)
  misc_feature (71): n=c or g
cctaaaaaaaaggaaaagaaactagaaaagaaaaaaaaaggaaaattgtgccatcctccatccgccccctntcctctctctccgcgcgcgccacgtgtccc

SEQ ID NO: 10490 - DNA, 101 bp, rice(Oryza sativa)
  misc_feature (71): n=a or t
aatgcaacaacaatgttctaacattaaaaagggattcgtgcattacctaataaggtaaatcaaacacattntatatatatatatatatatatatatatata

SEQ ID NO: 10491 - DNA, 101 bp, rice(Oryza sativa)
  misc_feature (71): n=c or g
ggaaatttcagccagtatagttagtaaaagctaccgtccacagcagtaaattaagcacggaaccccaggcngtgtccctagctagctagctctgggctctg

SEQ ID NO: 10492 - DNA, 101 bp, rice(Oryza sativa)
  misc_feature (71): n=a or t
taggcacatgagaacgtgacatgcaccggtccgaacaccagagcatgtttcatcggcaactcgctcggcgngcttggcgggaactccttcgagtttcccga

SEQ ID NO: 10493 - DNA, 101 bp, rice(Oryza sativa)
  misc_feature (71): n=a or t
aattgcccgagttgttaatgcttgctcaggagcaattttgcagcattcaggcatttgcaggattttttttnaaaaaaatacaacttatggcacaatgccac

SEQ ID NO: 10494 - DNA, 101 bp, rice(Oryza sativa)
  misc_feature (71): n=a or t
ttgtatacgtctaatatttgtgattgtagggaatttgttattgggactaacaagtatagatttccaaatgngctgttcggctcgagcacaaccgggctcag

SEQ ID NO: 10495 - DNA, 101 bp, rice(Oryza sativa)
  misc_feature (71): n=a or t
agtttaataggacagctaactactagaggcttcaccatttggcttttttcttattagggaataaaaatgantttggagttaaaacttttatatatgtgttc

SEQ ID NO: 10496 - DNA, 101 bp, rice(Oryza sativa)
  misc_feature (71): n=a or t
actgtggaggtagcttgtcccgtagatcagttcaattggcaatagagggagtggctacagagatggaaaantcaaggagggatgagaggttagagttggcc

SEQ ID NO: 10497 - DNA, 101 bp, rice(Oryza sativa)
  misc_feature (71): n=c or g
gcttgttagaaatagaatggaaatttgtgagacaaatatatacaagtgtttaggtaattaaatcgaaccancacattactttctaatcttatccattaatt

SEQ ID NO: 10498 - DNA, 101 bp, rice(Oryza sativa)
  misc_feature (71): n=a or t
tacttatgattctgttgttcggggcctcaaattgggctttcgtgtaatatgtggttgcgaattcggttttnaaaaaaaacgtggttgcgaattgcgaaggg

SEQ ID NO: 10499 - DNA, 101 bp, rice(Oryza sativa)
  misc_feature (71): n=c or g
caaatggaccaagcgccaagggtcacgactgtgtcgaacccgcgacagcactccctctgaaccttgagcanactggagcagagccgctcgtggaaggccgc

SEQ ID NO: 10500 - DNA, 101 bp, rice(Oryza sativa)
  misc_feature (71): n=a or t
tttcaattcaagtacgaataaatagtatattataaagactaaaacttatttggaaccagcacagaatactnttgtttgtaactttcctttggaataaagta

SEQ ID NO: 10501 - DNA, 101 bp, rice(Oryza sativa)
  misc_feature (71): n=a or t
gattgccttgggcgattcatacctaagatcaaattctgccaaagcataaatccacttcccaactcttcctnttaaaactggagccgataacatatatttga

SEQ ID NO: 10502 - DNA, 101 bp, rice(Oryza sativa)
  misc_feature (71): n=a or t
cgaggatcatctcgaagaggtgtgggccatggcaatcgtcgcgaagacatgcctgaattcaaagccatcanggcggccttctgctcggtacgttctgagag

SEQ ID NO: 10503 - DNA, 101 bp, rice(Oryza sativa)
  misc_feature (71): n=c or g
atgagtaaccacagcagtataggagaaaatacctaggtaaataactaaaataattgaactccacttacctntgcaaatggatcttcctcttctactggaca

SEQ ID NO: 10504 - DNA, 101 bp, rice(Oryza sativa)
  misc_feature (71): n=c or g
tacgactttatgctatctgttgttttggcctggactgatatttcaattcttcgcaggggtcgacatggttntagacgatctgaagaaggagcatcctaatg

SEQ ID NO: 10505 - DNA, 101 bp, rice(Oryza sativa)
  misc_feature (71): n=c or g
gcaagcccgtcatcaatgacacctatcagtgacgggcttaagtttcagcccgataaagataatctttgtcnggcccaaacctaaccccgtcaccgatatga

SEQ ID NO: 10506 - DNA, 101 bp, rice(Oryza sativa)
  misc_feature (71): n=a or t
tgcatatttgctttctgatgagaaatgaatgtttttgagtctatgcgtttgctttgtttggtcttgatgangaagttaagaattttgaagtaattgtttgg

SEQ ID NO: 10507 - DNA, 101 bp, rice(Oryza sativa)
  misc_feature (71): n=c or g
gtgcaatcattaaaggtcatcgagtgccccaaaattattggtcaaccgcgctagtgatgagtagtgactgnaatttttgtcaaaggttcacacgttcgtcg

SEQ ID NO: 10508 - DNA, 101 bp, rice(Oryza sativa)
  misc_feature (71): n=a or t
tatgaggataaagatctctgttgattgtagctcactgtggcataacatgtgttgccatatcattttttttnaaaaaaaatttacgtcgtgcgtatcctagc

SEQ ID NO: 10509 - DNA, 101 bp, rice(Oryza sativa)
  misc_feature (71): n=a or t
gtgagccagcgcacgccgttgggaggatgaagagggaggaaaaataatagggttaccgatcacgcacaaantttatcgtgatttcgaccattcaaaaaata

SEQ ID NO: 10510 - DNA, 101 bp, rice(Oryza sativa)
  misc_feature (71): n=c or g
tcaaatttttttaaaaaacttttatgactatttagatgccatgaacgaaacgagatgttattctcacgagngatgaaatcactttccccagcggtagatag

SEQ ID NO: 10511 - DNA, 101 bp, rice(Oryza sativa)
  misc_feature (71): n=a or t
ttgcaacggctgctcatcagggatgggaagttcatcagatggatgtgaaattagctttcttgaataggganttggaagaagatgcttaggtggttcaacca

SEQ ID NO: 10512 - DNA, 101 bp, rice(Oryza sativa)
  misc_feature (71): n=c or g
atcgagcagttaatacgaactgatctcactgtttgtgttacagcgcgttatgatttatgaactcactgttnttacagcaggtactctggcacagcgagacc

SEQ ID NO: 10513 - DNA, 101 bp, rice(Oryza sativa)
  misc_feature (71): n=a or t
aaaaccaaatcctctccaccatctatctcgaggggtggaaattttccagttgaggccgaggtgggggaaanttctcacccgcaggtgagcggggtcggggg

SEQ ID NO: 10514 - DNA, 101 bp, rice(Oryza sativa)
  misc_feature (71): n=a or t
ctcacctggaatgattaaaaagtgtcaattaatgcgacaattccacggtcatgggaccatctcagaacaantcttcagaagatgtgaggagatggggcctg

SEQ ID NO: 10515 - DNA, 101 bp, rice(Oryza sativa)
  misc_feature (71): n=c or g
ggtccggaatgttagggaggtaatcacaggctcatccacgtccctgaaacgcccgatggtgccctccaccnaagtcacctgttcatccgccgacaacttga

SEQ ID NO: 10516 - DNA, 101 bp, rice(Oryza sativa)
  misc_feature (71): n=a or t
aataggaattgccagtcagttcacatgaaaaacaattttgtggaggtgcttccaggaagccttgctgatgnagagatcattttgctgttgaaacactgcca

SEQ ID NO: 10517 - DNA, 101 bp, rice(Oryza sativa)
  misc_feature (71): n=c or g
ttcttttcccattgcaacacatgggcacctaactagggtatggacattatctcatgtttgtggtcatgatnaaatcgctcataaaacatgtgcatcttaga

SEQ ID NO: 10518 - DNA, 101 bp, rice(Oryza sativa)
  misc_feature (71): n=c or g
gcaccggaactgcgcaaacatcgactgcaaccggctttacctgtatgttcgttcgtcgtctctgctaatgncagcaattttttctttctttctttctttca

SEQ ID NO: 10519 - DNA, 101 bp, rice(Oryza sativa)
  misc_feature (71): n=a or t
aaccttcctcttatgagcggcatgtccattgaaaagattcgcaacttcactcctagtgtcattgccaaaanttcttccataatcaccgtgagtaatatgcc

SEQ ID NO: 10520 - DNA, 101 bp, rice(Oryza sativa)
  misc_feature (71): n=a or t
aagacaggctttatacctatgccactcagtctttagtgcatgttttctatgcttaagctgctttcctccanaataatactcttgctcactgtaggtctcta

SEQ ID NO: 10521 - DNA, 101 bp, rice(Oryza sativa)
  misc_feature (71): n=c or g
gagaaggataaggggaagaaatcccctcaatcaatgtttgaacgagcaacgggatcggccgaatttagagngggaggcggtggtgtggcgtacgggcacga

SEQ ID NO: 10522 - DNA, 101 bp, rice(Oryza sativa)
  misc_feature (71): n=c or g
tgactattctatttgactcaccaaatctttttgtatccacacaggacattattcatgttgttgaatccaanttaaccaagaaccatggtgattactttttg

SEQ ID NO: 10523 - DNA, 101 bp, rice(Oryza sativa)
  misc_feature (71): n=a or t
aaaaaaaaggaagatcgcaagatctagagcaatgtggctaacatataggtgcttgagatggtgatctcaantttttgtcttttgagcttttggttaggagg

SEQ ID NO: 10524 - DNA, 101 bp, rice(Oryza sativa)
  misc_feature (71): n=a or t
cctgattagacccaaaacaatcatgagcacggtagacaacacaagcttagggcgtcttgcacgattaggtnttgttcggtttagaggggattgaagaggat

SEQ ID NO: 10525 - DNA, 101 bp, rice(Oryza sativa)
  misc_feature (71): n=a or t
cagggctttgtcactaggaagctgaagaaggccctccttgtcaccactcagaagctccctattaaaatcgncgcggagagatgagttcaacatttttgtta

SEQ ID NO: 10526 - DNA, 101 bp, rice(Oryza sativa)
  misc_feature (71): n=a or t
ttcgccgtttgcagcgtttctctaaccgttgctcttctacccggtctatttaacccatgaacattccatgncatgatgtcaactataggggtatgacataa

SEQ ID NO: 10527 - DNA, 101 bp, rice(Oryza sativa)
  misc_feature (71): n=c or g
tctgtatcaatccgtaccgtgcatcctcaaatcatgtaaatctccaccgtactatttcaccacgtcaccangcgaatacacagcctctccacgtgtgcgat

SEQ ID NO: 10528 - DNA, 101 bp, rice(Oryza sativa)
  misc_feature (71): n=c or g
gattcatacggccacgtcactttcgccccccttctccgcattctgttttctactattcgctagtatactgntactagttcttcttcttcttcttctgtctg

SEQ ID NO: 10529 - DNA, 101 bp, rice(Oryza sativa)
  misc_feature (71): n=c or g
cactccgttggattgtggtaacacaacaagttcaacggacgtgttccaagccatagctcgcgttcaattgncctccaacaccccacaaagtgtagacaatg

SEQ ID NO: 10530 - DNA, 101 bp, rice(Oryza sativa)
  misc_feature (71): n=a or t
tacaaaatgttgtaccaaaaaaaaccagagtccatttacaaataaaatgaatcgctgaaaacatgagcaantttaccaaactttagctaagaatcataata

SEQ ID NO: 10531 - DNA, 101 bp, rice(Oryza sativa)
  misc_feature (71): n=a or t
ttgatatggcatataaacatattatattataggtttccggttctgcatttgaagcagacgacataacagtnggaccactagacctatgagttaggagagtt

SEQ ID NO: 10532 - DNA, 101 bp, rice(Oryza sativa)
  misc_feature (71): n=c or g
gctactcccctaccgccactggacgcgcatggatcccctttctagagctcgatgagtggccaaaagagaanagctgagctagaagaaagggtattttggtc

SEQ ID NO: 10533 - DNA, 101 bp, rice(Oryza sativa)
  misc_feature (71): n=a or t
acatttgagtttatgactaagagttgactgataggttttgaatgagcgctctcgttgattttttttttttnaaaaaaaacttctagtaattgacaagcata

SEQ ID NO: 10534 - DNA, 101 bp, rice(Oryza sativa)
  misc_feature (71): n=c or g
gagacctctaaaatgaaatcaacatttaaacattttgagcttcagaaatttctgtgacaattctgcgttcnaaacaggctctcaatgttgccatagaagaa

SEQ ID NO: 10535 - DNA, 101 bp, rice(Oryza sativa)
  misc_feature (71): n=c or g
tcaaaataaagttaccaaaacaaagttacacttgcgcactcgcactgcataccaacccaacggagagaganggagagagatctagagagagagggagagag

SEQ ID NO: 10536 - DNA, 101 bp, rice(Oryza sativa)
  misc_feature (71): n=a or t
atgtgcttatagagcatacggttgagtgcgagttgttgtgagtgactatgtttgtaccgtgtttttttttnaaaaaaaaagttagacatgatagatagacc

SEQ ID NO: 10537 - DNA, 101 bp, rice(Oryza sativa)
  misc_feature (71): n=c or g
aaagcattgtgccttttgtcgtttcacagagacagccaatacagtagataagataactggcattactctgnattacctggatttctcttcttctttgaatg

SEQ ID NO: 10538 - DNA, 101 bp, rice(Oryza sativa)
  misc_feature (71): n=a or t
aacggcaaagtttgccgtatcagcccaaaggccgacgatgcctggttagaaattcatgatgagtgtttggntgactttcataagtgtgataagatttcttt

SEQ ID NO: 10539 - DNA, 101 bp, rice(Oryza sativa)
  misc_feature (71): n=c or g
aggtgagcaagctaagggaggccatggcgaggtaaccggcactgtcaatggggttcggagtttgaaacacngaaacggactcgcggacgccacagtctacg

SEQ ID NO: 10540 - DNA, 101 bp, rice(Oryza sativa)
  misc_feature (71): n=a or t
tgacatttttgcaaaatcagttgtacttgcagtcaggaaacggtacgtacagggtataaagtgtagcagangccttcaactgccaggaaacaaaagttagt

SEQ ID NO: 10541 - DNA, 101 bp, rice(Oryza sativa)
  misc_feature (71): n=c or g
caatgcatggctgaggctgacatcggtgacaaccatggcttgaagctcgccggagcttgaggcgggcctancggcgaagaagagcatgccggagtcggcgg

SEQ ID NO: 10542 - DNA, 101 bp, rice(Oryza sativa)
  misc_feature (71): n=a or t
ccatgttagagccatgcgagggatataaagtacgcaaaagttgcaaatgaagatttatctagctatgtatnggtgcgataaaatgacaatcaagacttgaa

SEQ ID NO: 10543 - DNA, 101 bp, rice(Oryza sativa)
  misc_feature (71): n=a or t
tatagctcaagtatatgcgtattcgttctgcttgtcatttacaatttaaaaagacataattcctagagttntttataacattgatttagcatatatgatac

SEQ ID NO: 10544 - DNA, 101 bp, rice(Oryza sativa)
  misc_feature (71): n=a or t
taacataagtgttaggaaaagctttaatagtaagagtgagcgaggtacaactcattcgaatttgtcagaanttgaggtatataacattgttattggtattt

SEQ ID NO: 10545 - DNA, 101 bp, rice(Oryza sativa)
  misc_feature (71): n=a or t
cagacggccaaaagagattttcgtgtgtgggcctccagcccatctgctcggaagtgtatgtgaaaatcatnttttttttatacgggtggcacaattttcgt

SEQ ID NO: 10546 - DNA, 101 bp, rice(Oryza sativa)
  misc_feature (71): n=a or t
caggaagggaggacgaagggagtatgctttacaaaatgttgagatgagtatgtactagcactatttttttnaaaaaaaattgagaatatatgttttaataa

SEQ ID NO: 10547 - DNA, 101 bp, rice(Oryza sativa)
  misc_feature (71): n=a or t
aatttcacggaggaactagtccattggagcttaaggtcactttgactcaaatcgtttctttcaatgcagtngatcttctacaggttaggtgattccaagag

SEQ ID NO: 10548 - DNA, 101 bp, rice(Oryza sativa)
  misc_feature (71): n=c or g
tctgaaagtgaatgtgggggtaggaacgccataaaaacgaccgagagttatgatccctgtgcgcgtatganagaacgcgtcttcagtaatggcgaaacccg

SEQ ID NO: 10549 - DNA, 101 bp, rice(Oryza sativa)
  misc_feature (71): n=c or g
atgtacctattaattattattatatagtatgataagagtcgtttcgcactggaggctgagaagtcaggacnggccctgtcgccagggaacggcgatggcca

SEQ ID NO: 10550 - DNA, 101 bp, rice(Oryza sativa)
  misc_feature (71): n=a or t
cagaagccaaaatgtctcctctgaagtgcaccatgttacagaatttattcctctcgcttcattctttttcnatggttctactccctccatccctaaatgtt

SEQ ID NO: 10551 - DNA, 101 bp, rice(Oryza sativa)
  misc_feature (71): n=c or g
ttcatgatatgcaacgaccacagagcttaatttcccatacgaccacaaacaaatcaaaacatattgccagncagcctatatgtgctagtcccaataaaata

SEQ ID NO: 10552 - DNA, 101 bp, rice(Oryza sativa)
  misc_feature (71): n=a or t
aggcagtcatcagttgcacctgttgtacccagtgagctttctttgatcatggaagaatgtatggaattctnggcaattaatgatatcacccggaggggggg

SEQ ID NO: 10553 - DNA, 101 bp, rice(Oryza sativa)
  misc_feature (71): n=a or t
catccctcatcagattaagtttataagtcgacctttttggttgagttgagtggtgcatacaattgtaactnattaaatatccaaaattaatccaattactc

SEQ ID NO: 10554 - DNA, 101 bp, rice(Oryza sativa)
  misc_feature (71): n=a or t
atcaaaagcgttagtttcaatatagcaaagtacaaatagcctcgaggtacacacgtatacaagaaaaacangtgcaccaacaccgaataaagcaattgaac

SEQ ID NO: 10555 - DNA, 101 bp, rice(Oryza sativa)
  misc_feature (71): n=c or g
cgatcttagacttcggaaaaagtacgcacatcaacgatttgcaatcattttttagtgttatatcaaaaccntcgattactaatatacactgtcaaatcact

SEQ ID NO: 10556 - DNA, 101 bp, rice(Oryza sativa)
  misc_feature (71): n=a or t
ttgtaccagtgatgtacgcctcacgccctttgttaataagacaggctaggtacatctcatcaactgcacanacgggtagacatgtaaatgttttatatact

SEQ ID NO: 10557 - DNA, 101 bp, rice(Oryza sativa)
  misc_feature (71): n=a or t
tagttgacggcgccagcggaggcggcggatgcggcggcggcattgtcgtcgggcttattcttgaagtaatncgctgggggcggcggcgcaggggagtcggg

SEQ ID NO: 10558 - DNA, 101 bp, rice(Oryza sativa)
  misc_feature (71): n=a or t
ttcgctgacagccaaaatgggttttcgctaacaaccagttgtgaaaccagcagcctaaggccagtgaaaanaatacatttgtgatgagagctatcggccgt

SEQ ID NO: 10559 - DNA, 101 bp, rice(Oryza sativa)
  misc_feature (71): n=a or t
cttggtcaggtacactccacgttgaagatcatcatgcaacatgttggtgttggttggatgaacggcgaagncgagcttgacgaccacagcatagcgaagat

SEQ ID NO: 10560 - DNA, 101 bp, rice(Oryza sativa)
  misc_feature (71): n=c or g
tataaagattaatatactgtatacataagcttgggttataaatggacttacatatacttgcggcccaaaancgaaataggccaaccagcatgtgggccgaa

SEQ ID NO: 10561 - DNA, 101 bp, rice(Oryza sativa)
  misc_feature (71): n=c or g
aagttcaacttaaaagacatatgtaaaaactcatgttttcataatcagagggagtatttgtcaaactagcnacacagaagtgcatctgaagcaacttgccc

SEQ ID NO: 10562 - DNA, 101 bp, rice(Oryza sativa)
  misc_feature (71): n=a or t
tttattttttatgaaaatgaatagatttttcgtagaaaatatcttcatcataatataatacaagatgtttntatataaaaaaaatcaagtattgattattt

SEQ ID NO: 10563 - DNA, 101 bp, rice(Oryza sativa)
  misc_feature (71): n=a or t
cgatcagctgttgatgagcggctaatgatttttttttcaaggaactgattgatcacatgtctgaattggcnaggaatacgtcgttatcaaaagttcagaac

SEQ ID NO: 10564 - DNA, 101 bp, rice(Oryza sativa)
  misc_feature (71): n=c or g
tgccatttcggcaacagatgtttgcctcatcgccatcttgttaactggccaattgtttgaattgagcagancatacaatgtctgtgaaataatatggacct

SEQ ID NO: 10565 - DNA, 101 bp, rice(Oryza sativa)
  misc_feature (71): n=c or g
atgattacattggcaaggtaatcagccacctatcttagtacctattaatccatagctggtgttgaaacganacacatttgaactgtcaggctgataggcat

SEQ ID NO: 10566 - DNA, 101 bp, rice(Oryza sativa)
  misc_feature (71): n=c or g
catccatccgcgcctccctgaagtcccatcggcttgctgctcacaaaaaacatgaatattagagaagaaantaatatcaaataattaaaaaggatgaggat

SEQ ID NO: 10567 - DNA, 101 bp, rice(Oryza sativa)
  misc_feature (71): n=c or g
ccttaatttatttcttgcaaactccgatgagctctctgtcacagatgaatttttctttggataaagccttngtaaatatatctgccaactgctcatcagtt

SEQ ID NO: 10568 - DNA, 101 bp, rice(Oryza sativa)
  misc_feature (71): n=a or t
gcgggtctgcttactagcatacagccccatccttcgatacaatgttgcaaccaagcaaaccatctacctgngcctgtgcatcaatacattgcattgatatc

SEQ ID NO: 10569 - DNA, 101 bp, rice(Oryza sativa)
  misc_feature (71): n=c or g
tgtcatttgatctctaataaggttattagtagtcagaaaagttatattcttttagataatagtcagaatanatgcatcatgcatgcatggtttggttgctt

SEQ ID NO: 10570 - DNA, 101 bp, rice(Oryza sativa)
  misc_feature (71): n=c or g
ttcaaggtactcataaaccaacaatggtgtgttgctgtcaatgcaacatccatgcagtttcacaagattcnggtgttgcacagcagaaattgttgcaacct

SEQ ID NO: 10571 - DNA, 101 bp, rice(Oryza sativa)
  misc_feature (71): n=a or t
cttgacacatatgcctccagtgccctgtaagaaacatgcagatgggagttatagaccaaattttttttttnaaaaaatggaaaataaacagagaaacaaat

SEQ ID NO: 10572 - DNA, 101 bp, rice(Oryza sativa)
  misc_feature (71): n=c or g
ggtgccgttcaaaatcaaaatttatcagctgaaaaaatgtaagaaaaactaatacaggctgtggttagttncttctagagttggaagttttggttgaaatt

SEQ ID NO: 10573 - DNA, 101 bp, rice(Oryza sativa)
  misc_feature (71): n=a or t
aaggagtcgagtatacggtggtttgttattttgcaacttcttcttttattacgtcaataatgtttatttgngtatatgatacatgattatattgtatttta

SEQ ID NO: 10574 - DNA, 101 bp, rice(Oryza sativa)
  misc_feature (71): n=c or g
ggggagttgtgaaccgggattaaaacgggtttgtccaccagtggtgctgattctccctatcatcaaggttnactctaaattcttagtcaccaggccatcgg

SEQ ID NO: 10575 - DNA, 101 bp, rice(Oryza sativa)
  misc_feature (71): n=c or g
cagccttatctcttcatcggttcatccggtgcctgttgtctctttcttctctctcacatacagtctctctnctcttgttttttcttcttctctcctcagcg

SEQ ID NO: 10576 - DNA, 101 bp, rice(Oryza sativa)
  misc_feature (71): n=a or t
acgtgtgggtcgtctggtcttcttttcaacgttataatgggtgtattcactttgacattatttttaaccanaccattttctttaaaattgtcaaaaaaaaa

SEQ ID NO: 10577 - DNA, 101 bp, rice(Oryza sativa)
  misc_feature (71): n=a or t
gggaccataatcccgttgggaaccagacattacggtcggttccagatagtctaaccagctagctatttttnaaaaaaaatcaaatgaaaacaatgaacagt

SEQ ID NO: 10578 - DNA, 101 bp, rice(Oryza sativa)
  misc_feature (71): n=a or t
taagggagtcaaagtgaacttattccttttcgattcacaccaccgtactttgtgtaagaaggctgggcctnaattgggttgagatgggctggccacacccc

SEQ ID NO: 10579 - DNA, 101 bp, rice(Oryza sativa)
  misc_feature (71): n=c or g
attctgtggaagaaatggctgctggtgccgtccagcttgatacctgacagaattacagaggaatgtatganacatgagctaactaattactactagttcaa

SEQ ID NO: 10580 - DNA, 101 bp, rice(Oryza sativa)
  misc_feature (71): n=a or t
ggttcgatgtgcgtagagtggagcagtactagtgtaaacttaattagcaaatgtttagttggaaaaaaaanttatcactgcatgactacattagatatacg

SEQ ID NO: 10581 - DNA, 101 bp, rice(Oryza sativa)
  misc_feature (71): n=a or t
catatgtgcctgtgaggtcattttcaatgatggatttgcgccggctgcatagtccaagatcctcatgtcgnctcaaatatcagaaaacgacagactagcgt

SEQ ID NO: 10582 - DNA, 101 bp, rice(Oryza sativa)
  misc_feature (71): n=a or t
tccttattgttatctttcaagattggaaagttcatatggagagctcaccattggatgcaacctcacgaaantggtacattagctctgtttgttttacagtt

SEQ ID NO: 10583 - DNA, 101 bp, rice(Oryza sativa)
  misc_feature (71): n=a or t
ctcttaatggattaataattcaccggcacactttgtaaactctcaaacagtacatgattctttcttttttntaaaaaaaactttaaccttatagatgaatt

SEQ ID NO: 10584 - DNA, 101 bp, rice(Oryza sativa)
  misc_feature (71): n=c or g
tcaattcaaacccctttgtgtttgccttggatctggaaaagtaaagttttcatgaaaatcaaggtatttgnatggctatttttcttagacagagtgaatac

SEQ ID NO: 10585 - DNA, 101 bp, rice(Oryza sativa)
  misc_feature (71): n=c or g
ctaagactaattcattctatttcggccttcatatgcaagactagacattaaataacttaattagccaaggncataccataattagcacatgtagatatacg

SEQ ID NO: 10586 - DNA, 101 bp, rice(Oryza sativa)
  misc_feature (71): n=a or t
cttctccatccttaattaatgttctccttttatggtgctagtatatgccacaaatgctttttttttggggnataattactgttgaatttcttaaagtgcag

SEQ ID NO: 10587 - DNA, 101 bp, rice(Oryza sativa)
  misc_feature (71): n=a or t
caatgcgtacagcgtagtgaggagtgacccggtgagcactcagccactgtgcactgaaccgttcaggtggnttttttttttttgcttgtaagaacacgttc

SEQ ID NO: 10588 - DNA, 101 bp, rice(Oryza sativa)
  misc_feature (71): n=a or t
agaagcgtgaacattaccatggtaccatcagatcaatctttttcagaaattacaattaccagtgataaaantttttatatactttacaaacacatcggaaa

SEQ ID NO: 10589 - DNA, 101 bp, rice(Oryza sativa)
  misc_feature (71): n=a or t
agtggccttttatatggtgttgtgttgttatcgtcaacggtaagcacataaactagtatgtagtttttttnaaaaaaaaaactagtaatccaattgtgtta

SEQ ID NO: 10590 - DNA, 101 bp, rice(Oryza sativa)
  misc_feature (71): n=c or g
tgcttctgtgctttgcagacgtgacacgagtgctgtgcgaactggaactcacaattcgtagagtgaaggtntccaccacacctgatgggagagtgctggat

SEQ ID NO: 10591 - DNA, 101 bp, rice(Oryza sativa)
  misc_feature (71): n=a or t
agattgcaaaaggcacacagtcaagcaaaatcaattctcagagaccattagaacaaaaacaacctgaaatnacaaagaaaagaacatttaagagtagggca

SEQ ID NO: 10592 - DNA, 101 bp, rice(Oryza sativa)
  misc_feature (71): n=c or g
atatagagctctccaaagccaaggatatgtagttggcggtccccaaatgaccccagtaaataagcggattngattcacatatctaagtccatgtttcggaa

SEQ ID NO: 10593 - DNA, 101 bp, rice(Oryza sativa)
  misc_feature (71): n=a or t
cattatgtatttgatgtactccggacgctgccagtatttgagatacttgagatacccgataaatgcctcancctcaaagtacctattctgtgctagatctg

SEQ ID NO: 10594 - DNA, 101 bp, rice(Oryza sativa)
  misc_feature (71): n=a or t
atggcctgttataggattcttctgaggatgattccagcgaagatgatgaggatgagagtgacgaggaaganactcccaagaaggtatgtgtatgtgtttga

SEQ ID NO: 10595 - DNA, 101 bp, rice(Oryza sativa)
  misc_feature (71): n=a or t
cctctccttttccaaagctccaattggtgatagattagtagtagttgatgcatagttaatttaatcgtaantgacttaattgagcactgaactacctcaac

SEQ ID NO: 10596 - DNA, 101 bp, rice(Oryza sativa)
  misc_feature (71): n=a or t
ctcatgctgcaaagcagcatctgctgataaccgctgtaaagccaaaacaggtgtgctcagattgaagtatntaaatatgaatgcatgatataaatcatgaa

SEQ ID NO: 10597 - DNA, 101 bp, rice(Oryza sativa)
  misc_feature (71): n=a or t
cattttactctcaaataaatgctaagggatctaattttgcccaaatatcaataacctggaggctggagtanctcctgacacctcccaaaaaaaaaacaacc

SEQ ID NO: 10598 - DNA, 101 bp, rice(Oryza sativa)
  misc_feature (71): n=c or g
tttgtagattgcaacttagaaatggtgtaagaggtaaccatgagaacatatgtgaatcaggaagaaattgncccccaccgaaagctagtcgaacagagaaa

SEQ ID NO: 10599 - DNA, 101 bp, rice(Oryza sativa)
  misc_feature (71): n=a or t
cagttactctgtctatttccacgcagttattttgatcacaaccagcaaggctataaatgattgacatgccnagtgcagggaggagatcattgtctgtcaat

SEQ ID NO: 10600 - DNA, 101 bp, rice(Oryza sativa)
  misc_feature (71): n=a or t
agaaacagaacagtctgcatactttggcctgttggctgagtactgctggctcactaaagatacacaaatgngtcaatgtgacgtttctatggcatatgaat

SEQ ID NO: 10601 - DNA, 101 bp, rice(Oryza sativa)
  misc_feature (71): n=c or g
gtactccctccctctttaaaactcctcctttcgtcttcctcccgttccggccttgtgcagagaatctcaantgagatatgttcagcatatgtttgctccaa

SEQ ID NO: 10602 - DNA, 101 bp, rice(Oryza sativa)
  misc_feature (71): n=a or t
gcatcgccggcgagcggttcaggaggcggagcgagtggtcgaattgggaattgaggtttcgtgtttttttnaaataaaaaattgatgggaaggttttgggg

SEQ ID NO: 10603 - DNA, 101 bp, rice(Oryza sativa)
  misc_feature (71): n=a or t
tgattgtagcagctgtgctgctgcagccatcaataccgatcaacgtcattatagttatatttgaaaaaaanttaaaactttcgatattttttttagcaatt

SEQ ID NO: 10604 - DNA, 101 bp, rice(Oryza sativa)
  misc_feature (71): n=a or t
tgttcaagatgtatgatagaaatgggacgctactttcggatgtgagacatgtgtgccagcaataaggagtngtctaattttgcttaaaagcctacatgaga

SEQ ID NO: 10605 - DNA, 101 bp, rice(Oryza sativa)
  misc_feature (71): n=c or g
catgtattgctcttgctgacaagtacaagacttcaagttttgccatggtctgttgcagtaaactgaatcantatcacaaaacaataattgtgcacttactg

SEQ ID NO: 10606 - DNA, 101 bp, rice(Oryza sativa)
  misc_feature (71): n=a or t
tatatctaataagctcagttctttctatcttggaagaaaatatttagaccagggcctatctattgcagggnattatagaggaattcaaggtgcctagagat

SEQ ID NO: 10607 - DNA, 101 bp, rice(Oryza sativa)
  misc_feature (71): n=a or t
gcatgtgttcctgggagcatatcaacatgctcttcttttgtaacaatgaataccttcttcttcttcttttncatgtcttctttctccaacagctaataata

SEQ ID NO: 10608 - DNA, 101 bp, rice(Oryza sativa)
  misc_feature (71): n=a or t
ggacggccattcaccatacttgacaaattgacatgaaagcaaaagtttggttagaagtcatttatttctcngcaagtagttgtaaattacatggtagtgtg

SEQ ID NO: 10609 - DNA, 101 bp, rice(Oryza sativa)
  misc_feature (71): n=c or g
cggaagagtctgggttattggagaaaaatccaacggaaaaaaaacgcaagaaaaatctccaactcattgtnccgccgccttgcgtcgaaccctcgatccac

SEQ ID NO: 10610 - DNA, 101 bp, rice(Oryza sativa)
  misc_feature (71): n=a or t
acaaagaaagaagacaaccttattttcttatatcatcatacctactcagccttgttttcttatatcatcanacctacttagctaaaaaatgattgtgtttt

SEQ ID NO: 10611 - DNA, 101 bp, rice(Oryza sativa)
  misc_feature (71): n=a or t
aattatcaataagttattattaaattactccgattccattatgttccgccatttttcgcgtaaagataaanaaaaaatggcgtcaactacaagtcaattag

SEQ ID NO: 10612 - DNA, 101 bp, rice(Oryza sativa)
  misc_feature (71): n=a or t
tcatgtgtaacagatatcctctccgacccaaagtagtggtaattgtcagttccattgttttattttttttnaaaaaaaagtgttattcgttgtgtcaaaag

SEQ ID NO: 10613 - DNA, 101 bp, rice(Oryza sativa)
  misc_feature (71): n=a or t
taaaattattttaaaaatagataattttgtatagatgctagccacacaattgtgtgggtcacgcatctagnttttttaaaaaatgcattatttagtagttt

SEQ ID NO: 10614 - DNA, 101 bp, rice(Oryza sativa)
  misc_feature (71): n=c or g
ccaaataggtaaaaatgtcgttcgataaattaccaattatttattatccttcaattatagcacatttatangatatttatcagtaaattacataagattta

SEQ ID NO: 10615 - DNA, 101 bp, rice(Oryza sativa)
  misc_feature (71): n=c or g
acgcatatatatattgatttagtacatattggatgatcagtaagtcaagttttgtgctcaaccacaccaantacatttctctactatgcgcttcgtggcat

SEQ ID NO: 10616 - DNA, 101 bp, rice(Oryza sativa)
  misc_feature (71): n=c or g
tagaacacttgcattggctaaaacagatcaggattctattgaaagacagagggtatgtctagattgtagtnaaaataaaccttaccaaattttaaaaatat

SEQ ID NO: 10617 - DNA, 101 bp, rice(Oryza sativa)
  misc_feature (71): n=a or t
gcagtacactctactcgtgatccactctcggtaaaaatgctactagtaccaatcgagaccgaatttcccanaagaaaaagaaaaagaaaattgaacctcga

SEQ ID NO: 10618 - DNA, 101 bp, rice(Oryza sativa)
  misc_feature (71): n=a or t
gccggtgcgaacatgtaagccacgaaatttgcaatctcaccaatgagcactacgaaattcggaaaaaaaantatcaagaatttcgaataattttgcactag

SEQ ID NO: 10619 - DNA, 101 bp, rice(Oryza sativa)
  misc_feature (71): n=a or t
gtacccagagatattcctctcctcacaacacgggtagaaatgcaaaaagtcgatctataatgatttttttnaaaaaataaatctatagtgatattcatttg

SEQ ID NO: 10620 - DNA, 101 bp, rice(Oryza sativa)
  misc_feature (71): n=c or g
cgcttctcacctccgcagccatcctcctagtcctctccatcgtgaagccgcctgtggacaagagtggctgnggcggctggtctgccactttctctaacgac

SEQ ID NO: 10621 - DNA, 101 bp, rice(Oryza sativa)
  misc_feature (71): n=c or g
accattattgcacgaccgtactaaatgctagatttgagacaactttcactgttgatcaggtccaccgccantttaggcgcttcaaggaggtttggaatatt

SEQ ID NO: 10622 - DNA, 101 bp, rice(Oryza sativa)
  misc_feature (71): n=c or g
agttatgttaatgagttgctccgttttgcgtgcgagaaaaattagtttccaacggcaaggaaggaacgaantgttaaattgacgagtagaagatgtttctc

SEQ ID NO: 10623 - DNA, 101 bp, rice(Oryza sativa)
  misc_feature (71): n=c or g
agcagagagcaccaaaatatgcatcttaagaaaagagcaccaacatatgtcattataaggtacgttcaggnaaaaaaccatgccctagagagataattgaa

SEQ ID NO: 10624 - DNA, 101 bp, rice(Oryza sativa)
  misc_feature (71): n=a or t
aaaccaaacagcgttaaacatcattagcaattacaagcaaattacattggacgtggattttcatccctcgntgtttgtatgtcatctaaatagttattaat

SEQ ID NO: 10625 - DNA, 101 bp, rice(Oryza sativa)
  misc_feature (71): n=c or g
tcaagcaccatgttctcccttgtctaaatttggccaagtttctgtgtcttttgacgtggaccgcattcaangccggtgcttggttgatgactccaatacgt

SEQ ID NO: 10626 - DNA, 101 bp, rice(Oryza sativa)
  misc_feature (71): n=a or t
ggagtttggtcaagtccttggtctcccctgacttgatttgagtcttctgcagtcagcctagggcgttcctntggctgtgattagttgggcaaaaggaaatt

SEQ ID NO: 10627 - DNA, 101 bp, rice(Oryza sativa)
  misc_feature (71): n=c or g
tacacaaaccctttccttcatctaaatcgaatatctgaccagtcatgaaaaataataacatgttcttggcnatcttctcatggcattaaatactaaccttt

SEQ ID NO: 10628 - DNA, 101 bp, rice(Oryza sativa)
  misc_feature (71): n=c or g
cttggataatgaggacatgtaactggattgaagtaaaaacaaggacagttcggccttgttttcatttagantgaaaatcttgagctttggtgcttcgggta

SEQ ID NO: 10629 - DNA, 101 bp, rice(Oryza sativa)
  misc_feature (71): n=a or t
cctaaccagcaacaacatatataatcaatcctctcgtggccatatcatattacagtaattccattatctantttgcttggatctaataaaaagtaactcga

SEQ ID NO: 10630 - DNA, 101 bp, rice(Oryza sativa)
  misc_feature (71): n=a or t
tccattttttcgtctgatatgcaccagtcgactgtctcagtgtcctctattcgatttttctgtctcattgntcgatttctccctacactgaagctgctctt

SEQ ID NO: 10631 - DNA, 101 bp, rice(Oryza sativa)
  misc_feature (71): n=c or g
atgccatctcttcagtttggtatctatatgcctatacatctcgatggaaaataattgcgatgttgcttatnaattattgtactatgttttttccattctat

SEQ ID NO: 10632 - DNA, 101 bp, rice(Oryza sativa)
  misc_feature (71): n=c or g
ctgttgcctcttcatgtccatcggtattgccctgcacgcgaactatgagcatgccaaccgtttgcacacanacagagagagagagagagagagagcgctta

SEQ ID NO: 10633 - DNA, 101 bp, rice(Oryza sativa)
  misc_feature (71): n=c or g
ggtggagtgtatcttcacgacaagtttggtataagttgctgttcagtgtcaggttggcatccctatcaccncgctgacaagcttcgtttccaatttggtcg

SEQ ID NO: 10634 - DNA, 101 bp, rice(Oryza sativa)
  misc_feature (71): n=a or t
tgccaagtttagttagtaacatgtactgctgtgcatctctgaataaatgttaaggaggcttcatgtaaganttttttgatgatgatgatatacgatattag

SEQ ID NO: 10635 - DNA, 101 bp, rice(Oryza sativa)
  misc_feature (71): n=a or t
gtctagccaatccgatggacaatgcgcagctccctgtcgactgcattctttgctgctgtatgactatattngggactttgtttcctttcttcatataacct

SEQ ID NO: 10636 - DNA, 101 bp, rice(Oryza sativa)
  misc_feature (71): n=a or t
aacttctcggtagggttttgtgcgctatttttggtcggtttgcgtgtgatttaccagttagtgtcgcgcanaatccgcgagggatttggtgagctaggatt

SEQ ID NO: 10637 - DNA, 101 bp, rice(Oryza sativa)
  misc_feature (71): n=c or g
agccccgggatgatgacctcgatggtgacggtgaccccgactgctagtggtggcagcgatgggagcggctnccgcgcaccttggctcctcctccaccacca

SEQ ID NO: 10638 - DNA, 101 bp, rice(Oryza sativa)
  misc_feature (71): n=a or t
tctcgtacaagcagacaggggcaaccaatttaattacactatctgattgttacatctgttctttttttttnaaaaaaaaagtcttgctactatcatgtaat

SEQ ID NO: 10639 - DNA, 101 bp, rice(Oryza sativa)
  misc_feature (71): n=c or g
cgtggatgagtgatgaaggccccgaggctgtcatcacgggtgcgtcatctataccacatactacaccacantaccagcagtaacagtaatcttcttctcct

SEQ ID NO: 10640 - DNA, 101 bp, rice(Oryza sativa)
  misc_feature (71): n=a or t
ctctgggagacctactgctgcgccatggcctaccccaactacagcctcgctgacatctcctaccacgtcgncaagctggtagatagacacatctcgccatg

SEQ ID NO: 10641 - DNA, 101 bp, rice(Oryza sativa)
  misc_feature (71): n=a or t
gagctgcgcctgaagtcgaaaaccactcaaaacgtcaatggtgacactgatattcctcgaatcaatctgcncccctcgtcccagtaggatcctggaagcat

SEQ ID NO: 10642 - DNA, 101 bp, rice(Oryza sativa)
  misc_feature (71): n=a or t
cagattctacagtgagttggcctcttctattatcattctcaagggctcaagtctgtcttcacagttacttntcttgttcctaatgtattttttgttagagt

SEQ ID NO: 10643 - DNA, 101 bp, rice(Oryza sativa)
  misc_feature (71): n=c or g
tcgtcattaatggcttgtttaattatcaacgtggtagttcaactccgtagtttgtctttaattaatgaatnagaataggggaacccggcccggggagagaa

SEQ ID NO: 10644 - DNA, 101 bp, rice(Oryza sativa)
  misc_feature (71): n=c or g
cgctcattttctcctaatcctctttcttgccccgtaagaacaacatgctctgctgcttccttttttatcgnagctgctgatctcattctgtcagagtttag

SEQ ID NO: 10645 - DNA, 101 bp, rice(Oryza sativa)
  misc_feature (71): n=a or t
tctgaagcaaggttttcattttcagttttgctcaaaaattcggccatgtcggtagcatcgaaattcccaantttttgggattttgaagacttattggatca

SEQ ID NO: 10646 - DNA, 101 bp, rice(Oryza sativa)
  misc_feature (71): n=a or t
actatttaatttaaatattactgattgtccgatgatttttttgggaagtccagtgaaagcatttttttttnaaaaaaaaactcagctttagtttatttgtt

SEQ ID NO: 10647 - DNA, 101 bp, rice(Oryza sativa)
  misc_feature (71): n=c or g
agtatatcttatagatggggcgccgcgagtacagtgaacaatatcatcatcgggcaggggcaggggcaggngcaggcgctgccattgtggtggtggtggtc

SEQ ID NO: 10648 - DNA, 101 bp, rice(Oryza sativa)
  misc_feature (71): n=c or g
gctgtccttgaggttgccgcagttcgctgccgctcgtcatcgccaccgcagtccacgattgttgtcgtcancaccaccatagccccgcagctcccatttct

SEQ ID NO: 10649 - DNA, 101 bp, rice(Oryza sativa)
  misc_feature (71): n=a or t
tggcaaggaaattgcatggcgtctcattgtagcaattcaatgtaacccgtcgctgtttacctctgccgacntagcagttgctgtggtagaggaaaattttt

SEQ ID NO: 10650 - DNA, 101 bp, rice(Oryza sativa)
  misc_feature (71): n=c or g
atctctcctaatgcttcttctaatttccaatgtactacctactccctccgttccccccaaaaaaaataaancctagatttccgtgtccaatgtttgattgt

SEQ ID NO: 10651 - DNA, 101 bp, rice(Oryza sativa)
  misc_feature (71): n=c or g
attgtctatatattctatttaaatagagattgagacagggtcaaaatcccaagtcttacatagagtaagcnttgtttatcaatgcaaaatgaccttcggat

SEQ ID NO: 10652 - DNA, 101 bp, rice(Oryza sativa)
  misc_feature (71): n=a or t
tgcattttcttctttgcctttcaatcctttaatgatgccaccaagaattcctcctgctggagtctacagangaattttcattgtcatgccaaattgtacac

SEQ ID NO: 10653 - DNA, 101 bp, rice(Oryza sativa)
  misc_feature (71): n=a or t
cactcaagcgtgcatgcatgagatacatgcatgaagccgaccggcctcctactgttttacatatttttttnaaaaaattcatgcataaagtctactctacc

SEQ ID NO: 10654 - DNA, 101 bp, rice(Oryza sativa)
  misc_feature (71): n=c or g
caaaactatatcagggagaaaacaaacttgagctgatcagctcttaggctgttacgatatgattctcgggnagaacattcctcccagcttactcgcgagaa

SEQ ID NO: 10655 - DNA, 101 bp, rice(Oryza sativa)
  misc_feature (71): n=c or g
tttaaactactgaggccccatgtcaataatgaaatcaaacctcattagctggatggaacctctgtttcatnaagcagagagagagagagagagagtaattc

SEQ ID NO: 10656 - DNA, 101 bp, rice(Oryza sativa)
  misc_feature (71): n=c or g
caacattaagcacactaagcagtatgccaagagggcatgatacaacatagataagtacagtgatcagtganagtgagaggctgaagatggatattccaact

SEQ ID NO: 10657 - DNA, 101 bp, rice(Oryza sativa)
  misc_feature (71): n=a or t
tacagttttattcgattctggtgctacgcattcatttatatccaagagatttgtttgggtacacgggttangaaaagtgtaacttagtactcccatgaaag

SEQ ID NO: 10658 - DNA, 101 bp, rice(Oryza sativa)
  misc_feature (71): n=a or t
ctgacattttttaaacttattatgctttcagaaaggagattaggtaggtcacatcaagggaattatctctngtcatgaaaatgggaattaaaatgaacgta

SEQ ID NO: 10659 - DNA, 101 bp, rice(Oryza sativa)
  misc_feature (71): n=a or t
tgtactgtgtactttaactatggtaacatatttatgcacatgttttctattcgacggcactatcacctacnatagatcttgattgtgattgcgagcatgag

SEQ ID NO: 10660 - DNA, 101 bp, rice(Oryza sativa)
  misc_feature (71): n=a or t
cattgtcatcgccaaaatgatgagaggcaaaaaggagtacagatttaggtgagagcataatatattttttnaaaaaaaggaagtatgaagtagaaaattat

SEQ ID NO: 10661 - DNA, 101 bp, rice(Oryza sativa)
  misc_feature (71): n=c or g
actctcgcaatgctattaacatgcttactacctttttttcaggtgtccttagtgacatgataataggagcntctcaaggaggagctgatagaatgattgat

SEQ ID NO: 10662 - DNA, 101 bp, rice(Oryza sativa)
  misc_feature (71): n=a or t
gcagtgaatgatcacttcagggatcatacatgtatccacagaatgcatacagtgtgaatctcagaaagttngtctcaaacacgctactgacaagtgataac

SEQ ID NO: 10663 - DNA, 101 bp, rice(Oryza sativa)
  misc_feature (71): n=a or t
ggggcctgagagatgacgtgaggcaggtcatagttgatgcccctaatatgcttataccgctaggtgatcanccccagggtggatccgtcgcctccaccggc

SEQ ID NO: 10664 - DNA, 101 bp, rice(Oryza sativa)
  misc_feature (71): n=a or t
ttctttttagcactacgtcaatacaggttaaccaagttaacatgccacgtcagaaaaaaaaaacgttgacnataatatcatgtaaggaccatataggacaa

SEQ ID NO: 10665 - DNA, 101 bp, rice(Oryza sativa)
  misc_feature (71): n=a or t
ctaagtattcaactccatatactggttcagtttgtcaagaacgcaattcatcctatgaggcatgcattcancttcccagttgcctcacttttctttggaga

SEQ ID NO: 10666 - DNA, 101 bp, rice(Oryza sativa)
  misc_feature (71): n=c or g
ctggagtactcggctactcctagtacgttggattggattcggcatgggcacgggccatagctgcatagtgntgcctgtgctcatgacggcgtggtgtactg

SEQ ID NO: 10667 - DNA, 101 bp, rice(Oryza sativa)
  misc_feature (71): n=a or t
gtacttctcctagaagtactaaagtacaaaacgctttccatctcgtcatcaaatcttttctctctctcacncacacacacatgactttgggacttgggaca

SEQ ID NO: 10668 - DNA, 101 bp, rice(Oryza sativa)
  misc_feature (71): n=a or t
tggattgatcattaacatgcttaattaattatacatgtactaattgaacacataacagaagttcacacatnaacaaagaaaatcgatcacattatgtctaa

SEQ ID NO: 10669 - DNA, 101 bp, rice(Oryza sativa)
  misc_feature (71): n=c or g
tagccaatgtttcaagcgaggttagcttctgcagggtagctaatggcacagacgagcataccttgatggtnacacgaactaaccattccatgtcatggaat

SEQ ID NO: 10670 - DNA, 101 bp, rice(Oryza sativa)
  misc_feature (71): n=c or g
gttatagtagttacattaaattgcactactattattatattacaatatgctttttaaaaaataacttgagncattatcttacggaattgctaaaaatatgt

SEQ ID NO: 10671 - DNA, 101 bp, rice(Oryza sativa)
  misc_feature (71): n=a or t
tagcttacaaaggaggaagggagggtaatataccattaaacttcgtttttattcattgcaatgcaagtgcngtattttgctagtaccattaatcttgagta

SEQ ID NO: 10672 - DNA, 101 bp, rice(Oryza sativa)
  misc_feature (71): n=c or g
aattttgtatgatggtggttctctagtttctgatcaaaatacaaaagagggatatgtacatgtactacctnaaaggactgtaaatgcatcaaaagaggatg

SEQ ID NO: 10673 - DNA, 101 bp, rice(Oryza sativa)
  misc_feature (71): n=a or t
ttaacttgcattattggacagataatcttagaaaggaatatactgaggaaggagcctagctgttcataagntacatcggaaacaaagtagatatatgtaat

SEQ ID NO: 10674 - DNA, 101 bp, rice(Oryza sativa)
  misc_feature (71): n=c or g
ccatcaaaggtggcgatggcgcaggaggtgggcggggttttggtgtgagtattagccatggaggtcacganatatcaattggtataggcggtggctttgga

SEQ ID NO: 10675 - DNA, 101 bp, rice(Oryza sativa)
  misc_feature (71): n=a or t
catgtactcatgtaggttaaaaaccctagcgtgtgataaagattgcatcacattacttatggaggtgctanaagcaatagaactataagtaacaaactacc

SEQ ID NO: 10676 - DNA, 101 bp, rice(Oryza sativa)
  misc_feature (71): n=c or g
gatattcaatcacaggcatcaaaatttctggaatatatctttggcaatttcgataaactggttctcttctnttgtgcccctgcaaacaagaaaaatttaga

SEQ ID NO: 10677 - DNA, 101 bp, rice(Oryza sativa)
  misc_feature (71): n=c or g
caaatggctcagatgcatttcttcctcttccttaatttgggctatattgggcataataccctataatcttngacagagggagtatatactaaaaatacatt

SEQ ID NO: 10678 - DNA, 101 bp, rice(Oryza sativa)
  misc_feature (71): n=c or g
tgtacaactgactaaactctgatcgatcgctatggtagaaattgtcccccaaaaaatgttcagaaacagancagagactcttcctactatagctgctcaga

SEQ ID NO: 10679 - DNA, 101 bp, rice(Oryza sativa)
  misc_feature (71): n=c or g
cgacattctttcttgatggccgtgagcaggttatattctatccggtgttatcccaggtgatgagcatcccntttgatttttttctttgtttacattggtta

SEQ ID NO: 10680 - DNA, 101 bp, rice(Oryza sativa)
  misc_feature (71): n=c or g
ccctttcctcgtgaaagaatcctatcacacctgaacaggcaacagatatgatttctaagcatgaacttganttaatcttttaaggttaattatgcaaaaaa

SEQ ID NO: 10681 - DNA, 101 bp, rice(Oryza sativa)
  misc_feature (71): n=a or t
caacggtgtgcagccatctaagacaagaaagagcatccaaaggatttctatcgtacatcactctttttttnaaaaaaaaaaggtagaaaaggctgaagttc

SEQ ID NO: 10682 - DNA, 101 bp, rice(Oryza sativa)
  misc_feature (71): n=a or t
gtcgaacaatgcggcagataaatatcagagactctagtggacgagtttcatcactagaaacctaaccaatngagacctaaccaattgaactatgtgtattt

SEQ ID NO: 10683 - DNA, 101 bp, rice(Oryza sativa)
  misc_feature (71): n=c or g
ttcatcaccagcgtggagggagagccgtctctactcacaaagctctgtgcccctcatccgtggcaagctcntctgcactgcccggggcctggctggtctcc

SEQ ID NO: 10684 - DNA, 101 bp, rice(Oryza sativa)
  misc_feature (71): n=c or g
atacttagggctcaatccattgatgagggtgagaacaagcgtgcagtcgctctgtggttcgcccgagatcngtgaggttgtccaccatggttcagagccgg

SEQ ID NO: 10685 - DNA, 101 bp, rice(Oryza sativa)
  misc_feature (71): n=a or t
cagaaagttggttcgtttgtgtcatataacgtatctatcgaagttaatatgtgctaattatatctagatcntagtgtattacagataagcaatttaatcat

SEQ ID NO: 10686 - DNA, 101 bp, rice(Oryza sativa)
  misc_feature (71): n=a or t
tttccacagggaatgtgtacgtttagctcttctttaggttcatctaaggacaaaagataaatgtacgcaangtggtatagagttgtttagaaagcttaact

SEQ ID NO: 10687 - DNA, 101 bp, rice(Oryza sativa)
  misc_feature (71): n=a or t
aaaagaacatttcaatgaatatggatgtcatgtgatccacagcttcttccgttcagtttgctaacaacatncgtactataagaggagcttaattattcgag

SEQ ID NO: 10688 - DNA, 101 bp, rice(Oryza sativa)
  misc_feature (71): n=c or g
ctgcagcggtagcggcagcggtagtgccctaggtggccatgagctcgttgtgcaacaagtgaaggaggttnggttgtgttgacgcgaaaaacacacactgg

SEQ ID NO: 10689 - DNA, 101 bp, rice(Oryza sativa)
  misc_feature (71): n=c or g
attgggggaggatgtctctatacacaccatcaacaagttcttgtcaacgagcatgcccaggaggccaggancaggtgctagctgtgtcgctgctgcacgag

SEQ ID NO: 10690 - DNA, 101 bp, rice(Oryza sativa)
  misc_feature (71): n=c or g
acgatgagttctgctgttctcacgtcgtttcaattagccatcaaacatgtacacatgttccgtactcttgncaaacggtcggcactcggcaactggactag

SEQ ID NO: 10691 - DNA, 101 bp, rice(Oryza sativa)
  misc_feature (71): n=a or t
gaggaggaggcagcggccgggaggtgcggcggcagcgccgattctagggtttttatttttttgaaattttnttttttttggatttttgtttttccgtgtag

SEQ ID NO: 10692 - DNA, 101 bp, rice(Oryza sativa)
  misc_feature (71): n=a or t
agagggtaacagcttatactagatccatgtaatgagggatcctaaaaattttactaagtcaaaacatccanccaagtttcatgttctttgatgagacgcaa

SEQ ID NO: 10693 - DNA, 101 bp, rice(Oryza sativa)
  misc_feature (71): n=c or g
ttatctctcatgcctctctctccactctgtgcaatgtatgcatttaacaagctttcaaataatttttcttntaaattatttatccaatatatgattcaatc

SEQ ID NO: 10694 - DNA, 101 bp, rice(Oryza sativa)
  misc_feature (71): n=c or g
ctgcaaaaagcagactggccatcaaggcaacaagtagaatactagctgctacctgtcacatcatagggggngagtctaaccaccatgggtggcctggtatg

SEQ ID NO: 10695 - DNA, 101 bp, rice(Oryza sativa)
  misc_feature (71): n=a or t
actgatgaaaagcattgctgagaagaattgcgcctggtcggatgctctgcacataaaaagggaaaaaaaanagaagaaatctatgtctgcagcctatgcaa

SEQ ID NO: 10696 - DNA, 101 bp, rice(Oryza sativa)
  misc_feature (71): n=a or t
gctcctgctcaatggccattttagtggattccgagtagaaatccggacctatctttttctaaaaaaaaaanaggggaaaaggagaagcacaattcagattt

SEQ ID NO: 10697 - DNA, 101 bp, rice(Oryza sativa)
  misc_feature (71): n=c or g
tcccttcaaaagtattacttgaaatctaatgataacaacttatatgggtcatgttatatttcagagcaatntagaaagaaaaagcaaaccaacatctacta

SEQ ID NO: 10698 - DNA, 101 bp, rice(Oryza sativa)
  misc_feature (71): n=c or g
atatagaatttttatccacaatataatatggcgttgaaccatacacagttgagaagtatacatgaaaagantatgcagatatcagtagattaatgtctaca

SEQ ID NO: 10699 - DNA, 101 bp, rice(Oryza sativa)
  misc_feature (71): n=a or t
tatcaatatataattaaataatttgtaggtgtagtgtccaaatattttttttatgggctcgccactcaaanggaaggaatggtatatatccaattgatgtc

SEQ ID NO: 10700 - DNA, 101 bp, rice(Oryza sativa)
  misc_feature (71): n=a or t
ccaccatgacaaagtccgactcctttcctctactctcggtttcagtccgcaccgtgagttgctagacatcntggtgaaaacttttggagtgtcagattgga

SEQ ID NO: 10701 - DNA, 101 bp, rice(Oryza sativa)
  misc_feature (71): n=c or g
caccatcctgtaccgcctcctgctctggcgtccctggtgaaggtggaggcgaatcatcacttccttccacnaaattccatgtaaagatagctccgtccttg

SEQ ID NO: 10702 - DNA, 101 bp, rice(Oryza sativa)
  misc_feature (71): n=a or t
actggtgcagtttgagtggccaatcattttgttgtgtgatttcgtttcaatgagatattgtgtgatcttgntttgcttttgttttgaaaaaaacttgttgt

SEQ ID NO: 10703 - DNA, 101 bp, rice(Oryza sativa)
  misc_feature (71): n=a or t
caagtgaggtaacaagtggcatataattaaggaattatcgagtactcactttgtccctaaataagtgttantttagtcaaaaatttatccctaaaagaatt

SEQ ID NO: 10704 - DNA, 101 bp, rice(Oryza sativa)
  misc_feature (71): n=c or g
atggagctgtatatgaataatccttgtgttcttgataataaactcgaacaaccatggccacaaaaggttgntagcaaacgagagctgagaagaactcatgg

SEQ ID NO: 10705 - DNA, 101 bp, rice(Oryza sativa)
  misc_feature (71): n=a or t
caagagcaacagaacattctaccagtgtctctaggacagcagaaggttcgggaaatggacagactacatanattacctgcatggataataagtgttatcat

SEQ ID NO: 10706 - DNA, 101 bp, rice(Oryza sativa)
  misc_feature (71): n=a or t
ggagaaagagatggattatggaaatgacaaattgtatacagacgtcactgctgccagaaaagaacttccanttttttttctttttttctgcattgagaaat

SEQ ID NO: 10707 - DNA, 101 bp, rice(Oryza sativa)
  misc_feature (71): n=c or g
ccgtcctctccgtcatcatcctcctcctctccaacctcgcatcaaacgtaccaacgggtaattatacattntattaatccagaattaatgtatactactcc

SEQ ID NO: 10708 - DNA, 101 bp, rice(Oryza sativa)
  misc_feature (71): n=a or t
ctgtcgacccctgatccagatcaatacacaggacattatacaacaagagatatttgccagtaattagactngcatacttgaatgttaattattatcacgta

SEQ ID NO: 10709 - DNA, 101 bp, rice(Oryza sativa)
  misc_feature (71): n=a or t
tgttgtcgagacacgatgttagataaatagagccatgtgaagaacttgtatttaggctgagcggctcaacntctccagatcacgccaaggaattgtaggca

SEQ ID NO: 10710 - DNA, 101 bp, rice(Oryza sativa)
  misc_feature (71): n=a or t
gacaaactcatgcctttaattatcatcttgtcgatcagtcatcgggaaaaactagagctgatttttttttnaaaacacagggcagagcatagaccgcttat

SEQ ID NO: 10711 - DNA, 101 bp, rice(Oryza sativa)
  misc_feature (71): n=a or t
cttcctctgctcttctactatacacgtacgagtacacctcacctgcacgtcgtcgtcttctgttttttttnaaaaaaaaagaaaaaaaaaatcgatgttct

SEQ ID NO: 10712 - DNA, 101 bp, rice(Oryza sativa)
  misc_feature (71): n=c or g
tggtattacatgagtacaagtggaagcctaaacatgtgcaaattctagagtgggaatggattgtagcacantagcacttttatcgtacatttagatagaat

SEQ ID NO: 10713 - DNA, 101 bp, rice(Oryza sativa)
  misc_feature (71): n=c or g
agtttctcccgtataaaaacggccgcgcgcgggcagcgaagctccaaacaacgaggggaacgaacgaacancacaaggtgtccacaacacaaagccgcccg

SEQ ID NO: 10714 - DNA, 101 bp, rice(Oryza sativa)
  misc_feature (71): n=a or t
tatagctaacaatagcttaaatcaagttgtttaagtaacactgatgtaaaaaagtttttggcaaaattatncttttggaagtgtggcacagataatcatca

SEQ ID NO: 10715 - DNA, 101 bp, rice(Oryza sativa)
  misc_feature (71): n=a or t
cgccaagctgagctgacacctccaagtccaaccaactcgtctccgacccaacggcaacgtttttttttttnaaaaaatagactttttatgctttaatttta

SEQ ID NO: 10716 - DNA, 101 bp, rice(Oryza sativa)
  misc_feature (71): n=a or t
actatcagatttcaacataactcatctcggttttaaacaagagcagttttacttctcacgagatttttttnaaaaaaataaaaaccgataaatccctatca

SEQ ID NO: 10717 - DNA, 101 bp, rice(Oryza sativa)
  misc_feature (71): n=a or t
atataaaaatatacatgtcttgctgaattattatagtgttatggattcaatagtctttggttggtttggcnatcaactcttctttggagcctagtttatta

SEQ ID NO: 10718 - DNA, 101 bp, rice(Oryza sativa)
  misc_feature (71): n=a or t
ccatatctatcttactatcggttccacactgagtctttaatattctgtattcaaggctttgtttttttttnaaaaaaattactattaaggattttaggctt

SEQ ID NO: 10719 - DNA, 101 bp, rice(Oryza sativa)
  misc_feature (71): n=a or t
gtacattgtgtacatgtatggtaccgaccaaaaagttcatgtttggttggagcgtgcctgccagaattatnttttttcgattataatactaccataacatt

SEQ ID NO: 10720 - DNA, 101 bp, rice(Oryza sativa)
  misc_feature (71): n=a or t
acacacaaacttcatcacatataatatatgcatgacgggcattagttttgttctggcgaactttttttttnaaaaaaaagaaaagaactacgactatatat

SEQ ID NO: 10721 - DNA, 101 bp, rice(Oryza sativa)
  misc_feature (71): n=c or g
tcatgctggtagatggatggactgacaaaatcatcagagcgctcttggttggagaacagctctgaagtctnatcaaatcattctgtgcttgttagcttatc

SEQ ID NO: 10722 - DNA, 101 bp, rice(Oryza sativa)
  misc_feature (71): n=c or g
atgatgcttgggcgggtgttgggttagctaggaatagtgttggggtagggcggatgcggatgcggagcgancaccggtgatggtgggcgatgcgattcggt

SEQ ID NO: 10723 - DNA, 101 bp, rice(Oryza sativa)
  misc_feature (71): n=c or g
tgctaactgctagctaaatcttcttgtgaaattaagcccaatcggagtaggtggtgcagaaaaaatgctcnatcaagttgtgtatataatatatggcagat

SEQ ID NO: 10724 - DNA, 101 bp, rice(Oryza sativa)
  misc_feature (71): n=c or g
gtcgccgtccgctccgatgaggttgagcatggccttcaccctgtcctccatctctgcatacacacacacanagagaaacaaattaacccaaacacggcacc

SEQ ID NO: 10725 - DNA, 101 bp, rice(Oryza sativa)
  misc_feature (71): n=a or t
caaattaaactaccaatgctggtaataccataaatccacatattggtggttctgcttcgaaattttgagcnagtgtgtatcgtaccacaacagcctgctgt

SEQ ID NO: 10726 - DNA, 101 bp, rice(Oryza sativa)
  misc_feature (71): n=c or g
tatatattttctatccatccatccatcgagagagaggccggtcgatcggtcagtagctagctagcttcttnttgttgttagctcgagctgggggagacaag

SEQ ID NO: 10727 - DNA, 101 bp, rice(Oryza sativa)
  misc_feature (71): n=a or t
acacgcaataatgttgcctcgccattagtttgcaaattttgttgactcggcaaatgttggtttggctatgnttattaatttttgttggtgttgttgtgatg

SEQ ID NO: 10728 - DNA, 101 bp, rice(Oryza sativa)
  misc_feature (71): n=a or t
aaatttagattcaccaacaatgattaaatcaggagagttctgcaaacacaaaatattacaatatcattagnaacatagataacactaaaacaactataaat

SEQ ID NO: 10729 - DNA, 101 bp, rice(Oryza sativa)
  misc_feature (71): n=a or t
aagacctctgttgcagttgtttgtctaagtggaaaacatagtgactgtgtgcaacgaatgaggctagaaantagttgaacatgttcttttagattttcagt

SEQ ID NO: 10730 - DNA, 101 bp, rice(Oryza sativa)
  misc_feature (71): n=a or t
gaggcaggcggcgagagaacgacgggtcgaagaaacggaggactctgagaaagaaacaaattcctaaaggnggtgcggctcgccggcccacacgcgatcga

SEQ ID NO: 10731 - DNA, 101 bp, rice(Oryza sativa)
  misc_feature (71): n=a or t
ggcagtgcctacttccgtgaaactgtcaaagatcatctggttctctgatgtttcggtcaaaatcaaaccangcttaatagttcccttgctttctaataatc

SEQ ID NO: 10732 - DNA, 101 bp, rice(Oryza sativa)
  misc_feature (71): n=a or t
ctaccgatgtacatatagcgaatctgaattgtgctgccgtagccacagccgctcaaaaatatgttcacttnggttgttgtttagagaatcctagaataaaa

SEQ ID NO: 10733 - DNA, 101 bp, rice(Oryza sativa)
  misc_feature (71): n=c or g
gaagagtaaaagagtaacacagtaccatggacaaaacttgtaggcaaaaactataaggtttacgattttgntatatatttgtcgacaaattttctcctaaa

SEQ ID NO: 10734 - DNA, 101 bp, rice(Oryza sativa)
  misc_feature (71): n=a or t
acttctacatcgatctgatcctgagctgtccggatgtatccgcagaccatacgcttttccatttttttttnaaaacttagaccatatgcatatgctacgta

SEQ ID NO: 10735 - DNA, 101 bp, rice(Oryza sativa)
  misc_feature (71): n=c or g
tctacaggtacctctactctaactctaactgtaacatcaaaatgattcctcaactcaactcaactcaactnaactgaattctcttgagatatactgaactt

SEQ ID NO: 10736 - DNA, 101 bp, rice(Oryza sativa)
  misc_feature (71): n=a or t
accagccgataaggtgctagcttagagatgtgtgtgtgttggaggaccacaacctcctctaggataagggnaggaacaaataggagatgaatgatttaaga

SEQ ID NO: 10737 - DNA, 101 bp, rice(Oryza sativa)
  misc_feature (71): n=a or t
catctaaatgctgttaggagtctgctaacactacttgctcttggaaagttgtaggggctcattttggacgnagaaatttcacaagattttagcacgaatca

SEQ ID NO: 10738 - DNA, 101 bp, rice(Oryza sativa)
  misc_feature (71): n=c or g
tcagatttactccagtatcccctgcataatacggcgtctctgtgatatcttggtatcacaatcgatcatcngccgctgcttacgcccgcccgcccgatcga

SEQ ID NO: 10739 - DNA, 101 bp, rice(Oryza sativa)
  misc_feature (71): n=a or t
tactatgatcaattcagaaatactttccatgtgacttgtttttgaaatgttttccaattttcctttttttnaaaaaaaaatgtttgctccatgtcaattgt

SEQ ID NO: 10740 - DNA, 101 bp, rice(Oryza sativa)
  misc_feature (71): n=a or t
gacgctttctccatgcgcctcgccggctacgacggaatgactcgagagaggaagagtgagtgtgtgtgtgngagagagaggaagaggggaaagaggaggtg

SEQ ID NO: 10741 - DNA, 101 bp, rice(Oryza sativa)
  misc_feature (71): n=c or g
catgcgtttatgaacagctggaggcctctgccataatcaccgtgcacggaagaaaaaacacagagcaagangcaagtattgtgctttctaccgaaagtatt

SEQ ID NO: 10742 - DNA, 101 bp, rice(Oryza sativa)
  misc_feature (71): n=a or t
agtggtggtgtataagacagaacatccaagttctttcacacattaatttacaccatccaggtttttttttnaaaaaaaaactcatcaacttgaatccaaat

SEQ ID NO: 10743 - DNA, 101 bp, rice(Oryza sativa)
  misc_feature (71): n=a or t
atacccattttccttctctctaaaccagaggaatttgcttaatccctctttgccaccaaaatactttccantccctttgattgtgttatcttcaacaatgt

SEQ ID NO: 10744 - DNA, 101 bp, rice(Oryza sativa)
  misc_feature (71): n=a or t
tccccatgagaaggggtggatctggaaaaggccattttctattgcacccaaaacatgttcagcagcacttntgcaagcaatggttcaacaataacaacata

SEQ ID NO: 10745 - DNA, 101 bp, rice(Oryza sativa)
  misc_feature (71): n=a or t
aatgcagaatctttactgtcaccggccttcagctcagctcagctcagcacgctcgcttctgcaggctggcnggctggctgctgcagccagcgcttcccttt

SEQ ID NO: 10746 - DNA, 101 bp, rice(Oryza sativa)
  misc_feature (71): n=a or t
tgcaaaaaatagacttattaaggccatataagaggcagaccaaagagatgggggaggaggcaaaatagacnttttttctaaggagaagcacgatgcgcttt

SEQ ID NO: 10747 - DNA, 101 bp, rice(Oryza sativa)
  misc_feature (71): n=a or t
gagggtggccacaaagtggacatgccttaccgcagataatttggagaaaagagggtgattgtttttttttnaaaaaaatcatatttatcacactttgattt

SEQ ID NO: 10748 - DNA, 101 bp, rice(Oryza sativa)
  misc_feature (71): n=c or g
ttaacattgtttgggtggggagcgtggaaagaaggtttggtattgtcttaaataaaaatctaataacaacntaaatggtacgtccatcggtttaagtcgaa

SEQ ID NO: 10749 - DNA, 101 bp, rice(Oryza sativa)
  misc_feature (71): n=a or t
tcaccgagcaggacgcgccgggttactaccagacgccggcgtccgacacggtatgcaagaagttcagaaantttttttcctcctcttttcttctcggaaat

SEQ ID NO: 10750 - DNA, 101 bp, rice(Oryza sativa)
  misc_feature (71): n=a or t
cactgactaacctggcgaatagacaaggtataaaattgctaatggaaaaggtagcaaaaatccagaaatcnacataatgaaactgaggttcatcaaaatga

SEQ ID NO: 10751 - DNA, 101 bp, rice(Oryza sativa)
  misc_feature (71): n=a or t
gactcgcggcccacagcgggattatctggttgcgttttccaccctcccgcgcgcgctgccggtgacgaaanacgatgatggaaattcccgatcgactgacc

SEQ ID NO: 10752 - DNA, 101 bp, rice(Oryza sativa)
  misc_feature (71): n=c or g
atgggtgttccacgtcagacgaaaggggtaaaaccagccgaaattagtcgcgagggggggttaagtgtccntattgaatagttcaagggggtattatatct

SEQ ID NO: 10753 - DNA, 101 bp, rice(Oryza sativa)
  misc_feature (71): n=a or t
actatgagtttggatattagttactacgacctttgtccattaacagaacagcttttagctaccaatgtggntagtgcatttctatattaacagctaaacgt

SEQ ID NO: 10754 - DNA, 101 bp, rice(Oryza sativa)
  misc_feature (71): n=a or t
gtaatcgagttcagcctggaggtaaaactctctaccatggatgtcgacatggttgaattgcctgccagtangccaaacttctcgacagtcatgcggcgagc

SEQ ID NO: 10755 - DNA, 101 bp, rice(Oryza sativa)
  misc_feature (71): n=c or g
aacggaaagctgtatcaagaactgttgagtgttgaaaggcttcaaaacaagaccattcacacttccttganacacaaattactgaaagcttggatagagca

SEQ ID NO: 10756 - DNA, 101 bp, rice(Oryza sativa)
  misc_feature (71): n=c or g
tattttactgccattatagtactaccgatagatatcaacaaaagaaaaaaagaactcttcttctgggtatnttattactggatttttttttctgaaacttt

SEQ ID NO: 10757 - DNA, 101 bp, rice(Oryza sativa)
  misc_feature (71): n=c or g
ttcaactatttattatttgccaatgttgaatcagccatttatctgatcaatctttacgtttttgtcaccanagagagaagcttctccgttttcatttttgt

SEQ ID NO: 10758 - DNA, 101 bp, rice(Oryza sativa)
  misc_feature (71): n=a or t
actaaacctactgtcaattagtactagtggttcattcaattagttttgccttttgcagttggacaaaaaantttttgatgatttttgcgccaggaaaggaa

SEQ ID NO: 10759 - DNA, 101 bp, rice(Oryza sativa)
  misc_feature (71): n=c or g
caacaacaacaagattactcatggtttgcatggtactgtgcatgcatagctacatgcaaaggctcatccantaaacaagctgagcaaaaaaaaacacttaa

SEQ ID NO: 10760 - DNA, 101 bp, rice(Oryza sativa)
  misc_feature (71): n=c or g
ttatagtattagaatgtgtcacattcaatattatattggtgttttagggacggaagtagtaaatggcaaantccccggtcaaaaacaaaaaaaaaaactta

SEQ ID NO: 10761 - DNA, 101 bp, rice(Oryza sativa)
  misc_feature (71): n=a or t
aaaattccaatcaaccaagaccaaaaccaaattacctgagactgcaatattcggtcctagcgtttttccantgcaattcggtcattatattcaaatagctg

SEQ ID NO: 10762 - DNA, 101 bp, rice(Oryza sativa)
  misc_feature (71): n=a or t
gcaagctccaggggaagagaggggagaggtggaagtccacttacatgttggttcaacatgttttttttttnaaaaaagaaaatgattggaatgccacgcca

SEQ ID NO: 10763 - DNA, 101 bp, rice(Oryza sativa)
  misc_feature (71): n=a or t
cctaccttagcttgcagccctgtaaaataatccgtgcattttgttgtgccaagcacaactatttttttttnaaaaagaaggctgataatgcataaattatc

SEQ ID NO: 10764 - DNA, 101 bp, rice(Oryza sativa)
  misc_feature (71): n=a or t
actaccattaattaagtgtggtggtagttagaagtagatctaaactcttcaatcaaataagatcaacagtntatattactttctaccataggtacagtgca

SEQ ID NO: 10765 - DNA, 101 bp, rice(Oryza sativa)
  misc_feature (71): n=a or t
gatatccttagctgtttgaggtttcagtatgtaagctactaagtcgtcaaagatttcccttcttttttttnaaaaaaaaatgatctgtagatttcagccat

SEQ ID NO: 10766 - DNA, 101 bp, rice(Oryza sativa)
  misc_feature (71): n=c or g
ttcgatctcctctcttcgatctctgcattatttgatttgattggggattgtgggcggcgtggcgtggcgtncaggaggtgcggcatggcggcggccatggc

SEQ ID NO: 10767 - DNA, 101 bp, rice(Oryza sativa)
  misc_feature (71): n=c or g
ttaggaaggcggtagtacatccaataactcactggcagttagtcataacatataatttaggcccagtttanttctcacccaaaattttttcaccctgtcat

SEQ ID NO: 10768 - DNA, 101 bp, rice(Oryza sativa)
  misc_feature (71): n=a or t
aaccatatcatttgtactaaaccaaaaggcccaacatacggcggaagcccctacaagaataagtttttttnaaaaacccctttaggaatctaaaaaaaaat

SEQ ID NO: 10769 - DNA, 101 bp, rice(Oryza sativa)
  misc_feature (71): n=a or t
atggccagccggtgagcttcctcggctgtttttatccgagttttgcatattcgctcggattttaggaaaancataaagaggagatcaagtggatcaaaagc

SEQ ID NO: 10770 - DNA, 101 bp, rice(Oryza sativa)
  misc_feature (71): n=c or g
gaaccttgtagtacgtacctctatcaaccaaccgtccctccctcctacactttttcatggaaggatcaatnctcattttggcttggatttcgtttgtaaac

SEQ ID NO: 10771 - DNA, 101 bp, rice(Oryza sativa)
  misc_feature (71): n=a or t
aatgatttaagattttgatgtttgtctatgtgcattctggcatcatatatatttgagaatggagatactanttttaaaatatgtcgcttgctagcatcacg

SEQ ID NO: 10772 - DNA, 101 bp, rice(Oryza sativa)
  misc_feature (71): n=c or g
cgtacgtcgatcatcgtcgtctcactgacactgtctctgggcctcatcaagtcaagcagtcagcaaccgantggcactcgacatcgagttgtcgatgccgc

SEQ ID NO: 10773 - DNA, 101 bp, rice(Oryza sativa)
  misc_feature (71): n=a or t
ttgctgctctagcctagacaatatttgatgattgcagaaactggcttctgttcggagcctgtacaacttcnctgttttattgtggattaatccgtctagtc

SEQ ID NO: 10774 - DNA, 101 bp, rice(Oryza sativa)
  misc_feature (71): n=a or t
attttttcaaaccagtttttaagaaatggcgtgtttttgcatgtttttttcttttttaatggcgatggaantttttttttgttctcgttcttttttttttg

SEQ ID NO: 10775 - DNA, 101 bp, rice(Oryza sativa)
  misc_feature (71): n=c or g
ttccctcctcgtggagctctctctccatttttatcttgattcgtgagtagtcttgttgttgcatggttgtnacacccggagttttcccttcccttaggttc

SEQ ID NO: 10776 - DNA, 101 bp, rice(Oryza sativa)
  misc_feature (71): n=a or t
cggcgaggagcttcccggcgagaaatcgcgtcgccattgatatatatgggtctcgccggtttttttttttnaaaaaaagatactccctccatattttaatg

SEQ ID NO: 10777 - DNA, 101 bp, rice(Oryza sativa)
  misc_feature (71): n=c or g
agtatccaaattttaatccactcctttaagaagaaacgaacgggacctcgatatattatgggtaccagatntaatacgtatgagtataacactatattacc

SEQ ID NO: 10778 - DNA, 101 bp, rice(Oryza sativa)
  misc_feature (71): n=c or g
ctgcattagcaagacacagaacattagagtgctgaagtacaagtctaatagtacacaaatgatagtcagcnactctgcctagtttgattcaacttgtctca

SEQ ID NO: 10779 - DNA, 101 bp, rice(Oryza sativa)
  misc_feature (71): n=c or g
taccaacaatcaaatttcatatcattaataccaaatcaaggaattatttttttttctaggcatcgcaatcnaaagcatgaaaggctcaataactggtcaag

SEQ ID NO: 10780 - DNA, 101 bp, rice(Oryza sativa)
  misc_feature (71): n=a or t
attagccgaaaagctgaattgttttgttaatcaccctagctaataagctagctaccccattaaccgagagntttttttatttaaaaatacgcaatataaac

SEQ ID NO: 10781 - DNA, 101 bp, rice(Oryza sativa)
  misc_feature (71): n=a or t
cgttgtccagaacaacctgaactgctgatttatgtttcattttagcactgcaaatacgaaccagcttcacntttctagttcataaaaacattggaaacaat

SEQ ID NO: 10782 - DNA, 101 bp, rice(Oryza sativa)
  misc_feature (71): n=a or t
ctcgttggtcctttcctgtcgcgagcgtatttaatttctctttctagcgaatttgcatctcaggctaagtnttttttttgagataatggaattaaatctag

SEQ ID NO: 10783 - DNA, 101 bp, rice(Oryza sativa)
  misc_feature (71): n=a or t
tttaataatgttgacgtgccttacacgtgcatgctcactagtgaaaataaatatacgagttttcttttttnaaaaaaaagacagcagaattatagcaacag

SEQ ID NO: 10784 - DNA, 101 bp, rice(Oryza sativa)
  misc_feature (71): n=a or t
tactttcccaactcatttctctcattttccgtgtatacgttttttcaaactgtaaacgatgtatttttttnaaaaaaatatcatattaatcttttgaaaaa

SEQ ID NO: 10785 - DNA, 101 bp, rice(Oryza sativa)
  misc_feature (71): n=c or g
aacaaaggaaaaacatatctaccacacaaaactcctcattaattttaggggaacacaacagaaatactagncaactacttattacaccttaaaatttacta

SEQ ID NO: 10786 - DNA, 101 bp, rice(Oryza sativa)
  misc_feature (71): n=c or g
atttcatccttgaaccctcaactatcaaaattaatgcaatatagatcccatgatggtttggactcaaaacnaatacaatatagatcccatgacggtttgga

SEQ ID NO: 10787 - DNA, 101 bp, rice(Oryza sativa)
  misc_feature (71): n=c or g
tggttcctatgaaacgaatgcataaacagtgccaaatccaaaggaattgccaatcctacgaaaatcctgtntaattcctccgttccgaacaagcccttagc

SEQ ID NO: 10788 - DNA, 101 bp, rice(Oryza sativa)
  misc_feature (71): n=a or t
cataaaaaccaatcctaactacgaatctggacatatacgtgttcaagttcgtactaggattggtttttttnagacggagtagtatctcatatggaaaatat

SEQ ID NO: 10789 - DNA, 101 bp, rice(Oryza sativa)
  misc_feature (71): n=a or t
cgacacgacattttcgctgatggggtacaagagttattagaagttactagagcatcgtacaatagaaaaanggcttcttactagcaaaactaagcgatatt

SEQ ID NO: 10790 - DNA, 101 bp, rice(Oryza sativa)
  misc_feature (71): n=c or g
ttttttgttgtttctgcagagtttcaggcttacattgctcaccgtgaacctctgtatcggatgtgcctttnattagtatttatttaaggatgactgaacat

SEQ ID NO: 10791 - DNA, 101 bp, rice(Oryza sativa)
  misc_feature (71): n=a or t
tggagttcccaactccacctcctgaactcagcctaagtgtaagtgtgtaactaactttgatatcagcatantttcatcatgtgtgaagctatctgatatga

SEQ ID NO: 10792 - DNA, 101 bp, rice(Oryza sativa)
  misc_feature (71): n=a or t
cataaaacagcaaaacaggtaaacaaaaatggcaaatgcaaaagtcaaaacaggtaaacatccaaaaaaanttttgtagctctgcttgcgcaagagatgtg

SEQ ID NO: 10793 - DNA, 101 bp, rice(Oryza sativa)
  misc_feature (71): n=c or g
ttacaagttgtgataaaggatttaccaccggactaacatattatagacacgtgaggactcacatgtcatanacagcgagtggcaagttcttaattgccaca

SEQ ID NO: 10794 - DNA, 101 bp, rice(Oryza sativa)
  misc_feature (71): n=a or t
caaaagctgacaccggtacttgctccgtattaattagtgtcagatcaagaaaaacgacactctactatacnccctacgtttcataataaacgaatctatga

SEQ ID NO: 10795 - DNA, 101 bp, rice(Oryza sativa)
  misc_feature (71): n=a or t
aaaatcggagaaaaaggcgacaaggaagccgaggggattgcttcgtcgacgaggagggagttggtggtggnggagaggtcgccgccatggagaatcttgcg

SEQ ID NO: 10796 - DNA, 101 bp, rice(Oryza sativa)
  misc_feature (71): n=c or g
acgagccctacaatcccaagagagtttaattgttggtttgcgtaagtgcgtggtaagttagtttgctattntttagttctcaattttttttttcaaaaaag

SEQ ID NO: 10797 - DNA, 101 bp, rice(Oryza sativa)
  misc_feature (71): n=c or g
tatcgtcttcaccgccggtcgtctcgtctcctgccaactagtgccctcgcctccacggctacgcgtctttntcattattgactcagacaagtggttctcca

SEQ ID NO: 10798 - DNA, 101 bp, rice(Oryza sativa)
  misc_feature (71): n=a or t
tataatagaaaaatgatacctcatcaagaacgataaaattgcttgtcttgtgactgagccagaagcccgancattcaccttttctccctaagtggctataa

SEQ ID NO: 10799 - DNA, 101 bp, rice(Oryza sativa)
  misc_feature (71): n=a or t
gggttgcaaagttcaggcactaaccaagtcattgacgtgaacaatcttgaaggtaaatacacttttttttntatattgcaactcttcaaacatgcgtcctg

SEQ ID NO: 10800 - DNA, 101 bp, rice(Oryza sativa)
  misc_feature (71): n=a or t
ctgactccgctgaatttctaaacctgaaaggcaagcagatttgttttccctcctttctcctcggagagacnatggattcggcaccccatatttttaaaaaa

SEQ ID NO: 10801 - DNA, 101 bp, rice(Oryza sativa)
  misc_feature (71): n=a or t
aatcaatttgaagaacacttagctctgaagtctgaattctgaacattcctaaccaatttgaagaacaattnactccttagtctgaattctgaacattccta

SEQ ID NO: 10802 - DNA, 101 bp, rice(Oryza sativa)
  misc_feature (71): n=c or g
taaaccttcacaatcttcttatccctctagacgttatattgtccgttgtcgggtcccaagactaatgattnagaaaccgacatgtttaactgtatcaagcc

SEQ ID NO: 10803 - DNA, 101 bp, rice(Oryza sativa)
  misc_feature (71): n=a or t
tcgacacatatacaatgtgttctagcctactgagatcctaactgtgatttgaaatttagcccattcttttntcttgatcacgagtaactatctgaacaaaa

SEQ ID NO: 10804 - DNA, 101 bp, rice(Oryza sativa)
  misc_feature (71): n=a or t
tgctattccacctgcgtttcatacggtaagtcatttgtttttttagtaaaatctaattaagatcgaccaantttatagtaaaatttagtaacatctaaaat

SEQ ID NO: 10805 - DNA, 101 bp, rice(Oryza sativa)
  misc_feature (71): n=a or t
tgattcccaatgacggttccgggggaaaatggacaattcgcatagctacaaccatcataactgccctatancaggaggagttcattcactatctcaacaca

SEQ ID NO: 10806 - DNA, 101 bp, rice(Oryza sativa)
  misc_feature (71): n=a or t
acggattgaatctaccgatgcgggtggcggtcgaggagggaggagtgatttgccaccgtcctcctcccctnctgagaaattggacattctgccactaccaa

SEQ ID NO: 10807 - DNA, 101 bp, rice(Oryza sativa)
  misc_feature (71): n=a or t
caatcaaatataaatttgggggcataagtttgtttaaaacctgggatttactcagagttggacataaaatnagccataaaatataaagggatagacatttt

SEQ ID NO: 10808 - DNA, 101 bp, rice(Oryza sativa)
  misc_feature (71): n=c or g
cgtcgctctcgcgctctggccgatgtaggagtatctatctagtgctcggtcgtctggcatagtggcatggncatgctgctgctgatttgttgttgcgatga

SEQ ID NO: 10809 - DNA, 101 bp, rice(Oryza sativa)
  misc_feature (71): n=a or t
tcgtaaatatatttaaacatggacatagtactccatcccttttatatcgtaagatactctgattttttttnaaaaaaatcaaacttctgtaagtgtttaac

SEQ ID NO: 10810 - DNA, 101 bp, rice(Oryza sativa)
  misc_feature (71): n=a or t
acgctgttactctgtttaagcaatagagtttggagatggctcaaaaatgcttcagataggagtactttttnaaaaaattaagataattagtacttatttta

SEQ ID NO: 10811 - DNA, 101 bp, rice(Oryza sativa)
  misc_feature (71): n=a or t
taggtgtattggcttgctaatgtctagaccagtattagctgtcctgatacaaccttgtattattttttttnaaaaaaaaagttagcaggtagtggtttgct

SEQ ID NO: 10812 - DNA, 101 bp, rice(Oryza sativa)
  misc_feature (71): n=a or t
gtcatactctccctctctctacctctttcccctctcacctttctctatctactctatcatcctctctctcnctcactgagcagagcagggaggagcagatg

SEQ ID NO: 10813 - DNA, 101 bp, rice(Oryza sativa)
  misc_feature (71): n=c or g
gcattgcagacgttctgcatccatagcaaaaagatggtggtgtatgtaaaaaaaatcgtttgcaaattgcnagttacggaagcgctgtgttactccatccg

SEQ ID NO: 10814 - DNA, 101 bp, rice(Oryza sativa)
  misc_feature (71): n=a or t
gaaaaacatctaaagatccgtccgattcctgaaaaagtggcaacaaaaagctgtttgtaaaaaataaaaanaaaagtaaaaagggcgaaaaaagtccgatt

SEQ ID NO: 10815 - DNA, 101 bp, rice(Oryza sativa)
  misc_feature (71): n=a or t
caaatattgacccacaaaagccaatggagctaaaattattcctatctcaaccaatacaaattccacaaaantgataccagcataaatcttgaattatcact

SEQ ID NO: 10816 - DNA, 101 bp, rice(Oryza sativa)
  misc_feature (71): n=c or g
tttattttggaaagaacactaattactgtgcaaataattaccgagataactagatactacaaattacaaanagtaatgactgaggaagaaggtattagttg

SEQ ID NO: 10817 - DNA, 101 bp, rice(Oryza sativa)
  misc_feature (71): n=a or t
cctcgtagaatagcgataggaaccaccggtggaaatcttgcagacaccagctgcaacacgtgcgctctagntgagttcacgagcatggaaacattgccagc

SEQ ID NO: 10818 - DNA, 101 bp, rice(Oryza sativa)
  misc_feature (71): n=a or t
atgtatgtctctaagggtattttgggtattttttaaaaagagccccatctcaatggcatattgtagacagntaataaagtcatcggtatattgtagaaaga

SEQ ID NO: 10819 - DNA, 101 bp, rice(Oryza sativa)
  misc_feature (71): n=a or t
ttaaaaaaaatagatgggacccaccataaagtgttaatactttatagtaagcttataccctgatagtagtngtttaccgcctccacaatgtatattacctg

SEQ ID NO: 10820 - DNA, 101 bp, rice(Oryza sativa)
  misc_feature (71): n=a or t
accatgtgcggctttaattaagctgctaatcgaaatagtagtaattaatcactcattatcaacaaaaaaantaatcactccagttaattaattaattacct

SEQ ID NO: 10821 - DNA, 101 bp, rice(Oryza sativa)
  misc_feature (71): n=a or t
gcatcacaataccgccccccccccaaaaaaaaaaaacacaacattaattcactcgcacccaaaaacgcaantaccccgtagcagccacgagccagccagtg

SEQ ID NO: 10822 - DNA, 101 bp, rice(Oryza sativa)
  misc_feature (71): n=c or g
tactcatgtaggttaatttttttagatagagggaatagtctgttcatattgcttgtattagtagactatantaagtactttcttttgtgtatagagtaggg

SEQ ID NO: 10823 - DNA, 101 bp, rice(Oryza sativa)
  misc_feature (71): n=a or t
cgcgccggcgacctcctccccaccaccggtcggcctgcccagagtgtagagagaagagagtgtgtgtgtgngagagagagagagagaagaggaaaggagag

SEQ ID NO: 10824 - DNA, 101 bp, rice(Oryza sativa)
  misc_feature (71): n=a or t
tttggagtttcagtcacacaccaacaaacgcgcgcgtgcatggaaaactgaccgaattaattattaaattnaggaaaaagtccgttttactcccctcaagt

SEQ ID NO: 10825 - DNA, 101 bp, rice(Oryza sativa)
  misc_feature (71): n=c or g
atttttcctagggccttaatccaatctaacttaatccgttgtctatctagcgtcgtcgtctccgtgtgttnccgccgggtcaccgtcgtcgtctctccctc

SEQ ID NO: 10826 - DNA, 101 bp, rice(Oryza sativa)
  misc_feature (71): n=a or t
actaatatttctctattaacttaaaccaaatttagaggagtttttttttgcggttatatagttctaatggnacatatattatttgttgaatattactacta

SEQ ID NO: 10827 - DNA, 101 bp, rice(Oryza sativa)
  misc_feature (71): n=a or t
cttccacacatgaaagtaggttttggctcgcacagaaaaattgtttttgtactagtgtgccccccagctcngtaacgcatgtttctccatctcccgttctg

SEQ ID NO: 10828 - DNA, 101 bp, rice(Oryza sativa)
  misc_feature (71): n=a or t
caattctcatgtgtgatgccttcaagaagaaaatattgattaggttgatgccatgaccgacttcaactagngaagaccaaaaccagagttttttttttttt

SEQ ID NO: 10829 - DNA, 101 bp, rice(Oryza sativa)
  misc_feature (71): n=c or g
gaagaagagacataaagcaatcaattcctatacttctgatatacggtcaaactctagtttacatttgctantatacaataatgtggccaataaccctcctg

SEQ ID NO: 10830 - DNA, 101 bp, rice(Oryza sativa)
  misc_feature (71): n=c or g
gattatctctcgatgcctatgtccaggggacactaacaaatgtggtttgacgattcgctcgtggatcgtanttaaaacatgttgtttaactatgagtaacc

SEQ ID NO: 10831 - DNA, 101 bp, rice(Oryza sativa)
  misc_feature (71): n=c or g
cgaaggggaacatcaaaagatacataaaagacgatcaatctatgcaaaatacatcctcggcactgccaatntcaatatcattgatagttaatagcgtacaa

SEQ ID NO: 10832 - DNA, 101 bp, rice(Oryza sativa)
  misc_feature (71): n=a or t
gaaatatactaccaaaaaaaatataaaattggttttcgtaaaaaaggaacttctgaaatttgtttcaaaanttttttaaaacttgcgtcgtaccattccgt

SEQ ID NO: 10833 - DNA, 101 bp, rice(Oryza sativa)
  misc_feature (71): n=a or t
aataaggttttgatataagttaatttgtttacaaagtatctatacttagctagggcaatagataccaaaancctccgtaaatttccatatgtttagcccat

SEQ ID NO: 10834 - DNA, 101 bp, rice(Oryza sativa)
  misc_feature (71): n=a or t
tggctactatgcaaaattttagtggcacacaaaataagatggactattagcatatgattaattgatcattnattattatatacttaaaaatggatataatt

SEQ ID NO: 10835 - DNA, 101 bp, rice(Oryza sativa)
  misc_feature (71): n=t or c
agtaccaatcatattgccctgatgctatgattgtacggttgaaaccagcacttccccctgataacatttanggtatgcagtatgctgtttcttttcaagat

SEQ ID NO: 10836 - DNA, 101 bp, rice(Oryza sativa)
  misc_feature (71): n=t or c
agcaaaattgcctgtttcagattgttactaaaggcacaccagaattacctcatcatcttgcttgttttggngggtctcgtcatcttgcttggcttccttgc

SEQ ID NO: 10837 - DNA, 101 bp, rice(Oryza sativa)
  misc_feature (71): n=t or c
ggacacaacacagaaaaagccaatcaatcaacggctacttgtatgtaatctccacgcattccaatggcggntgcctcccacaattcggtggtcactcgtca

SEQ ID NO: 10838 - DNA, 101 bp, rice(Oryza sativa)
  misc_feature (71): n=a or g
cttgttaactgggttagccagggactccggtattatactactatgatcagttcgtgtactttttttcgccnggcaagtttccccaaggaactcttttgatg

SEQ ID NO: 10839 - DNA, 101 bp, rice(Oryza sativa)
  misc_feature (71): n=t or c
ttttcatggagtgccatggacgtatgataacaatcaaagaggtgcaaacaatgtaagagtacgactggatngagcagtagcctcgccagcatggctgggca

SEQ ID NO: 10840 - DNA, 101 bp, rice(Oryza sativa)
  misc_feature (71): n=a or c
ttttttgtttctcttttgtaatggtttgatattaaatgatggtcgtcttttgcaaccgtcgagtgtcagcntgcttacttgctatgataaagagagctaat

SEQ ID NO: 10841 - DNA, 101 bp, rice(Oryza sativa)
  misc_feature (71): n=a or c
aaaaaaggaacaaaaacaggaaaagaaaacacgcttctcccttctcctcttttccctttttttcccctctncatcttccttcccctttcctcctcctcctc

SEQ ID NO: 10842 - DNA, 101 bp, rice(Oryza sativa)
  misc_feature (71): n=t or c
ccgttttgtttttgtatttttgtggggggtttgcggtttttgagttttttttttgacgattcgaagggttngttggattgcaggtcgtgagagctgctgag

SEQ ID NO: 10843 - DNA, 101 bp, rice(Oryza sativa)
  misc_feature (71): n=t or c
ctctacgccgtcgtctagagttagcctctagactctcgatccagacgcttcacgcggaaatggaggaatgnatttttcttttgtttttctttaaagaggaa

SEQ ID NO: 10844 - DNA, 101 bp, rice(Oryza sativa)
  misc_feature (71): n=t or g
atattgtttttacctgtgacccttttaagagaggacaaaacccatggatagtgagctctattatgtttccntattgtttttgttcttgcattttcttcaag

SEQ ID NO: 10845 - DNA, 101 bp, rice(Oryza sativa)
  misc_feature (71): n=t or c
tttaagctcttctgggtggagctgacctgtcggcgagtactaactactaacaaactggactaccaactaanaagctgaatcggttcttgccaccaaacgaa

SEQ ID NO: 10846 - DNA, 101 bp, rice(Oryza sativa)
  misc_feature (71): n=a or g
agctgcgctagagccactgaggataacctggggacgaagcagtgttgcaggcctgtttgaaatacggtctnaactgttatttctaggtcgagagagtgcgt

SEQ ID NO: 10847 - DNA, 101 bp, rice(Oryza sativa)
  misc_feature (71): n=a or g
ttggcactaagcacgatgggcccaagtcccacatcaactaggcacaatttccatctctgcagggcccaatngaccaactataaggctgtagctaattcaac

SEQ ID NO: 10848 - DNA, 101 bp, rice(Oryza sativa)
  misc_feature (71): n=a or g
gaagttagaacaagggttgttttttttttcatttcacctgaggtagaagaagagtagatcctcgcgccatngacgagcgaggttggatcgatcagaagatt

SEQ ID NO: 10849 - DNA, 101 bp, rice(Oryza sativa)
  misc_feature (71): n=t or c
tatagaaaaaaaactagactaattttgcagtacgtgtgttcagaaacttctaggcggggttgcagggattnagggcttattttatggtggaacgggttgct

SEQ ID NO: 10850 - DNA, 101 bp, rice(Oryza sativa)
  misc_feature (71): n=a or g
gatacttcctatttgaattcacctcaaaacccctccaaagacattgttttcttgcactattaatattatcnataactaatttaggcaatttcaaagtgcac

SEQ ID NO: 10851 - DNA, 101 bp, rice(Oryza sativa)
  misc_feature (71): n=t or g
ccccacgacgacctggacgtgtaccgatctgacgtgggttcaggacttcaggtttcttgagttcttggttntgctgttcatggtgtggttcggttccacag

SEQ ID NO: 10852 - DNA, 101 bp, rice(Oryza sativa)
  misc_feature (71): n=t or g
caactttgcatgtcatgggcttgggagaagtggacagtactactgggaattagataagcatatctttggtngttaattaaattttgattggaggttacagg

SEQ ID NO: 10853 - DNA, 101 bp, rice(Oryza sativa)
  misc_feature (71): n=a or g
ttttctctcctctctcctcacctgctgtttttgtattctattggcaaactccaagtgtgatgagatgaganagaaaaatatggaggagaggagagagagag

SEQ ID NO: 10854 - DNA, 101 bp, rice(Oryza sativa)
  misc_feature (71): n=a or g
taaggaagaacacaagaggcgtagcactcgtccaacaccttcgtcaccttgagtgtgctgagctcaatctnctggacaacctgggcaccatcatacgtagt

SEQ ID NO: 10855 - DNA, 101 bp, rice(Oryza sativa)
  misc_feature (71): n=t or c
caagatgatgatgtgtctgattgtgtttggatgtctgatagctgccttggatatgtttagaaatgttgcanaaaaacagatgttttctgtcgttagtttac

SEQ ID NO: 10856 - DNA, 101 bp, rice(Oryza sativa)
  misc_feature (71): n=a or c
tgaagaagtactatggtaaagggatcaaaggaaaaaatgccagcgccattgaactcaattttgagcagtanatgacatgcaaattagattggattaatgtg

SEQ ID NO: 10857 - DNA, 101 bp, rice(Oryza sativa)
  misc_feature (71): n=t or c
gtgtccttactagcactctaatttcttgtctcccctttgctataaccatgcagttttttcaacctcatccngacatgaaacctggaacctcacaaatatat

SEQ ID NO: 10858 - DNA, 101 bp, rice(Oryza sativa)
  misc_feature (71): n=t or g
atgtctagaatattataaagtccaacaaaagatggagcacatgcatgaaagattacgtacacgaatgcagntgatacagtggatgttaggcataagaagca

SEQ ID NO: 10859 - DNA, 101 bp, rice(Oryza sativa)
  misc_feature (71): n=a or g
ggttcgtttcgtaatttattgcagcttgaattttgatgacagctgttactgtttctggacccttcgagatngcgattgctcgagctcgctacgtcaacagg

SEQ ID NO: 10860 - DNA, 101 bp, rice(Oryza sativa)
  misc_feature (71): n=t or g
actacaaatgggttattgcattatttatgcaaggaagatcgtgtccaaatcattgaagcgtctaaaaatgnaaactatgttttttgagacagaagatgatg

SEQ ID NO: 10861 - DNA, 101 bp, rice(Oryza sativa)
  misc_feature (71): n=t or c
aaaatcagatttgttgacaagttaaaggacctcggatgaactttcccctgtggaccaaccgactgggcctngcgctcgcgggatcgatcgatatcgatacc

SEQ ID NO: 10862 - DNA, 101 bp, rice(Oryza sativa)
  misc_feature (71): n=a or g
ctcccggcatcagccgtcttgatcagctcgatagtatccttatcgaactgcttccttctcaggcaatcctngatctcgactaaatccccttgcaccatcct

SEQ ID NO: 10863 - DNA, 101 bp, rice(Oryza sativa)
  misc_feature (71): n=t or c
attccgtgaatgtcttctaggtgtagtgtgccagatcacgcactacgaccaagtagtcccatggatatacnagaaataatatatagtggtcgctgcaaaga

SEQ ID NO: 10864 - DNA, 101 bp, rice(Oryza sativa)
  misc_feature (71): n=a or g
atgtcagcagttgatggtgctggagattgttgctgttgtgatgactcctgcgatgactgctgctgctgttnctgatcagaggctgccggagactgcttctg

SEQ ID NO: 10865 - DNA, 101 bp, rice(Oryza sativa)
  misc_feature (71): n=t or g
ccacccacctccatggagctaaacatatgatggtatattctacccattcttgtttgtggcaatgcgcgggntggaatgttaaagcgacgaccacggctcgc

SEQ ID NO: 10866 - DNA, 101 bp, rice(Oryza sativa)
  misc_feature (71): n=a or g
caagttaagaatgtggtaaacaaaggaccaccaaggatggatggtgacaagaaggaggagaagaaatgctngttttgtaaggagccatggtttccaaggca

SEQ ID NO: 10867 - DNA, 101 bp, rice(Oryza sativa)
  misc_feature (71): n=a or c
gtgtggttgcaggtgggtgttcattgtctgcttgcactgtatgcactgaagctcagcatcggatgatttangataggctccatggctcaggctcattccga

SEQ ID NO: 10868 - DNA, 101 bp, rice(Oryza sativa)
  misc_feature (71): n=t or g
atgtgtacctcttgttctggaggaattcctgtagttcgttgataagctgcttttcatccaacatcagtgtntatgagttggtaaactttttcttgtcaaga

SEQ ID NO: 10869 - DNA, 101 bp, rice(Oryza sativa)
  misc_feature (71): n=a or g
gcaacgtacattcatcagagttgcatagtggagtagtagcaaatactctactagtagtagaatagtgagtnagagtagagtagagtacatgcgcttgtgct

SEQ ID NO: 10870 - DNA, 101 bp, rice(Oryza sativa)
  misc_feature (71): n=t or c
ggttagacttgctgtttgcgttgttgttccaaatgagtgtggcgtttgccttgtaactgcacccttggctncagtcacctggtttaaccatctcaaagcct

SEQ ID NO: 10871 - DNA, 101 bp, rice(Oryza sativa)
  misc_feature (71): n=t or c
taccaagtttgcaaaatttattccattatcccatccattcactgcttattcagtagcacaggccttcatanaacaaatttatgatgtttttgggatgccac

SEQ ID NO: 10872 - DNA, 101 bp, rice(Oryza sativa)
  misc_feature (71): n=a or g
caggtgcttctgaggtatttagtgccagcctatttgtaaaactgtacttgtaaccgtggatggtattaacngttgaaaataaatatcgtgctttcgaatgg

SEQ ID NO: 10873 - DNA, 101 bp, rice(Oryza sativa)
  misc_feature (71): n=t or g
cactgaggcttgacagtataatgatttttatatcccttggaggtttctactgcaaagtgaggattgattgncttcactcatgatgacaagcgataacggaa

SEQ ID NO: 10874 - DNA, 101 bp, rice(Oryza sativa)
  misc_feature (71): n=t or c
cagcacctcaccaccggccaaccatcaagcaggaaattgtgacctccgatatgatctgaatccatccacantgataggttggagagggagaaggtgagaga

SEQ ID NO: 10875 - DNA, 101 bp, rice(Oryza sativa)
  misc_feature (71): n=a or g
ggtgggttggcgggcaggtctggcgtgggcgcattcatggagatgacgacagaggcaagaatttggatttngatttggtaatgcgggactctgttgtggat

SEQ ID NO: 10876 - DNA, 101 bp, rice(Oryza sativa)
  misc_feature (71): n=a or g
cctggttcacaataagaggacgggagttggctgcttaaggtcgttctccagatgttgctgtaggcatgtcntttctcgaagtcatagctgcgccgttctcg

SEQ ID NO: 10877 - DNA, 101 bp, rice(Oryza sativa)
  misc_feature (71): n=t or c
tttgaatttgaaggtctcagttgtgaaagtaaaatcttcttaggagcttgcgtaggtttctaacagcatgntatagagaagtggaacgctttgatgttcag

SEQ ID NO: 10878 - DNA, 101 bp, rice(Oryza sativa)
  misc_feature (71): n=a or g
aacagggctctctgcacagaagaacaacgacattctctgcctttgctgagataaaaccaagaaggaatacnttccgacaaccacaattgtagcactcaaga

SEQ ID NO: 10879 - DNA, 101 bp, rice(Oryza sativa)
  misc_feature (71): n=a or g
aaacaatttttaggagtagaaacctaaagactcccacctttctttcccccctttttatgctcatacgccantgaaagcctcacattgattgcaagagattg

SEQ ID NO: 10880 - DNA, 101 bp, rice(Oryza sativa)
  misc_feature (71): n=t or c
aactcagtcaagagaacagtggtgatatactttcccatttcataaaatttcccaatcccatatatcacctncttcttgtaagcgtcgttcactggagacat

SEQ ID NO: 10881 - DNA, 101 bp, rice(Oryza sativa)
  misc_feature (71): n=t or c
ccttaagatcttgataaaggctataaatgagagggtggctaaggtggccgagaagataataagctggactnagactgcttttattcctggtaaaaatattt

SEQ ID NO: 10882 - DNA, 101 bp, rice(Oryza sativa)
  misc_feature (71): n=t or c
tgagaagttgtgaatcactctgccctgcattggccaacagagtagtgcaatgtaatatttttatggttaancagaattccagcaagcaaagtgggtgttca

SEQ ID NO: 10883 - DNA, 101 bp, rice(Oryza sativa)
  misc_feature (71): n=a or g
agattacgaatcttggacactgaagcagaagattgaggatctcgtcaactgtgatcctatccatggtatcntgccaaaaaatcctaaatataaagcatatt

SEQ ID NO: 10884 - DNA, 101 bp, rice(Oryza sativa)
  misc_feature (71): n=a or c
ctacttctttcactcagaatgttgacatcggaatggatgctgattcattaactcagcttgcctctacatgncataccatggaacaagaacttgtttccttg

SEQ ID NO: 10885 - DNA, 101 bp, rice(Oryza sativa)
  misc_feature (71): n=t or c
tttagctctaggagctagtgcaaatctgtggtcacagccggctgttccaaaggaaacctggggagttgcgnagggagaggaagaggatgaaaggaactggt

SEQ ID NO: 10886 - DNA, 101 bp, rice(Oryza sativa)
  misc_feature (71): n=t or c
tcctgatccacacccaataaccacccctatgatccccatcatcccccatccaagaacacattcatggaatngatcaaaattgcaacagaaaatgaaaataa

SEQ ID NO: 10887 - DNA, 101 bp, rice(Oryza sativa)
  misc_feature (71): n=a or c
tactggaagcaggtgatcaaaggttttaaatctccggctatagcaaccactatgtccaaagatatatactnactcactccgtttcaggttataagacgttt

SEQ ID NO: 10888 - DNA, 101 bp, rice(Oryza sativa)
  misc_feature (71): n=t or c
gggtagattcgtaatcttccctcctcctcgctctcaggtaattttctttctgaacacaaaccaaaccaagntgaaacgactggagaaacctcgaaaagcac

SEQ ID NO: 10889 - DNA, 101 bp, rice(Oryza sativa)
  misc_feature (71): n=t or c
agagtaaggcaaaccccatgtccatgtcgttgtagtcgtcgtccgccatggcttccgccgcctctgattcnggccgctacaatcgctagggtttcgccgca

SEQ ID NO: 10890 - DNA, 101 bp, rice(Oryza sativa)
  misc_feature (71): n=t or c
ggaagaaattatcaggaatttggtcgaacagagaaggggtgaggacataattggagcgagctaagtcatgngtgagggccgagggcgacagcgacgagagc

SEQ ID NO: 10891 - DNA, 101 bp, rice(Oryza sativa)
  misc_feature (71): n=a or g
acgttttgcatcgcatccttttgttgttcctttgaaggggcacctcttgaaggtcgttttcatgcaatcantcatacagactgtagctgttgaatctcagg

SEQ ID NO: 10892 - DNA, 101 bp, rice(Oryza sativa)
  misc_feature (71): n=a or g
ccatccatttttttcactgttcaagttcagaaatgtaaagaacagcaacctgacagaagaatggtacaccnatcaaaacacccctctctctctctctctct

SEQ ID NO: 10893 - DNA, 101 bp, rice(Oryza sativa)
  misc_feature (71): n=t or c
tcctgctagctagctagcttcctatcagttgcagtttatgctctagcttcttcacacgattgagctcacanaatgggatcaatggcaatggcaggttgttg

SEQ ID NO: 10894 - DNA, 101 bp, rice(Oryza sativa)
  misc_feature (71): n=a or g
gggcagaaacagcccgtccgtctcaaaccctaactctgcaagacgcgcgtccgccgccgcaactagcaatncccaagcggcgtcgcggggttcgcccccct

SEQ ID NO: 10895 - DNA, 101 bp, rice(Oryza sativa)
  misc_feature (71): n=t or c
catttagccatcattaacagtgttatgagtatgtgaaaattaaggtgatggaagagtgtgagaggcattcnatttccatgtagttgaatttgcaatggttt

SEQ ID NO: 10896 - DNA, 101 bp, rice(Oryza sativa)
  misc_feature (71): n=a or c
cggggacgccgcgagcccgatgtagtctcgcgcttcgagcggcggcggcatcggaatcgagagatgcacangcagagaggagaggagaggagaggagaggg

SEQ ID NO: 10897 - DNA, 101 bp, rice(Oryza sativa)
  misc_feature (71): n=a or g
tggtgagattaaaaaggaaagatgcattttggagtgagcaataacgcaacgcatgcctggtggcagctctngcagggagcgtcgcactccacccaggtgag

SEQ ID NO: 10898 - DNA, 101 bp, rice(Oryza sativa)
  misc_feature (71): n=a or c
cttggagtagttgacagccctgatcctaaccctcattgacgagatgcaaatttgtgagccacgatgacttnatatgaggcattggtaggtgatgattgtgc

SEQ ID NO: 10899 - DNA, 101 bp, rice(Oryza sativa)
  misc_feature (71): n=a or c
ctaatctgcgtaagatgatgaacgtactcacccagtgtttaaaatctaatcttgatgtgcatcattgacanttttatgggaagctactgtggacgtggtca

SEQ ID NO: 10900 - DNA, 101 bp, rice(Oryza sativa)
  misc_feature (71): n=a or g
tatcttttcctttgcagtgcgctcgcaagccatcctgatattccttcacatgcctttccccgtagagtagnaatttcctgcaatttttcctttgttttgtt

SEQ ID NO: 10901 - DNA, 101 bp, rice(Oryza sativa)
  misc_feature (71): n=t or c
aaagctgcaatcttggaggtttgatagagagggcaggctccccctggaacgagttatatagaaaaccaaangaggacgcgccatcaaactctgagtccgat

SEQ ID NO: 10902 - DNA, 101 bp, rice(Oryza sativa)
  misc_feature (71): n=t or g
gaggacacttaattgagatatgaagtccgtttgtggttcttgtgagcttaagatgcttggcacttgatttncttagtttagcaatatcatcatttgacatt

SEQ ID NO: 10903 - DNA, 101 bp, rice(Oryza sativa)
  misc_feature (71): n=a or g
atgctttcctcttctgctgttgtgggtgctgtaggccgttcatccaatatttctttgaccaatgtatgttnctgttctgatgacaaaagagtttgcaacaa

SEQ ID NO: 10904 - DNA, 101 bp, rice(Oryza sativa)
  misc_feature (71): n=a or g
tgcatatctccagggccttggctcacaggtttgggagatctttatagacgacaagacttacgtggtccttnaggttcgcataggatatatacagatcgagt

SEQ ID NO: 10905 - DNA, 101 bp, rice(Oryza sativa)
  misc_feature (71): n=t or g
gttcggcagcgagccgagcgcggcggcggcagcgagcgaccgattcgttttttttatttttggtatttttnattccgtgcggacgtgtttgaaagcacagt

SEQ ID NO: 10906 - DNA, 101 bp, rice(Oryza sativa)
  misc_feature (71): n=t or c
agcaagaaatcgctttggtatgaagggctttctggagatcttctttatagctgcctggtacatttggaaanaaagaaatggcatgatttttcagaatgttc

SEQ ID NO: 10907 - DNA, 101 bp, rice(Oryza sativa)
  misc_feature (71): n=t or c
caattgacaatagaagtgcgttgagattttcgcaaggacaatacaacagatggaagattgcttggttggtntgaaaattggaagttagcattcttaaatag

SEQ ID NO: 10908 - DNA, 101 bp, rice(Oryza sativa)
  misc_feature (71): n=t or c
tgtatatcctatgttcttgctaacactaccatattatttgtgtcttttgatgcagctgctgaagacccttngagtaagaggtcacacatcacacatcccgt

SEQ ID NO: 10909 - DNA, 101 bp, rice(Oryza sativa)
  misc_feature (71): n=t or c
cacccaggaatctgccgtgcacctattgacttcttgtagagtaacctgcagaatctgggaagaaatccaangatgggaaagttgggacctgctcatgcatg

SEQ ID NO: 10910 - DNA, 101 bp, rice(Oryza sativa)
  misc_feature (71): n=a or g
tgttgagcaaaggaacatttgctctttttcaccttaagttgatgtttagtaagaatttgcaagacagcctnaagatgtttaacatgatcaccaagagtctt

SEQ ID NO: 10911 - DNA, 101 bp, rice(Oryza sativa)
  misc_feature (71): n=t or c
ccccgccctgaccacttcacctgcctctccatatatacgcagtttgcagcagatcagacactctcaccgcngctctctcttcctctccaacatgaatatgc

SEQ ID NO: 10912 - DNA, 101 bp, rice(Oryza sativa)
  misc_feature (71): n=t or c
aaaaaaatgtagcgttttgatcagtcaaaaccaccagggaactcccaggaatgattcaaaaccaccactgnatttcactaggcaccgaaaataaaataaaa

SEQ ID NO: 10913 - DNA, 101 bp, rice(Oryza sativa)
  misc_feature (71): n=t or c
tcgttgttgggcctcctctctaccagttacgacgagtgcaggtccagtgcaggtcctaaattatcaggttnagacgtggcagtcagtttgatcctgcaaat

SEQ ID NO: 10914 - DNA, 101 bp, rice(Oryza sativa)
  misc_feature (71): n=t or c
gtcatttgatgccgagaaggcaaaattcatcagggaaatgggggacctcaagaggaagattgaggaaatcnaggtcagcaaggaagcttctgaggaagtag

SEQ ID NO: 10915 - DNA, 101 bp, rice(Oryza sativa)
  misc_feature (71): n=a or g
gtttgctgaatcggcattgactgtgctgggttggccaccagtgggtttggtagaaacatcgcagcaacctnctcctgggtcaaccgattgatattttgtcc

SEQ ID NO: 10916 - DNA, 101 bp, rice(Oryza sativa)
  misc_feature (71): n=a or g
ctatagcacttggctacagaccttgccatattgtacgcttgatgattgttgtgaatgcacgtgggagatgnaagaagcttcctttgggatactatggcaat

SEQ ID NO: 10917 - DNA, 101 bp, rice(Oryza sativa)
  misc_feature (71): n=a or c
tctcccatgctgttagtaaggtaatctccttccttttatttgaaagctaggcaggtgttctaccgagatgnaatgcaaagggaatttcttgcttaattaac

SEQ ID NO: 10918 - DNA, 101 bp, rice(Oryza sativa)
  misc_feature (71): n=a or c
ctcttgtatgcctttttttaatcaaactgtcagcttctgttctctgtccatgcttcttctgggctttgacntgaaagattgtggtttagaacattaaatct

SEQ ID NO: 10919 - DNA, 101 bp, rice(Oryza sativa)
  misc_feature (71): n=a or c
ccaaaggcagagcaaaaacccaaaccccccacacacaacgaacccgattcagaagcaacacaacacaaccnaaccaagcaaagcagggagaaggacggagc

SEQ ID NO: 10920 - DNA, 101 bp, rice(Oryza sativa)
  misc_feature (71): n=t or c
cagcgacagggtgaggagcggatccaccattgctggcctcaagaacgccactcccttgcagatccgcgggnagggggaggcgtggatccgtcagcgtagcc

SEQ ID NO: 10921 - DNA, 101 bp, rice(Oryza sativa)
  misc_feature (71): n=a or c
agaacgagcaactggactctagtagctgatgtatcagaaaagacagtagctacacctgcccttctgatgcnaagactccttagtctccactctccagcaat

SEQ ID NO: 10922 - DNA, 101 bp, rice(Oryza sativa)
  misc_feature (71): n=t or c
acgacgagaggaaggggtaggtgaaattgacaacattgcgagcagtggtgggttgttgatggcgcgtatcngatggaggaaggagggctcagtgatgacgc

SEQ ID NO: 10923 - DNA, 101 bp, rice(Oryza sativa)
  misc_feature (71): n=t or g
gggacatggtgcaggtaagtttgtcatggcactccccttttttatctcctttagtttcaagtgagaaaatnaatttccctcatacaaattgcttgtttgtg

SEQ ID NO: 10924 - DNA, 101 bp, rice(Oryza sativa)
  misc_feature (71): n=a or g
ggagctgcattggagcggccactagagaaccaattacgccattcttgctgaatggatctttccgtgcactnagcttggtcaagaagatcttgcaaagtgtt

SEQ ID NO: 10925 - DNA, 101 bp, rice(Oryza sativa)
  misc_feature (71): n=t or c
cggacgtaccactcttccctattttctctctccaccctctcaccatggtccctcacttcacctgcttgccnagcaccaagtcttgccaagaaccacagcag

SEQ ID NO: 10926 - DNA, 101 bp, rice(Oryza sativa)
  misc_feature (71): n=a or g
gaatttaaattttaaaacttagaaataaagctgagaaataaataggattagacggtaaacccggccgctcntgcatcacagaaccttatcctgttcgctcc

SEQ ID NO: 10927 - DNA, 101 bp, rice(Oryza sativa)
  misc_feature (71): n=t or c
gaagctcatcacgcgagctcactacaaatgacaaaacaaacaccagtttttcttcttcttcttcttcctcnggccaaaatcactccaccgtgatcctacca

SEQ ID NO: 10928 - DNA, 101 bp, rice(Oryza sativa)
  misc_feature (71): n=t or g
gggattgttgcgttagcgtttgggttgcggggtggtgtggtttggtggtgggggcggttgattgcgggtgnaatggtggtgtggtggtgcggggggattgg

SEQ ID NO: 10929 - DNA, 101 bp, rice(Oryza sativa)
  misc_feature (71): n=a or g
tgaaggcgacagtgatctgcatgatctggtcctcgctgaaggagtcactggagctgaagagcctgatgtcnttgtggttggtgaggtggtagttggagatg

SEQ ID NO: 10930 - DNA, 101 bp, rice(Oryza sativa)
  misc_feature (71): n=t or c
gagaaatatctctacaattctcgactaaaagaaagcaacttacagtgtgttgtccaagtgaatgggctagntgatgccttggggttcggtcttccacttga

SEQ ID NO: 10931 - DNA, 101 bp, rice(Oryza sativa)
  misc_feature (71): n=t or c
gagaagttgaacccatccaaacagcttccttcctcccccctcctggctccgctcgctggatctctcctctntctctctcgcaccctctccccggcgaggta

SEQ ID NO: 10932 - DNA, 101 bp, rice(Oryza sativa)
  misc_feature (71): n=a or c
gggggggggagagtacagagctgagttgattccgaaaacagaaatggggaaaaaccgaaagcctccaaacngtaaccctaccccgtataaaatcccacaca

SEQ ID NO: 10933 - DNA, 101 bp, rice(Oryza sativa)
  misc_feature (71): n=a or c
tcgtgtactagatcattttcattcatctcaaacaatgaaacgccgccaatatgagtgagcacatacacctnttttttcttcatggcccaacgtattgggcg

SEQ ID NO: 10934 - DNA, 101 bp, rice(Oryza sativa)
  misc_feature (71): n=a or c
aatctaaacaactttcctttgttgaccatcgccgccttcttttttcagatatttcaataccgcacttgtcnatgatgtcttgataatttatcttgcaagac

SEQ ID NO: 10935 - DNA, 101 bp, rice(Oryza sativa)
  misc_feature (71): n=t or c
gaagcacttggtcgctgatgcgttggccaacaacctttggatctgcgatctccatggctccttgggagtcnaggcaatcttgcaatacttgcatatttggt

SEQ ID NO: 10936 - DNA, 101 bp, rice(Oryza sativa)
  misc_feature (71): n=a or c
cccacaaccaaccgcaaggtatcataaaacaaagtgctttgttcaccacacagaagagcattttaagtgcngtctttctaatcaggaaattattatttgtt

SEQ ID NO: 10937 - DNA, 101 bp, rice(Oryza sativa)
  misc_feature (71): n=t or g
cccccagatggtactgcccaatgactaaaagcctcccaacacggcgcttgagcacggtaaacaggttatancaattgtccgcgccaatataaacgtagtcg

SEQ ID NO: 10938 - DNA, 101 bp, rice(Oryza sativa)
  misc_feature (71): n=t or c
accattgatttgagggtgataagcagaactcttgtgtagcttggtgccagatttagtgaataagaattccnacagttgactagtgaatattctatcacggt

SEQ ID NO: 10939 - DNA, 101 bp, rice(Oryza sativa)
  misc_feature (71): n=a or g
acaaccttgcagcgtttcatggggcaatgattcatcagggaattcaataaagcaagcagattcaggtggtntttgaatcttctgaagataaacatgaagat

SEQ ID NO: 10940 - DNA, 101 bp, rice(Oryza sativa)
  misc_feature (71): n=t or c
caggattatgaacttaggggatctagcgagatgtcccaagaatttgtgcaacctactcttcagagtagtanaatccaagctcctagcgccccttcacagta

SEQ ID NO: 10941 - DNA, 101 bp, rice(Oryza sativa)
  misc_feature (71): n=a or g
accacgatcggatatcgccctggtgtgacggtagtctttgggtggtcgacttctgagaactcgatcttctnctctgaccaattcatcttggatgcagcccc

SEQ ID NO: 10942 - DNA, 101 bp, rice(Oryza sativa)
  misc_feature (71): n=t or c
aaagaagtagatggtacagaactacagattacttactgttagatagggtctcatttgctcctgtgaagggnatagtagctgcgcaagattgtgattttctg

SEQ ID NO: 10943 - DNA, 101 bp, rice(Oryza sativa)
  misc_feature (71): n=a or g
caacagtccatacttgtatgcatgactagaacatatacataatgcagccattttatgttccttgggatatngtattcgttgctgattcttgaattccttca

SEQ ID NO: 10944 - DNA, 101 bp, rice(Oryza sativa)
  misc_feature (71): n=a or g
caggctagtggtggacacttgtttcatagccctttgcctagtgcatctcattgtttcttctagattttcangtgctagcactctcttagatgctcttcctg

SEQ ID NO: 10945 - DNA, 101 bp, rice(Oryza sativa)
  misc_feature (71): n=a or g
tctgttgtctgacatatctataaagaagaggaggtttagggagttgatccaacctggtattggtccagtgngtcggttggcacttaatattaacatttcca

SEQ ID NO: 10946 - DNA, 101 bp, rice(Oryza sativa)
  misc_feature (71): n=t or c
cgtcacgttctctatcctcttgcacgggaacccgttcagccgcagcgctgcacgacatacatatatacgtnaatatgaatcttcgcactgtcttgtacggg

SEQ ID NO: 10947 - DNA, 101 bp, rice(Oryza sativa)
  misc_feature (71): n=a or g
gattttccagggaagaacggcattgtgggatgctatcttgcttctgtgccaccaaataaatgttggttatngcggtgtagttaggggaatccacataggtt

SEQ ID NO: 10948 - DNA, 101 bp, rice(Oryza sativa)
  misc_feature (71): n=a or g
gttttttcctccagcgaatcacccaacgacagatctttctccttcaaccatttaggaaacttccgtttctnttctttacaaatccaaatgtccgttcttct

SEQ ID NO: 10949 - DNA, 101 bp, rice(Oryza sativa)
  misc_feature (71): n=t or c
acatcctgttaatatataaaggcacatgttcagcaagcactcatacgccactgctacaagtggaaatacantattagtagttaaaacaaacttttgttaat

SEQ ID NO: 10950 - DNA, 101 bp, rice(Oryza sativa)
  misc_feature (71): n=t or c
agtgacaggtgatgccacaatttctccagggtgtttttcgcgaaaatgtttttgcattgtaattttgagcnttctttcagggtgtttttggtgaaattttt

SEQ ID NO: 10951 - DNA, 101 bp, rice(Oryza sativa)
  misc_feature (71): n=a or g
tcagtgttgctttctcatctggcttccccacacaatcaggatcatcattgcaaaagaaatgaaaaatcccnatgcagtgaagaggagaagtacaacatcta

SEQ ID NO: 10952 - DNA, 101 bp, rice(Oryza sativa)
  misc_feature (71): n=a or g
aaactaacaaatgcactaaccccctccctatactcttcagaatcacggtgaatattgtacatccaacttcngtccatctgcaatcaataaatagagtaaaa

SEQ ID NO: 10953 - DNA, 101 bp, rice(Oryza sativa)
  misc_feature (71): n=t or c
ggaaaaaactgcatctgatggagctgttaaaagtgccgagcatgagaataaaacagtagagcagaagacanttaaagatgatgcatggaaatcacatgata

SEQ ID NO: 10954 - DNA, 101 bp, rice(Oryza sativa)
  misc_feature (71): n=t or c
gtacaagttcataaggttgcaaacttcagtaggaaatgttttgagccagttccgtgaaagatcaaggtatngaagggagataaaagaacacaagccagtta

SEQ ID NO: 10955 - DNA, 101 bp, rice(Oryza sativa)
  misc_feature (71): n=a or c
ctctttctgcagctcctctacaaagattccattctcctgatcacggcgttttgtgtcactctggatactgntccttgtttgatcttttgctgcagctaaat

SEQ ID NO: 10956 - DNA, 101 bp, rice(Oryza sativa)
  misc_feature (71): n=t or c
cctatcagtatgcatcttgagaattggtaagtcgtaagcatgaaaagatcatgtagcacagcccggtctcntgttattaagtagtccatctcatccacaac

SEQ ID NO: 10957 - DNA, 101 bp, rice(Oryza sativa)
  misc_feature (71): n=a or g
agcacacagcaaaaaaaaaaagaaatccaaaagggtggagttggagctcaggaatccatccccagacagangaggaggaggaggaaggggtggtcgcctcg

SEQ ID NO: 10958 - DNA, 101 bp, rice(Oryza sativa)
  misc_feature (71): n=t or g
acttgtttaatctacggttcttgggtcttcgcaaaacatatatcgagtatctcccaaaagaactgagtagnttacagaatttggaagtcctggatgcttat

SEQ ID NO: 10959 - DNA, 101 bp, rice(Oryza sativa)
  misc_feature (71): n=a or g
tgctgacggttcctcttttcttcccgctccgagaagttcatcatgaaatcgatgaggctatccgtccttcngggttggagcttgacctccttaaagttctg

SEQ ID NO: 10960 - DNA, 101 bp, rice(Oryza sativa)
  misc_feature (71): n=t or g
gaactgccgattgcggaattcaacgaagaaaacggctcgcgacgtcaaattcctcaaggcaaggtattatnaggatcatcacatcgatatccctccttctc

SEQ ID NO: 10961 - DNA, 101 bp, rice(Oryza sativa)
  misc_feature (71): n=a or g
gtccctgggcaccatctcgacctccccctgaaacttcccaatcaatcgatcaatcaaacaaactctggtcnatttccccccaccgcgcggtgcagctccgg

SEQ ID NO: 10962 - DNA, 101 bp, rice(Oryza sativa)
  misc_feature (71): n=a or c
ctccaaaccaagttgctctatcccaattttgcatgagtccaggtttctcgtaaggtggcaaactaggcagntaaacaatttgtaactacactacagtgaga

SEQ ID NO: 10963 - DNA, 101 bp, rice(Oryza sativa)
  misc_feature (71): n=a or g
tgcagtgcatagcttcccttcttgtcaccttccaggagtactctgggatggagacctacgagcgagactgncgaccagggttaaactttcggtttagccga

SEQ ID NO: 10964 - DNA, 101 bp, rice(Oryza sativa)
  misc_feature (71): n=a or g
tcatcctttctggcggagaggcgaccctcacaggtgcggtgtttcatcatatgagctagagtgtagcagtngcaaggccaccatccagatcaatacaggaa

SEQ ID NO: 10965 - DNA, 101 bp, rice(Oryza sativa)
  misc_feature (71): n=a or g
gcacaagcggaggatgtccatgatcaccacgaagctctccttgaggatgacatcataatcaatggtgaccngctctatcggccctatagtcgaggagaagc

SEQ ID NO: 10966 - DNA, 101 bp, rice(Oryza sativa)
  misc_feature (71): n=t or c
actgcttgtaactttcttccaagaaattagagagttcagacgcatacagtacagtgtggttgttgctagtngatcagttataccaaagtgtagaacactaa

SEQ ID NO: 10967 - DNA, 101 bp, rice(Oryza sativa)
  misc_feature (71): n=a or g
atatccatttcagagattgaaaactggtaaaaacgccgcacatgcatgcatacacgccaaaacaagaacanaatctgctcagttgaacccccaaacctttt

SEQ ID NO: 10968 - DNA, 101 bp, rice(Oryza sativa)
  misc_feature (71): n=a or g
tcctcaatcaatggtcattgctgaccttggctgctccttcggtgcaaacacactcctcttcatctctgagntgatcaccacaatatatgaggactataaca

SEQ ID NO: 10969 - DNA, 101 bp, rice(Oryza sativa)
  misc_feature (71): n=t or c
ttacttgaaccctagaattcctggcatagctaatttctccttcccctccgaccatgtggaaatcacgttcngtgttgatcatggttgtattttctgatggg

SEQ ID NO: 10970 - DNA, 101 bp, rice(Oryza sativa)
  misc_feature (71): n=t or c
ggatcactatcacctcctgattcttgaccatatcttggatgagcgtcttttcgaggttagaaacagctacngccatgcttttgtagtaggcatgtttcaac

SEQ ID NO: 10971 - DNA, 101 bp, rice(Oryza sativa)
  misc_feature (71): n=t or c
cccacacgcttgaataaaaacgcgatttcgcgagccaaaaatccttgtcaaacttggcattccccagcttntccccccattccccctccctctctcgccat

SEQ ID NO: 10972 - DNA, 101 bp, rice(Oryza sativa)
  misc_feature (71): n=t or c
gagttcatgagttacttccgtaaactcggtaaaacttcttggcacaaaattgctagagagctgaaggattngcaatgtcaccttcagaatctccggaattt

SEQ ID NO: 10973 - DNA, 101 bp, rice(Oryza sativa)
  misc_feature (71): n=a or c
cctgtgaatggagcagtcttgtaatggatctgaatgtgcatcagcctcactatcgtatcctgctgtacttnaaggtttggcggaaccgatgtgtcggatcg

SEQ ID NO: 10974 - DNA, 101 bp, rice(Oryza sativa)
  misc_feature (71): n=a or g
ttaacgctcgaacgaatattaattaattaccgtcacaaaccacaccgtagaattcacacagctagcgttangccatgagcccgtccgatcaggtgttgctc

SEQ ID NO: 10975 - DNA, 101 bp, rice(Oryza sativa)
  misc_feature (71): n=t or g
atgcatcgaaccatagagtaatttgctcaatacagtcattcccggatgatcatggagaggaatgaccgccnacgttggtaagcagaatattccaatctatg

SEQ ID NO: 10976 - DNA, 101 bp, rice(Oryza sativa)
  misc_feature (71): n=t or c
tatcagtaacccaaattgacgcgattctatcaatcagtcacccagagtagttacgggtcaatctctctcangtatcagtgatgtgtgattgatctgttcaa

SEQ ID NO: 10977 - DNA, 101 bp, rice(Oryza sativa)
  misc_feature (71): n=a or g
caaactacgaaaataaaacgcacacgactacaaaccacgatgataaaaagcacacgatagagatagaatgnatatgatttgaaaggagcggcggccggcga

SEQ ID NO: 10978 - DNA, 101 bp, rice(Oryza sativa)
  misc_feature (71): n=t or c
attggaggaagatctagaggagcttgaagcagatgcaagatggctagccctagccacagttcatacgaagngatcgtttagtcatggggctttctttggga

SEQ ID NO: 10979 - DNA, 101 bp, rice(Oryza sativa)
  misc_feature (71): n=t or c
gtcaaaagtagacaaatttaattgcttaccttgaatgctttccaacagtacaatgtggagctggagaagangccacagattaaacctacagtaagcaaaat

SEQ ID NO: 10980 - DNA, 101 bp, rice(Oryza sativa)
  misc_feature (71): n=a or g
ttctcactcttgttcttgttcttgcttcttcaggtttgtagagagagagagggcaaaggcacgcaaagagngagagagtgaggagagatggcggcggaggg

SEQ ID NO: 10981 - DNA, 101 bp, rice(Oryza sativa)
  misc_feature (71): n=a or g
caacttggccataacaagaaggggcgtcaattgagaaagacaggattaaggcctaaacaacaaccaaaganaaagatcacgccactggttgatgatgaagc

SEQ ID NO: 10982 - DNA, 101 bp, rice(Oryza sativa)
  misc_feature (71): n=t or c
acttaggagtataataaatccaacactaccatgaagattgaggacctctgtttttccaactactacggccnaagtttagttccaaactttttcttcaaact

SEQ ID NO: 10983 - DNA, 101 bp, rice(Oryza sativa)
  misc_feature (71): n=t or c
ggatcttttgtttatttttttacatatataggttgataatggtgtctcgacaggatgctataatctggacngtgatggttttgtacctgtaaacaattccc

SEQ ID NO: 10984 - DNA, 101 bp, rice(Oryza sativa)
  misc_feature (71): n=a or g
catcttttatttttatctagtctgctactgtatttgctctcacaagcgtacaacatgtgttatctccaganagtggtcaacaaccctgaaaagcagctcct

SEQ ID NO: 10985 - DNA, 101 bp, rice(Oryza sativa)
  misc_feature (71): n=a or g
agtcccactgatgaattcaagtccaacaattagccgtatccatgcacggattttcttcaacataactgctntgtatatatgggtagcgtctttctccaatg

SEQ ID NO: 10986 - DNA, 101 bp, rice(Oryza sativa)
  misc_feature (71): n=t or c
ggtgatggtccccgctgcccatactgaatgtgttcattggcacggcaaatgcaccctctcccttgacgatngatgccctcagcatcacaacgtaaagacgc

SEQ ID NO: 10987 - DNA, 101 bp, rice(Oryza sativa)
  misc_feature (71): n=a or g
ccatccgggcgtgctgtcaaactgaacataaggtattggcgtgttccttcttgactcgcacggtcacgccntgtttttgatggagtaaaacatcccggtca

SEQ ID NO: 10988 - DNA, 101 bp, rice(Oryza sativa)
  misc_feature (71): n=a or c
gttgatccatggctggcagatagtgagaggaatagaaacgagagctacgcaaaacagagttatgaacatanctgttagcagctgatcctgagaggaaacag

SEQ ID NO: 10989 - DNA, 101 bp, rice(Oryza sativa)
  misc_feature (71): n=t or c
taccggtaaattggatcaagatgcttctggaaggcattgtcaaatgctttctgaaagacacaatcaaatgnttcgattgccctttgctgggaaatagcatt

SEQ ID NO: 10990 - DNA, 101 bp, rice(Oryza sativa)
  misc_feature (71): n=t or g
tgtgaccagggtggtttttcccagtccacccattcctgacaccgttatcaccttattgtccaactcatcanaatatagccattctgtcagcagtctcctat

SEQ ID NO: 10991 - DNA, 101 bp, rice(Oryza sativa)
  misc_feature (71): n=t or g
ttctgctcactaacagaggtcatcgtacaaatctcagctttagctgtcgcgttagaagcagcagattcctncgcttttgaagatttcttcgacctgcttga

SEQ ID NO: 10992 - DNA, 101 bp, rice(Oryza sativa)
  misc_feature (71): n=t or c
gagtatcaactaaaagaaaatccaagttcattttctgaacaaagaagcagcttcctgagattacctacganatgcatttcctgatctcccaacaatgagga

SEQ ID NO: 10993 - DNA, 101 bp, rice(Oryza sativa)
  misc_feature (71): n=a or g
gtggcgttttataaacagatagcgtggattggtacgtgtcacgtcaggaattaccaaaccaaccaattcantctctaaatctaatcctcgaaactaacgaa

SEQ ID NO: 10994 - DNA, 101 bp, rice(Oryza sativa)
  misc_feature (71): n=t or c
ataaataaaaaataaaaaatctcaagttcagtgttacggtttagttgaagactttgatactgaacagaacnatgagaaattaatccagtctctaggagagc

SEQ ID NO: 10995 - DNA, 101 bp, rice(Oryza sativa)
  misc_feature (71): n=a or g
caagtgcactatatgcctcccagcctggttgtcaacatcaacaaatgccatcactgccatgtcatcatcangtctagctatcttcaccaccctcaaattgt

SEQ ID NO: 10996 - DNA, 101 bp, rice(Oryza sativa)
  misc_feature (71): n=a or g
ttgcaatggttacgagtagattgggttgatcgagttatcctttctttggtcctggactggactagtggacngggagattggaggtgctcgtggagaaactg

SEQ ID NO: 10997 - DNA, 101 bp, rice(Oryza sativa)
  misc_feature (71): n=a or g
aggaggagtaactgatttggctgacttgcggcccgtaattattggctttcttcttatcagaaaactacganattaatgaaccggatggaggcagcaagaag

SEQ ID NO: 10998 - DNA, 101 bp, rice(Oryza sativa)
  misc_feature (71): n=a or g
atgaggacaactgtgcactttgagtttattcatgtttggaagccatgtcttctcctcacagtggggtggtnaaacttgcaagacttgaaaactggtcaatt

SEQ ID NO: 10999 - DNA, 101 bp, rice(Oryza sativa)
  misc_feature (71): n=t or c
acatttatatgcgatgaagtcggctattgggatgttgtcaactgacaaacttgtgaaaatcatcagagacngaaaaaacgagatgccgactgaggtgcaaa

SEQ ID NO: 11000 - DNA, 101 bp, rice(Oryza sativa)
  misc_feature (71): n=a or g
tcttgctcctcgatctccctctgcaataagtcgatctctttgtcccatatccaggtgttgagtatctcgcnctctgcttcctctcttgtcgccgccaaatc

SEQ ID NO: 11001 - DNA, 101 bp, rice(Oryza sativa)
  misc_feature (71): n=t or g
tgtgatgacctaatagttgaaacaagggaaatgtttgtagacatcctcaatccatttgcaaaaatgaagcntatcgatgcacttcaacgtcttggagtatc

SEQ ID NO: 11002 - DNA, 101 bp, rice(Oryza sativa)
  misc_feature (71): n=t or g
cgacaagctacagtacctggagacacttgacatccggcaaacccagataaaggcattcccaggaaagcatnttatccttcctgggctgaagcacctacttg

SEQ ID NO: 11003 - DNA, 101 bp, rice(Oryza sativa)
  misc_feature (71): n=a or g
ccatttgcattaacatccatgtcatattgcatgccttgttgatcattatctacaaaaaaaatcacttgctngtcagtgccctttatctagacacaaagaac

SEQ ID NO: 11004 - DNA, 101 bp, rice(Oryza sativa)
  misc_feature (71): n=t or c
acctagctaccctaggtccagatctggaaccactccaatgggatctgagcgtctctccagcacgagaggcnagatccccagtcgcggccacattgtcggtg

SEQ ID NO: 11005 - DNA, 101 bp, rice(Oryza sativa)
  misc_feature (71): n=a or g
atattttgcatccacagtgccttaccttcggggctggagtgtcttcagcaaaatactccgtgctttcttgnttctccacattgtgagcctttcaccttttg

SEQ ID NO: 11006 - DNA, 101 bp, rice(Oryza sativa)
  misc_feature (71): n=t or c
ttcgagttcagttttcatcacctctcaagcctggaggaccttcatgccacgattagttgttatagagccantagaagtagcgtggaggctgcagaagctgc

SEQ ID NO: 11007 - DNA, 101 bp, rice(Oryza sativa)
  misc_feature (71): n=t or c
gagaacatgagtggcttgcggcaggttctctcagatttcagattcgtgaagcaaggtgagggaggcgaganggatgctacagaatgggcgctgaactatat

SEQ ID NO: 11008 - DNA, 101 bp, rice(Oryza sativa)
  misc_feature (71): n=a or g
ctagcaagagagagtgagtgcttgcttggtgtgtgggtgatgagcaagttgcagtggtgaaggggaaagcnagctgaggagaagtagtggaaagatgtata

SEQ ID NO: 11009 - DNA, 101 bp, rice(Oryza sativa)
  misc_feature (71): n=t or g
gacacccctgctcctcctgaagcaaaattgacacccttcagatatacggagctgttcattggtttgctgcntatagagaggtatggaggagggctgggcac

SEQ ID NO: 11010 - DNA, 101 bp, rice(Oryza sativa)
  misc_feature (71): n=a or c
ttaccaccattgccattctccccctataaatacacgcacgcaccctcttcttccacctcgagccagccatngcctcctctcctctccacgcgacgagcaag

SEQ ID NO: 11011 - DNA, 101 bp, rice(Oryza sativa)
  misc_feature (71): n=a or g
ttctctcttaaattggaaacagaattcaacactttcattctacacacaatacaaaccatccgacctatgcnattgtgcaaaaggactacaccggcttttct

SEQ ID NO: 11012 - DNA, 101 bp, rice(Oryza sativa)
  misc_feature (71): n=t or c
ttacaatttaaaatgttatcattcatttcagtgttatttctgcctgccattcttacccaacagatttcccngctgtccgaatatttacttgaattagtttg

SEQ ID NO: 11013 - DNA, 101 bp, rice(Oryza sativa)
  misc_feature (71): n=a or g
ttttgagttacggctgacacataagagtagtggagtgtcgttgactaactcgatggtcaccaagcagatgncatatgtcggagcaaggtctagcaaatcta

SEQ ID NO: 11014 - DNA, 101 bp, rice(Oryza sativa)
  misc_feature (71): n=a or g
aactttagtggtttctcaatactgtcaaccacctttaaactggatacgaacatttttagccagttcacctnccccgtggcctcatagcatgctataaactc

SEQ ID NO: 11015 - DNA, 101 bp, rice(Oryza sativa)
  misc_feature (71): n=t or g
tgatcctttgacctcaacctttgcctttcctttgtttacctccccttgttgttccaagtttctaatgaacnaaaaatgaatttttttgacgatgtttgtca

SEQ ID NO: 11016 - DNA, 101 bp, rice(Oryza sativa)
  misc_feature (71): n=a or g
tgtctcaagatcttcagcaattgaggctgttgcttgttccttatcatgggacgacaccacttcagaatcancattacctggcacccgagggcagtcttctt

SEQ ID NO: 11017 - DNA, 101 bp, rice(Oryza sativa)
  misc_feature (71): n=t or c
ctgactgggggtaaagcaccggtctgactgcctgtctcgggacaaaacgcagtttttgccatctctttttngcaaaagcaatttcccgttcctttttctgt

SEQ ID NO: 11018 - DNA, 101 bp, rice(Oryza sativa)
  misc_feature (71): n=a or g
gaggtgctgcagcagctaaggaagcagctggagtacccaaggcagctggatgtatggaataacccaaacantgacccctgctacacccagcctacttcggt

SEQ ID NO: 11019 - DNA, 101 bp, rice(Oryza sativa)
  misc_feature (71): n=t or g
aacgattgactgtagcttgcttactgtgagctaactattgccttgttcatgcagttggcccctggcttttnctggaaagttcataccggttccccgaactg

SEQ ID NO: 11020 - DNA, 101 bp, rice(Oryza sativa)
  misc_feature (71): n=t or c
caacaccgattcaagctggagaaggctaggcaaaggttaactgatcaccgggagtgccaaaatattgaagntacaatccagcacaatcagcagcttgtgca

SEQ ID NO: 11021 - DNA, 101 bp, rice(Oryza sativa)
  misc_feature (71): n=a or g
gactctactcttgcaagattatgatcatgtaccgtatttgcatcatgttggttacttgccatgtgttgtcnaaggtgaaaatgtccacattgagcacgaac

SEQ ID NO: 11022 - DNA, 101 bp, rice(Oryza sativa)
  misc_feature (71): n=a or g
ctcacattcctcttcatgcaagtgtgaatttgtcttttgacactgaactgtactggaacagctagctgatntttccaagatttgaggatccgtgctttggt

SEQ ID NO: 11023 - DNA, 101 bp, rice(Oryza sativa)
  misc_feature (71): n=t or c
gcggcgagcggcggattttggcatgtgttgaagcaggtcacggcggcggcatcgaactcgtccttcccaanggcggcggcgttgaagcaagcggcggcggt

SEQ ID NO: 11024 - DNA, 101 bp, rice(Oryza sativa)
  misc_feature (71): n=t or c
tgaaacattacaaagttcagagcaagcagtagaatttcctcaaagggctcctttagaaaacaaagggtttntcaaggaatttgggggtaattcaatccttt

SEQ ID NO: 11025 - DNA, 101 bp, rice(Oryza sativa)
  misc_feature (71): n=t or g
ttgctgcctttttggaagggattgagctaagcatgcatgctcatatacaagtaactaccaatctactccantagtaattaaggtagctagctaggtaatta

SEQ ID NO: 11026 - DNA, 101 bp, rice(Oryza sativa)
  misc_feature (71): n=a or g
gcattatagatgtttcttgccgtggtggttgggcagcagctcttagcttccaccttgatcgtctcttgctncaggactaagcctagcaccagcacacacat

SEQ ID NO: 11027 - DNA, 101 bp, rice(Oryza sativa)
  misc_feature (71): n=a or g
cccatctttgggcccggggtcctctatggcgtggacctggaaaccagaaaagagcagatacgcttcaactnggacattctcaagccacgtagcctcaaggc

SEQ ID NO: 11028 - DNA, 101 bp, rice(Oryza sativa)
  misc_feature (71): n=t or c
gactatgtaatatattcaaagattttgtaatgttcgcagccgatgttgtagtttaagtctaagtgatgagnagttagcagatcttgcatttcaaggattgt

SEQ ID NO: 11029 - DNA, 101 bp, rice(Oryza sativa)
  misc_feature (71): n=a or g
agctctccttccaaaccattcttcagaaaagagaggtgctccaacatggaagcatcaaagagctcatctgncaagctgccattgatctcgttgttgctagc

SEQ ID NO: 11030 - DNA, 101 bp, rice(Oryza sativa)
  misc_feature (71): n=t or c
caccgagggagatgcatggagcatagagaaaaggttgagagagaaagtggagggaggagagaaaaaggaangagagaaggaaacatatgtgacactgacat

SEQ ID NO: 11031 - DNA, 101 bp, rice(Oryza sativa)
  misc_feature (71): n=a or c
tttcgtgattctgcttgtttctattactactaggaaaaactgaaggaagtggaaaggcatgcagaacttgntgaaaacactgttgatcaccacattcacag

SEQ ID NO: 11032 - DNA, 101 bp, rice(Oryza sativa)
  misc_feature (71): n=t or c
tcctgaatccctttatttgatcagcttgtggcagacctgaagtcaagatctttttgcaaaagtggatctcntaattccagccctggttcagggcacaacaa

SEQ ID NO: 11033 - DNA, 101 bp, rice(Oryza sativa)
  misc_feature (71): n=t or g
agtttgatgatgaatgagaatatgagagctatgctgtccaagattaaatttgatctgttagtgcgcaattnagttgcattcttagtgtggctgtttgaagc

SEQ ID NO: 11034 - DNA, 101 bp, rice(Oryza sativa)
  misc_feature (71): n=a or g
agcaattgcctaaacgtcacccatgggaacatattcatgggatatcgttgcaagtgccttcccggttttcnagggaatccatatatccaagatggatgtga

SEQ ID NO: 11035 - DNA, 101 bp, rice(Oryza sativa)
  misc_feature (71): n=t or c
atccgaatggcgctctcgtccaccaagaagggaacacgcactattgcggaatatgttggtaagatgaaatngttagcagatgacatgtcctctgcaaggaa

SEQ ID NO: 11036 - DNA, 101 bp, rice(Oryza sativa)
  misc_feature (71): n=a or g
cctgtaaggcccaacatggccatcaggtctcatggacgaaatgctgtaggtatccaagagcttcagattcncagagttccgcgaaccacctagtgccgcca

SEQ ID NO: 11037 - DNA, 101 bp, rice(Oryza sativa)
  misc_feature (71): n=a or c
agtagctcctcactgaacataaggtagggatagcatctccaagatcgtaaaaatgaatgagacacacaagnagcacgagcagcatctcgaagtggcattaa

SEQ ID NO: 11038 - DNA, 101 bp, rice(Oryza sativa)
  misc_feature (71): n=t or g
ggagtgattcctctgtggcgcatgtctcctccatcaataacactttgaagaagcctctgcatgctgcattnagcagggtgtccaatctgcacccagagaac

SEQ ID NO: 11039 - DNA, 101 bp, rice(Oryza sativa)
  misc_feature (71): n=a or g
atgctgttagctaagctgtgcatgcatcggcagaatcctatgacttgctctgactttgagtcactgacatnggccaactggatagagggcacacatatcag

SEQ ID NO: 11040 - DNA, 101 bp, rice(Oryza sativa)
  misc_feature (71): n=a or g
caggaggaggaagaggacaacgcggctgctgctgctactgctgacgaagatgtagatggaaatcactggtngagaaaccatctttggtcggtcggcccaat

SEQ ID NO: 11041 - DNA, 101 bp, rice(Oryza sativa)
  misc_feature (71): n=a or g
aatctgcacaaatggctcctgtaaggtgtactcaacagcagggtaggcataagcatttgtgttgtacatgnttttgttgcctgctgacatgacggccggct

SEQ ID NO: 11042 - DNA, 101 bp, rice(Oryza sativa)
  misc_feature (71): n=a or g
tctatgcaaaatcctagttaagatgcctaacttgagagatttagatataagtgacaatccgatcatggacnaaggaatcaggtattcataactctgaaccc

SEQ ID NO: 11043 - DNA, 101 bp, rice(Oryza sativa)
  misc_feature (71): n=t or c
aatttgacagatttaaacgttgctggtaatgtcttccatggatatgtcccatcaaatatagctgggctaanaaaccttttagctttgagcttgttaggaaa

SEQ ID NO: 11044 - DNA, 101 bp, rice(Oryza sativa)
  misc_feature (71): n=t or c
tgatcatatgtcacgcctcctccttgctcattatctaccatgtaactttcccagactctattgatttctantgtgggacatcctgggtgggcactggctgc

SEQ ID NO: 11045 - DNA, 101 bp, rice(Oryza sativa)
  misc_feature (71): n=t or c
atcctcgaaaaccttcttaccttcgatcgaggcagaggagaatccgacgaagaattcaaattcgccgaagnaaacactgagaggagatgattcgtgagcgg

SEQ ID NO: 11046 - DNA, 101 bp, rice(Oryza sativa)
  misc_feature (71): n=t or c
cacagacagacaacaccctcccttcaaattccacaagatacggaccacgcaagtaaacactgtaggatgancaatactgcccatccaaatgaaacaccatc

SEQ ID NO: 11047 - DNA, 101 bp, rice(Oryza sativa)
  misc_feature (71): n=a or c
cagcctccaatccacttgacggttatcgtttttaaccttgttgacagccaaatccgcaccactacccttcntcctcgccgtcctagtttgatgaccaacgc

SEQ ID NO: 11048 - DNA, 101 bp, rice(Oryza sativa)
  misc_feature (71): n=t or c
gttgttcctgcttctctctgttcaagggtctcaccaatgcaagcaattaccttgataccttgggaaagtgngtacgcaattttgtcagcaacaaactgtca

SEQ ID NO: 11049 - DNA, 101 bp, rice(Oryza sativa)
  misc_feature (71): n=a or g
gccagttttgtcaatccttgcaaaggcaattggtgaccttgctaccaaggaaaaaactgtttacagtccantactcaagaaatggcacccacttgctacaa

SEQ ID NO: 11050 - DNA, 101 bp, rice(Oryza sativa)
  misc_feature (71): n=a or g
tccaaattccaaagatacaacaatagcaggaaatgctaagtcgactagtttccgtaaatgacaccatttgngctcacaggagagccattgtgttgaagatc

SEQ ID NO: 11051 - DNA, 101 bp, rice(Oryza sativa)
  misc_feature (71): n=t or c
ccatttatttgtaattcactacatatatattgacatgtttttttccctacagagtatgcaaccgcgcaggnaaatgagaaggtggacgtgtacagctttgg

SEQ ID NO: 11052 - DNA, 101 bp, rice(Oryza sativa)
  misc_feature (71): n=t or c
gtgagaagaccaagtccaagagctcattcaaggggaggaagaccaagaaaatctcaagaagatgttgaatnaagtctacgccgcttttgaatcaagtataa

SEQ ID NO: 11053 - DNA, 101 bp, rice(Oryza sativa)
  misc_feature (71): n=a or c
ggaaaatcgaatgcaacatgagcttggcataaaatgggtgcagtattgatataacgtacctaattctatgntctgaatgatgtactttttgtaactcatct

SEQ ID NO: 11054 - DNA, 101 bp, rice(Oryza sativa)
  misc_feature (71): n=t or c
tccagccagagtatcttcaatttcctttggtgtgatttcattttcatgaagaagtaagcagtgctggcgtntccctctcgaaggtttctgaccctggcacg

SEQ ID NO: 11055 - DNA, 101 bp, rice(Oryza sativa)
  misc_feature (71): n=t or c
atttaaggggagaggagacgaagttgcagtggtcagtcaaggtgaacgaacgaatgaatggatcacgtcantcttcttctttcttctccagctgctctcaa

SEQ ID NO: 11056 - DNA, 101 bp, rice(Oryza sativa)
  misc_feature (71): n=t or c
acaagaagtggtccaagcatccagtcaaacactttgtctttaggccagttgaagtttgtcacttcaacatngtcagctacaacgacagaagaataaaagag

SEQ ID NO: 11057 - DNA, 101 bp, rice(Oryza sativa)
  misc_feature (71): n=t or c
ggagctatgcaagcagaagaatattgaagaaacggaaggggaaaaaggggaagctacgactcaactacctnaggacaggacagtggcgcaagctgctgatg

SEQ ID NO: 11058 - DNA, 101 bp, rice(Oryza sativa)
  misc_feature (71): n=t or g
gctctctttcccttggaaaaaaaaaagaaagaagaccgacacatttaatgcttatgtatatgacggaaaanttgaaagtttgacgaaaaaattttaaatct

SEQ ID NO: 11059 - DNA, 101 bp, rice(Oryza sativa)
  misc_feature (71): n=t or g
tactctagttgcatacaagagaggaatgggtctgacgaacatcagacattttctaaaagcaatggcagttnttaccttaaggggtcatgctcagagcaacc

SEQ ID NO: 11060 - DNA, 101 bp, rice(Oryza sativa)
  misc_feature (71): n=t or c
acttcaatctttcaaagggagacaatatttagttttccatgccttagggtattggtcctcaatgggaaagntatcgagaaccttccaagcagtatagaaaa

SEQ ID NO: 11061 - DNA, 101 bp, rice(Oryza sativa)
  misc_feature (71): n=t or c
ccttcagcagtccgtgcagacaaggctatcttcagtcccagacgacggaccttcttttgcaacttgattgnatggcttcgtggtttaggtccatgcatagt

SEQ ID NO: 11062 - DNA, 101 bp, rice(Oryza sativa)
  misc_feature (71): n=t or g
tcgtcacacgtttcgttaccaacaaccaagtcgagcactagaggaaccccggtgcccttatttcgatactntgaataaagttccatcgatttggcatatga

SEQ ID NO: 11063 - DNA, 101 bp, rice(Oryza sativa)
  misc_feature (71): n=t or c
gggttccctacactgatgctttttatccacggggtccccatcgaatacactggttcaagaaaagctgactngcttgtccgcaatcttaataagtttgttgc

SEQ ID NO: 11064 - DNA, 101 bp, rice(Oryza sativa)
  misc_feature (71): n=a or g
tctccaagaatgttttgagaaccaaaattctccgtagctaacttaagctccgcattgctgaagacattacnccttccaaccatgttgtagagttctgccaa

SEQ ID NO: 11065 - DNA, 101 bp, rice(Oryza sativa)
  misc_feature (71): n=t or c
cccatggctgcacagagaagatgctcttatggtggcaaagtttgatggaattactagtccgtcacaggttncccttgaggtagttcccatctaggttagta

SEQ ID NO: 11066 - DNA, 101 bp, rice(Oryza sativa)
  misc_feature (71): n=a or g
cagcaaggaacttctggcagtcatcccaggcagtgcaaattatcaaggtttggatctgtgcgagtgacacncgtggcatccttgaacaaaaacgatgaagt

SEQ ID NO: 11067 - DNA, 101 bp, rice(Oryza sativa)
  misc_feature (71): n=t or g
tagagggtctaccttatccgtaaccctgacaatatcaatgttctatcaaatttgcacaccttgccttctanaccttcaactataaacccataaggttgatc

SEQ ID NO: 11068 - DNA, 101 bp, rice(Oryza sativa)
  misc_feature (71): n=t or c
gggacccacatgttggcctcatgacagtacctgatgggtgcagctagaaaatgcatgcatgcccttgccancttccatgtgtgggtgcctcttgcacttga

SEQ ID NO: 11069 - DNA, 101 bp, rice(Oryza sativa)
  misc_feature (71): n=t or c
attatcgcttgacgggaaaccacaatcgtcccagtcagatggtttatcattgttatttgtcatgatgagcntccttaagcatagttcctcatcttcagtta

SEQ ID NO: 11070 - DNA, 101 bp, rice(Oryza sativa)
  misc_feature (71): n=a or g
ctgacattctgacctagattagtgctgatctaatttgcagggacgtaatcagtgtgtgaattctatgtgtntctgtgaccaaccagagggttgggagaagg

SEQ ID NO: 11071 - DNA, 101 bp, rice(Oryza sativa)
  misc_feature (71): n=a or c
ggatcaggaaacgagtccacaggtgaatgctgttgatcttgaccaggattacggcttggaggccctggacnaactggcaaccaaacaagatcagaaccaat

SEQ ID NO: 11072 - DNA, 101 bp, rice(Oryza sativa)
  misc_feature (71): n=a or g
aatcgagaatctcgagatgcaattgcacatccaaatgaagattcggatgttgtaaaggggcctagcacgtntacaagtagccaaagtgcctctggagattc

SEQ ID NO: 11073 - DNA, 101 bp, rice(Oryza sativa)
  misc_feature (71): n=t or c
ctcctccgcttctgctggtttgttggcgtcgtgctgcactgttgcaaagaagtctcttggtagggaatggntgtcgtcgacgctgctagaaaaatcgtggt

SEQ ID NO: 11074 - DNA, 101 bp, rice(Oryza sativa)
  misc_feature (71): n=t or c
gttggattttacctcgcttccataagcgctggactgtccgaatgtgcactccaaagtccaaattgatcagnaacaattcttgtatcattcttgtgtagtat

SEQ ID NO: 11075 - DNA, 101 bp, rice(Oryza sativa)
  misc_feature (71): n=a or g
tggtttggtcgtacggttccaaaaggagtgatagaagggcaacttgtgtaattgctcagttgcagctttgnctaatcgaggttcactaccacctgaagaca

SEQ ID NO: 11076 - DNA, 101 bp, rice(Oryza sativa)
  misc_feature (71): n=t or c
acggcgctccttcgctatgggacaaaatcctagtcttattgctggatatatggaagaattgtacagactanaggtatcagaagttgcagaggtgacaatac

SEQ ID NO: 11077 - DNA, 101 bp, rice(Oryza sativa)
  misc_feature (71): n=a or g
atatgaatgagaaggtgcagcaggctgtgaagttggcatgccagaattagaagcagatgatcccctagttngaatatttcctcccggatatgttgaggtca

SEQ ID NO: 11078 - DNA, 101 bp, rice(Oryza sativa)
  misc_feature (71): n=a or g
gtcgagagggagtgtgagtgtgaagcctagtgatgatagcgatcttcttttgaagccaccgcagaagccantccgggcgaatgggccaccggagagcgtaa

SEQ ID NO: 11079 - DNA, 101 bp, rice(Oryza sativa)
  misc_feature (71): n=a or g
tactcctggctaaattaaatcgacagcgatgggttacatatatcctaattacatactctaccggctgatcntccgcgactggtgagttgggccacagccaa

SEQ ID NO: 11080 - DNA, 101 bp, rice(Oryza sativa)
  misc_feature (71): n=a or g
aacctagtttgacttgaacaccacatatgcagagatgactgaaatgttactgaattggaacaaggacctcncagaacaagttgacaaaaatcgaagcacgc

SEQ ID NO: 11081 - DNA, 101 bp, rice(Oryza sativa)
  misc_feature (71): n=t or g
atgtttgcaggtttatgaggtcttctattatgcacagaaagcagtgctttacccaacagctcctctatttnatcaggaggcacagatgctaaagttacgct

SEQ ID NO: 11082 - DNA, 101 bp, rice(Oryza sativa)
  misc_feature (71): n=a or g
ctctggttgatatttttgtggcaggcttcaggtgatgtgttacaagtatctatgggacaatttgatcagtnagaaattcccagcagagaatttcttcagct

SEQ ID NO: 11083 - DNA, 101 bp, rice(Oryza sativa)
  misc_feature (71): n=a or g
ccactattggtgacgctgcaccttgtttctttgattgcggcaaaacgatatggaattcggaattgtggctnaatctgttggaaagaggaatccgagagctt

SEQ ID NO: 11084 - DNA, 101 bp, rice(Oryza sativa)
  misc_feature (71): n=t or c
tgctgaaatcatgcactacctagttcacgttcttcagtaactgtgctttgtgactcaatatcaccagttgnggagatcaagccagattgtgtgcagcatgt

SEQ ID NO: 11085 - DNA, 101 bp, rice(Oryza sativa)
  misc_feature (71): n=t or g
aatgccattatgtatatgagtttcactaaattgccacttttaaattgtgcgtgctcactagaatgctaacntaggtcctgtttagttcacacacaaaaatt

SEQ ID NO: 11086 - DNA, 101 bp, rice(Oryza sativa)
  misc_feature (71): n=t or c
ggttggttaaaccttgtgcaaaagtgagtagcatcaaccttgagattatcagtagcaaaagcatcccatangagtgccgacaccatgctcctctttccgac

SEQ ID NO: 11087 - DNA, 101 bp, rice(Oryza sativa)
  misc_feature (71): n=a or g
gccgagtggtcgtttcgaggtgctgctgtgttcttaagtcattgttcccaacttcaaacccctcattttcntacgcacgtttttcaaactactaaatgtta

SEQ ID NO: 11088 - DNA, 101 bp, rice(Oryza sativa)
  misc_feature (71): n=a or g
agaagtgccttttgcaatggcatgctgcatttggtttcctatcagcgttcaatagtgtcggtagatgtggnagggaggacatggcgtacaacgaaagtgcc

SEQ ID NO: 11089 - DNA, 101 bp, rice(Oryza sativa)
  misc_feature (71): n=a or g
agctggttattgcctaggtgaagggtcatgagcttggtgcatcctctcatctccacaggaatgcttcctcngagcaaatttgtgctcagattcagcatccg

SEQ ID NO: 11090 - DNA, 101 bp, rice(Oryza sativa)
  misc_feature (71): n=t or c
ctgccaacatatacagcatacggattggtgaccttaactgatcccccttgattaatttgcagagttcaacngttcgacaaccagagcttcctcaagtacgt

SEQ ID NO: 11091 - DNA, 101 bp, rice(Oryza sativa)
  misc_feature (71): n=t or c
tcaattagccaaaacagaagtaaaagaaatgggtctcactcatagtacctatcagttgaataataaagtgnagagaccgagtcatttggctgttcactact

SEQ ID NO: 11092 - DNA, 101 bp, rice(Oryza sativa)
  misc_feature (71): n=a or g
cgctgggtttttctgtttggcgggttagccattctcgggctctttgggtatggcgtttactggatgataangcggagaaatcgccgtggagaggcggctcc

SEQ ID NO: 11093 - DNA, 101 bp, rice(Oryza sativa)
  misc_feature (71): n=t or c
tcaaacatgctgctcaaagctaaatggtttcatggttgcaacaaaactaaccatgccatccggggcgatcnccgcacagtccttgattgaaccgtgatcat

SEQ ID NO: 11094 - DNA, 101 bp, rice(Oryza sativa)
  misc_feature (71): n=a or g
atacactatcagcattttacttcttttacgttttatgcacacatttaatgttacctgtcaagtaaatggtnagtttgttctatgaaaatcaattaggaaca

SEQ ID NO: 11095 - DNA, 101 bp, rice(Oryza sativa)
  misc_feature (71): n=a or g
gacgcggcgcatggcggctatgttttggtggctgccgaaatttatagcggcgactcggccacttgactccnatcaagttgggcggctcgcccggatgcatg

SEQ ID NO: 11096 - DNA, 101 bp, rice(Oryza sativa)
  misc_feature (71): n=a or c
gcccaactaaggagcctttacatttcggacgtaaggagtaactattgctcagaattgtgttcttcactatnaaaaatgcaacacctcttgagattacatgt

SEQ ID NO: 11097 - DNA, 101 bp, rice(Oryza sativa)
  misc_feature (71): n=t or c
catttcccgctttcgccattcatgccattcttcttttgtcttcccatcttcttctcgttcactctccttgncctcttctgtgttcttcccctcttgctcac

SEQ ID NO: 11098 - DNA, 101 bp, rice(Oryza sativa)
  misc_feature (71): n=a or g
ttagtaatgcaatagaatataaggcagcccaaactaaataaatctatggctcgagtctgacgaccatgacnaagctgttcaggtgcttgccaaccagagct

SEQ ID NO: 11099 - DNA, 101 bp, rice(Oryza sativa)
  misc_feature (71): n=a or g
atggtatatccatgcatcatactgtgatatacatctataggagcatctatcccatcctcttccatttcacncaccagttcttcagcccgttccatattgcc

SEQ ID NO: 11100 - DNA, 101 bp, rice(Oryza sativa)
  misc_feature (71): n=a or c
tgcatatgccataaaaattacattacatgcaggttcttacaagtacacagtgcgaggatcaactaccttancaaatttgtttattgctggtgattggatag

SEQ ID NO: 11101 - DNA, 101 bp, rice(Oryza sativa)
  misc_feature (71): n=t or c
gctccctatgcactgcggtggtatttggcacttcggtggcctttgccttctgtagtagctgcttcttatgngctctgctgatctcatcagaatcggaactt

SEQ ID NO: 11102 - DNA, 101 bp, rice(Oryza sativa)
  misc_feature (71): n=t or c
tttctcaaagtcgttggccaaggtggaggtggctatgctctagacttactggcgtgttccttggcttccangtgttcaaatggacagctaggggtgtcaaa

SEQ ID NO: 11103 - DNA, 101 bp, rice(Oryza sativa)
  misc_feature (71): n=t or g
cacccccatggctgccatggcggggacgagctcttgaggagatgcaagtatttggtgatgggagaagaagncctggtgatcgaaccgatcaactccggcta

SEQ ID NO: 11104 - DNA, 101 bp, rice(Oryza sativa)
  misc_feature (71): n=t or c
ccaactatttggaataatcataaagctagccctgcagcttttacttctagacaacgccctatccttggagntcagtatacacctttttacagtcagacatc

SEQ ID NO: 11105 - DNA, 101 bp, rice(Oryza sativa)
  misc_feature (71): n=a or g
tcagtttatctgctgggtgccaaatcgtttgctgaggattttatgatatggtttggccggttctacaatanctccaacctttgtgccaacaccttctttgt

SEQ ID NO: 11106 - DNA, 101 bp, rice(Oryza sativa)
  misc_feature (71): n=a or g
tctttctttctctctttctcctcctgctgctgcgttgctttcttcaggcagctagctcagctgcttgtgcntgcatgggaaggagtaggaggaggaggctc

SEQ ID NO: 11107 - DNA, 101 bp, rice(Oryza sativa)
  misc_feature (71): n=t or c
ccaacggctgtgcatgcagtcaagacctgcatatgatgccattgaactggtgtacggtcaacttgtggtgnaactctaaaggagaacgtgaggctacctat

SEQ ID NO: 11108 - DNA, 101 bp, rice(Oryza sativa)
  misc_feature (71): n=a or g
tccatacattactagaaaaaataaggcttggtggctgctcaaaatccatgcatgatgttacctcgtttttngcttgcgagggcatgaatcatttgcactgt

SEQ ID NO: 11109 - DNA, 101 bp, rice(Oryza sativa)
  misc_feature (71): n=a or c
attttatcatcattttctctttttgtgacatgaactgaaatacagaagaccactgattgccaagagtccancattgaagaaggtccgcatgtagaggaaaa

SEQ ID NO: 11110 - DNA, 101 bp, rice(Oryza sativa)
  misc_feature (71): n=a or g
ttaattccttccccaccaccaccacctcctcccctccctcacttcaggattgattcccctctcgccgatcnagcaatgcgcgcggatgcagaggagagaga

SEQ ID NO: 11111 - DNA, 101 bp, rice(Oryza sativa)
  misc_feature (71): n=t or c
aacgaaataaaaatctagggtttatcagggcccacacgcagcctcgccgcgccgtgttttttttttcctcngcctttattttctcctctcctctcctctcc

SEQ ID NO: 11112 - DNA, 101 bp, rice(Oryza sativa)
  misc_feature (71): n=a or g
atttgcggatctatgggtggacttcctgctcaaagagacggaagaaagggaaaaacgagaagcatccgaanctgcaaggctgtcgcaggaagagaaccaga

SEQ ID NO: 11113 - DNA, 101 bp, rice(Oryza sativa)
  misc_feature (71): n=t or g
taaaaagagacgtggcaaaaaatgaaatgcgtcgccgagcctctaaatttgacggtacttccacgaccttntctttagtattaagcagaaggtagaggcgt

SEQ ID NO: 11114 - DNA, 101 bp, rice(Oryza sativa)
  misc_feature (71): n=a or g
tgtggattggccactgtctgactatgagaaatatgagcccataggacaagatgattgtggaaggctgtgtntgatcgactgcttctgcgccatggcggtgt

SEQ ID NO: 11115 - DNA, 101 bp, rice(Oryza sativa)
  misc_feature (71): n=a or c
gcccatcatgatcgtcagtgcacgccaatatgtatgcatgttaatagattggcaagatctcgataaaaaanatctattaagatgtcaacccgaggtaatta

SEQ ID NO: 11116 - DNA, 101 bp, rice(Oryza sativa)
  misc_feature (71): n=a or g
gaaaggttaagttgcattcatggtacattaatttggcatgcgagtgtaatttagtacatgaacgtgagaantgagagttgtagtgtgataagggtgtgatt

SEQ ID NO: 11117 - DNA, 101 bp, rice(Oryza sativa)
  misc_feature (71): n=t or g
gcagatgatgatgctcccgtggaagtcgtcaccccacaatttctctagctcttccagcagttcagtacaanttttatttttttttgagggttcagtatgct

SEQ ID NO: 11118 - DNA, 101 bp, rice(Oryza sativa)
  misc_feature (71): n=a or g
cgataggactgaagtcttcatctagcccggcgatgatgtactggaccatatcttattcatcaagaggacgnccgccggcagccatctcatcaccaagagca

SEQ ID NO: 11119 - DNA, 101 bp, rice(Oryza sativa)
  misc_feature (71): n=a or g
acctttttatataaaaatacataagctgacaaaattaaaccacagatttttgttccaatgtgtgaaatganccattggaaaagctatgcatttaaactgcg

SEQ ID NO: 11120 - DNA, 101 bp, rice(Oryza sativa)
  misc_feature (71): n=a or g
agtcagaccgatggcacacaggcggtcacaccgacgtccttaaggtggtcgaacctgcagcatacagaagnttagattggagtattatagaggttaggttg

SEQ ID NO: 11121 - DNA, 101 bp, rice(Oryza sativa)
  misc_feature (71): n=t or c
aattgctaagaacatatccactgtttggatgcatctgagatctatattacttagcagatgatcatactgancaaggatctcaaggggaacacagcctacca

SEQ ID NO: 11122 - DNA, 101 bp, rice(Oryza sativa)
  misc_feature (71): n=t or c
cttactcattcaataaccgaatactacagcacacacttttctactggtgctaatacttctcaagtttgccngacctatgatgagtttacgaagaagtgtga

SEQ ID NO: 11123 - DNA, 101 bp, rice(Oryza sativa)
  misc_feature (71): n=a or g
cataccatcatcgatttaacagctacgtttttcttgcacaggtttaacaagcaaatctaacaaggcacgtntaataatcgccatcgttgtcagcatctcat

SEQ ID NO: 11124 - DNA, 101 bp, rice(Oryza sativa)
  misc_feature (71): n=t or c
tcaattttcaaatatataagtgaatatcacaataaatggaacaaggatacaaagtccacaaggcggctatngttgtcgaaggtaaaacagtttgaattcgg

SEQ ID NO: 11125 - DNA, 101 bp, rice(Oryza sativa)
  misc_feature (71): n=t or c
tttgaagctaaagttaaaagagatagacgaagaagctggtagaggaccaatatctactgatttatgggaanagaggtacaagttggaagaggagctcactc

SEQ ID NO: 11126 - DNA, 101 bp, rice(Oryza sativa)
  misc_feature (71): n=t or c
gagttgtcctcgatcgatcacagttccaccatcatgaaagcacgccaacatggctcccgctcagctactangaatgtagcgagttctttaacgctaccagt

SEQ ID NO: 11127 - DNA, 101 bp, rice(Oryza sativa)
  misc_feature (71): n=t or c
aagatcttcatctgtaggcatgacatctggcagatccccatcacaaaggaaaactgagacagtccaagacngtccaactccaccaaaagctgtaacccttt

SEQ ID NO: 11128 - DNA, 101 bp, rice(Oryza sativa)
  misc_feature (71): n=a or g
tggtctcccaaaatgttggacaagaaccattgcattaagaaaccgctgttgcatgtcgcgattgccaccangaaaagaccgaggtagcacaatcctcgttc

SEQ ID NO: 11129 - DNA, 101 bp, rice(Oryza sativa)
  misc_feature (71): n=t or c
cattaattcgatgctgtagtactcttcccctataaatcaatccatccttcctctctttgtccatcacacangcacctaattattagtagcatacacacata

SEQ ID NO: 11130 - DNA, 101 bp, rice(Oryza sativa)
  misc_feature (71): n=t or c
caaactcactactgtttgttcatccattccgatggattatgacatggacatgtggtcttctatgcagggtntcccaaaccactgtggccggggttaccgcg

SEQ ID NO: 11131 - DNA, 101 bp, rice(Oryza sativa)
  misc_feature (71): n=a or g
gtagccgatgcgtactctgccttctcgaacgaaatctctccaaatcagctttgaccccagctttgaatccngcccatggcattgccaaatttggtcgttaa

SEQ ID NO: 11132 - DNA, 101 bp, rice(Oryza sativa)
  misc_feature (71): n=a or g
ggacgtcatggagaagaatcatggtggttatgatcaggttgggtttgtgtctcgggacttgtacaacttcnttgctcgttacaagaaagaaagaattgagg

SEQ ID NO: 11133 - DNA, 101 bp, rice(Oryza sativa)
  misc_feature (71): n=t or c
ctcccaattgggcatatctgtaaaggtaagcaattcaagcctagagaatgctactgcctcctctgtggttntgagcttgcagccaagaaattctggtccaa

SEQ ID NO: 11134 - DNA, 101 bp, rice(Oryza sativa)
  misc_feature (71): n=a or g
tcttgattggttgctaaatgattattgttattgtggctacagctcgaggtgccaaaagaactgattactcngtctgagcttgaggacttgaaattgcaacg

SEQ ID NO: 11135 - DNA, 101 bp, rice(Oryza sativa)
  misc_feature (71): n=t or g
cttcagtgggttttggtggagcctcttttgtgcagaagtatgagtacgataccatcccaatcacagcaatnaggattccaagtatatttctccagctaaat

SEQ ID NO: 11136 - DNA, 101 bp, rice(Oryza sativa)
  misc_feature (71): n=t or c
gcatcatttgaagcagcccgtatgtaaggattctgtacatgggctttcagtctgccactgctttccatctngatggtatccacaattgacctcaaaccaac

SEQ ID NO: 11137 - DNA, 101 bp, rice(Oryza sativa)
  misc_feature (71): n=t or c
acattcggcatccttccttgctgattcttgttgttgagcaaatagtttgtgcttctccaattgaggatgtnggatcgacttaacaatagtcgcccactctg

SEQ ID NO: 11138 - DNA, 101 bp, rice(Oryza sativa)
  misc_feature (71): n=t or g
ccggggaaccaatgtgagcaagttggacgtggtgctcccgatgctgaaggagctgcattctggccaatcgnaatggtccctctaccgctcccgccgtcgcc

SEQ ID NO: 11139 - DNA, 101 bp, rice(Oryza sativa)
  misc_feature (71): n=t or c
atctcttggaatagccttataaaaggaggagttgttaggagcaacaagcttgcaacaatggcgaccatagnatccatgcatatgtatggcttctctcttca

SEQ ID NO: 11140 - DNA, 101 bp, rice(Oryza sativa)
  misc_feature (71): n=t or c
tcccctctacatttgcctcgatgaatacaaactcatccacataaccccaagaataccgacgagtgctcatnaacccaaataaaacaacagatttaggggac

SEQ ID NO: 11141 - DNA, 101 bp, rice(Oryza sativa)
  misc_feature (71): n=t or g
atgatacaacacaatgcaaaggcagacatagaaggaacctgaatggaaggagatcggaaattttggtattngtaaatataagaaaataggtccaatatcca

SEQ ID NO: 11142 - DNA, 101 bp, rice(Oryza sativa)
  misc_feature (71): n=t or g
gtgattcagctagtgaactggatgaaaatttcggcgttgctgttgagtttgaacagaacgaagacgatganggaagtgattctgatcaggtacatacattc

SEQ ID NO: 11143 - DNA, 101 bp, rice(Oryza sativa)
  misc_feature (71): n=t or c
ggcgtgcaccgccgggacgttgaccgtgatactgcgatggtagtagttgcctggaacaaccaaagtatcgngtgcaagatcaaggacttccttgttatctg

SEQ ID NO: 11144 - DNA, 101 bp, rice(Oryza sativa)
  misc_feature (71): n=t or g
agcgaggcgaaggccgagatcaagcgtctgaatgccgagcttaaaaaagaacaaaatcattccgccgcctngactgaatactacaacctcaccgagccgaa

SEQ ID NO: 11145 - DNA, 101 bp, rice(Oryza sativa)
  misc_feature (71): n=a or g
agaacaaggagtggaggtgcgatttttgacgttcgtttgatggtgagtgcaagccacagtaagacacagcnatcgagcagcaactcaccttctctattatt

SEQ ID NO: 11146 - DNA, 101 bp, rice(Oryza sativa)
  misc_feature (71): n=t or c
cgatgttgctatcctgtgtgtgtctctaagacgagagggatgcacttgactccatgaccagcatggttcangagccagtcgtatgaaagattgtggcattc

SEQ ID NO: 11147 - DNA, 101 bp, rice(Oryza sativa)
  misc_feature (71): n=a or g
tccagctcgatcatcttcttcaccttctcctcgtcggagtcgtagctgtagatgatgtccttgcttttctncgccatctcgtggtccatcactattttcga

SEQ ID NO: 11148 - DNA, 101 bp, rice(Oryza sativa)
  misc_feature (71): n=t or c
gttttgctcctgatctcggcgattagctccctgatctcgccggttgtcattattagcgtcattgcggtggncgctgtgggcccgtcgatcctgatcttcat

SEQ ID NO: 11149 - DNA, 101 bp, rice(Oryza sativa)
  misc_feature (71): n=a or g
gtcgatcaacaagtcctctcctacctcctatcctccatgaggaaggacatgctggttcagatcgctgcctntacaacggtgttgatgcgaaaaacacgcac

SEQ ID NO: 11150 - DNA, 101 bp, rice(Oryza sativa)
  misc_feature (71): n=a or g
cctttcattcaggaaacctcttctgacaatctgagcgtgtgcttccatccctgttttcagtgatggaattnatgagatcataggtaggatctccaagtatg

SEQ ID NO: 11151 - DNA, 101 bp, rice(Oryza sativa)
  misc_feature (71): n=a or g
gaaaggaaaagaaaaaacgggcgaagaagaagaaaaacgtaaaagcagcttgcggtgcgaggcaaaagctngtagacgaggcgggggtgattagctgttcg

SEQ ID NO: 11152 - DNA, 101 bp, rice(Oryza sativa)
  misc_feature (71): n=a or g
acatcagggctccctgacattgacaaggcacagcacacaggattcttcatggaggattcgcttgtaaccantcatgggaaggagcatgacgtatactgttt

SEQ ID NO: 11153 - DNA, 101 bp, rice(Oryza sativa)
  misc_feature (71): n=a or g
ttccacgtccctaaaaaaatcacgttccctcattcctgcatcatctatgcgtcgcttctctgtccccaacncgccgccgccgcatacccccgcactccgcc

SEQ ID NO: 11154 - DNA, 101 bp, rice(Oryza sativa)
  misc_feature (71): n=a or g
tattattaatgtatgaattatgtctatgcagaatgtcgaagtgcccaaggacatcttaaaattttgtcaanatattaatgttgaactgaatggtgaagata

SEQ ID NO: 11155 - DNA, 101 bp, rice(Oryza sativa)
  misc_feature (71): n=t or c
tgtacagcttctccaagcatggaaaacatttaaggaagccaaattgtgtccagatttggtccagcagactnaagaaccaaaaccttcactgtgcgcagcga

SEQ ID NO: 11156 - DNA, 101 bp, rice(Oryza sativa)
  misc_feature (71): n=t or c
ttttacctgtcttcttccactgtccagtggcctttgacagcatcagccttcttgatacctttccttgacgncttgtttcttgaaatcaacctgccattcat

SEQ ID NO: 11157 - DNA, 101 bp, rice(Oryza sativa)
  misc_feature (71): n=a or g
aatcatcagttcattacagccaatggaaagctacctgaatgcattgaaataacaatggttttgtgcaactntgcattttccaattgttctgttcagaatta

SEQ ID NO: 11158 - DNA, 101 bp, rice(Oryza sativa)
  misc_feature (71): n=t or c
tataagatgttcaagagcggttcagagtggaagcatatcaccatggcaacagctatccagttcccgggttncgcttttgttatcttcgcaatcttgaatac

SEQ ID NO: 11159 - DNA, 101 bp, rice(Oryza sativa)
  misc_feature (71): n=t or c
ggaagaggggtttaggggatatatctcgcttacttgaaattgaggtactggccgacggcgaggagggcganggagtagagcggcggcggccaggagaagga

SEQ ID NO: 11160 - DNA, 101 bp, rice(Oryza sativa)
  misc_feature (71): n=t or g
tagcttagtgatagcctcggacaacgagataatccaacagaacatgtaagacaaagcaaggagcgagaaantccaaatcgagttgattagtgggtggtcgc

SEQ ID NO: 11161 - DNA, 101 bp, rice(Oryza sativa)
  misc_feature (71): n=a or g
ggccatgtttgctgaaatctacgatcatggttggtgacaagggagaaagcgaaggttcaaaagaatcctcntcagcaagcagaggaaaagcctatggacgt

SEQ ID NO: 11162 - DNA, 101 bp, rice(Oryza sativa)
  misc_feature (71): n=t or c
tcatggatagttaaagagttaggaatatgagataagcaccttcccgttcctatatgcatcaagcaccatangaaggtgccttcgttcgtcaaagtggtagc

SEQ ID NO: 11163 - DNA, 101 bp, rice(Oryza sativa)
  misc_feature (71): n=t or c
gcagcaagttcagattctcttgttgtgcttctgtcttcctcgaagcaagaaagtgtatttaacttcaccgnatcaatattttcttgtgttaaaggaattac

SEQ ID NO: 11164 - DNA, 101 bp, rice(Oryza sativa)
  misc_feature (71): n=a or g
caaacatataaacagctaaactatcaacaaatctaaatgtcatgtcatggtgagttctaagcttttacctnttcaaatacaaaccaattcctctcacaacc

SEQ ID NO: 11165 - DNA, 101 bp, rice(Oryza sativa)
  misc_feature (71): n=t or c
agttcatcaaaagaaagaaccttgtaagcatgagatgggaatgtggatggtgcctcagtgtcttctctaanggttgtgtgggcagtgaattttgccatgac

SEQ ID NO: 11166 - DNA, 101 bp, rice(Oryza sativa)
  misc_feature (71): n=a or g
gccaaggcactgccttgagatctgctgtgtgttcttcttggcagcactgatcatcaacctcatgaaggatnttgtaccaaaccatgtctccaggttcatcc

SEQ ID NO: 11167 - DNA, 101 bp, rice(Oryza sativa)
  misc_feature (71): n=a or g
aatgatcatagctataaaaaatagtggggttaccttaactcaagtgaatgtgcttgggcactcgcacgatngttgatcgatggtggggcgtcggtacaggc

SEQ ID NO: 11168 - DNA, 101 bp, rice(Oryza sativa)
  misc_feature (71): n=a or g
cttacccaaattgctcttgctgcactgctaatgtccagcttctgacggcgcagaccaattgggggcaacancgccacctctgagctcctccatccactcct

SEQ ID NO: 11169 - DNA, 101 bp, rice(Oryza sativa)
  misc_feature (71): n=t or c
gctgctgccagaatgagttcatcatcatcatctgatgatgacgaatccaagagttgatgcataagaaagcntctcattgtgatgtgctagaggaagaaaac

SEQ ID NO: 11170 - DNA, 101 bp, rice(Oryza sativa)
  misc_feature (71): n=t or g
cgaggagctccgaccagctcccctcgaacatgtcataactgatcccaacgctcgtgctggtggcgctgccnctgccgcattgctcgctggaccaatctgcc

SEQ ID NO: 11171 - DNA, 101 bp, rice(Oryza sativa)
  misc_feature (71): n=a or c
taacatactccaatttcttgagctggtccacattaattgtctcattgctgagtacagaatcaacctctgcntgtgcttttctcatcttggagggattctgc

SEQ ID NO: 11172 - DNA, 101 bp, rice(Oryza sativa)
  misc_feature (71): n=t or g
ttcagagacaccaagcaccatgctgtcctcctctttcatcgtctcagcaagtaattcaccaaggtaggatncgaatgcatcgaggaccatcgtgattattt

SEQ ID NO: 11173 - DNA, 101 bp, rice(Oryza sativa)
  misc_feature (71): n=a or g
ccacatcaaattcccaacaaacattccagggtgttctacctactttgtttctggtgtctttggaatcatcntcatggtgtggtcttccggcatgaggaagc

SEQ ID NO: 11174 - DNA, 101 bp, rice(Oryza sativa)
  misc_feature (71): n=a or g
ttaaaactatttaaactaattgttagtttttttctcaatgcatagacgatggcagatagatcatggatgcntagagagagatatcatgcgtcatatattga

SEQ ID NO: 11175 - DNA, 101 bp, rice(Oryza sativa)
  misc_feature (71): n=t or c
cgtcgtcttttctaaacatgtactagtattttgggggcccacagtgaatttggcccaaaatgctgacagcngctctacggctctacgctgtgcagatgggc

SEQ ID NO: 11176 - DNA, 101 bp, rice(Oryza sativa)
  misc_feature (71): n=a or g
gtgcccaaaggccaggctgaagagctgtacaggaagttccttgcctttgaaaaacagtttggtgaccgtgnaggaattgaggacgccattgtgggtaagag

SEQ ID NO: 11177 - DNA, 101 bp, rice(Oryza sativa)
  misc_feature (71): n=a or g
cgatgtctttgaccccaagttcaacatcgtctctcctggtgctgacatgtccatctacttcccattcaccnaatcacagaagaggctcacctctctccatt

SEQ ID NO: 11178 - DNA, 101 bp, rice(Oryza sativa)
  misc_feature (71): n=t or c
atgttcaacacatatttatatattcactaatgctaactatactaacaatttatataatcgtcatcacaagnggctcctgaatgcgtgagttcctctgttgt

SEQ ID NO: 11179 - DNA, 101 bp, rice(Oryza sativa)
  misc_feature (71): n=t or c
gttgattcaagacaagcttggggctgccgggccaaatttgaaaaagcacaagcaatacaagccctgccttnagcttgaagctccccgtgctcctagggcgg

SEQ ID NO: 11180 - DNA, 101 bp, rice(Oryza sativa)
  misc_feature (71): n=a or g
acatgagcttcctgttctttcttgacttgctcgtgatgtattgtctattcaagtgtcacctgtagcttcanaatcagcatttagtgcaggcggacgtgtta

SEQ ID NO: 11181 - DNA, 101 bp, rice(Oryza sativa)
  misc_feature (71): n=t or c
tgactgggagtgcagttttatgtatcgtcaccagccagaatcgaacattcatgatattcctgagctggtcnggtgagtttcatctgtaaattgcaaccaaa

SEQ ID NO: 11182 - DNA, 101 bp, rice(Oryza sativa)
  misc_feature (71): n=t or g
gaagagcttggatttaccatcctaatctttacttggacacttcaatagtgtttggcagttctgatcgccanaagcgagtgccgagcactgagacgtttatt

SEQ ID NO: 11183 - DNA, 101 bp, rice(Oryza sativa)
  misc_feature (71): n=a or g
ttggttgctccttacatcgaggagcacctggcgattatttgctcagaaaacattggcaagtccgatgcctngattacacgccatcatattgatactttccc

SEQ ID NO: 11184 - DNA, 101 bp, rice(Oryza sativa)
  misc_feature (71): n=t or g
cgcgcgcgtgaagaaccgtgagggggggaggacctgaatgtaaatgtaagagaagccgagggggctacgcnggaaatggcagtggagcgaggagtgtgtga

SEQ ID NO: 11185 - DNA, 101 bp, rice(Oryza sativa)
  misc_feature (71): n=t or c
actctgccagtcatatacttaaagatcgtacataaaaagcaagctagtatatcttttaagatcgtattctnagtaatctactaccttcatcccaatgtaat

SEQ ID NO: 11186 - DNA, 101 bp, rice(Oryza sativa)
  misc_feature (71): n=a or g
aatatctggtggtacatcatttgagctcttctgatgtactgatgaacgcctattcagttcttccaacttcncaagagcttttgctctttgttgttttgtcc

SEQ ID NO: 11187 - DNA, 101 bp, rice(Oryza sativa)
  misc_feature (71): n=t or g
atgagaagataatttatttgttttgatgattgattacctttggcgatcatgaggcagaggagggcaagganaggcttcgatttcgattccatggtttttgt

SEQ ID NO: 11188 - DNA, 101 bp, rice(Oryza sativa)
  misc_feature (71): n=t or c
accaggtggcatttaaatcctagtgatgcatacattgaggacaagcacttacaggaagctaaaagcatagntaaagaaatgcatgaaactatttctgatgt

SEQ ID NO: 11189 - DNA, 101 bp, rice(Oryza sativa)
  misc_feature (71): n=t or g
ttgaggtttttttattctcaaagttttgatcacctagcctcatggagaaaaaatcttcgcaggatggcacnggtgaaagcggcgcacagtggggctgatgc

SEQ ID NO: 11190 - DNA, 101 bp, rice(Oryza sativa)
  misc_feature (71): n=a or c
gttgcagaagatcttgcagatcctattgccaattgtcgctgtagcattgatcttcattgtagtcatgatanttgtgaggaggcagcagagatatgcggaat

SEQ ID NO: 11191 - DNA, 101 bp, rice(Oryza sativa)
  misc_feature (71): n=t or c
caattctgcatcttgaaacgccttaaaagattcttgatgtacttcatttgatgcactaccttgaggtattngcttaatttgcaatccaaaaagtacgataa

SEQ ID NO: 11192 - DNA, 101 bp, rice(Oryza sativa)
  misc_feature (71): n=a or c
taaggttgccacttgataaatgcattgaatgcatgtaactcaatgcttctacacaccctatagcaatgccnaagcgtgtacccaaagggatggagatgcca

SEQ ID NO: 11193 - DNA, 101 bp, rice(Oryza sativa)
  misc_feature (71): n=t or g
gcaatccaatcgccatgctggtctcctaccgcgtatggcagtcctttgaagaagttttcaacaggcttttnaggcaatagcttcaggtgatcaaagcaggt

SEQ ID NO: 11194 - DNA, 101 bp, rice(Oryza sativa)
  misc_feature (71): n=a or g
cacccgaggccagcaggaagcgaatcccattgctattgtccaagcaccgtcattgtcatcgtcgcagccantcgcagccgtcatcttcgccattgctgccg

SEQ ID NO: 11195 - DNA, 101 bp, rice(Oryza sativa)
  misc_feature (71): n=t or c
gttccgatgcttgaagactctggcgctagagatggtcgatccgcaggtgaagcctgtggttgattttctcnggtgtttcccgtgcttggaggcgctctata

SEQ ID NO: 11196 - DNA, 101 bp, rice(Oryza sativa)
  misc_feature (71): n=a or c
ccgtggagaagcttgttcacgatgccggtgctgagctcctcgatggatcttctcatcttcttggtgagggngtcttcgccgatcttctggaggcacttctc

SEQ ID NO: 11197 - DNA, 101 bp, rice(Oryza sativa)
  misc_feature (71): n=a or g
agtgcaagcttctacgagtcttggatctacaagaatgcaatggtttgaatgacgatcatctgaaacacatntatgaactgtggcatctgaaatacctgagc

SEQ ID NO: 11198 - DNA, 101 bp, rice(Oryza sativa)
  misc_feature (71): n=a or g
aagtgatgctgttgtcacagagttcagtagaacgcagaaggccggtgtactacaatcttacgcgttcatanttctggcagctggatctctcttaggaaatt

SEQ ID NO: 11199 - DNA, 101 bp, rice(Oryza sativa)
  misc_feature (71): n=t or c
ctttcaacatcattccattttctctgggaagcatagatgtttgacagcaatatatatgctgaggaatctcnggtacctaactccatcaaccgttcaccagc

SEQ ID NO: 11200 - DNA, 101 bp, rice(Oryza sativa)
  misc_feature (71): n=a or g
gtctgcgctggactagataatccaagaccatgtgatcaaatgttgcttgtgttatcgtccctcacttcacnagtgttttttagcatgaattttcttacagt

SEQ ID NO: 11201 - DNA, 101 bp, rice(Oryza sativa)
  misc_feature (71): n=t or c
tccgcacgatcaatttagatcatatgaaagacccacacgtatacatcgacaaatacactctgatgaggcangatcaaagaaacagaagcacatcgacaaat

SEQ ID NO: 11202 - DNA, 101 bp, rice(Oryza sativa)
  misc_feature (71): n=t or c
accaggcactgcacgaggctatcatcatcaccaacgatggtgccactccagcctgccacttgcatgctcgntgacctctcccgctctcaggacgccaccgc

SEQ ID NO: 11203 - DNA, 101 bp, rice(Oryza sativa)
  misc_feature (71): n=a or g
gcaatctcctccagtgtcatatttttccttggttcaactaaaccttctgctattaacagtctacttagccncttcccgtgtatcatatagtcctctggaaa

SEQ ID NO: 11204 - DNA, 101 bp, rice(Oryza sativa)
  misc_feature (71): n=t or g
ccgctcaatgatgttgatagcagtagcgacagtggcctcctctttgaatatgttcatggatattgattttnttcttgatcttatgattgagttaattttgt

SEQ ID NO: 11205 - DNA, 101 bp, rice(Oryza sativa)
  misc_feature (71): n=a or c
gcgacgacgacgaagacggcggcgagtaggaggaagaagaaagactcttcttgcctatgccatgtgacacnatccctgtttcttgcgaggtcttaaatctc

SEQ ID NO: 11206 - DNA, 101 bp, rice(Oryza sativa)
  misc_feature (71): n=t or c
ctacccacttccatttgcgatcctcaagaacttccttttcactggcttccacacgaagagccttgtcagcnagagtcttcatgctagaaattttatgagca

SEQ ID NO: 11207 - DNA, 101 bp, rice(Oryza sativa)
  misc_feature (71): n=t or g
agaagacctctgtcacagacttacattctccatcggaatcattatggtaatacctgaagagtacagccctncaggagcaattctttaagcaggcttgcttg

SEQ ID NO: 11208 - DNA, 101 bp, rice(Oryza sativa)
  misc_feature (71): n=t or c
caccaatggctatgcagcagccgaatgatcattcgagagccattgcgtcggggttttgacacggtggtcangctagtggcatggacgatttggaaagaatg

SEQ ID NO: 11209 - DNA, 101 bp, rice(Oryza sativa)
  misc_feature (71): n=t or c
actagtgcttaccatatcagttttgttggatgtagggtctgacacagtctcctcagtcttctccttaacantgaattcgccatgcggcacagtaatctcat

SEQ ID NO: 11210 - DNA, 101 bp, rice(Oryza sativa)
  misc_feature (71): n=a or g
ataggaggcatggcgaaatcagttggaagaacagctcttatgatagtgtttgctcttccacttcagctctnctctaattccatatatctcaacctttcatg

SEQ ID NO: 11211 - DNA, 101 bp, rice(Oryza sativa)
  misc_feature (71): n=a or g
ggttgaagaactcccatcagtactatgggcaagttctttggtcttagtattgataatattagaggtcaagnttatgataatggctctaacatgaaagaaaa

SEQ ID NO: 11212 - DNA, 101 bp, rice(Oryza sativa)
  misc_feature (71): n=t or g
tcgaatggtgtttgcccttcgttgttaacaatgttcagtttgatgtttctgctctccaaaattgcgagacncgggttcccggccttcaccgcgtagtgcat

SEQ ID NO: 11213 - DNA, 101 bp, rice(Oryza sativa)
  misc_feature (71): n=t or c
tgaattaatggaacgctggagtttagtgtcacaattgctctagttgactcgacacggtaataggtatcctngcacaaggtgttctcaagtggttgacaaga

SEQ ID NO: 11214 - DNA, 101 bp, rice(Oryza sativa)
  misc_feature (71): n=a or g
ctatcggtttttatgtgtttttctgatacacctttggacttgtcggcaggtgtcaaaggtattaatgcgtnatcttccaaggtgtaaggcatttgacaacc

SEQ ID NO: 11215 - DNA, 101 bp, rice(Oryza sativa)
  misc_feature (71): n=a or c
ttgttttattggtgcagcatctgagtttgacttcatgttgtaagcagaatccgttttcatagcctctgagntattatcatgcagcgaacagcttcccatga

SEQ ID NO: 11216 - DNA, 101 bp, rice(Oryza sativa)
  misc_feature (71): n=t or c
gccctgcttccgttctcccaatcctggatatccttgagaacaccagtgtcaacaaaggagcttccagttgntcctgaacggtacaggttctggatgtgttc

SEQ ID NO: 11217 - DNA, 101 bp, rice(Oryza sativa)
  misc_feature (71): n=a or g
caacatcgtcgactcgtctgcaacacagcaactcggcatcgcatcgcacagcacaagtcaacacttagccncctgcctgcatggcgtcagcccgccggctg

SEQ ID NO: 11218 - DNA, 101 bp, rice(Oryza sativa)
  misc_feature (71): n=t or c
actgcatcatcatcttgctgccatatccacttcgactccaatccataatcgcggatagatcacttcactantgcaacggattacgactccaatgggttctt

SEQ ID NO: 11219 - DNA, 101 bp, rice(Oryza sativa)
  misc_feature (71): n=t or c
gtgtactcaagtcctgtgaatgcactcgtttttctggagaataacgcacaagacgtcgctgtagtcttggnagcagtggacatgaaacaattgagtggttt

SEQ ID NO: 11220 - DNA, 101 bp, rice(Oryza sativa)
  misc_feature (71): n=t or g
gagaaggagttcaactggatgacacagtttttattgctgcactcgctgcttgcgctcatggaggtttgttncaagaaggttggagtatatttaatgaaatg

SEQ ID NO: 11221 - DNA, 101 bp, rice(Oryza sativa)
  misc_feature (71): n=t or c
ataacagtaaggttttataaatactagtgtgatccgcaatagccaattggacgacttaaataccacttgtngtgtcgttctcacttgtgacaggagaattc

SEQ ID NO: 11222 - DNA, 101 bp, rice(Oryza sativa)
  misc_feature (71): n=a or g
acgcactagcagaagccccttagcagacatgactaatgtttcagaagtagcagctgctccaacaacgacanagatccgcggtaaatggaagtgccctcgca

SEQ ID NO: 11223 - DNA, 101 bp, rice(Oryza sativa)
  misc_feature (71): n=t or c
cgcacgtccatccgtgaacgtgaagacatccacgacgtcatgaccgctcgactgcacgaccacgtaaagantacgacgatcaactcgcccgacgtcgtcga

SEQ ID NO: 11224 - DNA, 101 bp, rice(Oryza sativa)
  misc_feature (71): n=a or c
accctcaaatatttcagacgcaacatattcagccaggggcacgaggagatcagcttatatatatctctatntgtcaaggagaaatatttcagattcaagac

SEQ ID NO: 11225 - DNA, 101 bp, rice(Oryza sativa)
  misc_feature (71): n=t or g
aatgggcgccttggagaagggattgatgccgttcttgtccaagattgggatcttgtgggcacggggcagcnactgcggcacgtagggcattaggcttccgc

SEQ ID NO: 11226 - DNA, 101 bp, rice(Oryza sativa)
  misc_feature (71): n=t or g
gaagtctggacctagcaattggaaggttaaaggcacaggaggcttcatcgaggaagtcttctgaaaaaatnaaggtaatttagctttagttgtttaacttt

SEQ ID NO: 11227 - DNA, 101 bp, rice(Oryza sativa)
  misc_feature (71): n=t or c
cagcttcaaccacctagatggtccacttcaagagctgcagtcatcaaatcctagcctttcccttccactanaggtaatgaatatctccagcaatttttttc

SEQ ID NO: 11228 - DNA, 101 bp, rice(Oryza sativa)
  misc_feature (71): n=t or c
ttcacaatgcaactaaaatgtttggtctgaaacagcagatccaagcaagtaatttacctgattatgaatgngctttcctgtctgtattgcccctgcatgcg

SEQ ID NO: 11229 - DNA, 101 bp, rice(Oryza sativa)
  misc_feature (71): n=a or g
tcttgtgtcttcacaggagatctggcttcagagtcatggccagcatcctttctgggagggctgtttgtttnagcttcaacctcaggaatctttcggcttgg

SEQ ID NO: 11230 - DNA, 101 bp, rice(Oryza sativa)
  misc_feature (71): n=a or g
caggcttacgcttacgatgtttgtggttactgccgctcccgttagctccattgttgccgttgtctttcttngggtgccagccgcttgccaaccgcttttga

SEQ ID NO: 11231 - DNA, 101 bp, rice(Oryza sativa)
  misc_feature (71): n=t or c
caaatattcattaagaataacgcggaaattgatgggggggaattgcttatgttgtacgaaatatgtgcaangattgcttcgatatacctacaacaagattt

SEQ ID NO: 11232 - DNA, 101 bp, rice(Oryza sativa)
  misc_feature (71): n=t or c
aaatttgaactaatatggcccatatacttacatggatgggccagaatttcagcccaacccaaacgagacgntgctggcctccgttcagcatggagtagttg

SEQ ID NO: 11233 - DNA, 101 bp, rice(Oryza sativa)
  misc_feature (71): n=t or c
attcctcatgctcctcctcgatccttaattccatctcctctccgttttcttgattaaatcctacgaaatcntggcaaatttccagcctttctttctgctga

SEQ ID NO: 11234 - DNA, 101 bp, rice(Oryza sativa)
  misc_feature (71): n=t or c
atttggatgttgtcttgaaaccgaagtccctctactggtgtatgactttgtcccaaatggctcactaaatngcattattcacgctgatccaagtatgagag

SEQ ID NO: 11235 - DNA, 101 bp, rice(Oryza sativa)
  misc_feature (71): n=a or g
gtgacatgtagggctgagctagaaggtttacctgatgtttctttgccattgtctgggttaaaagctgctcntgtggaggtttcatcgttccatcactgtgt

SEQ ID NO: 11236 - DNA, 101 bp, rice(Oryza sativa)
  misc_feature (71): n=a or g
tcttgagttcgactctcaacgaaagcattttgattattctttttggattcttttgttttttgttcttgttntgatcggctggctgccacatcttcttcatc

SEQ ID NO: 11237 - DNA, 101 bp, rice(Oryza sativa)
  misc_feature (71): n=a or g
ttgcatgcatacttacgcactcccatctattttagcactcaaagtcccaactgcactggacgcaataaatntcgctgcaacattaccgccccacattagct

SEQ ID NO: 11238 - DNA, 101 bp, rice(Oryza sativa)
  misc_feature (71): n=t or c
atcgaaaacatataatcttgagtactttttgaaattcggaagaattgcgtagaggaaccattgagcagctngaaaaagctcgaatttgattgcagaaagtc

SEQ ID NO: 11239 - DNA, 101 bp, rice(Oryza sativa)
  misc_feature (71): n=a or g
tctccaagattcaaacggaggaaggtggtgaaatccgcgacctgacctggctagcatggaagacgccaacnagaacctggcccagcaaggagatgccaacg

SEQ ID NO: 11240 - DNA, 101 bp, rice(Oryza sativa)
  misc_feature (71): n=a or g
agctgttatcaaccaatccctaaagtacttgcaagtgccatgcaaaatgaactcaacgatgccaataaatnggagcgcacgtgtgtctggcatgacccagt

SEQ ID NO: 11241 - DNA, 101 bp, rice(Oryza sativa)
  misc_feature (71): n=t or g
aacgcggcgcggaggtgcggtgtgtgtggggttttctctgcttctctcgttctgggacccgccctagcttntgtctctccccagtgcggcgttgtcaccgg

SEQ ID NO: 11242 - DNA, 101 bp, rice(Oryza sativa)
  misc_feature (71): n=t or g
caccgacagtcaagtcgctgggaattggtcagtgtgacaaccttcattctgttcaactagacgcgctgaancattccctcaagaagctactaatatttggc

SEQ ID NO: 11243 - DNA, 101 bp, rice(Oryza sativa)
  misc_feature (71): n=t or c
ttttcttcaggagatgatgaactcgcaagcggcgacgggttttaatacagacatggctggtactaaatccnagggtccggctgtgttcacaaaggacgttg

SEQ ID NO: 11244 - DNA, 101 bp, rice(Oryza sativa)
  misc_feature (71): n=a or c
agcgcctggacgccaacttgcagttccatccgacgcaatctagcatcatggcactctccggcatcggatcncgcctcagcgtcatcgccggccaacccctc

SEQ ID NO: 11245 - DNA, 101 bp, rice(Oryza sativa)
  misc_feature (71): n=a or g
tttgttgaatcccagatgaagactgagattcttcactgagagatggtattccgtcccgaagaatcggaacntaataccatcgcccacatctcgcagggtac

SEQ ID NO: 11246 - DNA, 101 bp, rice(Oryza sativa)
  misc_feature (71): n=t or c
atcgacacttgccagaagcaaataattgaagacaaagcaatcttagatcaactcgctattgccctatcgcngatggagcacgaacttgccactttgcaggt

SEQ ID NO: 11247 - DNA, 101 bp, rice(Oryza sativa)
  misc_feature (71): n=t or c
ctactggtatttgcctgctccgtcatgtctgttgttctgattatgtgtgtcaacagcaagttcctgagaanaagcgtcgtgagtctacgttgaaaggcatt

SEQ ID NO: 11248 - DNA, 101 bp, rice(Oryza sativa)
  misc_feature (71): n=a or g
attatatgaaatccgcattaaaaaatgaacgtttgtttaaactctgtctggtgattcttgcacacatgcantggcacgaagctgcaattaacaaggaggaa

SEQ ID NO: 11249 - DNA, 101 bp, rice(Oryza sativa)
  misc_feature (71): n=a or g
ttttttccctcatatctctctccctacgtcatttttttcttaactactactcactcttctcttttcttctncagttctactgctgctagcgagctctcctt

SEQ ID NO: 11250 - DNA, 101 bp, rice(Oryza sativa)
  misc_feature (71): n=t or g
caaacgcagaaagatagggggtaaaagttctgttgatgctgccggtgatgcgaatattgattcggattcancaagttctctcgcacactcagattctgata

SEQ ID NO: 11251 - DNA, 101 bp, rice(Oryza sativa)
  misc_feature (71): n=a or g
caagctaattgacctaaaaaatgagccaagcaagcttagcttgttaggataaacagtcaaaccgaggcagnccaagctaagctggctcgatatctaacctt

SEQ ID NO: 11252 - DNA, 101 bp, rice(Oryza sativa)
  misc_feature (71): n=a or g
gggtcctcacccttccaaaggaaagatcttcgaaaacgatagattcttttaattacccattttggagcttngatggctgtaaggtgatgagttggcatggc

SEQ ID NO: 11253 - DNA, 101 bp, rice(Oryza sativa)
  misc_feature (71): n=t or c
atttgtgcagcagcagaaacgatatatggctgaggaagaaaggccattgaagacaaccgtaccaccagcangagcaggagccatccagctaggttaccatt

SEQ ID NO: 11254 - DNA, 101 bp, rice(Oryza sativa)
  misc_feature (71): n=t or g
ctcagggggcagctgcgccacgtggtgtgctctgcctattcttggactgtcttttgtgcctttgagttcangggctaaccccctgcccacatggaattagt

SEQ ID NO: 11255 - DNA, 101 bp, rice(Oryza sativa)
  misc_feature (71): n=a or g
tagcattgatccattcacaacttggagtacctcctttctgcttctatctctcctgcaaatggagaatagcnagcaagagaggacggactcaccattggagt

SEQ ID NO: 11256 - DNA, 101 bp, rice(Oryza sativa)
  misc_feature (71): n=t or g
ggaggagggcggcaccgtcgacggggaagacctcatcgatgatgtactctaatatgatccgcgactcgcanatgggtttgccgttgtggatgagcacgggg

SEQ ID NO: 11257 - DNA, 101 bp, rice(Oryza sativa)
  misc_feature (71): n=t or c
gggcactcgggcattcaggtcacatacagtcgagtgaaatggttgtttgcctggacaggcctcaagcgggnagtgcagacttttgtgaccgattgcgccgt

SEQ ID NO: 11258 - DNA, 101 bp, rice(Oryza sativa)
  misc_feature (71): n=a or c
gattacgcagtgcgagctggcccctttctgccttgattaaaccaaccgagtctgtggccgcaccctctagntttgttagttctgctgaaggtttgctcact

SEQ ID NO: 11259 - DNA, 101 bp, rice(Oryza sativa)
  misc_feature (71): n=a or g
gggattttccagataatacagtgataacttcttgcatcgatcagcaccagctagaataaaaagaaccattnattactgattacactgtcaaaatcaactta

SEQ ID NO: 11260 - DNA, 101 bp, rice(Oryza sativa)
  misc_feature (71): n=t or c
tgctcctcatcgaattcattcacatgaacgtcatggaggtagcgatgaggctccaggaaatactccgactncaagaactcatccaggccgtcgtcgcggtc

SEQ ID NO: 11261 - DNA, 101 bp, rice(Oryza sativa)
  misc_feature (71): n=a or g
ttcttccattatgtgcatttctctatactaggatactgctaagatctgttggaactggaaggaaccccatngagtccaagagtttaattttaaggagctcg

SEQ ID NO: 11262 - DNA, 101 bp, rice(Oryza sativa)
  misc_feature (71): n=a or g
ttttgatggctctccgagcatggtgactagctcatcttccgattcgttcacgtcggagtcacaagatttgnagaagattaacttacatgtgcatggtgatg

SEQ ID NO: 11263 - DNA, 101 bp, rice(Oryza sativa)
  misc_feature (71): n=t or g
caaaactgcatttctaatctccctccttaaccctttagtaaatctatgagtcaagtactttgagctaaganttgggtcataaactaacagttgattcatca

SEQ ID NO: 11264 - DNA, 101 bp, rice(Oryza sativa)
  misc_feature (71): n=a or g
agatgacttcagtcttgatctccgaactttgcagacagcaacaaataacttcgacgagcgaaataggctcngggaaggtggttttggtatggtttataagg

SEQ ID NO: 11265 - DNA, 101 bp, rice(Oryza sativa)
  misc_feature (71): n=a or c
attttcctaagagtagacaagtccttgttgcaaaattgttctccagcaagcacaaaatcagacagtgatgnagattgcttcagtccaaagaactggcacat

SEQ ID NO: 11266 - DNA, 101 bp, rice(Oryza sativa)
  misc_feature (71): n=t or c
aaaagcgtacctcagtgaccgaacgaattagcagttctcagaattcagtgatggggtggatagaccacctnggagcccttcgccaactagccctcgttcca

SEQ ID NO: 11267 - DNA, 101 bp, rice(Oryza sativa)
  misc_feature (71): n=t or c
tgaccactcctcctgcctccacgtacgtttgcctctggctttccctgctcattgctcatcgtcatcgtcancggtgaggatgtctccggccggttcgggcc

SEQ ID NO: 11268 - DNA, 101 bp, rice(Oryza sativa)
  misc_feature (71): n=a or c
tgttgatttggcaaaaacaaggtaacttcacctacaacggcaagcagtacgacgcaacggccgcaccacanggtgcagactaccacaagtgcagagaagaa

SEQ ID NO: 11269 - DNA, 101 bp, rice(Oryza sativa)
  misc_feature (71): n=a or g
aactatgcttatttccttaacaaatcttaggcggaagaagaggcacttcttctacaacagtacagcatacncaatgatggaggggaggaattcagagaaag

SEQ ID NO: 11270 - DNA, 101 bp, rice(Oryza sativa)
  misc_feature (71): n=a or g
ccacctggagcaccggccgggatagaactgcccttcatccgcagggcaccatatgaagacagggagcacancgccgtccctcgccgcggaggccaacgccg

SEQ ID NO: 11271 - DNA, 101 bp, rice(Oryza sativa)
  misc_feature (71): n=t or c
gtgggtctcaacatttttaatttatttttttgtgcaaactagcatgtggcccacaatttttaatatttttnaaatcaaattgccacgtaagcgccacgtca

SEQ ID NO: 11272 - DNA, 101 bp, rice(Oryza sativa)
  misc_feature (71): n=a or g
caccgcgtccgctacctgagtgaaaccattactgttctacagcgtgggggtgggggtagtgacagctctantggcagtgtgtgagatgtaggagtggtgtc

SEQ ID NO: 11273 - DNA, 101 bp, rice(Oryza sativa)
  misc_feature (71): n=t or g
gcatgccaagtgccagccgcaactgaaaccggattaaagctcaatgtcaggaaatgttcaatcaacttggnggtgcccttattgtttttgcatccgtgacc

SEQ ID NO: 11274 - DNA, 101 bp, rice(Oryza sativa)
  misc_feature (71): n=t or g
gcttgattcctagtaggccgggcctttttcggtccaatagaaagggctacctcatgagtttatattccttnataacaaaggctggctcattcattgcataa

SEQ ID NO: 11275 - DNA, 101 bp, rice(Oryza sativa)
  misc_feature (71): n=t or g
ctgggtaccgtggtgcctataccggaggtggtggcaacggtcaaaacggtggtggtggcagtggttattancataatccttgatgtggatcagtattgcta

SEQ ID NO: 11276 - DNA, 101 bp, rice(Oryza sativa)
  misc_feature (71): n=a or g
gccgttggcgctggagtccaacgccgccgatgaagctgctgctgcaggaggtgtatcaggagaagcagaancagaagccgatgaagctgctgatggcggcg

SEQ ID NO: 11277 - DNA, 101 bp, rice(Oryza sativa)
  misc_feature (71): n=t or g
catgcaagcgccactgctctcaacaagatcacattacgtttcgactggctgtttacagtagaaagtagcanagaggaacgcataaattcgctgcccctaat

SEQ ID NO: 11278 - DNA, 101 bp, rice(Oryza sativa)
  misc_feature (71): n=t or g
gatctggtgctctgcttgggttgagttcttgattttgccgaggtgtatcgatggagacgacggcggcgaanaagctgccgccggggttcaggttcaggccc

SEQ ID NO: 11279 - DNA, 101 bp, rice(Oryza sativa)
  misc_feature (71): n=t or c
tggatggcccataagacggatgtgagctcttcgacccattgtgtatcataagacataagcctatcgtagangtgggtcttgatcccttggagcacaagacc

SEQ ID NO: 11280 - DNA, 101 bp, rice(Oryza sativa)
  misc_feature (71): n=a or g
gtgcatccagacgaggatacaacaagaaggatcggaagagcatttgtgactttaggccaggaagataaagnaaagattgtcctcgagaaatacttgaagaa

SEQ ID NO: 11281 - DNA, 101 bp, rice(Oryza sativa)
  misc_feature (71): n=a or g
ttgggtgtccaaaaactcactacaccttggcaacagaaggcacttactaaacttatgggttcgcgttatcntttggtttataagaaggggactaataatcg

SEQ ID NO: 11282 - DNA, 101 bp, rice(Oryza sativa)
  misc_feature (71): n=t or c
gtatccatggctgatgctaccaacgatcccatccgactacattcttggaccaaaagatcctctagccttangctcggtccattttagactgtccgacttta

SEQ ID NO: 11283 - DNA, 101 bp, rice(Oryza sativa)
  misc_feature (71): n=t or c
tctggtgatgataatagatggtggaaaattgttttgtgatgagatggctgagcaagttgagtggtggtgcnagggtaatacattctcttctaacttcaaga

SEQ ID NO: 11284 - DNA, 101 bp, rice(Oryza sativa)
  misc_feature (71): n=t or c
ttcagggcacgcggattcactagtgccagtctcaggagcaacgtcattgaaggggaggtgaggagcatccngggaggggcagatccaccattgctgttgaa

SEQ ID NO: 11285 - DNA, 101 bp, rice(Oryza sativa)
  misc_feature (71): n=a or c
ttcatctgaatctcaaattcttaatggtacaggcatatgcagttgcaggtgagcgttagctgaagctcacngccggcgaggggtcccggtggcaaccgcct

SEQ ID NO: 11286 - DNA, 101 bp, rice(Oryza sativa)
  misc_feature (71): n=a or g
gccgccgccgccgccaccacaagtctcaatagcgagcgacgagcatgctctcccttctcttctcgaccacncgccaaccctgacgctgctgccatcactgc

SEQ ID NO: 11287 - DNA, 101 bp, rice(Oryza sativa)
  misc_feature (71): n=a or g
tttattttcttgcgaaaaggttgttgctgtccgcccacttgctggatggcgaactccttgcagagggcttncacttcttcgaccgccatcattgccttgcc

SEQ ID NO: 11288 - DNA, 101 bp, rice(Oryza sativa)
  misc_feature (71): n=t or c
tcaggtggcaattcgacaccaacctcatcaactttgtcgaaccatcgtaccatgacaacgttggttgaatnagtatcttcatacagatcctccacttgggc

SEQ ID NO: 11289 - DNA, 101 bp, rice(Oryza sativa)
  misc_feature (71): n=a or g
aaatgggaagaaatcagtatggactttgttcaaggattacctaccacacctccaggaaatgatagtatctnggtaatagtggatcggctaacaaaatctgc

SEQ ID NO: 11290 - DNA, 101 bp, rice(Oryza sativa)
  misc_feature (71): n=t or c
gcccagtaccaaaatctcctcaatggtacctccccttcgccgaacaggtagaagggcaaagctaggttttngcatggtccgctcctccccagcaccacaat

SEQ ID NO: 11291 - DNA, 101 bp, rice(Oryza sativa)
  misc_feature (71): n=a or g
acccacaataaccaatcaatgaaatgagaatgaacatcagaagcagggggaaggagagatcaccggtggtncctttccgtcgccggagcgaagtgagcaat

SEQ ID NO: 11292 - DNA, 101 bp, rice(Oryza sativa)
  misc_feature (71): n=a or g
ctagctgcatttggagctctgcagaaaatgttttctcctttaccacctcatgctcaagtgcagtcaccatnccgcgcagctccacaacttctgagttcact

SEQ ID NO: 11293 - DNA, 101 bp, rice(Oryza sativa)
  misc_feature (71): n=a or g
tgtactgtcctggattacgcatgcacattgatttatttcctaacatgtagattacggaacaactctggagncatggcagaggggtccctagttgttgccat

SEQ ID NO: 11294 - DNA, 101 bp, rice(Oryza sativa)
  misc_feature (71): n=t or c
atcacacactgatcgtttcaggggtaaagtcacaggaatcatacttgttggtgatctcaaaagttaaaaangataacatatgaacttgtttttatttagca

SEQ ID NO: 11295 - DNA, 101 bp, rice(Oryza sativa)
  misc_feature (71): n=a or g
ttgcataaaagcttataagcttgatgcactcaaatctgtacggaagaccaatgaagcaaaatatattggcnaagcaggcagccgcactgatgcaattgtga

SEQ ID NO: 11296 - DNA, 101 bp, rice(Oryza sativa)
  misc_feature (71): n=a or g
caaggcgagatcaagtccatgacatacgatattgagatcgcacacctaacgatagcgatccatcttcatcntctaggggaggttcgtgacgacctcgcggt

SEQ ID NO: 11297 - DNA, 101 bp, rice(Oryza sativa)
  misc_feature (71): n=t or g
tccaatctggcccgagagaagtaaaagcccacagcggcctaaccgatatgttatcctttcacgttacatcnataaacaaccatattttttctgttgtttag

SEQ ID NO: 11298 - DNA, 101 bp, rice(Oryza sativa)
  misc_feature (71): n=t or c
gcaaacccgatgaacaaaagaagattcagtctaactttaaaaaaactctgccagagacaaggaagggcacnaataggcagcaaaaatcttgctggagatga

SEQ ID NO: 11299 - DNA, 101 bp, rice(Oryza sativa)
  misc_feature (71): n=a or g
atatcatcacccttgagttcaacgaccttgagacacagactagttaaggtctcaacctgttgtatccaatntggaaccctatggaacgccttgtaaaggtg

SEQ ID NO: 11300 - DNA, 101 bp, rice(Oryza sativa)
  misc_feature (71): n=t or c
tcaaaagggatttatcatattgccaaactttatcacttgttggtactactttcgatttctagcccgacganggtatttccttgtcgtaggagcttgctgtg

SEQ ID NO: 11301 - DNA, 101 bp, rice(Oryza sativa)
  misc_feature (71): n=a or g
tcaaggtactgcaggaaatcccaaccacacgatgatcctgtcattttaattatagttagttccttcagtcngggcaccgctgagtgcgcattgctgcaagg

SEQ ID NO: 11302 - DNA, 101 bp, rice(Oryza sativa)
  misc_feature (71): n=t or c
atcggaccactcgtggaccactaggtggcgatgtcgttgaaggagagctccaacaaggaagcctcggacgntgccactgccaccacgagcggcagcaaagt

SEQ ID NO: 11303 - DNA, 101 bp, rice(Oryza sativa)
  misc_feature (71): n=a or g
attagcgggtgcttttcgaatggatggcatggtaagtctattgagcttttcgccaaaatgtggtctgaagncctcgagatcaatccagtgacgatgcttgg

SEQ ID NO: 11304 - DNA, 101 bp, rice(Oryza sativa)
  misc_feature (71): n=a or g
caagttgcggtactagcggtgcattttactcgataaactatatccacaagaaccaacaataatgcccagtnatacaaactaattaattacacaaaacagtt

SEQ ID NO: 11305 - DNA, 101 bp, rice(Oryza sativa)
  misc_feature (71): n=a or g
tattttggaacatttacattaatttaaagaatagatgattgaagttctaaaaatgaatagcgatcgactantgtcaattagttggcgacaaacagagcaca

SEQ ID NO: 11306 - DNA, 101 bp, rice(Oryza sativa)
  misc_feature (71): n=t or c
taccacctactccagcttacttgcctttccaatccatcatcatccgtcggcatctagctagctagtagtangtaccccctccgtccttaaaaaaacagtca

SEQ ID NO: 11307 - DNA, 101 bp, rice(Oryza sativa)
  misc_feature (71): n=a or c
ttcctttgcaaatttccaaagttgttcagcttcctcatcattatcagagctattttgctctataggctgcntataatcagagtctgaactatcagatactt

SEQ ID NO: 11308 - DNA, 101 bp, rice(Oryza sativa)
  misc_feature (71): n=t or g
cggtggcagcgacagggatgacaagcacaccgcaatgcacacgcgttgctttggtgcatctaactccacgnccatgaacctgttggtggcggtgccgttgg

SEQ ID NO: 11309 - DNA, 101 bp, rice(Oryza sativa)
  misc_feature (71): n=a or g
gttgctgatgccttgtctaggaaagatgagcagcaagaaatctatgcaatttcaacaagccagcccaaatngttggagatggttgtggaaagttatcacaa

SEQ ID NO: 11310 - DNA, 101 bp, rice(Oryza sativa)
  misc_feature (71): n=t or g
acacccttcagtcaccagtactgctcccatggtaaccaaaataaaagtcccagctatccccaagatgtagngccaacagctgtaccaatttcctgtttcga

SEQ ID NO: 11311 - DNA, 101 bp, rice(Oryza sativa)
  misc_feature (71): n=a or c
taaacacctaaaatttcttgtagggccatggtttcgaatgagcagtatctcatatcgtgagatatcagatntggggcaggcagccatggaacttaagtgta

SEQ ID NO: 11312 - DNA, 101 bp, rice(Oryza sativa)
  misc_feature (71): n=a or g
atttttatgatgatttttattgaaatacgttaataaatgctaaactaatatctcttgatgtagccgatgcngtttccgcagcaaagcgcggagtgccatct

SEQ ID NO: 11313 - DNA, 101 bp, rice(Oryza sativa)
  misc_feature (71): n=t or c
agtgcaacaacgatgaggtaagaaatgccttaagcctttggccatgcccaacaaagcaactcctcactagnatacgataaagctccagcaaggttaattag

SEQ ID NO: 11314 - DNA, 101 bp, rice(Oryza sativa)
  misc_feature (71): n=a or g
cttaccactagtactcggtgcagggaatcgctgaggttgcctggctactgacgagattgatggcgccaccntcgctgcagagagagagagagagagagaga

SEQ ID NO: 11315 - DNA, 101 bp, rice(Oryza sativa)
  misc_feature (71): n=t or c
ggtttctgttctgaattcagaccggcttcccagttctgaaattcagcttgaaggtctctaaggctgtcccnaaccctccatatcatctagtttccattgca

SEQ ID NO: 11316 - DNA, 101 bp, rice(Oryza sativa)
  misc_feature (71): n=t or c
agatcgtcagctaggcccttcatcttggagaagtaggcggcagttgttgtggatcctttcttggagttggngaggctgatcctgaggttggtgatgcgtgc

SEQ ID NO: 11317 - DNA, 101 bp, rice(Oryza sativa)
  misc_feature (71): n=a or g
tattgtacctgctcttatagcaccttatccatctttaaaaaccgatgcgaaaagactccttccgtggttcnggaaacggtttttgctgacgagagcaggtg

SEQ ID NO: 11318 - DNA, 101 bp, rice(Oryza sativa)
  misc_feature (71): n=t or c
tacgacgacgacgacgactttgaactactgaacgaggattggttattcttcagagatcaccagacaccacngaaggatgttcattctccgagcacacggtt

SEQ ID NO: 11319 - DNA, 101 bp, rice(Oryza sativa)
  misc_feature (71): n=t or c
tgttttaacaggtacattttctgtgtgtactacttccttcgtgctctcacttattctgaacatgcattttnccttcatttggtagtctggaaaagctagct

SEQ ID NO: 11320 - DNA, 101 bp, rice(Oryza sativa)
  misc_feature (71): n=t or c
cacctcctccccagtcgccaattccaacccctcgctcacgtagccctcgacaatctgatgaaaattgttgntcctgagaaactcctgggtcttcatctcag

SEQ ID NO: 11321 - DNA, 101 bp, rice(Oryza sativa)
  misc_feature (71): n=a or c
tcaacaacatttccgtatccttcgattgtgtcagcatcaactagtatttgaaactctgagcttaccaatgngaccaatattcatcccagaccgagcaagag

SEQ ID NO: 11322 - DNA, 101 bp, rice(Oryza sativa)
  misc_feature (71): n=a or g
ctagacatacctgttgaaattatcaacaagtttgaggaattctgggcagcttccagagctactccactganaggtgcttatgttccaatgtcagcttattt

SEQ ID NO: 11323 - DNA, 101 bp, rice(Oryza sativa)
  misc_feature (71): n=a or g
cctaaccatctacgaaaataggcctatgcaggcggctgactacccgcccataaaaatttctatgatctttnttagtgacaggagaagcgtctgaccacatg

SEQ ID NO: 11324 - DNA, 101 bp, rice(Oryza sativa)
  misc_feature (71): n=a or g
cccaaaccgcatcatcacagataacgacacacaaatcacaagcgacctgttcagagattactgtgagggcnttgggatcaaactttgctttgcctctccca

SEQ ID NO: 11325 - DNA, 101 bp, rice(Oryza sativa)
  misc_feature (71): n=t or c
tttctttatggcatttcatgaactgttctaaggctaagacctcatcattatctgatgatcagtgggagtcnatcaccatgtcattatctgatgtgtgggag

SEQ ID NO: 11326 - DNA, 101 bp, rice(Oryza sativa)
  misc_feature (71): n=a or g
gttatttgcagaggatcaaaaggatttgttttcctttctggcgaagtcttgatatctggtacttgaggagnaacatacgtaggaactggttgtgcaaaaag

SEQ ID NO: 11327 - DNA, 101 bp, rice(Oryza sativa)
  misc_feature (71): n=a or g
gccccaagcccgcgaacccttcggtccagaaaccgcagcatacattggatcactagatgctgacaaagacnttgcgcttctcaagttccacgggtgggcgc

SEQ ID NO: 11328 - DNA, 101 bp, rice(Oryza sativa)
  misc_feature (71): n=t or c
accggatctggctgctaataggagccgtctgtcgatcctctcttctgctttctctgataggctagtgtcantgtcatattcttcagtttcgctccctgatt

SEQ ID NO: 11329 - DNA, 101 bp, rice(Oryza sativa)
  misc_feature (71): n=t or c
taacaaaatactattattcctatcagtccagttagctcggtcagcaatgctcaccggagggccgccgaagntgcctaattcctccacctcatcgtcccatg

SEQ ID NO: 11330 - DNA, 101 bp, rice(Oryza sativa)
  misc_feature (71): n=a or g
ccttgctcttttcgtccaaatgcacacaagaccccactcattttcaccatccaccatgcaacaccaagatnaagatcctgacattcctctgtaattttgca

SEQ ID NO: 11331 - DNA, 101 bp, rice(Oryza sativa)
  misc_feature (71): n=t or c
ctactagtcgatgatgtgagccgctacatatggcttactctgctagcaagcaaggatcaagcaccggcggngatcaagcgcttccaagcggcggccgagct

SEQ ID NO: 11332 - DNA, 101 bp, rice(Oryza sativa)
  misc_feature (71): n=t or g
atgctattaggtatggttctccaaccatagatgatatcgaagcgttcacaattgcataccgtgcaaagatngatgatgcagagtcagcaggcaggatacca

SEQ ID NO: 11333 - DNA, 101 bp, rice(Oryza sativa)
  misc_feature (71): n=a or g
gccgccggcgtgtgcttcttgatgaactccggcgtggtcacggccatatcgtagagatcggcgagcttgancgcgccgtcgccgtcggggaggagcaggag

SEQ ID NO: 11334 - DNA, 101 bp, rice(Oryza sativa)
  misc_feature (71): n=t or c
ttgtttgcaccaggatcaattgagggtcggatggttcagtggtttcagaaagcttcaagcacaatagtganaaatatttccattgatgccactaagtacat

SEQ ID NO: 11335 - DNA, 101 bp, rice(Oryza sativa)
  misc_feature (71): n=t or c
attacaagcaagctgagaagctttgcactaaggtacacccagatcttcctgcaaaagtcccatctgatacngcatcttttggtagaccaaggtgacatttc

SEQ ID NO: 11336 - DNA, 101 bp, rice(Oryza sativa)
  misc_feature (71): n=a or g
tgcatcaggttcagctgtagtattgtcctgtagctcattttcaacagttaaattagtaggtaatggattantcatatggttaagcactggttcatcccctt

SEQ ID NO: 11337 - DNA, 101 bp, rice(Oryza sativa)
  misc_feature (71): n=t or c
ctttgtcgtagttgactacgagatcgcctacaggatataccagtactacaccaagtaggtggtaacttaantagagaaagaattaaactacatatatactg

SEQ ID NO: 11338 - DNA, 101 bp, rice(Oryza sativa)
  misc_feature (71): n=t or c
aacttcagcgctgagagtagcccagacatcttgaatagagcccgaatgtaagtcgcctggtttaaaacacnataaaacacgtgttagttctcaaatagagg

SEQ ID NO: 11339 - DNA, 101 bp, rice(Oryza sativa)
  misc_feature (71): n=t or c
ctcactcgcggcccaggtggaagccgctcgtcggcgtcattgttgacgtagcacagcacggcgatactggntgccacgacgaggcaagatgatgatacgag

SEQ ID NO: 11340 - DNA, 101 bp, rice(Oryza sativa)
  misc_feature (71): n=t or c
gctacaacgaactgccgacgcctggccaatgtaccctcttccaaagaatacttatcattgctcatgcttanagctctctcaaactgctccaactgcaaggc

SEQ ID NO: 11341 - DNA, 101 bp, rice(Oryza sativa)
  misc_feature (71): n=t or c
aatggcccatccaatgtgcctgtaaaatatataactccagaactctcattgacaccagcaatttggtcgancatccaatcaccttgtgtgaggggccccaa

SEQ ID NO: 11342 - DNA, 101 bp, rice(Oryza sativa)
  misc_feature (71): n=t or g
cctcaataactctcttgtaacgctgtttgtccattggactgccaaaaagaatgttctcctcaatgtttccngactgtatccaggcagtctgagggacatat

SEQ ID NO: 11343 - DNA, 101 bp, rice(Oryza sativa)
  misc_feature (71): n=t or g
ttatcctaaagaagaaactctatccagacattcggtactggggcctaatgggcttcatggcaaatggacgncacctgttactggtatcagggtatgattat

SEQ ID NO: 11344 - DNA, 101 bp, rice(Oryza sativa)
  misc_feature (71): n=t or c
ttgctgcaagatccttttccaagctctccaatgtgcactcatgatagtccacaacccattcaagccattangcgccacttcaacacaagtaccatcatcaa

SEQ ID NO: 11345 - DNA, 101 bp, rice(Oryza sativa)
  misc_feature (71): n=a or g
ggactattatttgctactccctttgtcccataatgtaacaatctaggtcccatactaggactacgaatttngacatgaccctcctttcgtcctataatgta

SEQ ID NO: 11346 - DNA, 101 bp, rice(Oryza sativa)
  misc_feature (71): n=t or c
gtgtcaaacattttgaaacggagggagtactatttcttcagacctgtcatggttgctagggctgtcatctntgaggcatcttgacatgagttgggtggatc

SEQ ID NO: 11347 - DNA, 101 bp, rice(Oryza sativa)
  misc_feature (71): n=t or c
ccgtgcttgttacacctccatcttcgttttgatatgaatctgattgatttgatgggccacatgacacctcncagcgaactaggatcaagcagtagtaactc

SEQ ID NO: 11348 - DNA, 101 bp, rice(Oryza sativa)
  misc_feature (71): n=a or g
tggtggatcgtcaccgcaccgcgcatgatgttgtccgcgccgacgtcatacacttggttgaacctgtgccnctcgatggcgtccacgatcctggtgaggtc

SEQ ID NO: 11349 - DNA, 101 bp, rice(Oryza sativa)
  misc_feature (71): n=a or g
tcagaggcggtgacgagaaagatcacctaactcgctgcctttgtcttcttcagaccgtctccatcggtacncctctgcgcccacgaccccagagccccgca

SEQ ID NO: 11350 - DNA, 101 bp, rice(Oryza sativa)
  misc_feature (71): n=a or g
acctttctccaatgatccttctctttcttaagttgtcgttgggcagatttatcaatagtttgatccttctncaatctgttacgcaattcgtaccaattggt

SEQ ID NO: 11351 - DNA, 101 bp, rice(Oryza sativa)
  misc_feature (71): n=a or g
gaagtgtagatggtacttcgataataacggtggccgactgctgcaaggtatgggcattaccatcttctcanagaaagagctagaaaatataacacaaaagg

SEQ ID NO: 11352 - DNA, 101 bp, rice(Oryza sativa)
  misc_feature (71): n=a or g
aagtgctcacgccatccttgcgacacgattcagtcaagcgccaacgcatatgccaaattgccattcttgcnatgcgatttagctctcatcactcacctctc

SEQ ID NO: 11353 - DNA, 101 bp, rice(Oryza sativa)
  misc_feature (71): n=t or c
ctagaactttatcagctgatgcatcaattttatccttggcagtcaatgcaactagaggatccttgccgttngtcagtctctcttgccagaaataatccagt

SEQ ID NO: 11354 - DNA, 101 bp, rice(Oryza sativa)
  misc_feature (71): n=t or c
actttcaattttaacgtggaactaaacacaccctcagttgaaagtttgaaccagttgttttgagaacaccntaattaaactttctccatttaaaaccaagg

SEQ ID NO: 11355 - DNA, 101 bp, rice(Oryza sativa)
  misc_feature (71): n=t or c
ttggtgatttgctaatggacactttcgggccagttggagagataaaatcttaaagaaagacgagaatgccntaaaaccacatgcttcaacacatggcatta

SEQ ID NO: 11356 - DNA, 101 bp, rice(Oryza sativa)
  misc_feature (71): n=t or c
ttgctttgcagcgtatgggctaatggagatgtgatggctggtgctgaaatgctcacctcaactactgaacnttgaatgcacagcactactactacaagtca

SEQ ID NO: 11357 - DNA, 101 bp, rice(Oryza sativa)
  misc_feature (71): n=t or c
ttacaaaacgggccagaaattctggtctgcacaaaagggcccaaaaatagcccgtttctttcttcacatgntccagtagaactaggaagatagcctgcaca

SEQ ID NO: 11358 - DNA, 101 bp, rice(Oryza sativa)
  misc_feature (71): n=t or c
atactgcaataacaggtactaccacaacataacatcaaatacattgacagtgcttgaggcaatggcagcanataatgtaaaaactctgatatactcaagta

SEQ ID NO: 11359 - DNA, 101 bp, rice(Oryza sativa)
  misc_feature (71): n=a or c
cacacgtagtacaggggcggtaggcagcgcaatactatacgagagttcgatcgatcgatcccaacaacacncacatgtccgtccaaatctagcaaagcccc

SEQ ID NO: 11360 - DNA, 101 bp, rice(Oryza sativa)
  misc_feature (71): n=t or c
gctcaagcttggttataatgtcgatggagttgatcaagaaagtacgataccagttggcattcagtacttanatggcctcaaagagatctccgtaaaaattg

SEQ ID NO: 11361 - DNA, 101 bp, rice(Oryza sativa)
  misc_feature (71): n=t or c
cccatctcgagatccaatttaatggtatgtatgtagcacgtgtacggtgtacgtgaatgtatgttactagnatgtatacgggacaggaggacactacgaat

SEQ ID NO: 11362 - DNA, 101 bp, rice(Oryza sativa)
  misc_feature (71): n=t or c
gactgcaactcagaatgtgagagagattaaggaacatctatgatcagtgatctatctacctcgacgccggnagagatggcttggacgacctttggcacgta

SEQ ID NO: 11363 - DNA, 101 bp, rice(Oryza sativa)
  misc_feature (71): n=a or g
atcttgcattagcgcaagaaacgaaccccaatccattttgacatggcgtcagggaatgtgaagaataggtnaatcacgcagaagaggagtggattacaaca

SEQ ID NO: 11364 - DNA, 101 bp, rice(Oryza sativa)
  misc_feature (71): n=t or c
tttccatttcagagagagagagagagagaaggccaatcttactaccccaattccatccccctttgcatatnctcactcactctcaagtctcaactcaactc

SEQ ID NO: 11365 - DNA, 101 bp, rice(Oryza sativa)
  misc_feature (71): n=a or g
tttgcagctagacaaacgtgcaatgacctaggagatttagcgtgcactgacgagacgtgcaagaagatatncggagacagattagaatactactgcaagcc

SEQ ID NO: 11366 - DNA, 101 bp, rice(Oryza sativa)
  misc_feature (71): n=a or g
gcatcgatccgtgcagtgaccacctcgaggcttagcaggtgctccatcccaacaggtgtccggccgtgctnctgctccgctatgccggcggcacggaagcc

SEQ ID NO: 11367 - DNA, 101 bp, rice(Oryza sativa)
  misc_feature (71): n=a or g
gctcaatctccggaggttttttagggaagggaaccacgaatcaaacaagaagcgttttgcagctatatccnaataagaataataaagagacagatctagat

SEQ ID NO: 11368 - DNA, 101 bp, rice(Oryza sativa)
  misc_feature (71): n=a or g
tctttcttaatgccacatagggaaaaacctctataatcggtcatctggcaacaagcgcagtaaaagacctngccaaccttagggttacatagaaatgctat

SEQ ID NO: 11369 - DNA, 101 bp, rice(Oryza sativa)
  misc_feature (71): n=a or g
ggcctccctctaaatgggcccagaaagcccactaatcccatcgcattcgccatttcgcctccactgtggcngaaatatctcctccgcttaaacccccacat

SEQ ID NO: 11370 - DNA, 101 bp, rice(Oryza sativa)
  misc_feature (71): n=a or g
caaggtcccttgtagcactgccagtgcttgctcagcagaaggcctgaatatgcaatgacaagagtaatttncaagtacctcatcaaaaaaaaaaaatacaa

SEQ ID NO: 11371 - DNA, 101 bp, rice(Oryza sativa)
  misc_feature (71): n=t or c
cacgcctcactacattttcaatatccaaggtggccactttcaagggctcaaactcgctttcaaggtgatgnttgtcactcgcgcgccatcagtgttaaaaa

SEQ ID NO: 11372 - DNA, 101 bp, rice(Oryza sativa)
  misc_feature (71): n=t or c
accaaagcaaagcaacgagctagcaagggcaacaacaaccacccctctcctcgtcttcgtagttggttatncctctcagctacaccattttgttaacaatg

SEQ ID NO: 11373 - DNA, 101 bp, rice(Oryza sativa)
  misc_feature (71): n=t or g
tcttttttgcctctaatccttcagaatttaagcagctgatgccctcttgcggcctgagaccactccagganaaccatcctgacgccgatgagctccctgtg

SEQ ID NO: 11374 - DNA, 101 bp, rice(Oryza sativa)
  misc_feature (71): n=t or g
tgacaccgatactaatactatatatccgcccctgcttatgggtaccaggttcgattcctatgggtaccttntctgatacttatggataccagatccgatct

SEQ ID NO: 11375 - DNA, 101 bp, rice(Oryza sativa)
  misc_feature (71): n=a or g
ccctcgaccttccttgcgagaccccattgtccgcgtaccctcttcgatccaatgtttgattggttgtcctnttgctcatcctcgtttccctcctcgtctac

SEQ ID NO: 11376 - DNA, 101 bp, rice(Oryza sativa)
  misc_feature (71): n=t or c
atgaatcaccaagtgcatgacataatctatgtatgcttcgtggaagcatccagcaaggtgaaatttacagnccatcgtttggtatattggagacaaaagta

SEQ ID NO: 11377 - DNA, 101 bp, rice(Oryza sativa)
  misc_feature (71): n=a or c
tgccgagtcgtcttccatggaagcaagaacagagaatcggcttttcctaggacggcgatcgggcacgcctncccggccagctcggccgccggtagcagggc

SEQ ID NO: 11378 - DNA, 101 bp, rice(Oryza sativa)
  misc_feature (71): n=t or c
ctgctactcccaaatgtgcagaaatatttttggtgaagacgttatacttaggccgaagggcctttgcagcnggtccaccatcagctccaaattcactaaac

SEQ ID NO: 11379 - DNA, 101 bp, rice(Oryza sativa)
  misc_feature (71): n=t or c
ggatgaagtacatgagttacatcccccaaagggggaaagctgatagaacagctagttttgcagaaaaagcntctgagtaatgggcaaaatacacttcaaac

SEQ ID NO: 11380 - DNA, 101 bp, rice(Oryza sativa)
  misc_feature (71): n=t or c
tccttcatcctcccttgtctgaaacacccagcagtgagatggctgtatgtagcatcatacggcttcaacanaatagagatcatttcttcaaacaattgcat

SEQ ID NO: 11381 - DNA, 101 bp, rice(Oryza sativa)
  misc_feature (71): n=t or c
tggtgtgtgtggtctcccattttgtgatttttgtgaagtggagatagtggcagggatcatgatacgtcgangcaaagttgcaaacaccttttgctgtccat

SEQ ID NO: 11382 - DNA, 101 bp, rice(Oryza sativa)
  misc_feature (71): n=t or c
agagatagacgagaaggatgattaagaataaaacattcggcctcgtggctatgtacgctgagtgtacgaangtgttgtgggaggaggggatggaatgatga

SEQ ID NO: 11383 - DNA, 101 bp, rice(Oryza sativa)
  misc_feature (71): n=t or c
gtaggccttccagactctgttggaggagttttatcaggacctgtgtcaaatgtggcaacaaggtggtactntggtatttggtagaaatttatattgaaatg

SEQ ID NO: 11384 - DNA, 101 bp, rice(Oryza sativa)
  misc_feature (71): n=a or g
ccaacagccagccacaggtagccgatgttcttgaagaaccaagcaaggcaccgccgctgcacctggcactngcgctggcagtccacggggatgagatcgcc

SEQ ID NO: 11385 - DNA, 101 bp, rice(Oryza sativa)
  misc_feature (71): n=t or c
cttcaatgtttctgagaagttgagcaagcaaaattatcagctgtggtgcgcacaagtgctgactgcgattngtggggcacgcctcaaggggcatctgaaag

SEQ ID NO: 11386 - DNA, 101 bp, rice(Oryza sativa)
  misc_feature (71): n=a or g
agcagatattcctgttgctcgccctcacacgcgactgcaaagcggaatcagaaaagagaaagactacattnacggtactcttaaatggggtcgtctgacat

SEQ ID NO: 11387 - DNA, 101 bp, rice(Oryza sativa)
  misc_feature (71): n=a or g
taatgtaaacttgcctggatcatgtagtattatggacctggcttcaccttactaatcacctctagcttagnactggtaatgtaaacttgcctggatcatgt

SEQ ID NO: 11388 - DNA, 101 bp, rice(Oryza sativa)
  misc_feature (71): n=t or c
ggtcaccgggaacacagtcacgtgcaccctctttcgagatgaaggctacaacgatttgactgcaagtctgnaacaaacgccattgttccgtgaagtctaca

SEQ ID NO: 11389 - DNA, 101 bp, rice(Oryza sativa)
  misc_feature (71): n=a or g
agcttcttctgctaccccccacaagcttcctcaaagaagagatcggccaccattttgtggtctcatttctnagctccctttttgtttcctgattgctggtg

SEQ ID NO: 11390 - DNA, 101 bp, rice(Oryza sativa)
  misc_feature (71): n=t or c
tgaaattaatattgacggttacgtgacgccatatgaaaatcgatctttgctaatcctggggcgtttatacnaacggattaacccctcctgtctctgcatct

SEQ ID NO: 11391 - DNA, 101 bp, rice(Oryza sativa)
  misc_feature (71): n=a or g
ctcgccgctccccgctcccagcccatcacagcagctgtggtgtccagatgaccagatccgacggctagctntgacccctgtggcggccggaattcggacgg

SEQ ID NO: 11392 - DNA, 101 bp, rice(Oryza sativa)
  misc_feature (71): n=t or g
caaaaaaaccaaaatatacttgagagaatttcgagccagaccagtctatgtaccttgaggaagacagcatnggctgctggaatactgtcaaacatgtcgcc

SEQ ID NO: 11393 - DNA, 101 bp, rice(Oryza sativa)
  misc_feature (71): n=t or c
tctaggtgctctggcggcttcaactctacccctgcaaccgtagcaactccagcacaccaccgccgtgaccnatcggccactgcgaagcctgtggctgctgc

SEQ ID NO: 11394 - DNA, 101 bp, rice(Oryza sativa)
  misc_feature (71): n=a or g
cgatacacaaggcttgctagcatgatctcgatggtggtgatcgcgaagtttatacctgggcatatccttcnaccagtcctgaatggcaagaaattgaaatt

SEQ ID NO: 11395 - DNA, 101 bp, rice(Oryza sativa)
  misc_feature (71): n=a or g
atttatgttagacatctctcttgctccagtttgttgttgttgttggccactttggcctgtacttgctccangctgattattttcttcttctctgtctcctt

SEQ ID NO: 11396 - DNA, 101 bp, rice(Oryza sativa)
  misc_feature (71): n=t or c
cagattcaacgacgtcggcccgacttgcgtctaatcatatcctctgcaacaattgaagcaagatccatgtnaacttttttcaacattaggtcatttcctta

SEQ ID NO: 11397 - DNA, 101 bp, rice(Oryza sativa)
  misc_feature (71): n=a or g
tcgtgatgctcggtggacggctgcgtttcccaacaaatgcttcgctcgatcaatggtggaaggttgtgtgngacttgagagagcgtgcgtacgtgcaaccc

SEQ ID NO: 11398 - DNA, 101 bp, rice(Oryza sativa)
  misc_feature (71): n=a or g
tccgaagatacatcgccaaaggatgcttgctggtgcaaattggcaattgccggaatcatccccaaggactnagccgaatgtgagtcagaccctgattggtc

SEQ ID NO: 11399 - DNA, 101 bp, rice(Oryza sativa)
  misc_feature (71): n=a or g
tacatgccgatactccgtcccattcttccgcaagtccaacaagtcaagatgtcctcatcagcgccaacagntaggccagctgttcttttttttttccctcc

SEQ ID NO: 11400 - DNA, 101 bp, rice(Oryza sativa)
  misc_feature (71): n=t or g
tctttttgagtccgacgagcaagaccgtacctccaaaaaattcagatcattgattttccaccctactccgnagctggtgtagtggatgtcgtctttttgac

SEQ ID NO: 11401 - DNA, 101 bp, rice(Oryza sativa)
  misc_feature (71): n=a or g
tgcttttcccgcccacaagcccacccgtgggagagccatcgtaaaaaaccagcacctttctttactaatangtacttgctacattcatccctctttccata

SEQ ID NO: 11402 - DNA, 101 bp, rice(Oryza sativa)
  misc_feature (71): n=a or g
acctgtttggtcatccagcacaacaagaactgatcttctgagttcctgaagttatgccaccatcactactnctagtagtagtactggtatgaccacatttc

SEQ ID NO: 11403 - DNA, 101 bp, rice(Oryza sativa)
  misc_feature (71): n=t or c
aattacaaaaacgaattcattgcatcctactcgttccgtttttgtggttctcaatagattccgtcaccgcngactgggagttgccggctaatgccaattgt

SEQ ID NO: 11404 - DNA, 101 bp, rice(Oryza sativa)
  misc_feature (71): n=t or c
tgtgctggaatttgtcaatggtgttggcttcacatttgctaatgtataggaatttcaagacgtggaatctntttgggctgtgttgccagatcaaaacaggc

SEQ ID NO: 11405 - DNA, 101 bp, rice(Oryza sativa)
  misc_feature (71): n=t or g
attctgaaccttcattgggtacactgcatgtgcttgagcagtgtatattgttgcaaaagtggcatttgatngcacatttgtcctataaataagtttggtca

SEQ ID NO: 11406 - DNA, 101 bp, rice(Oryza sativa)
  misc_feature (71): n=t or c
caagacgtacgaacgactccggcgggagttgtaaaacaatcctagagttcattattagttgacgttagagncttaactgtttgtatgaaaaataaatgacg

SEQ ID NO: 11407 - DNA, 101 bp, rice(Oryza sativa)
  misc_feature (71): n=t or g
tggctacttgaatttttttcgcagcattcactgactctcatgcatcaatgtctgaggacgcattgaaaganaagcatgccaacttaaccggtgaagttgta

SEQ ID NO: 11408 - DNA, 101 bp, rice(Oryza sativa)
  misc_feature (71): n=t or c
gtgccaaggagaaccattacaatgtgtcgctggattacggcacactagtcgtcacagattggagccatgtngggttcaacgaggtggactacgggtttggc

SEQ ID NO: 11409 - DNA, 101 bp, rice(Oryza sativa)
  misc_feature (71): n=t or g
cagacaggagaagcttctagaaccttccagaagcaaggtagctaatcgatcgatcgatcaatggcggaganggtggcgaggctggcgtcggagagggcggt

SEQ ID NO: 11410 - DNA, 101 bp, rice(Oryza sativa)
  misc_feature (71): n=t or c
acattcagcctttttccaagggtgtgcataaggtgcatcgttgtgtgttgactcaccattaatcctcatcntttttctgatgtctgaacctgaaccgccga

SEQ ID NO: 11411 - DNA, 101 bp, rice(Oryza sativa)
  misc_feature (71): n=t or g
gcttctttcttttttctttagcttattaggttgtttcctctcgagtctaaaccttttggtacctgacttangcatgcaaaccaaatcaaatgaaacgactt

SEQ ID NO: 11412 - DNA, 101 bp, rice(Oryza sativa)
  misc_feature (71): n=t or c
tgacacggtatcgactgttactcccactcaacgcccttccatgcaaggatctttttcaccatccaagaacngacgtcggcgacgcaatgcttgtcgcactt

SEQ ID NO: 11413 - DNA, 101 bp, rice(Oryza sativa)
  misc_feature (71): n=a or g
gacacgcatgctgtctcttccaggaaagcactgaacctcacgaattatctgcttagtgaaagccattccgnttgctcggtgtttgcacagctaggtttccc

SEQ ID NO: 11414 - DNA, 101 bp, rice(Oryza sativa)
  misc_feature (71): n=a or g
ctaaaatgttgaagtataggggcttttttacaaaaaaacacccactaaccatccccccaaaaccctagccnccgccgcccgtctcctcctacctctttgtc

SEQ ID NO: 11415 - DNA, 101 bp, rice(Oryza sativa)
  misc_feature (71): n=t or g
gtgttgcacaggagttgctgcgtttactgaattgctcttacgccctagaacttcaaggtgaaaagttttgncgtgtcacatcggatatacggatacacatt

SEQ ID NO: 11416 - DNA, 101 bp, rice(Oryza sativa)
  misc_feature (71): n=a or g
ttgaccgcacgtagaataaaacaacttatttgtgacaatggggagaacacatcgttaacagaaatagtcanccatcctgaccggatggattttccttatcc

SEQ ID NO: 11417 - DNA, 101 bp, rice(Oryza sativa)
  misc_feature (71): n=a or g
acccaaaaaatttttccactagttttccaccaactgaaagtttccctactctcaacctattactccctccntattttaatgtataacgccgttgacttttt

SEQ ID NO: 11418 - DNA, 101 bp, rice(Oryza sativa)
  misc_feature (71): n=a or g
gggaatgcagggcgttgccgatctccaaccatcaccatcagtaccggatctacccctcatcgccatcgttntcgacacctcaaggctggaggcagctcgat

SEQ ID NO: 11419 - DNA, 101 bp, rice(Oryza sativa)
  misc_feature (71): n=t or g
accatatttccattccaaagctcagtgagccaaacttcactctgataaacttggtcacccctgtgcattgngctatagttctggtagattacaccctgttc

SEQ ID NO: 11420 - DNA, 101 bp, rice(Oryza sativa)
  misc_feature (71): n=t or c
aattcactcacatggaggagcagcctcaagctctcttccaacaatgtttggaaatgagcagccaacatggnaacaatggtgagcaaatccttcatatgcaa

SEQ ID NO: 11421 - DNA, 101 bp, rice(Oryza sativa)
  misc_feature (71): n=a or g
gggcaaagcagaaagtggtgttctaagaattgcacgagtactagatgaagttacgccagtaggggatgacnattgcaaaggttggcttgccagcacagata

SEQ ID NO: 11422 - DNA, 101 bp, rice(Oryza sativa)
  misc_feature (71): n=a or g
atacatcagagagtattgcctgaaatccatctagcaaacatctcgagacactccttaggtttatactctgnagcagtgtgcccagcaccctgaagtattgg

SEQ ID NO: 11423 - DNA, 101 bp, rice(Oryza sativa)
  misc_feature (71): n=a or g
ttcaatacattttttttaatgataagaagccctgctttcttatagtacctaagtcatgtttaatctaccanatcaatttcagtgaagtacatgaaggaaaa

SEQ ID NO: 11424 - DNA, 101 bp, rice(Oryza sativa)
  misc_feature (71): n=t or c
aaccatcgagtcacaatctgaaacatccacttcgaccaactcgattgatgaaaaagttaccgaggcaccanaagttgagaatgaagaaattcagactctgg

SEQ ID NO: 11425 - DNA, 101 bp, rice(Oryza sativa)
  misc_feature (71): n=t or c
tctagaatctcacagcctatactgacacatggttcacctttagcagatgattcctccaacttggtattagnactggtatcatcagatgatatgtcatcaac

SEQ ID NO: 11426 - DNA, 101 bp, rice(Oryza sativa)
  misc_feature (71): n=t or c
gtactaatactgaaatgtccatttgatgcacagaaaaataagtgtagcacacggtagtaccaaagtactcnctccgtttcaaaatgtttgacacttttagt

SEQ ID NO: 11427 - DNA, 101 bp, rice(Oryza sativa)
  misc_feature (71): n=a or g
tttcctagtaacccagttatcttcagcactgctatcagcagcaagatgatcattacacttttcagtcacangtagtaatttgtgatttctcctgggtgaca

SEQ ID NO: 11428 - DNA, 101 bp, rice(Oryza sativa)
  misc_feature (71): n=t or c
aaactgcaaagaatcattgcagcacgcagctctatcagactataagacattctggccttaggagaggatgntaggctaggacctcctgagcttaatgttga

SEQ ID NO: 11429 - DNA, 101 bp, rice(Oryza sativa)
  misc_feature (71): n=a or g
aagtgtgttgagacctggtatctccatgacgttgatcaaagtgatgtttgatccaaccttattgaccgccntatctcttggcttgtcaagcatggctgcct

SEQ ID NO: 11430 - DNA, 101 bp, rice(Oryza sativa)
  misc_feature (71): n=t or c
atcaccgcaaaaaaaggaaaatctaatcagtgataaacacacactttaagccacgtatctttgattctttnccccttcttttcctgctatcttgggctctt

SEQ ID NO: 11431 - DNA, 101 bp, rice(Oryza sativa)
  misc_feature (71): n=a or g
agatgttgctaagaataggagaggaggaggagacgttgagattgttggtgagaatctaaaagagagtgtgnatctgttgctttatggttgccgaggctgga

SEQ ID NO: 11432 - DNA, 101 bp, rice(Oryza sativa)
  misc_feature (71): n=t or g
gagagtgcccgttgctaattggtgtttaattgtttgtagtatttttgctgtatctccgacttgtgcccgtntgctgtaacaaacgaagtctgaggttcagt

SEQ ID NO: 11433 - DNA, 101 bp, rice(Oryza sativa)
  misc_feature (71): n=t or c
gtgcgggaagaggaaccagagggatgagttcttcctgttgcggaatcgacttctgagttctgacgccatanacatggcccaagaaagaagccgataaggag

SEQ ID NO: 11434 - DNA, 101 bp, rice(Oryza sativa)
  misc_feature (71): n=a or c
acttgctcgtattatgaaggaaagacagttgagcaacaaagagctgcaatgtatatttgaaggtgcaagtnctgggaagatgtgtattaacccaaaagcat

SEQ ID NO: 11435 - DNA, 101 bp, rice(Oryza sativa)
  misc_feature (71): n=t or c
ccaaggcgcacaagctcgttcgtcggctgggttcgagaggacctcatggaccacatggacaatagcggccnatatgtgttggtgcattttccttttaaatc

SEQ ID NO: 11436 - DNA, 101 bp, rice(Oryza sativa)
  misc_feature (71): n=a or g
cccctaccaccatggcaagcctcacctgcacaagatggaggaggtcaagctcgcggcgatgaaccgcttcntcgcaaccgcgaacggcgcctctgccggtg

SEQ ID NO: 11437 - DNA, 101 bp, rice(Oryza sativa)
  misc_feature (71): n=t or c
aatgatgtctatcaatcatctcgcaaactctatgctcggcacagctttcttcgagaggccataaaccccanttgttttgctcccaccgtaccatgtagaca

SEQ ID NO: 11438 - DNA, 101 bp, rice(Oryza sativa)
  misc_feature (71): n=t or g
atatacatagccttcctcatacacttggtcactttggaacttcggtccataccattcatattgtgacaccnctggctggatcatgtttctgtttatcagct

SEQ ID NO: 11439 - DNA, 101 bp, rice(Oryza sativa)
  misc_feature (71): n=t or c
gtggtaattcatattgtgttcatcactctcgaagatgaggataagaacaagacaagtgtgcacagcactgntcaaactggtccacctgtgataaatcctct

SEQ ID NO: 11440 - DNA, 101 bp, rice(Oryza sativa)
  misc_feature (71): n=t or g
tcgacaagggaaacgacgagggagctccacttactcaggctcatctttcacttcactcgcagagatcccancaacctctaatctcccatggaaaggacagg

SEQ ID NO: 11441 - DNA, 101 bp, rice(Oryza sativa)
  misc_feature (71): n=a or g
tcttcttggtcttcttcttgggagccagagctgattggtcaatagccaatgccttggcctttctcttcctnccaacatcggccggttctctcatctgtcgt

SEQ ID NO: 11442 - DNA, 101 bp, rice(Oryza sativa)
  misc_feature (71): n=a or g
atgacgttaacacgagttggcggcacagaggcaaaccgatgcgcgaagataccagtcagcgacagacgagnaggtcgtagtggtgatgaaaccagtcggcg

SEQ ID NO: 11443 - DNA, 101 bp, rice(Oryza sativa)
  misc_feature (71): n=t or c
aactctgaggaattcacatgtgtaatacccacagaggaccatggcttttgtacatttgtgatgcctgtatngtcgaagcttgttcgatgttctattctagg

SEQ ID NO: 11444 - DNA, 101 bp, rice(Oryza sativa)
  misc_feature (71): n=t or c
acatggttttttctttttcctatccaggggccgttgatagaagacacttccaagctgatgaacaccacganacagatctcattcgcgtcagtccaagcctt

SEQ ID NO: 11445 - DNA, 101 bp, rice(Oryza sativa)
  misc_feature (71): n=a or g
gcggataaggtttgggttagtgggtgttattttgccaaaaaacccctactcttttctcattttgcagagcngtcccttttcgcccccaaatactgtttgta

SEQ ID NO: 11446 - DNA, 101 bp, rice(Oryza sativa)
  misc_feature (71): n=t or c
tgcacatatccaccaggtgggatatacttggatgctgcccttgtggctttcgcatcacggctgtcataacngacaatagcatctagtacttggactgcatc

SEQ ID NO: 11447 - DNA, 101 bp, rice(Oryza sativa)
  misc_feature (71): n=a or c
ctgaaactgtcatgaactgcaaatgcaatgaaacctgctcgctgatctctcatgattatcccaatgccatnatcttccagggtcactagcccatgaaatga

SEQ ID NO: 11448 - DNA, 101 bp, rice(Oryza sativa)
  misc_feature (71): n=t or c
aggaggggaatttatttgcatctgaactctatctggacggagaagaggaatgggaatggttgcaagaaaanggatcagtaaaagacaggagggcagggcag

SEQ ID NO: 11449 - DNA, 101 bp, rice(Oryza sativa)
  misc_feature (71): n=a or g
gtccataattccttcccaagttcccagcccaacccaagtccctactaaccgaggagagaggctaaccctangagagaggcagcgcaaccagggggttgagt

SEQ ID NO: 11450 - DNA, 101 bp, rice(Oryza sativa)
  misc_feature (71): n=a or g
aggccattagcactataagtcatatctcattcgcggaggaagaaagtgtttctccaaaaaagccgacttcnatagctgaggtggcgaagcagcgcgagcta

SEQ ID NO: 11451 - DNA, 101 bp, rice(Oryza sativa)
  misc_feature (71): n=a or g
ttgggcatcagagtgggttcggccaaacccattttggcccctcttcttctcatttttcaaaggtaagcacntcggactcctcactctcccccactttgagc

SEQ ID NO: 11452 - DNA, 101 bp, rice(Oryza sativa)
  misc_feature (71): n=t or g
tgaataaaatggcagttattgcttccttgctttatcagctaaccaccatatgatttcctaatagcacaaangtgacaatatactagtaacagtctagattc

SEQ ID NO: 11453 - DNA, 101 bp, rice(Oryza sativa)
  misc_feature (71): n=a or c
ctggatctccaaagatctttgcaggatttggagacgatacggccgaatctttcgacctcatataccatgtncaccatagctgcatgcaaaggatttcatgc

SEQ ID NO: 11454 - DNA, 101 bp, rice(Oryza sativa)
  misc_feature (71): n=t or c
aagcggaggtggcggacctggggggattcacgagcctccaatctctttcgtgtacaacaacccgtacatanctacaggcaagtgcatttcacttgaaactt

SEQ ID NO: 11455 - DNA, 101 bp, rice(Oryza sativa)
  misc_feature (71): n=a or g
accgacgaaagattgtttctccaccagtgcacataaaaatttttatttttccagacgactgcctccagacnggcaaaatccccacacgggaaaatgaattt

SEQ ID NO: 11456 - DNA, 101 bp, rice(Oryza sativa)
  misc_feature (71): n=a or g
taatatattgtgcttatttccatgcatgcagttgccaagggaggagcaacaaacaagctttgacaatacanccattaaaaatatccagcgcgatctctacc

SEQ ID NO: 11457 - DNA, 101 bp, rice(Oryza sativa)
  misc_feature (71): n=t or c
ctataagcatggacatggctgacccaattgttggttcaaagaatgagattcgtgagagatatatgcgtctngctgagataactgaactgattcatgtataa

SEQ ID NO: 11458 - DNA, 101 bp, rice(Oryza sativa)
  misc_feature (71): n=a or g
gtacaatgattttgtagctctatcagattttgatatttttatggcagtgcatccttcattctcctagcatnctcctccagccttttgagcccttgtttggg

SEQ ID NO: 11459 - DNA, 101 bp, rice(Oryza sativa)
  misc_feature (71): n=t or g
tgagtgccggtgtcaaatgcataggttgtcatcttgcccatattattcacggacacgagcagatagggganaaatagcacgtaggaggtgacgaggatgag

SEQ ID NO: 11460 - DNA, 101 bp, rice(Oryza sativa)
  misc_feature (71): n=a or g
aataaagaactttgatgtaggtagaagaagccatcaagcaattagggtcaccaatggagtgaacatggatngccgggcaaagcttgcagccccagttgcag

SEQ ID NO: 11461 - DNA, 101 bp, rice(Oryza sativa)
  misc_feature (71): n=t or c
ggcgtgctttcttttggccaaaatagatattggatcgaataacaggtatcagcaggacctgtgttcttgtnggattcggaggaggtcggtaatattgccaa

SEQ ID NO: 11462 - DNA, 101 bp, rice(Oryza sativa)
  misc_feature (71): n=t or c
acatctcctcgagagattaaaatccattcctggtagtgtgagctagcagtccatgcaagctgtaagacagngacaagaacaatttagcaatatgaaggcta

SEQ ID NO: 11463 - DNA, 101 bp, rice(Oryza sativa)
  misc_feature (71): n=a or g
actccctgagctacctgaatccactagaattaacacttctgttccttgaacctaccctagcatgcgcatantcccatctggctcagaaccttgtattgcct

SEQ ID NO: 11464 - DNA, 101 bp, rice(Oryza sativa)
  misc_feature (71): n=a or c
catggcatcccttctggctctcaagtggtggcccacgctagctctaacctctaataagtagtattatcttngttccgaaataagtttattttcactcctct

SEQ ID NO: 11465 - DNA, 101 bp, rice(Oryza sativa)
  misc_feature (71): n=t or g
gtgatggaatctgaaggcctagcttcagccagatgttgttccatacatgtctcgcataaaagcactccatnaagaggtgcacacttgtttcaggctctata

SEQ ID NO: 11466 - DNA, 101 bp, rice(Oryza sativa)
  misc_feature (71): n=a or g
aaaagcactgatagactgcaccagactccatcagcttctcggcatactgtttgtacatcgaattgcgctcngactggcgatacggcccaaattccccacca

SEQ ID NO: 11467 - DNA, 101 bp, rice(Oryza sativa)
  misc_feature (71): n=a or g
gaaagatgagagacatatgaaaaacctactgtgtgatactctcgagttgaatcaagttcttgaccgagatntctcagctctatctggtggtgaactccaga

SEQ ID NO: 11468 - DNA, 101 bp, rice(Oryza sativa)
  misc_feature (71): n=a or g
tagttctaggttagtttttctttttctttttttttgacgggagggactaccatgaaagcttgctgtgtgantgaatgttgcaggagtagaacctggaacga

SEQ ID NO: 11469 - DNA, 101 bp, rice(Oryza sativa)
  misc_feature (71): n=t or c
agtacattctagcacaatatactaccaaataaatacatagatacattttgcttaccagccagtgtcagtgngatgctcttctagaatatcggttgatacag

SEQ ID NO: 11470 - DNA, 101 bp, rice(Oryza sativa)
  misc_feature (71): n=t or c
acggccacgctgctgcagtggctagcaccgaccacataccaagagccgaggcagagccatattggcagggnaagacggctgcctcctctcctcgttggctt

SEQ ID NO: 11471 - DNA, 101 bp, rice(Oryza sativa)
  misc_feature (71): n=a or g
agagttcaatgcatacaatgcctgctttctccgattcagtgtttctacatgtgccatatcgctattacatncacaaaaatatgcctatactgttcttaaac

SEQ ID NO: 11472 - DNA, 101 bp, rice(Oryza sativa)
  misc_feature (71): n=a or g
taaagtcatcacaggtatctcgctatcgatggatacgcgtgttatctagcactaaaaaagataattagccnttaatgcaagcacacatgtcaattctatat

SEQ ID NO: 11473 - DNA, 101 bp, rice(Oryza sativa)
  misc_feature (71): n=a or g
aagtttaaataacttgaattgaaaatcatttcacactcctgtgttgtcttgtggctaggtattaaatatgntttgctgctggatagaaaatccgaactcca

SEQ ID NO: 11474 - DNA, 101 bp, rice(Oryza sativa)
  misc_feature (71): n=a or g
gcgatctgctgacatctttcttaatttctgctttttcggctttgcgtcaggtttaactactaggtggtgcntgatgcggtctagcgaaatgcctccaactt

SEQ ID NO: 11475 - DNA, 101 bp, rice(Oryza sativa)
  misc_feature (71): n=a or g
tggtttaccccgtacaagatcccgcggccatatcacctaaaaaaaattcttaatcacattcacacccaagnccaacacttcttcaaccaacacccgcactg

SEQ ID NO: 11476 - DNA, 101 bp, rice(Oryza sativa)
  misc_feature (71): n=a or g
actctttggctccaggctcagttaactgtctatgcatcaccttgttcaagttattattgcaacaagtcccnggctcccggcctctccatgacgctgttgct

SEQ ID NO: 11477 - DNA, 101 bp, rice(Oryza sativa)
  misc_feature (71): n=t or c
ggagagatgtactcatggaggagcttggcatcaagatgttcagtggtggggaggattgacattctggagcnctgaggagaccatgtaggccattcgatgca

SEQ ID NO: 11478 - DNA, 101 bp, rice(Oryza sativa)
  misc_feature (71): n=a or c
caatcgtcgagctcccaagaattcctacttacttccaatcgaggtattactgcaccatgatctagtgctgnaatctccaagcagcagtcttctctcagaga

SEQ ID NO: 11479 - DNA, 101 bp, rice(Oryza sativa)
  misc_feature (71): n=t or c
atatctgccgtgacgacgttcggacacatggagaagtcgcttgcctgattgcatcactctctatgactgtntgtctgtatctacacgtattgtagttacca

SEQ ID NO: 11480 - DNA, 101 bp, rice(Oryza sativa)
  misc_feature (71): n=t or c
ttactttatagtattgaatttaatcttgaagaacatccctccatcagacccctctccttctcctctcaccncctctccctctccctctcctcagagcctac

SEQ ID NO: 11481 - DNA, 101 bp, rice(Oryza sativa)
  misc_feature (71): n=t or c
tggaggtgtttgacatgatcttcatcctacgtgatacttatgagcgcagtttgagatctaatcaaccaagngatgccggccttgtcaagtgggaataaatt

SEQ ID NO: 11482 - DNA, 101 bp, rice(Oryza sativa)
  misc_feature (71): n=t or g
gctgaacttcctatgtaatagaagggcattgagttcctcattatttagccttttggaatcatgtatgtgtncgacatccacatcagatctttcaaaacctg

SEQ ID NO: 11483 - DNA, 101 bp, rice(Oryza sativa)
  misc_feature (71): n=a or g
tctaaacttctgatgattttttaaaatgcgcagccattcataagagaattcaattacccgatggccagtanctgtgctagtggggatagtggtgttttcgt

SEQ ID NO: 11484 - DNA, 101 bp, rice(Oryza sativa)
  misc_feature (71): n=a or g
caataggttcccgtgcttcctattcgagaagtccatgtgcagggccatatgcctccttaatcacctccgcntacccccgaaggagtggcccgacacctggt

SEQ ID NO: 11485 - DNA, 101 bp, rice(Oryza sativa)
  misc_feature (71): n=t or c
caacctcggtactaggaaggacaaccatttgtgctagttcttcagctttagctaaccgccactccgatagntccttggaagcaagttcctccgcagtcatt

SEQ ID NO: 11486 - DNA, 101 bp, rice(Oryza sativa)
  misc_feature (71): n=t or c
acactggatcttgcacagctggaagatgatataacggaagaagagcttaaggtgactgttttctccatgcnacctgagaaggcactggggccagatggttt

SEQ ID NO: 11487 - DNA, 101 bp, rice(Oryza sativa)
  misc_feature (71): n=t or c
acggttcaaaaagctttgtgactgacttcgtgcaggtgtaaaaagatgccagggaatgccagttcaacggngcgttcctaccagtgagagcaagtgatata

SEQ ID NO: 11488 - DNA, 101 bp, rice(Oryza sativa)
  misc_feature (71): n=t or g
agagaaaggagagaataatcaagagaggacagggggagagaggggaggagttgaaaaaaaatttgaagtgntgagagggaaaagagagtggaggggagaaa

SEQ ID NO: 11489 - DNA, 101 bp, rice(Oryza sativa)
  misc_feature (71): n=a or g
gtggattgactaggaaggggcatgcgtatttatagataagatgcaaaatggcacatgccatgctgctgaanaagtctagattatttcttaataactgttga

SEQ ID NO: 11490 - DNA, 101 bp, rice(Oryza sativa)
  misc_feature (71): n=a or c
atactgggaatttgccactttgtaagaggggatgttgtgagagggattaaactcgtttggtgcagagtggnaaaaatttaaatgccccctggataacggaa

SEQ ID NO: 11491 - DNA, 101 bp, rice(Oryza sativa)
  misc_feature (71): n=a or g
tctagacattctgcatggtgtaaacatgaagtgaatgatgaaattaacaaagtggtctgcttgagctatgnagagttgccttctcatttgaagcaatgctt

SEQ ID NO: 11492 - DNA, 101 bp, rice(Oryza sativa)
  misc_feature (71): n=t or g
agatattgaacttcggtcctgtcagttagggcctaaattcccaacatggctcaggtatctaacagatgtanacaatcttgatatctcaaacacaagcatat

SEQ ID NO: 11493 - DNA, 101 bp, rice(Oryza sativa)
  misc_feature (71): n=a or g
tccaaatgatggtttacgttcatatgatagcaaggttagtgcacagttacttcgcctttgtatagtggtgntattggttgagtaaataatccaagtcaaat

SEQ ID NO: 11494 - DNA, 101 bp, rice(Oryza sativa)
  misc_feature (71): n=t or c
tgtctcagattatgatttacttatactatgcccacttttgtaggtcatggtttctgtggctgaaaataatncggttattctttacataagggatgttgacc

SEQ ID NO: 11495 - DNA, 101 bp, rice(Oryza sativa)
  misc_feature (71): n=a or g
gcaaccttatggtggtggtactacatacaaccagcaaatcgctaatggggatctaccaaattcccagtatngccgcagacaaggtaataatagtggcgttt

SEQ ID NO: 11496 - DNA, 101 bp, rice(Oryza sativa)
  misc_feature (71): n=a or g
aggagaaatcacatcactcctaatgatggatcgtttgctgaatctatcaggaccacccctaggcagcatcnagaatatgaagataaagacattcaggagcg

SEQ ID NO: 11497 - DNA, 101 bp, rice(Oryza sativa)
  misc_feature (71): n=a or g
ccagctagaggtaccgcgtccactgcaatgcgacaagaaaggacgcgcatgacagtgtgcatattctcctncatccggtcaaaggtaagcctctgctcaac

SEQ ID NO: 11498 - DNA, 101 bp, rice(Oryza sativa)
  misc_feature (71): n=t or c
ctttgtgattttaccctcattttttgaactgaggctgatggttgcaaccattctgttaagatgactaaggntgtgttcggcagcctgggttgggaacccat

SEQ ID NO: 11499 - DNA, 101 bp, rice(Oryza sativa)
  misc_feature (71): n=t or c
ttggcttaatcagttttgagcatcctctcttggatactgctccatagtaataagattaagtaagctgcacnccacacattctttgagcgatatttgttcat

SEQ ID NO: 11500 - DNA, 101 bp, rice(Oryza sativa)
  misc_feature (71): n=a or c
cacgatgccgccgctggcacaactcctcaacgacgtcatctagttcaacatcctctcgtgcctgccttctnggtgctcatgtgcctcgccatcttctgtag

SEQ ID NO: 11501 - DNA, 101 bp, rice(Oryza sativa)
  misc_feature (71): n=t or c
cacttgtgccattgccatgccagctctctctatgtgagacgacacataggctgtgtttagtgtttaagatncaaacttcagtcattttttatcacatcaat

SEQ ID NO: 11502 - DNA, 101 bp, rice(Oryza sativa)
  misc_feature (71): n=a or g
tgttgtcagtaatccattgtgcaatgacgaagctctttccaacaaagatttaccaagccctccatctaagncctttcttgacaaaattactggtgcaagct

SEQ ID NO: 11503 - DNA, 101 bp, rice(Oryza sativa)
  misc_feature (71): n=a or c
cagtttatttggaaaatctcaaagcagaaccctcgtacttcctagagttcagatcttgtcaaaattcaganatttcacattgctcaaagtaaaggcacgag

SEQ ID NO: 11504 - DNA, 101 bp, rice(Oryza sativa)
  misc_feature (71): n=a or g
tggcctctaagaaagagcattctgctgtcaagagttttgataagcctaagttggcccctggggaactttgnaaggctcagcaactcaaggagtatcgcgag

SEQ ID NO: 11505 - DNA, 101 bp, rice(Oryza sativa)
  misc_feature (71): n=t or c
cgactacactatggggtattatcttgcagatgctatttatcctgcatgggcaacactagtgaagagtatcnagatgccacaaaggaataagagaaaatatt

SEQ ID NO: 11506 - DNA, 101 bp, rice(Oryza sativa)
  misc_feature (71): n=a or g
taatctccatagattccttggcctcaaaggaagaaggtcttccttacatacactggatgtgtttagttcancgcaaagtttggattttggttaaaattgga

SEQ ID NO: 11507 - DNA, 101 bp, rice(Oryza sativa)
  misc_feature (71): n=t or c
aaatttgaataatgcattgacatggcttcagagatgtatgtgcctttctaagctgctttgattgctcattntaatgcagagtttcatgttgaggttgctgt

SEQ ID NO: 11508 - DNA, 101 bp, rice(Oryza sativa)
  misc_feature (71): n=t or g
ggcgatgttaaccacattggatgtacatgcattagcaaagcgcaaccgatcgtgaattaatccacacgctnggataatatttcttcaaatacttgccatta

SEQ ID NO: 11509 - DNA, 101 bp, rice(Oryza sativa)
  misc_feature (71): n=t or c
atgggaccacgtataacaaaaaggaaacagagcaatcaacgttcgtacccgaacgagcaggcttttgccgnagtgcatccttcatcaaactcgttcagctc

SEQ ID NO: 11510 - DNA, 101 bp, rice(Oryza sativa)
  misc_feature (71): n=t or c
acacgcatcagcttgatggcatcccaggcgtctttggccatcggcttgacaacgagcgtggacagcatctngggtggcacagctcggagaatggcctccat

SEQ ID NO: 11511 - DNA, 101 bp, rice(Oryza sativa)
  misc_feature (71): n=a or g
cgcctccttctgctgctgctggagctcgacccgctgcactcaatctccgtcacgttgtcgaagatgctctntagagcctctctcttggcactagagcgatc

SEQ ID NO: 11512 - DNA, 101 bp, rice(Oryza sativa)
  misc_feature (71): n=a or g
aatgctttcctttccacagatgtacatttccttagtttcattgtcaattgatggtaagtttatgtgcaccnttgatgtcaagcttcctgaagaagaattag

SEQ ID NO: 11513 - DNA, 101 bp, rice(Oryza sativa)
  misc_feature (71): n=a or c
cttctccaagagcaccaagattcacagatcgtagtggttctggaaaaaaaaagtcctatatggcgaatgtntgaagctagtggttgatggaaaacaacagt

SEQ ID NO: 11514 - DNA, 101 bp, rice(Oryza sativa)
  misc_feature (71): n=a or g
cgtcatgctgctcctcttcattgtgcataggcaagtcattcttgactggtataaggtgattatcacggctnataccaagtattaggcctggtacgtcagaa

SEQ ID NO: 11515 - DNA, 101 bp, rice(Oryza sativa)
  misc_feature (71): n=t or g
tatacacatgaaacatcaatacaagaactgggtgcaaagtttacctgactcaagaccaacccagatttctntaattctttgcagcttagagcctctaaagg

SEQ ID NO: 11516 - DNA, 101 bp, rice(Oryza sativa)
  misc_feature (71): n=a or g
ctgatctctcaattaagcctctagctactgatcagtcctaagctagcagcaggtaggtgtcagaaaggtgntggctagctttcatggcgagcaatggcgag

SEQ ID NO: 11517 - DNA, 101 bp, rice(Oryza sativa)
  misc_feature (71): n=a or g
atcatcatcagaccttgtagagaccttgtagagacagtacatgttgtactctgccttgtctctaatctacnttaatcagcagaaatcaaacttgacactgc

SEQ ID NO: 11518 - DNA, 101 bp, rice(Oryza sativa)
  misc_feature (71): n=a or c
gttgaatctgctgctaactgtttctttttcctgctgttcacttcagttatcctcttgctcaaatggatgcngaccaaccacaggtagacacttgcaccgag

SEQ ID NO: 11519 - DNA, 101 bp, rice(Oryza sativa)
  misc_feature (71): n=t or g
atctctcgttcagtcaacttttgcttccgcttggactcgtaagccaagggcccgccaaaaatgtgattganttccttgcgagagtcttgaaagccagtcgg

SEQ ID NO: 11520 - DNA, 101 bp, rice(Oryza sativa)
  misc_feature (71): n=a or g
cagtagtagaatcttgcaagggtctggttaagtaactaacacacgccattttctgtttgctcggtgggaanaaaactagtgaccatagtaacactcttatt

SEQ ID NO: 11521 - DNA, 101 bp, rice(Oryza sativa)
  misc_feature (71): n=a or g
ctaggagtaaagagcatttctccaccaagtcccacagcaaaccgatgcggtttggatggaagagagtgtgngttgggagccttggaatggacaagggcagc

SEQ ID NO: 11522 - DNA, 101 bp, rice(Oryza sativa)
  misc_feature (71): n=a or g
aagaacataaatttctgttcatgtgaaatgagaccaaagtccaaactcacaaggacagaattgttctgaantggttgaatgcttgaaccaactatacttgc

SEQ ID NO: 11523 - DNA, 101 bp, rice(Oryza sativa)
  misc_feature (71): n=a or g
tgaatcagattgtgctctgctctgctctgctgcttatatatttctccacatgctttcagagaatgattcanaaagaaagaaaggaagatgagagctaataa

SEQ ID NO: 11524 - DNA, 101 bp, rice(Oryza sativa)
  misc_feature (71): n=t or c
tgagtccacagagactggttttttaacatcacaatccttgtcatgattttgtttaccatcagcctcactantaatttcttggcctatgcccttgtaatgtg

SEQ ID NO: 11525 - DNA, 101 bp, rice(Oryza sativa)
  misc_feature (71): n=a or g
cggccagctcgatgtgtcctgatccagtacaaatgctcgacaagatgaagatgagaggtcttggaggtaanagaaggacatggccatggcgatggcctagc

SEQ ID NO: 11526 - DNA, 101 bp, rice(Oryza sativa)
  misc_feature (71): n=a or g
tgccgtcaaatttcctacatatggaggaccttggactacttggtatggtctcatcaaagattgcctcaacnagtctgttaggtgagcgccttaattcctta

SEQ ID NO: 11527 - DNA, 101 bp, rice(Oryza sativa)
  misc_feature (71): n=t or g
tggtttgccatcgccctcctgtgactcgaccaaggcacccatcctctggggatccatcgaagggtacagtntccgctctgccgctggcggtgctggaatgt

SEQ ID NO: 11528 - DNA, 101 bp, rice(Oryza sativa)
  misc_feature (71): n=a or g
taagtttagtatttcttacggcgttaccagctcaaccaatgctgtcgggattgtttgtagtactgcacttntagtagctgccattgacatgtggaaccgga

SEQ ID NO: 11529 - DNA, 101 bp, rice(Oryza sativa)
  misc_feature (71): n=t or c
gttgttgcctcgtcaggcttacactcgtgtattttgacgatcaacttgtccccttcgtttgcgttctgcancttgcagcattgtctccgtggtgccttgtc

SEQ ID NO: 11530 - DNA, 101 bp, rice(Oryza sativa)
  misc_feature (71): n=a or g
agttttatttcgtgataattgtggaacctttctgtaggatcgaatattaaaaattaagccaaccagagagngtgaatggttggtgtacctaagaaccaaaa

SEQ ID NO: 11531 - DNA, 101 bp, rice(Oryza sativa)
  misc_feature (71): n=a or g
atagagatatgtattacttggtttctaattctaaggatagatctaatggtctatgtaatgtgtccaccatngtaagagaaatcaattggcatatgttttat

SEQ ID NO: 11532 - DNA, 101 bp, rice(Oryza sativa)
  misc_feature (71): n=t or c
caatgttttgggcttttcatgctcctctgcatctaatctcctttcttgcttgctgacatctctcattttcnactgacggtcttctttcttgcattctctga

SEQ ID NO: 11533 - DNA, 101 bp, rice(Oryza sativa)
  misc_feature (71): n=a or g
agctttcttctcctcccgccgcagtagcagcttggatcggtccctgcaaaaatccacaagaagctctgctngtcagacagagcagctgaatttaatcgtac

SEQ ID NO: 11534 - DNA, 101 bp, rice(Oryza sativa)
  misc_feature (71): n=t or c
tgaaactagctcacccgagtttatgcggctgcttgtatttgtggctattttttcagtggtaaacgacttanccgtcgacagtgagatgttgatttcatcaa

SEQ ID NO: 11535 - DNA, 101 bp, rice(Oryza sativa)
  misc_feature (71): n=t or c
ctatttcaagatttgagaatttgataccatggtgtgcaaaagaagccttggcctcatggtacatatgcgangaatgcaggagagcctgaaatgataaaaga

SEQ ID NO: 11536 - DNA, 101 bp, rice(Oryza sativa)
  misc_feature (71): n=a or g
ctgaaacacgtcaaaccgctcaatttgtgatgatatagcaaagtggagaggtgttctgcccgacgaatcanctttggttagcagtgttcgaccctctggct

SEQ ID NO: 11537 - DNA, 101 bp, rice(Oryza sativa)
  misc_feature (71): n=a or c
ttatagagttatagtgatgttgctttggatgaatatgtgtaggtgtacttttgttctctgtgagaaccagnacgtgctgaaagatgaggaaataagaaatg

SEQ ID NO: 11538 - DNA, 101 bp, rice(Oryza sativa)
  misc_feature (71): n=a or g
tgacacaaaactgtgtggaaaatttaaaactgagaatgcatcacaggatggctattcatgccacgatgagntgttacagtttcagagcatagatggtatga

SEQ ID NO: 11539 - DNA, 101 bp, rice(Oryza sativa)
  misc_feature (71): n=a or g
agtaattgcactaagggggttccaactacatagaaagaaaggatttgtgggtaagggacccaaatcaaacngggatgactcccggttgggcgcccgatcgg

SEQ ID NO: 11540 - DNA, 101 bp, rice(Oryza sativa)
  misc_feature (71): n=t or g
tcctaattaagattttaatttgtgcagattgagatacaaagccgagtcagaaacttgactgtttatgctancaaaattcctggcagcgtggcatataatgc

SEQ ID NO: 11541 - DNA, 101 bp, rice(Oryza sativa)
  misc_feature (71): n=a or g
gttcactactctgattccgtattttccatgggtggtagcacactagtactactttttaaaactgatagccncataaaaacaaataccaaacaattggcgcc

SEQ ID NO: 11542 - DNA, 101 bp, rice(Oryza sativa)
  misc_feature (71): n=t or c
tttaggtgatccatcattaattgatggagaattccttgacaagtttgacataattgtagttagctgtgcgnctattaaaacaaaggtgtgtattcttctcc

SEQ ID NO: 11543 - DNA, 101 bp, rice(Oryza sativa)
  misc_feature (71): n=a or c
gaaaatcgcaaaactataggtcagttaggcaaaatcgcaaatttagcaccggtacctatcgaacaaccacngttcgatagggtacctgccgacaggtgatt

SEQ ID NO: 11544 - DNA, 101 bp, rice(Oryza sativa)
  misc_feature (71): n=t or c
aaacggagggagtagaagttaagggtcggtttagaaaccttatgttggctgtaatttctcataaaatctcnttatgtaagaagctctccaaataatttaga

SEQ ID NO: 11545 - DNA, 101 bp, rice(Oryza sativa)
  misc_feature (71): n=a or g
gccttttgaaaattgcaatttgtattggtacatgagcctttaactgttgactgcaatatggccaggtgttntttggtaataatatatgttgcatcaggcta

SEQ ID NO: 11546 - DNA, 101 bp, rice(Oryza sativa)
  misc_feature (71): n=a or c
cgagtttcacttgacggcccattcagttcaactgattgctcggcgccagactcccttggcgtgacattccncccatcttgaaaatcagcttgaccccaagc

SEQ ID NO: 11547 - DNA, 101 bp, rice(Oryza sativa)
  misc_feature (71): n=t or c
ggtcaggcaagcgggggtccaaaaatccagccgactgctcaatcaagcagcccaaagccgactgatcaacnaggccccaggaaaaggaaaatggtcttgag

SEQ ID NO: 11548 - DNA, 101 bp, rice(Oryza sativa)
  misc_feature (71): n=a or g
ttgccatagatagaatcatccgagggaccaaaaagagcagccatcttcctaatccagtatctaggaggagnattatcccaatcagcccactcataatctcc

SEQ ID NO: 11549 - DNA, 101 bp, rice(Oryza sativa)
  misc_feature (71): n=t or c
gacatggcaagtgggaaatacctttggcgcactcttgtttcaccaccgacaaaatgcgaatctgagaaggnccagtgatggagttctgatatttatatcat

SEQ ID NO: 11550 - DNA, 101 bp, rice(Oryza sativa)
  misc_feature (71): n=a or g
gatgagtggtggggagaaggatggctaccaacttggagggggctgatggttacgattgattggaagtgtgntagatttgtaggcgatgttcttcctcctcc

SEQ ID NO: 11551 - DNA, 101 bp, rice(Oryza sativa)
  misc_feature (71): n=a or g
aattcgtactttttccttttaagattaacattggtgtcagctgagtaatcagtgccgcattcattgtgctngttgggaaaaccggtacctaagccggtttt

SEQ ID NO: 11552 - DNA, 101 bp, rice(Oryza sativa)
  misc_feature (71): n=t or g
cctagcggattttggatgacagatcacaaggcaattaggggacctatgtgtgtattgagctaaagtagagntattagtcccatggcgatttgattgatgct

SEQ ID NO: 11553 - DNA, 101 bp, rice(Oryza sativa)
  misc_feature (71): n=a or g
aattccttcatcgatcctcaagaattctacgtcatcagaaacagtatgaaagttatatcgctcgattcccngtatagagtgacacttcctagtcctgctct

SEQ ID NO: 11554 - DNA, 101 bp, rice(Oryza sativa)
  misc_feature (71): n=a or g
cagatcaagggggtggtcaggcaccatagggcagctcaacttgcttagcttccgtgctgctcagatcaatncaacagatcgctgccttaggaagctagcca

SEQ ID NO: 11555 - DNA, 101 bp, rice(Oryza sativa)
  misc_feature (71): n=a or g
acgcttgacctgcagaaaagcagaaaacctacatgagcattcaccatctctgaagagtgcagtactgatgnatgaaacgatttcgtaaattcagagttcta

SEQ ID NO: 11556 - DNA, 101 bp, rice(Oryza sativa)
  misc_feature (71): n=a or c
ttgtcgaacaccaggcccttcaggtcgttctggtactgaccctgcaacaatgtcagatggaaaaaaaaaancagtcaaacattcgaatctgcacatttttt

SEQ ID NO: 11557 - DNA, 101 bp, rice(Oryza sativa)
  misc_feature (71): n=t or c
tggaccaacaacgcggacgaacaaatctcctcaaccaccaaaagactccacggccgggtctagaaacaganagccaagacaagggaggagcatcaaggagt

SEQ ID NO: 11558 - DNA, 101 bp, rice(Oryza sativa)
  misc_feature (71): n=t or c
cacgttacatgaatgcatcagcatcacggacaatagtttgcaaacaaaagctttgcaggctcacctgaacnggaaaggctaatgggcgggtgatcgctccc

SEQ ID NO: 11559 - DNA, 101 bp, rice(Oryza sativa)
  misc_feature (71): n=t or c
aaaacagaggaaaaacaagaaaccacagtccgacataacacaacttggaccccaatgtcactatgtagggngacatgggcaatgaccaaactcactctacc

SEQ ID NO: 11560 - DNA, 101 bp, rice(Oryza sativa)
  misc_feature (71): n=t or c
acaaacactattaaaaatgtttgtacgagaccctccgtagattataaatggacctgaaaaatcgagagganattttcgtatacggttttttaagaggctgg

SEQ ID NO: 11561 - DNA, 101 bp, rice(Oryza sativa)
  misc_feature (71): n=t or c
tcatcgtcgtcgatagatccacccatccagtagtctgctatggcaccggatccggacgtcgcgaggtcctnggtggtcaatatgcccatcctataattgtg

SEQ ID NO: 11562 - DNA, 101 bp, rice(Oryza sativa)
  misc_feature (71): n=a or g
gattgtttatgattttaaatgttgtttgttcaggttgagtaccaagttgaggaatgcagtccagaaaaccnggccaagaatgagtgcattgatgttaaagt

SEQ ID NO: 11563 - DNA, 101 bp, rice(Oryza sativa)
  misc_feature (71): n=t or c
aaattcggtgatgacattattatgaacatacaaccttagggtcctgaatcgaggtgccaaagcagccatantatttgtgtgcacgtcagccttcacccttc

SEQ ID NO: 11564 - DNA, 101 bp, rice(Oryza sativa)
  misc_feature (71): n=t or c
cagagagtggggccttcaatcttaagaacaccatatcaaggaaatgcaagtttgaagaggcgaacagcgcntacgaggatcttgaccgtggcaagatcgtt

SEQ ID NO: 11565 - DNA, 101 bp, rice(Oryza sativa)
  misc_feature (71): n=a or g
ttaaaatggtcacaaattgagcgtgaagatattatcctaccacccttgcagcataggcgtagggataaggnactagtaagggtcatgagccatggctctct

SEQ ID NO: 11566 - DNA, 101 bp, rice(Oryza sativa)
  misc_feature (71): n=t or c
tttgcatggcagacgcaaagatcacacaaaccactgaaccaaccaccacctgctcttctttgcaattttgnagtatgtgcctctttggttattccgatctc

SEQ ID NO: 11567 - DNA, 101 bp, rice(Oryza sativa)
  misc_feature (71): n=t or c
tctgatgctcacttttgtagacttccttgtaagcactttttgtgttgcattcaccattttttgtatgcttncaataaagtttatcttcagtgttagcctgc

SEQ ID NO: 11568 - DNA, 101 bp, rice(Oryza sativa)
  misc_feature (71): n=a or g
cttcaaaatggcatggctcatggagatgacgttatccgtggcattgtgatcggcatccacgagaagtttgncaagtactggaaggactgcaacgtcgtctt

SEQ ID NO: 11569 - DNA, 101 bp, rice(Oryza sativa)
  misc_feature (71): n=t or c
tgtgaagatgattgtcaaggagactcataggctgcatccggtattgccattgctcaccccaagggtgtgcnagcaaacttgccagatcatggggtatgacg

SEQ ID NO: 11570 - DNA, 101 bp, rice(Oryza sativa)
  misc_feature (71): n=a or c
gacgtactccctctcctcaaggagcctcataagttccaagttcttcaggaattggcacaaaatacagaaanatacatcaccgtttagcaaacaggtccaac

SEQ ID NO: 11571 - DNA, 101 bp, rice(Oryza sativa)
  misc_feature (71): n=t or c
ggagcaatgcagtgcacaaatcactcttgaagaacaaaagcttgtcgacttaccgaaagccattgaagacnagaagtcaaaattaaaagcatatgtcaagc

SEQ ID NO: 11572 - DNA, 101 bp, rice(Oryza sativa)
  misc_feature (71): n=a or c
aggtttagctgcttcgccaaagcaaccttttgcttctgctccaatccatattaaatccccaaaccaacaanaaaatctttattaattattatacagtgaag

SEQ ID NO: 11573 - DNA, 101 bp, rice(Oryza sativa)
  misc_feature (71): n=a or g
agatcttcaggacaacgacaatcccataccactagatgcaaggttgagcattggtgtagaatgcgcagagncattagcctacatgcattcttccatgtatc

SEQ ID NO: 11574 - DNA, 101 bp, rice(Oryza sativa)
  misc_feature (71): n=t or c
gtgagctcatgctttgacaactgaacctgttttgagatgtccaaggggcttctgttaccttgttcattttnagttgttctaagcttcctctttcctttcac

SEQ ID NO: 11575 - DNA, 101 bp, rice(Oryza sativa)
  misc_feature (71): n=a or g
ctgagtagccaatcaatctcgcgcgtcgaatacttatggtcacaaaaacacgtcataatgcactagatgcngtcttagaaataaaattttagtcacaaatt

SEQ ID NO: 11576 - DNA, 101 bp, rice(Oryza sativa)
  misc_feature (71): n=t or c
tctgactatcactattcgtgactactgttgcgcgttatgaaccaccaaataattagggttttaaatctccnattgtatgtagctgccactatcttccgcta

SEQ ID NO: 11577 - DNA, 101 bp, rice(Oryza sativa)
  misc_feature (71): n=a or g
ctttagggattaggtctgaccttttgcgcttacctgcgtattgataaatactgctccctccgtccagaatntaagaagttttagtgttagacacggttatt

SEQ ID NO: 11578 - DNA, 101 bp, rice(Oryza sativa)
  misc_feature (71): n=t or c
ggtgaagccaagatttaaacatgaggggccaacttgacaactgatcaatcacgattataaacaaaaatagnggttttttgtaggtaataatatatcgtatc

SEQ ID NO: 11579 - DNA, 101 bp, rice(Oryza sativa)
  misc_feature (71): n=t or c
aagtttgatttcttggtctttattgatttctttcagcttcctaacatgatcacctggtggtgaaaacttgnatttgtacagactgaatcataagtcaaact

SEQ ID NO: 11580 - DNA, 101 bp, rice(Oryza sativa)
  misc_feature (71): n=t or c
acagaggggcacgcatcatatgatgtggcgctgtgttcattacacataaaaaatatttcagctcccatcgnttctaaaatcctggcgaatttcgaatgggc

SEQ ID NO: 11581 - DNA, 101 bp, rice(Oryza sativa)
  misc_feature (71): n=a or c
agattcggtttagaaatctaaaattgattcggatttgggacgaacaatggtagtgcttcaatctgattcgngtttcgcggcgagggcgtcgagaacaccat

SEQ ID NO: 11582 - DNA, 101 bp, rice(Oryza sativa)
  misc_feature (71): n=t or g
tacacacctgggtgacaaatatgccattttcagccaaaagggactcacagcagccaaagaattcatccatntattcatgaccaacttcttcaatcatctca

SEQ ID NO: 11583 - DNA, 101 bp, rice(Oryza sativa)
  misc_feature (71): n=t or c
agagtaaattaagctgtcaaatgcgtgatttcaactgggttgtgaggatctttaaagacaacaactacttngattataggtgcgcgcgcatgatcttgtca

SEQ ID NO: 11584 - DNA, 101 bp, rice(Oryza sativa)
  misc_feature (71): n=t or c
tgttgaaacgataacctctttaagatgcatcaattgcaagggaaagcctgtttcctttcctcccttctgangcggcccagtcaacctctttcttcctgcac

SEQ ID NO: 11585 - DNA, 101 bp, rice(Oryza sativa)
  misc_feature (71): n=a or g
cagtttcttggttggtgattcgggaatccaggtggtgaggaatttcgagcatgggatacacggaaagggcntgtcggtcaagttctccggagggagcacaa

SEQ ID NO: 11586 - DNA, 101 bp, rice(Oryza sativa)
  misc_feature (71): n=a or g
atggcattggggactgccatggctactcgccgtggtgctcggctctttcctgcctttgaactgatgaagtntatgaagctatttataggctaccgctagcc

SEQ ID NO: 11587 - DNA, 101 bp, rice(Oryza sativa)
  misc_feature (71): n=a or g
ggtgagttttttattttctattgccgatcttaatttatatcctggtctcccgccctctcgaattcgaagcntaaaactcatcttagtgtgtgtaattcgat

SEQ ID NO: 11588 - DNA, 101 bp, rice(Oryza sativa)
  misc_feature (71): n=a or g
cttctttcgcttgagtcaaccagatctacctgaagcttctatgtcttcttcaaccctggttgaggttcccntaagctcgtcaccattgtcatcattattag

SEQ ID NO: 11589 - DNA, 101 bp, rice(Oryza sativa)
  misc_feature (71): n=a or g
gtacatactacataatcaactaaaatttcattgggatagttggctagtacagcatacttgtgcgcaagagntcacaatttgaaatttttccacctcttttg

SEQ ID NO: 11590 - DNA, 101 bp, rice(Oryza sativa)
  misc_feature (71): n=a or g
gcccacatgttccccgtctcaagtactggagcaacaaaggtggtggtgtcttctcacttctcatgcgtccnactccatcgagcggatgcgcggaaaagatg

SEQ ID NO: 11591 - DNA, 101 bp, rice(Oryza sativa)
  misc_feature (71): n=a or g
tattctattgcagaaaagaacttttggggggcctcctgacttgaagaaagaaaaggcttattttgaagaanttgatgcttttgaactgatggaggagagcc

SEQ ID NO: 11592 - DNA, 101 bp, rice(Oryza sativa)
  misc_feature (71): n=t or c
ttgcctttttttttctcaatctgatagaatggtttaaatgtcattcaggtgtcccatgcggaggttcttgnacgtgtctcatctattcttaaggaattcgg

SEQ ID NO: 11593 - DNA, 101 bp, rice(Oryza sativa)
  misc_feature (71): n=t or g
cttattcccctgcccctctggataggcatggccccatttattcctcacataatatgcccacaccattattnggtattccaactagaccaccttaaaaacag

SEQ ID NO: 11594 - DNA, 101 bp, rice(Oryza sativa)
  misc_feature (71): n=t or g
tatcgattctgcgaaaatggtgagatgcatgtgctcgtgttggacaaccatgatgatgacggcccacaacngtggatcgacgttgaagagctggatgcgat

SEQ ID NO: 11595 - DNA, 101 bp, rice(Oryza sativa)
  misc_feature (71): n=a or g
gtcaactaaaatcattaacaaatatttgaagagacatgagaagcaggagcagaggtattatgaagataacnatggtttcgaccctcattgggattgtgagt

SEQ ID NO: 11596 - DNA, 101 bp, rice(Oryza sativa)
  misc_feature (71): n=a or g
cgcggctgtctacgtggcgcggtttcacgtacaccgacggcaacttgagtacttgactgactccaattttntcaccgcggccgatcagtccagagtcagtg

SEQ ID NO: 11597 - DNA, 101 bp, rice(Oryza sativa)
  misc_feature (71): n=t or g
atttgccacatcatataatacatcatgtgggagggtgtaaaagaaaacctcctagaaagcattcgggatanagatatataaaactaaaaaaagaaaaggaa

SEQ ID NO: 11598 - DNA, 101 bp, rice(Oryza sativa)
  misc_feature (71): n=t or g
ggtagattccatttgaactggtttaacaatgatcccagaactaaatgcaccatcctatttgccaatggcantctagggcatatccggcgacctgcaccaaa

SEQ ID NO: 11599 - DNA, 101 bp, rice(Oryza sativa)
  misc_feature (71): n=a or g
gtgtaacagttctgcctgactgatccctcttgtagaacgggaggttgctccttagaaggttagattgtatnaagaacttgatgactctatgatcgatcatc

SEQ ID NO: 11600 - DNA, 101 bp, rice(Oryza sativa)
  misc_feature (71): n=a or c
acacaaaaagtgcacctatcggataagccgataacgcacttgccttttgacccttttctgcaccattaacnggagtatacgtacgtacgtggtagagttaa

SEQ ID NO: 11601 - DNA, 101 bp, rice(Oryza sativa)
  misc_feature (71): n=t or c
atgaaacattgaagacaacgcatttgaaaatcagttaaaaactgctccatctgttgcctctgttcgtccgntaaattctccaccgtgaccatgatcttggc

SEQ ID NO: 11602 - DNA, 101 bp, rice(Oryza sativa)
  misc_feature (71): n=a or g
aaagtggcgaaaaaaacgtagatccaattcccccttaaaatggggaaaaaatctgagaaaaaatagcgaanaaaacaacaaaaataaaagaggtctgtgtc

SEQ ID NO: 11603 - DNA, 101 bp, rice(Oryza sativa)
  misc_feature (71): n=a or g
actaggagtatataagattttatttacggatgaacattgtatatgacggagccaacctagaatcgggcacncaatggggagggaaaaaatcaggcacggat

SEQ ID NO: 11604 - DNA, 101 bp, rice(Oryza sativa)
  misc_feature (71): n=a or g
agtagcacggcgagcgaggtatggctgtgtaatcccaccgtccaaaaactcaattttaacgtttgaccgtncgttttatttaaaaaaattataaaaaaaat

SEQ ID NO: 11605 - DNA, 101 bp, rice(Oryza sativa)
  misc_feature (71): n=t or c
tttaatccttatgttgtactgtagttataccatttgcagcctcagaatctgatcgttctcaggctaaaaanccaatgttgtaggagggaaggagcaattcc

SEQ ID NO: 11606 - DNA, 101 bp, rice(Oryza sativa)
  misc_feature (71): n=t or c
gtggctaaagaaaaccacgtcatccgatcaggtagtccaaagcagataatgctactattgcatgcatatantccctccgtctcaaaatataacaaacctaa

SEQ ID NO: 11607 - DNA, 101 bp, rice(Oryza sativa)
  misc_feature (71): n=t or c
tcctgaatttgcattaatatatgacttctaaattagcgtgcacaaatataccatcaatgtggcacaggaanacaatgttgtcttcggcatgaccgggacca

SEQ ID NO: 11608 - DNA, 101 bp, rice(Oryza sativa)
  misc_feature (71): n=t or c
atttgatggcttcaggatttgggagatttggaaagaacaaagggaaattcaaatttcaaaatttgaatccnaagatttgagtttggaaagaaattttgggt

SEQ ID NO: 11609 - DNA, 101 bp, rice(Oryza sativa)
  misc_feature (71): n=t or c
cagcgagccacacttggagtacatgtcaattagtgaattgcagacccgaacattgcgatccagtccaaatnttttagcaaactcgtgcacatacatcccat

SEQ ID NO: 11610 - DNA, 101 bp, rice(Oryza sativa)
  misc_feature (71): n=t or c
atgaactgagccagggtagtcttccccaccccaccaatgctaacaatcggcaagacagaaacattgctgangaatttggcctgagcaagtctaggcctggc

SEQ ID NO: 11611 - DNA, 101 bp, rice(Oryza sativa)
  misc_feature (71): n=t or g
acagattcgccgacagactttggcgattcttgggcaacttcaccaacgtcaagatcctcaagttgacggtncaggagctcggccacctcgccgtcgccggc

SEQ ID NO: 11612 - DNA, 101 bp, rice(Oryza sativa)
  misc_feature (71): n=t or g
agcaatggacagatgatagagagaggaggataaattcagtttgttgcagacgccaagcaaccagctgaccntggaagcaaaggcaagggcacgtacatcgt

SEQ ID NO: 11613 - DNA, 101 bp, rice(Oryza sativa)
  misc_feature (71): n=a or g
ataatctttcatcacttcacgaacaaaacaaagcttccttgcgctttaactctaagtaattattccctccntttcatattataagtcgttttgactttttt

SEQ ID NO: 11614 - DNA, 101 bp, rice(Oryza sativa)
  misc_feature (71): n=t or g
ccacaatgtgagccactcctaaagtgtcctcactagaggatacttgtagggaaactcccctcacaatgaangatacccctagtagcccacgagtgtcccta

SEQ ID NO: 11615 - DNA, 101 bp, rice(Oryza sativa)
  misc_feature (71): n=t or c
aacatcattaagtaattttcaaccaggctacgtagagaatagcccgcacatcaacctcttacctatcactnagtcatcgctacatctatgtgaaaatcact

SEQ ID NO: 11616 - DNA, 101 bp, rice(Oryza sativa)
  misc_feature (71): n=a or c
aacagctagacatataaaaattgctgagattgacccgaccacgatagaaatagcaaaaatgcttacctttnacaaagttcctacacaagtgatgatgtgcg

SEQ ID NO: 11617 - DNA, 101 bp, rice(Oryza sativa)
  misc_feature (71): n=t or c
aagaacatctgattgatctttggaccattttctattcctgttccctctattagaattctgagagttggggnagctcttccatcttcttagtggaggaagat

SEQ ID NO: 11618 - DNA, 101 bp, rice(Oryza sativa)
  misc_feature (71): n=t or c
ccaagatcttgagtacctcgaaggtacttgaggatagttttgacaccaacccaatgtcttctggttggggntgcactatatctagctaatagattaactgc

SEQ ID NO: 11619 - DNA, 101 bp, rice(Oryza sativa)
  misc_feature (71): n=t or g
gaaagggatgtgcggatttgcgagaagaccagttggctatatataatatacttcacggtttacgcgtagtngtttctcgagcgaaaaaaccaacgaccacg

SEQ ID NO: 11620 - DNA, 101 bp, rice(Oryza sativa)
  misc_feature (71): n=t or c
catgtgtaatgtgaattcagaggagaagataacaatagcaaatgatgatgtcatctgggttccagctcggngtgatcgggtctcttgcgctgtcggttgca

SEQ ID NO: 11621 - DNA, 101 bp, rice(Oryza sativa)
  misc_feature (71): n=a or g
gaggttgttcaatttggtgcttcctaggtgcacgctggatttggatcccaattcgtgcatgattcctgtantcttggcatgcagtggaccctgtgcctgta

SEQ ID NO: 11622 - DNA, 101 bp, rice(Oryza sativa)
  misc_feature (71): n=a or g
tcgcaatcgatccataacttcagacttcgcgatcagggtcctctggtgtgtattccagaataaattgattncgaacagtcaggttaatatatatggggcta

SEQ ID NO: 11623 - DNA, 101 bp, rice(Oryza sativa)
  misc_feature (71): n=t or c
cgccgtcgtcccgtaagacctccattatttcaccatcaacagcgtaacacacaccaccagaatttactcgncgaggtaaaaaaaataactgcatgttaaaa

SEQ ID NO: 11624 - DNA, 101 bp, rice(Oryza sativa)
  misc_feature (71): n=t or c
caagattggttacctagtgtctctaggaaacactccgtttttactcagtgccagatcaagcacaccgtaancttttactcccactcgggagagactcccat

SEQ ID NO: 11625 - DNA, 101 bp, rice(Oryza sativa)
  misc_feature (71): n=a or g
tagttcccaagcttcactggcatggactatccaaaagtcagagcagatcagcagacatgttggcttaaatnaatcaaaagatctagcttaaactacatgca

SEQ ID NO: 11626 - DNA, 101 bp, rice(Oryza sativa)
  misc_feature (71): n=t or c
gtagctaacgaaacgagatgagatgagcttgacatcggattcgggattggggaattttggagtagtcgtangtaagcaattggttggggatgcgaggtctc

SEQ ID NO: 11627 - DNA, 101 bp, rice(Oryza sativa)
  misc_feature (71): n=t or g
tcacacagctgcactacttgcactgaagtagctagagcttgcaagtaaagatggctaccaccaagcatttngtgttgctaataatccttgtcctccttagc

SEQ ID NO: 11628 - DNA, 101 bp, rice(Oryza sativa)
  misc_feature (71): n=t or c
gttagaaatacatcattcagagttgaaaaagttgaagtagaccggactgtgaaaattgaagctaaaagggntgagctagaatgcaagactaagttgtatga

SEQ ID NO: 11629 - DNA, 101 bp, rice(Oryza sativa)
  misc_feature (71): n=t or g
gatcatatttcttagtttgttaatgaactctggttccttcgacataaccaagcagttatccacattttctnatgctagcattgccaatgcttgcccagcga

SEQ ID NO: 11630 - DNA, 101 bp, rice(Oryza sativa)
  misc_feature (71): n=a or g
gaggagggggaagaagaagataaggttggggaggagaaggagcagaaagagatgggaagataacattgtgnaggaggagagatagcgtgtgtggacggcta

SEQ ID NO: 11631 - DNA, 101 bp, rice(Oryza sativa)
  misc_feature (71): n=t or c
aatcagttgacggcgaacgagatgactggtggagaagatgacaacgctaattaacggtgaagatggcacgnagccttggatgcgaggaaactagtcggcgt

SEQ ID NO: 11632 - DNA, 101 bp, rice(Oryza sativa)
  misc_feature (71): n=t or c
ttgattggttgaagacggatcgcgcagcccaaggaactggagtctataagccgattttgcagagtattgcncgtctgttgtgaggttccatcgaatgttgt

SEQ ID NO: 11633 - DNA, 101 bp, rice(Oryza sativa)
  misc_feature (71): n=t or c
gcgccgaccaaacaagtaaacctccctcaactcaagggcatccaagaaacatctgaatctgccaatcagcntcctgttgatgatcccattgtttttatctg

SEQ ID NO: 11634 - DNA, 101 bp, rice(Oryza sativa)
  misc_feature (71): n=t or g
tccaaggtggccaaaaatagttttctcaggaggggaaagggccgcatataaacaaaggcctacgaaaatanatgattttcgcagacggcatctccatcttc

SEQ ID NO: 11635 - DNA, 101 bp, rice(Oryza sativa)
  misc_feature (71): n=a or g
tccaatgatatgcatgcagaagtcaagaagcaatggtaggtaggttagatacccgtgaaggttgaggttgnggttgaagcagaggcgccctctcctcatct

SEQ ID NO: 11636 - DNA, 101 bp, rice(Oryza sativa)
  misc_feature (71): n=a or c
aattcattgttttacacaatgccataaggatttggcactgatgcgatgagagacaagaaatggttactccntccattctaaaatatagcaagttagcaata

SEQ ID NO: 11637 - DNA, 101 bp, rice(Oryza sativa)
  misc_feature (71): n=t or c
tctccatcataaccacatcaaagagaccatcaaattaatcacgagtaagcgtatcactctagaactcatanctgagagctatatactttggtattgcaaaa

SEQ ID NO: 11638 - DNA, 101 bp, rice(Oryza sativa)
  misc_feature (71): n=a or g
ccatatattgtagagttgtgtgcagtatacttactattaattccctctgtgtcagtatgagtgtaccaagnattggatgtgacatttcatagtataacgaa

SEQ ID NO: 11639 - DNA, 101 bp, rice(Oryza sativa)
  misc_feature (71): n=t or c
gcatgatcctcaatttcaacttctttggtatgggagtgattattgttttgccttcgtgcaggtttgctctnagttttaagcgaatcataacgatttcagta

SEQ ID NO: 11640 - DNA, 101 bp, rice(Oryza sativa)
  misc_feature (71): n=t or c
acagcggaataattacattaaaatgctgttgctacagaagatagtgttttagtggtaggtatcttggagantcggattacacacatggtgctggatattac

SEQ ID NO: 11641 - DNA, 101 bp, rice(Oryza sativa)
  misc_feature (71): n=a or g
ggtggtaggtgccggcgatgggagtggtggtggtggtgatgtgttgttgtactgtgacggcggaggcggcngcggcggcggcggcgaggacggcgaggagg

SEQ ID NO: 11642 - DNA, 101 bp, rice(Oryza sativa)
  misc_feature (71): n=t or g
gtttgattttttttgacatgctaaatggttcgaacaaaaaaaaattgggcacgcgtaaattaatactaaancatacaatagtctggaacttcaagacaact

SEQ ID NO: 11643 - DNA, 101 bp, rice(Oryza sativa)
  misc_feature (71): n=a or g
gaagctgaaaacagttcttgtagaagtgatatgctttttttatctcgtgagggcaacagcaatactgaggngtttgatgtttcccaatctcctattaccaa

SEQ ID NO: 11644 - DNA, 101 bp, rice(Oryza sativa)
  misc_feature (71): n=a or c
atatcattgcctatctcactttctcgtgttgtgatttcaacgtcagaacccatgtcttttaaaccaaaatnttctattgtttgcggtaaaacatatcggct

SEQ ID NO: 11645 - DNA, 101 bp, rice(Oryza sativa)
  misc_feature (71): n=t or c
aacgtcaggaacagaggctggatcaagctcatagaagccacggagcttgccacctctttcttctgtcaganggaaggatggtatttgatgagaaaacttca

SEQ ID NO: 11646 - DNA, 101 bp, rice(Oryza sativa)
  misc_feature (71): n=t or c
cttcatggatgacttctctgtttatggaaaaaccttcggtcattgcctctagaatttggacaaggtcttgnagcgatgccaagaaaatgacctagtgctta

SEQ ID NO: 11647 - DNA, 101 bp, rice(Oryza sativa)
  misc_feature (71): n=a or g
tgttccccttgaagccactccgtacaagctagcctggctagtaccttgaagttcgatgaggtgatcagctnttttgcatggaggtcctcctcgagggcaaa

SEQ ID NO: 11648 - DNA, 101 bp, rice(Oryza sativa)
  misc_feature (71): n=a or g
ttatacggatatactgtacatttgaagtattaagtgtagactaagggcatctaaataaaagacactctatnccggacaactacccctacaatgaaggatac

SEQ ID NO: 11649 - DNA, 101 bp, rice(Oryza sativa)
  misc_feature (71): n=a or g
gtcgacgtaatgccgagcaaggtcaccaaggtgctcaaaccggacacggcgcttgccattgttgacggtcnttagcgatcagtttcgaccgtcaatattac

SEQ ID NO: 11650 - DNA, 101 bp, rice(Oryza sativa)
  misc_feature (71): n=t or g
cctcaccaaaacaagtcttacatttacaagaaaacccgactcaaaaagaccttacctaagcgaggttaccnacctactaaggaattcgctgagcttagaag

SEQ ID NO: 11651 - DNA, 101 bp, rice(Oryza sativa)
  misc_feature (71): n=t or c
acaaatctagatacgatatctgtctatattcgtagcactacgatacatcccattcgatgttaggttattanaatatattataagacaaaagaagtatataa

SEQ ID NO: 11652 - DNA, 101 bp, rice(Oryza sativa)
  misc_feature (71): n=a or g
gaacatctttgaggaagacttttgtgataacagaagtggtgactggttgagtgacacgatgttatgttgtnttgagacagagattttggcagggattaaaa

SEQ ID NO: 11653 - DNA, 101 bp, rice(Oryza sativa)
  misc_feature (71): n=t or c
acctaattagcaggctaaggcagcaatcgattactgttgcacatgcccttggtacctctcaagtgcaaaanaattcacctcacatctgttgggttgcaaat

SEQ ID NO: 11654 - DNA, 101 bp, rice(Oryza sativa)
  misc_feature (71): n=t or c
tattgtgtgtcagatactacttccttttacttctccgcgctcgctacctttgttttcaaacttacaactgngttgaaattccactgcctttttctttcgaa

SEQ ID NO: 11655 - DNA, 101 bp, rice(Oryza sativa)
  misc_feature (71): n=t or c
ttgagcgggaaatctacctgctttaactatggtttgttatctgggcactgggtaccacatgtatttgcgangcccaaaagaagtagacatcaaatttaccc

SEQ ID NO: 11656 - DNA, 101 bp, rice(Oryza sativa)
  misc_feature (71): n=t or c
tgcaactgaattatccgatagaagcttccgcacaacatatggatatgctgcttgaaatgttttaaaagttncatctgctgcaatggccagccctacagatt

SEQ ID NO: 11657 - DNA, 101 bp, rice(Oryza sativa)
  misc_feature (71): n=t or c
taatttgaccctaattttttaactttgcccatttaactctgctttttaaaatcggaactgccgtctgaccntgttttcactacaccgttaaagtttattta

SEQ ID NO: 11658 - DNA, 101 bp, rice(Oryza sativa)
  misc_feature (71): n=a or g
tctcccctcaccgacggtcaccatgtcatgctgctcctcacctatcggcccatggcccaaggtagtagcantgggaagccgaaggagcaccaggacaggga

SEQ ID NO: 11659 - DNA, 101 bp, rice(Oryza sativa)
  misc_feature (71): n=a or c
aacaacatgtttctccttgtccagctgcagtgacaaggattccaagttcttgtgattgatgatggcatggnacagatgtttgctgtttttccggttgatgc

SEQ ID NO: 11660 - DNA, 101 bp, rice(Oryza sativa)
  misc_feature (71): n=a or c
ggggtgataattgtgcgatcttatcttaaggctgaaactgttctgctacagtaccgttcaagcaaagctcntgcatgaacattaatactgcacgtgaaaat

SEQ ID NO: 11661 - DNA, 101 bp, rice(Oryza sativa)
  misc_feature (71): n=a or c
tcttgagaatctctatgatcagttcctcggagagacgctccattgagaaatacagcagagctagttaggtntttcaaggtgtagcagttgtccagagccct

SEQ ID NO: 11662 - DNA, 101 bp, rice(Oryza sativa)
  misc_feature (71): n=t or c
tggcctctccctccttctgcacagaccacaaacatagccaccgtcgctgtcatcccgtcgccaacactccngtcggcatgagaggagaaggggatgggggc

SEQ ID NO: 11663 - DNA, 101 bp, rice(Oryza sativa)
  misc_feature (71): n=a or g
aacttgataaaaaaaaatatccgaatgactgtgcacattcagatgtcaatatttagcagccagatatgctntatcacacggactgcaaaagaacagaaaca

SEQ ID NO: 11664 - DNA, 101 bp, rice(Oryza sativa)
  misc_feature (71): n=t or g
aacacaagaaaatatgctaaacttacaaggctgccaaaacctatgtaaataggcttttcaccactctcaanccatttgagaaggggttcaggaggtttata

SEQ ID NO: 11665 - DNA, 101 bp, rice(Oryza sativa)
  misc_feature (71): n=a or g
ctcgatcgtctcgtactctcatagtctcatgcatgcatgtcaccaccgtacgtacgtggttgcaacagatngacaaggcggcgttgctcggggaggtggtg

SEQ ID NO: 11666 - DNA, 101 bp, rice(Oryza sativa)
  misc_feature (71): n=a or g
ggctgtaggtgctttagggtgtttctgagtaactaacttgactttgtggcttgctttggttaggacctgcnaggtgctatcgccagatcaagaacaagccg

SEQ ID NO: 11667 - DNA, 101 bp, rice(Oryza sativa)
  misc_feature (71): n=a or g
acttgcacaaatctgacgattgagacaagatgcgtatacgtgcatgcaagagcttttcttcagatttgccncttcttcaccttgagcatgagcccattctt

SEQ ID NO: 11668 - DNA, 101 bp, rice(Oryza sativa)
  misc_feature (71): n=a or g
agaacatgatgcagctggcctggactagtctttcactgtctttgtgctctcaattctcaacagattgatanctttgccattgagtcagggagagagatggc

SEQ ID NO: 11669 - DNA, 101 bp, rice(Oryza sativa)
  misc_feature (71): n=t or c
cactcttaaaaagttagtatccatttctcccttacctctaaaggagattagaagtgcaccctaaaaagaangcatgtgaatatatccaagtcatgcattgg

SEQ ID NO: 11670 - DNA, 101 bp, rice(Oryza sativa)
  misc_feature (71): n=t or g
gcaaccaaatccaatagttccactcagatatcttaaaatatgcttcacggcagccatatgctgtgatgttngagcttccatatatctgctgactatgccaa

SEQ ID NO: 11671 - DNA, 101 bp, rice(Oryza sativa)
  misc_feature (71): n=a or c
tgacgaaacatgttatgtgttaccttttcaccaactcaatattgaaaaacgatttctgtgaaaacatcacnttttttaggcggactaaaagaaagcccata

SEQ ID NO: 11672 - DNA, 101 bp, rice(Oryza sativa)
  misc_feature (71): n=t or g
aaactggtgaagctcctatgtcaccgttaccgtgagctggcacttggtaacgccgttatcgtgcatttttnacctgttcccgtgtgaccctggggcacaca

SEQ ID NO: 11673 - DNA, 101 bp, rice(Oryza sativa)
  misc_feature (71): n=a or c
agttctaatttgtggtctacctatcagcacagtttaaacaacacgtagtaccacctatcgtttcagccttncaaggcattctcaacaaaagtcacaggaga

SEQ ID NO: 11674 - DNA, 101 bp, rice(Oryza sativa)
  misc_feature (71): n=t or c
cctgcacgacctcctaactatgaacccaccaattcttccaatccgtatcctagttgtaggcttgtagccantgacaacatatttgctttagagaaaataca

SEQ ID NO: 11675 - DNA, 101 bp, rice(Oryza sativa)
  misc_feature (71): n=a or g
gctagaaagtatcttattttacatctaactttgctggctaatcttcatataattacagaagacaaggaggngggggggggggggaggggttatattgtaga

SEQ ID NO: 11676 - DNA, 101 bp, rice(Oryza sativa)
  misc_feature (71): n=a or g
attgggaaggcacaacaactcataggaccaggaaattttgatgcgcagtcacaattcacaattgtataccntcaggacacagttttgagctcccagttttt

SEQ ID NO: 11677 - DNA, 101 bp, rice(Oryza sativa)
  misc_feature (71): n=a or g
gcagcaaggaattgatcgaagatctcgacagtcagattgcttttaggggaatatgcaaaaaggattgctcnacagtctcagaccaccatgggacctgtgct

SEQ ID NO: 11678 - DNA, 101 bp, rice(Oryza sativa)
  misc_feature (71): n=t or c
gaaggaaggcgatcagctcgttcttcttctccctctcctccagcgacggccatggcgagattaggtcttgncgtgtgcgccgtctccttccacctctgcct

SEQ ID NO: 11679 - DNA, 101 bp, rice(Oryza sativa)
  misc_feature (71): n=a or g
ggagccaatgtcgctgagatggatggggatcgacgagaatagaggagataagagagggagtcactgatatntgggtcctatatattgactcgtccggttag

SEQ ID NO: 11680 - DNA, 101 bp, rice(Oryza sativa)
  misc_feature (71): n=a or c
tttgtttttaaattttgattgttggaatctccacttgactccaggattctctccaataaacaaaactgaancccaaattgacaactgaaaactttcacact

SEQ ID NO: 11681 - DNA, 101 bp, rice(Oryza sativa)
  misc_feature (71): n=a or g
catcttaatagactatctctaagttagtagatagttttgctaagttagtagctctctcatgtattgcctcntttttctctatagactatctctaagttagt

SEQ ID NO: 11682 - DNA, 101 bp, rice(Oryza sativa)
  misc_feature (71): n=t or c
tcttttggaagatttcacctgactttgttgacctggttgggactggttctcagttgcactagggcccgccnggtttagttctcaaaataaaaattttaact

SEQ ID NO: 11683 - DNA, 101 bp, rice(Oryza sativa)
  misc_feature (71): n=a or g
ttactagtctctttagcatgattcttgtacatcttgatggatataggagagtgagggtgtcgacaccagcnttgttggcacccaatacgttgaaccttggt

SEQ ID NO: 11684 - DNA, 101 bp, rice(Oryza sativa)
  misc_feature (71): n=a or c
acgtagccgaggaagtcgtgcttaaagcccatgttcttctccaagaaatccttcaccaccatggtggtagnttggccaggaacggtgacaacacggtcgct

SEQ ID NO: 11685 - DNA, 101 bp, rice(Oryza sativa)
  misc_feature (71): n=t or c
ttgtttagaaggggcacagagctcagctgaccacataccaattgtctagcaatgttggtcacatctttttngacccatctcaactctttcaagcaattatc

SEQ ID NO: 11686 - DNA, 101 bp, rice(Oryza sativa)
  misc_feature (71): n=a or g
ccactccctttctcgttattgatagatcggtctctatatcacctttctgggttcctcagtttcagtgagancagttacaatagcgagctatatgagctact

SEQ ID NO: 11687 - DNA, 101 bp, rice(Oryza sativa)
  misc_feature (71): n=t or c
ctacaagtaagtgcctataatgaggatgtgaatccagggggaacatatttaatacatagattatcccaaanccaagacaattccaactcagtgcactgtac

SEQ ID NO: 11688 - DNA, 101 bp, rice(Oryza sativa)
  misc_feature (71): n=a or g
tcttatttatccaactacgaatcataatctttcattcattctagggatgtgtttagatctagtggtgtaangttttagtgtgtcacatcgaatatacggac

SEQ ID NO: 11689 - DNA, 101 bp, rice(Oryza sativa)
  misc_feature (71): n=t or c
aaaatgcccttggatgggaacaaactcacttaccttatcatcgtttccctctcctccctcctcagcatttnccagccccgctgtagcaccgtggccgtaat

SEQ ID NO: 11690 - DNA, 101 bp, rice(Oryza sativa)
  misc_feature (71): n=a or c
gttctgctacggctgcgtgtcagagaaaaacgggcaacaaacggcagcaggcagcaaactttctccgaatnttttaggctgtagtactgtggctactgttc

SEQ ID NO: 11691 - DNA, 101 bp, rice(Oryza sativa)
  misc_feature (71): n=t or c
gctgacaacctataaaaatcctgagaaatgatgggccaacatttcttaagaaaaaacccattataaccatntgggccaggagctttgtctggtggaattat

SEQ ID NO: 11692 - DNA, 101 bp, rice(Oryza sativa)
  misc_feature (71): n=t or c
acaaaattttgcaagaggatccctaccgatctggtctcgtagagccggaacttctgaaggaatttgtcgcncgccatagcctccatcagatcagatcagca

SEQ ID NO: 11693 - DNA, 101 bp, rice(Oryza sativa)
  misc_feature (71): n=t or c
agatccgatctgctcctcctgctcttccctttctcgatctgtgcatttttttcgcctgggttttcggtggntgatccgcccgatctgtgtttttttttttg

SEQ ID NO: 11694 - DNA, 101 bp, rice(Oryza sativa)
  misc_feature (71): n=t or c
gcagaatttgttacaggacactaaaaaattgtggtttttgttgtaagacaccaaagaacacatatcttctngtagacatcgcaaaaatgtgaaaattagtt

SEQ ID NO: 11695 - DNA, 101 bp, rice(Oryza sativa)
  misc_feature (71): n=a or g
ttacatatgatatttcatcgtaggatgtccaagacataacgagtgacagcaagaagagcaaacaatcagantcatgcatccatactgataaggtaatcgtt

SEQ ID NO: 11696 - DNA, 101 bp, rice(Oryza sativa)
  misc_feature (71): n=t or c
ttttttgcataactttagaagcaattataatcaggatatgaatagcttgtaatttttgtaaattctgtcanattaaatgcatgtaccaggagaagaaatac

SEQ ID NO: 11697 - DNA, 101 bp, rice(Oryza sativa)
  misc_feature (71): n=t or c
tcgccctttttatatgcagggatattattctcactcacagccagccatggcataatagaagtaaatccttnagaagtgacccggttgccaacacagtggaa

SEQ ID NO: 11698 - DNA, 101 bp, rice(Oryza sativa)
  misc_feature (71): n=t or c
atgctatgcccattcatagctgtaatggtagggaacacgaccacaggttggttggcgctaccattgacatngaggcccaaagtcgaacacttggcatgcgt

SEQ ID NO: 11699 - DNA, 101 bp, rice(Oryza sativa)
  misc_feature (71): n=t or c
ttttttgacaccttagtttcggcattccgccacacattctcgaaggaaaaataaaatccccaacgaaaagnaccttaaataatattacctccgttttttaa

SEQ ID NO: 11700 - DNA, 101 bp, rice(Oryza sativa)
  misc_feature (71): n=t or c
aatgttgcacaagagataaaaaaagctctctcatcacatcatgggtacaataggggtgtggtcggatcaantccacccattcttttcattcatccccctcc

SEQ ID NO: 11701 - DNA, 101 bp, rice(Oryza sativa)
  misc_feature (71): n=a or g
gcagataccaaatattaatgcagtaacaccagaagggaagcaaaggcaaaggatgctcacaaaaagaaaanaagaagaagaagaagctattgttccttagt

SEQ ID NO: 11702 - DNA, 101 bp, rice(Oryza sativa)
  misc_feature (71): n=a or g
cacctcgctccttcttggtgaggtgatggcataggaggaaggccaatatggtcgccatcgtgcaacggtcngtggtcattgtcatggtcatggtcatggtc

SEQ ID NO: 11703 - DNA, 101 bp, rice(Oryza sativa)
  misc_feature (71): n=a or g
attcaattttgggggattttaagcacattccttgttcttgatgcatggaataaaaggtgaaaattgcctancattttaccattggaatattgtttggtcca

SEQ ID NO: 11704 - DNA, 101 bp, rice(Oryza sativa)
  misc_feature (71): n=a or g
agcaaggagacactggttgattcttactcttcgctcgatatgttccactgagtctttttgctgaccagtancccttttataaattcatactatttataatt

SEQ ID NO: 11705 - DNA, 101 bp, rice(Oryza sativa)
  misc_feature (71): n=t or c
ggttatcttccagcgaagccagtcacgttttggacattccctgcaataaacaaaacgtgtgtgtgcgtagnggctgtctttttgtagtttcgcaataatag

SEQ ID NO: 11706 - DNA, 101 bp, rice(Oryza sativa)
  misc_feature (71): n=a or g
gaaatttccacccaagcaaaacgacgtggatgctcaaaagcaacatatagcagcttctcctataatctccngctaaacaaaaaacttctcaacacaattca

SEQ ID NO: 11707 - DNA, 101 bp, rice(Oryza sativa)
  misc_feature (71): n=t or g
cgacatcttatgagaacataggaagtaccgaagtaatagaatacgtgtaatctgatcttagtttctctcgntccaaaatataaaaaactagtattgaatga

SEQ ID NO: 11708 - DNA, 101 bp, rice(Oryza sativa)
  misc_feature (71): n=a or g
atataattagtccctgtcccacgtgccatttgacatccaccagacgggttcactgaattcagtctgacctntcggcctcggccaatcggccatcgcatggc

SEQ ID NO: 11709 - DNA, 101 bp, rice(Oryza sativa)
  misc_feature (71): n=t or c
aaaagtttttgtcaccgtttttgtcactgattcgaaaagtcctgaaaattaaacacggagcttgtagcccngtattccttctcccccataggcagtacagt

SEQ ID NO: 11710 - DNA, 101 bp, rice(Oryza sativa)
  misc_feature (71): n=a or g
gtaacgaaactgtctacttgcatccttatgtgctgcaatcttcatcaccaatcaaggcatcttcaccgctngagctattttagaagacaaccatacaaata

SEQ ID NO: 11711 - DNA, 101 bp, rice(Oryza sativa)
  misc_feature (71): n=a or g
ttttcattaaaaaattaatttaaagaagagtagggagagggaggaaaacatacgtacatacggttggagtngtgtgatattttttaatttattaaaatgcc

SEQ ID NO: 11712 - DNA, 101 bp, rice(Oryza sativa)
  misc_feature (71): n=a or g
ggacaacctcatcgacacggccagggacgtggcgctgctgaaatcgagagggatcatcagcaacctgttcngcagcgatgaggctgtggcggcgctgttca

SEQ ID NO: 11713 - DNA, 101 bp, rice(Oryza sativa)
  misc_feature (71): n=a or c
tttgctgttaaacatcatgtatatgcagaggaaattaatacatgtgtgtgcaaatctgcaggtttacctcntgatgatagcaccaggaggagaaggctgaa

SEQ ID NO: 11714 - DNA, 101 bp, rice(Oryza sativa)
  misc_feature (71): n=t or g
ggcttccattctagtgctgtggtgtcgctgtttctccatctccacagcctccatagtttcaatcatgctantctgcaactctgaagcctgaaattaaacac

SEQ ID NO: 11715 - DNA, 101 bp, rice(Oryza sativa)
  misc_feature (71): n=a or g
ggccgagtcaagctcccatgaattggaggaaattcagaactcaccgcgcgggcaggccgtgatggctgtcnaagaagtccaagccctccgcaaggagttcg

SEQ ID NO: 11716 - DNA, 101 bp, rice(Oryza sativa)
  misc_feature (71): n=a or g
aatgaacagaagaaggcatctagctaatacaaattcagaaactggcacttcggcaacataccaaaacagancaaactgaaaagacaagcagagaagataaa

SEQ ID NO: 11717 - DNA, 101 bp, rice(Oryza sativa)
  misc_feature (71): n=t or c
agatgtagctacaaattatggcctagaacagctatatcattatttcccgacctgacagaggaatctagagnttggctgcagatttagttgaatagtgtgat

SEQ ID NO: 11718 - DNA, 101 bp, rice(Oryza sativa)
  misc_feature (71): n=a or g
tccgtctaatccctactgttaaatgtcacttttgcccctccctttccatctctcttcttcccctctcctgntggagagacgagatgggtgtcgggcgtcgg

SEQ ID NO: 11719 - DNA, 101 bp, rice(Oryza sativa)
  misc_feature (71): n=t or c
atcctactggcgccacaatgataaaccccttgggttgaagccctccctgtttgagatctcattttcctttnttcaatccttatggatattcttatcgttgg

SEQ ID NO: 11720 - DNA, 101 bp, rice(Oryza sativa)
  misc_feature (71): n=t or c
atcgggcccaacaacctcccgcatcacatcaaaccattaaccatttgaccccgaagacttacctgggctcnccaccatgtgacccatgaaaattgttccgg

SEQ ID NO: 11721 - DNA, 101 bp, rice(Oryza sativa)
  misc_feature (71): n=a or g
attacatgctgatcaactactgaacaacagatcatcctctgactcatcttctgacgatgatggcgaggccntactgtcacaagtgaaacatgagaaatcag

SEQ ID NO: 11722 - DNA, 101 bp, rice(Oryza sativa)
  misc_feature (71): n=a or c
tcaaaatcgtttcggctcgtccaagagatgcttccatcacagatcttgttaactgacggttcacttccatncggtgaaccacttgaagcctgcatatcttc

SEQ ID NO: 11723 - DNA, 101 bp, rice(Oryza sativa)
  misc_feature (71): n=t or c
ctcctcggttatctataccaaatattgaataatgcatcaaccaagatagctatcatatcaatagttggagnaggtggaccatggtggctgttgcagacttg

SEQ ID NO: 11724 - DNA, 101 bp, rice(Oryza sativa)
  misc_feature (71): n=a or g
tgccacattgaaaacttcccactcatatagcttccttatctctgcccagaccttcttgaacatggccggcntgtaaatacgtgccgcacttttctctagtg

SEQ ID NO: 11725 - DNA, 101 bp, rice(Oryza sativa)
  misc_feature (71): n=t or g
ttggataacctatttatttaatggaatcattaagggttgtccctgttgaaccatggatcagcggggtcatntaaaatggtttaggttcaatccagaaccta

SEQ ID NO: 11726 - DNA, 101 bp, rice(Oryza sativa)
  misc_feature (71): n=t or c
cgggacaggtttgtcgcgattggctccctcggagagatctcaatctttagcgtcgataacactgatggtgnagctcctctcacggcgagcctgttgctctt

SEQ ID NO: 11727 - DNA, 101 bp, rice(Oryza sativa)
  misc_feature (71): n=a or g
aacacacccaaaggaaacacccacaagagtcaggggagtctcatcccaaaataaatgtggccacgatcttnaaaaatgcgaaaaaaaattcagtataatta

SEQ ID NO: 11728 - DNA, 101 bp, rice(Oryza sativa)
  misc_feature (71): n=t or c
ttcgtcagttgctgatacaaccgacttattgcagtatggcctgccattgaaaatagtttcctataaggacntctatggctggacaatggatgatattgtga

SEQ ID NO: 11729 - DNA, 101 bp, rice(Oryza sativa)
  misc_feature (71): n=a or g
cagcaaagactcgatcgagcgagcgatctacttgtacttctctaggacgcaacggaaaatattctcgactnctctctcctcgtcgtagttgtcgccgtcgt

SEQ ID NO: 11730 - DNA, 101 bp, rice(Oryza sativa)
  misc_feature (71): n=a or g
agtagcttgccatacataccatgccgctcttgactcttgacagtttaattagctagcacctgtcgccattnccatgcctccctagctacctaagcttagct

SEQ ID NO: 11731 - DNA, 101 bp, rice(Oryza sativa)
  misc_feature (71): n=t or c
gttgcgcaacatgtttataggttgtaccaacacaaataagagcgtcatgaccttcttgaagcatcatcttnaagatcttgtttttccattgtcatgcgctt

SEQ ID NO: 11732 - DNA, 101 bp, rice(Oryza sativa)
  misc_feature (71): n=a or g
gacccctcactgctaggattgaggcaaactcttcaaaccactaggccaaactaactgttgtgactaagggnaaatactaaatgtacatatgatataaaccg

SEQ ID NO: 11733 - DNA, 101 bp, rice(Oryza sativa)
  misc_feature (71): n=a or c
tattatgtgttaatttgttcctctaaaatattgatggattgctaaacaacaagcgctactgcccctttcantactacaagaatttttgaacattggttgat

SEQ ID NO: 11734 - DNA, 101 bp, rice(Oryza sativa)
  misc_feature (71): n=a or g
ctcgttcctcctcctccgaattactaatcaaatctcaaatcgatggctactcactctctagagagacccanacccttcttcaggccgaaccaaatcgggga

SEQ ID NO: 11735 - DNA, 101 bp, rice(Oryza sativa)
  misc_feature (71): n=a or g
ggcgtgatgatgaggagatcctggcaattattggtggaaacaacgtggtgctcctacaagatttcttcatntatgagctggttgtggatgtggagtgggca

SEQ ID NO: 11736 - DNA, 101 bp, rice(Oryza sativa)
  misc_feature (71): n=t or c
tttaaaatagtagagatatatgatttagacttggtgtgaacccgtgagaaacatattcatacctgtcccanaatattgaacctgtaaaacataataaggaa

SEQ ID NO: 11737 - DNA, 101 bp, rice(Oryza sativa)
  misc_feature (71): n=t or c
gttcgttgtggttgcgcagaatgatgaggccacatatgaatgtaaccacatagcgagagtcaagttcactnagcttgacgaagcgccaccaggcatcaaag

SEQ ID NO: 11738 - DNA, 101 bp, rice(Oryza sativa)
  misc_feature (71): n=a or c
taatcggtcaaagggtcagactttcttctgtcggtcaagagcgactccaactactgtactatactaactanactacactagtggatcatcaattttccaaa

SEQ ID NO: 11739 - DNA, 101 bp, rice(Oryza sativa)
  misc_feature (71): n=t or c
acacctcgaacatcaatcgccttacatccggtttgccatagacgcagtaagcaaggccgtgtattgcttgntggacggcggtcgtggaaggatttctcagc

SEQ ID NO: 11740 - DNA, 101 bp, rice(Oryza sativa)
  misc_feature (71): n=t or g
gaattatagtgctgtccaatcttgaagactcaaagaccatgtctatctgctctgtttcctggaccagactnacttggtttgaccccccaattccacttggc

SEQ ID NO: 11741 - DNA, 101 bp, rice(Oryza sativa)
  misc_feature (71): n=t or c
agctcgctgagatgtgattgtagacgtatattgttcgcacgtgcgtgtcgattcctgccctttcgtagtantacatccttctggctatatggatcatgtac

SEQ ID NO: 11742 - DNA, 101 bp, rice(Oryza sativa)
  misc_feature (71): n=t or c
actgtgttctgatgtggtaatgtgtctacgaatcctgatacagttgaaatcacctacgagttactcccttngtcctaaaatataaacacttttagcatagt

SEQ ID NO: 11743 - DNA, 101 bp, rice(Oryza sativa)
  misc_feature (71): n=a or g
taattcttgccgccgtcgccactgagctcagcaatgccaataccgttgcatagctcctggaatcaaacacngctgagtggcttcgtcagtacgtccttcag

SEQ ID NO: 11744 - DNA, 101 bp, rice(Oryza sativa)
  misc_feature (71): n=t or c
ggcgtagtcaatccgatcttggaaattattaaactacagttgtgctgtattgccatctggaccaagatccncaacttgcaccccctgagaacggtcaccgt

SEQ ID NO: 11745 - DNA, 101 bp, rice(Oryza sativa)
  misc_feature (71): n=t or c
tgtctgctgctgggctaacagtggaccacccgttgatgacaagtactgatttctggacctcacatgagtgncttctcctaccctatgaacaatctctgacc

SEQ ID NO: 11746 - DNA, 101 bp, rice(Oryza sativa)
  misc_feature (71): n=a or g
ctagagtggagatagatcatgtatgcttgtgttaattttggcatgttcctttttagaaccaaagggagtantacagctactatcttaatataattcacgcc

SEQ ID NO: 11747 - DNA, 101 bp, rice(Oryza sativa)
  misc_feature (71): n=a or g
gattttgatgagatcgtagatacatcgttagttttcgtctatctagcatgcgttagaagatactcccttcnccccaaaaagaattaacttagaagaaaaat

SEQ ID NO: 11748 - DNA, 101 bp, rice(Oryza sativa)
  misc_feature (71): n=t or c
tccgtcaaatcctgcactaaactcgtgcacatgagatgatcataagcaagctataactacgccatggtgcnagccgtggcagatcgaaatgcgcctagtag

SEQ ID NO: 11749 - DNA, 101 bp, rice(Oryza sativa)
  misc_feature (71): n=t or c
ctattttaattatcttcaaaagacgtacgtactcctagtttatacatacggtagatttttacattatttanaacctgtgcttaacaacatagtaagatgta

SEQ ID NO: 11750 - DNA, 101 bp, rice(Oryza sativa)
  misc_feature (71): n=a or c
ctgaagctttagctagcagaaaggacgatgacatcgaccacatctgggtatgtacttccaccatcctatanttgttagtatctttatagtatttaaaagtt

SEQ ID NO: 11751 - DNA, 101 bp, rice(Oryza sativa)
  misc_feature (71): n=t or c
atacaagaaagtagaggatgagacccggttaccagtagcggagtcattaatcaaaaaacttctagacaatntgttaatcaagtcacaataaaataaataat

SEQ ID NO: 11752 - DNA, 101 bp, rice(Oryza sativa)
  misc_feature (71): n=t or g
caaaaataaatcattcatcactaaaagttattaggtgagactacatgccatcagccctccttctctcctcnctagctccctacctcccatcaccggcgtcc

SEQ ID NO: 11753 - DNA, 101 bp, rice(Oryza sativa)
  misc_feature (71): n=a or c
gcaaagtttggcaacatgaccttggcgatcaaacaccttaattttgccagataggtagagtgacagaaatncaagtccagcaaaagaccctggaagcatta

SEQ ID NO: 11754 - DNA, 101 bp, rice(Oryza sativa)
  misc_feature (71): n=t or c
attgtcgaactaactgaggtcaatgcttaatgcttccttattaccagtgctactacactttaaagaaattnttacgaaaacttttacaaacaaaaagtctc

SEQ ID NO: 11755 - DNA, 101 bp, rice(Oryza sativa)
  misc_feature (71): n=t or c
gatggattagagactacaccggggcgctgggtttgcaagctattcttgaataccttcagctttggagcctnctgaggtcgtcggtgtggctctctgaccac

SEQ ID NO: 11756 - DNA, 101 bp, rice(Oryza sativa)
  misc_feature (71): n=t or c
ttcgttccattttgccatcttcaccaaagaaggcatgcatagggattttgtcattgaagtaccacacaggntgctgattattcttcaccgcaacctgcagc

SEQ ID NO: 11757 - DNA, 101 bp, rice(Oryza sativa)
  misc_feature (71): n=t or g
catgcggcctgcaggatgttagagacagtaaaaggaattcaagtgggctgacccgcaaattcatttatatntcaaataagtaaccgatgagttcccgcgtc

SEQ ID NO: 11758 - DNA, 101 bp, rice(Oryza sativa)
  misc_feature (71): n=a or g
tagtggtattcatccatgccccatatctcatcaccaattggaggactcatcacaaaatcaacttgggtagnctgtaaagggagcaaggaattagaactaga

SEQ ID NO: 11759 - DNA, 101 bp, rice(Oryza sativa)
  misc_feature (71): n=a or g
cctaagtgtgagcatcacacaggcagccaatttctcgtaagtggttaaagagatgccaggcgttggcattnaggaattactgtcaccaaccggtcgtagtg

SEQ ID NO: 11760 - DNA, 101 bp, rice(Oryza sativa)
  misc_feature (71): n=a or g
gaaggttgggagggattggggagaaggggaataatggaggaataatgcgtagttggctgaaggagataaanaggagagagggtgaggtggatgaaatagga

SEQ ID NO: 11761 - DNA, 101 bp, rice(Oryza sativa)
  misc_feature (71): n=a or c
gggttgttgcatatacgcttgggatttagtatcagctttcacaatcttactcatccgttcagacataaacntttttctcctctttgatctacattttgcta

SEQ ID NO: 11762 - DNA, 101 bp, rice(Oryza sativa)
  misc_feature (71): n=a or g
tttggtagccgcaacactcataacgcaacgatgagatgcaacagaaaggatggacatgatggcctccgctngagtgcacatgtggttgccgagatagctga

SEQ ID NO: 11763 - DNA, 101 bp, rice(Oryza sativa)
  misc_feature (71): n=t or c
gaatttgtatttagcatgacccttcgcgtattgacaaaagaaatgttggccattgtgatccctacctgtgntgggaaatggagggacggatgaatcaatat

SEQ ID NO: 11764 - DNA, 101 bp, rice(Oryza sativa)
  misc_feature (71): n=t or c
atgctcgaataggcagttgcaatgtattcctcaagctctcgaggaacagaaggaacaactcttctcgcagnagatatgtatgccctgtgatcagatcaaga

SEQ ID NO: 11765 - DNA, 101 bp, rice(Oryza sativa)
  misc_feature (71): n=t or c
cagggcgatgattaagctacaaggagcccatggcaataccgaactcaatcaacaaaacgaacatgctaccntgaaaaagaaataaggaagcttacagaacc

SEQ ID NO: 11766 - DNA, 101 bp, rice(Oryza sativa)
  misc_feature (71): n=t or c
tcaaatttataaaagtaagacacttttgcaaaaagctcacataactacaaataagttgccggtaagtacanctctaaccctagagaaactactgaaaaaga

SEQ ID NO: 11767 - DNA, 101 bp, rice(Oryza sativa)
  misc_feature (71): n=a or c
acaagctcgccgtccgggaagagcaaaggtgacaatcccggcgctttcttcagctcagcgtcacagcgaangcctgcttcgcaagcgacgagcaggggcaa

SEQ ID NO: 11768 - DNA, 101 bp, rice(Oryza sativa)
  misc_feature (71): n=t or c
ggatcacgtaattattgggagagcatcaatgatgcaccaaaggcaggcatatcctctcttactatatagcncactaattcctaaaacttaacatgcatgca

SEQ ID NO: 11769 - DNA, 101 bp, rice(Oryza sativa)
  misc_feature (71): n=a or g
agctatctaggaacatgcctaatagatatgcacgtggtgtaaaaatatactcccccatccaaaaatattangcataaccacttttttttcaatgtttcgta

SEQ ID NO: 11770 - DNA, 101 bp, rice(Oryza sativa)
  misc_feature (71): n=t or c
cttaataagccgtgatgactagagcatgacatatgtgcaacatcggaccaaaaccatccaaaaacaatgcnaggggatatcgtccggcttcaaaaatccat

SEQ ID NO: 11771 - DNA, 101 bp, rice(Oryza sativa)
  misc_feature (71): n=a or c
cgtacatagcataactgactgactactgccttcatcctatgaagttttaacggaaattaagactgaggtgnaaattaaataatagaagtttatgattgatt

SEQ ID NO: 11772 - DNA, 101 bp, rice(Oryza sativa)
  misc_feature (71): n=a or g
gggagattctagcaattgcaacatcttccagaatctacaactcttctaaacagtccaaattcttacttagngtgtgtttagttcacgccaaaattaaaagt

SEQ ID NO: 11773 - DNA, 101 bp, rice(Oryza sativa)
  misc_feature (71): n=t or c
ggacagtatcgtcatcaacatcaagaactcgctgctgacggagaaagtcgccatccactggcacagcatcnggcagatcagcaggccgtgggcagacggca

SEQ ID NO: 11774 - DNA, 101 bp, rice(Oryza sativa)
  misc_feature (71): n=t or c
gggcatggaactaaacacggccttggctgttctttcaagtgaaaggtcccaactcaccttccctgtgttangtgagcacgtttttcaaactgctaaacggt

SEQ ID NO: 11775 - DNA, 101 bp, rice(Oryza sativa)
  misc_feature (71): n=a or g
taacatggataataaaggaacaaagtaggaactcagacgcgagcttctttatgtagcctatcacacaaacnatgttagatcgatctcggatcatcttttgg

SEQ ID NO: 11776 - DNA, 101 bp, rice(Oryza sativa)
  misc_feature (71): n=t or c
tgttgcatggatataacctcttcttttgagtgtacatgggatttgtgggttccattcagctgcttcgcatntctgtcgtaatcattagccaaaacagagat

SEQ ID NO: 11777 - DNA, 101 bp, rice(Oryza sativa)
  misc_feature (71): n=a or g
gaaattttagatcagttatgaagcagaaatttgcatacctcaacaaagttacaccacctgtcaagcaaccnaaacctcccatttagaaccatcctccatgc

SEQ ID NO: 11778 - DNA, 101 bp, rice(Oryza sativa)
  misc_feature (71): n=a or g
gaagatgaagtttggacagcattaaagccgagcgagagacgcatacatggcttattccgttgtgctgtgtnctcacaccatcaaaaacaaaaaaaaaaaaa

SEQ ID NO: 11779 - DNA, 101 bp, rice(Oryza sativa)
  misc_feature (71): n=t or c
gtaccccagaagtttcccccttgttgccccgaaagtgcatttctcggggttgagcttgatgccacccctcnataggctggcaaaagtttcccgcagatccg

SEQ ID NO: 11780 - DNA, 101 bp, rice(Oryza sativa)
  misc_feature (71): n=t or c
ggtgaagggggtcccgtgggatccggaaccggatgccctcagtactgtagccctggtgtcgtcgtccctgnggaagacgaatcgctccagcatcacccagt

SEQ ID NO: 11781 - DNA, 101 bp, rice(Oryza sativa)
  misc_feature (71): n=a or g
atacagctgcaactaccacgtatcatttggcatcggcgtcttatctcattgacctctcggcatattcaagngctcaataacatgatcttggtgggattggt

SEQ ID NO: 11782 - DNA, 101 bp, rice(Oryza sativa)
  misc_feature (71): n=a or g
tcctactaatatcgcgtgccacaatagaggcaataaaaacacccaaaagggctataaagatccaaacttcntctcctcaccctcggcatcccacaaccatt

SEQ ID NO: 11783 - DNA, 101 bp, rice(Oryza sativa)
  misc_feature (71): n=t or c
cagtgatgaacctttcagtatttttggctgcgtctcattactgtaccctataatcttctggatgaggtctnttgctttgctgatttccgcacagttgtcag

SEQ ID NO: 11784 - DNA, 101 bp, rice(Oryza sativa)
  misc_feature (71): n=t or c
actggttggctcatcatcatagacagcaacaacaacgccaccttcaaagtcaatatgaggcagtaatagtngtgccccatcgctcaccatatgagcagcag

SEQ ID NO: 11785 - DNA, 101 bp, rice(Oryza sativa)
  misc_feature (71): n=a or g
caaccaaccaaccaacaaaccaattaaatgcgtcgaatcgatcgaatcacccacccaaaacgccgcaccanaatcgagccgttcccaaaccacgggaggag

SEQ ID NO: 11786 - DNA, 101 bp, rice(Oryza sativa)
  misc_feature (71): n=t or c
agttaccgctttaagtatgcacaattagttccgggtggacgttgatttgttcacgagatcgctttgttcanagtgctaatttttaacagattacaggtaag

SEQ ID NO: 11787 - DNA, 101 bp, rice(Oryza sativa)
  misc_feature (71): n=a or g
atagactgagcgcctccttcacacttctcgcttgatcaacctcggctttaaagaacaataagctatcgtcngcgaaaagtaagtgggagatccctggggct

SEQ ID NO: 11788 - DNA, 101 bp, rice(Oryza sativa)
  misc_feature (71): n=a or g
accaaacatatggaataaagggttagggtttgtggcaaagaatagagtgtggctgacctcaacaagcgcancgtgcttcacggctctatcctgttggttct

SEQ ID NO: 11789 - DNA, 101 bp, rice(Oryza sativa)
  misc_feature (71): n=a or g
cccatttaagggactcagcgtgtcgctaaatgggctaattgggctgatcggccaatttgcgaatgcactanggccctgttggatcaagctcatcggatcaa

SEQ ID NO: 11790 - DNA, 101 bp, rice(Oryza sativa)
  misc_feature (71): n=t or c
atatgactcgttatagataagggacatctctaactggtctaattttccttaacccacacaaatgttgtcangccccggactagtaccgaccggaactagcc

SEQ ID NO: 11791 - DNA, 101 bp, rice(Oryza sativa)
  misc_feature (71): n=a or g
tcgatggatgtttggatggcatatctgttgaggatgctcttactctgctccatctcttctatcttcagccngctctgttttgagaacctttggaagttata

SEQ ID NO: 11792 - DNA, 101 bp, rice(Oryza sativa)
  misc_feature (71): n=a or g
caagattatatcaacaaggttgaaagactagatgtacctgactacatcaagcagggcgttatccaggaatncaaggtacctgacggtacccgactacgtta

SEQ ID NO: 11793 - DNA, 101 bp, rice(Oryza sativa)
  misc_feature (71): n=t or c
aaattcatacctgcaaagcaaaaactccaaatctttgcatcagtacacttctccattttgtagatgcatangtgtttccctttcaaaccagaacaccagta

SEQ ID NO: 11794 - DNA, 101 bp, rice(Oryza sativa)
  misc_feature (71): n=t or c
ttcagtgagcgtgtgctctacatttgtcgatggcttttagcttatattgtaatatatactccctccatccnaaaatgtttaacgccgttaacttttttaaa

SEQ ID NO: 11795 - DNA, 101 bp, rice(Oryza sativa)
  misc_feature (71): n=a or g
aaaagcgttgggcaccaaggaacaccgtggacggacatggggcattaggtccaccgttctctggaagtatngatttctagacaagcggacttccaacaagg

SEQ ID NO: 11796 - DNA, 101 bp, rice(Oryza sativa)
  misc_feature (71): n=t or c
atgctgggtctatctaaaatgactagacaatggcttttccccgggataatatatatttacgaaggcgtgtnattaatgacgcatgcaacgttttttactcc

SEQ ID NO: 11797 - DNA, 101 bp, rice(Oryza sativa)
  misc_feature (71): n=a or g
tacttttttttacacgatatgataaccttacttgaccgtatccaaatgaggtcagaagctagggaggaccngaggagagaaagtaatcgagccataagtag

SEQ ID NO: 11798 - DNA, 101 bp, rice(Oryza sativa)
  misc_feature (71): n=a or g
atcagtggagttcatggatggagtttgtggaattgcctcttctagatgtgactgctcacacacggtaactnaacttactctacggttttcaggatcatgct

SEQ ID NO: 11799 - DNA, 101 bp, rice(Oryza sativa)
  misc_feature (71): n=t or c
ttatgtttccttgtttgtgtagtggtttcacgtgtgctataacatgacaaatactacagtcagcacgccangcaggcaaaaccacttgggggttgtttgga

SEQ ID NO: 11800 - DNA, 101 bp, rice(Oryza sativa)
  misc_feature (71): n=a or g
gcggaccacagccacaagtgggtgttcaaggagccgcaggagcaagagatcaacctcatctcctcctggancaaccctgccgattctgtaagcaaaaagca

SEQ ID NO: 11801 - DNA, 101 bp, rice(Oryza sativa)
  misc_feature (71): n=t or c
gcaacttatccagttacttgccttggcattgcgcgatgattcaagtgaagttcgaaggagatctttgtctngtctcaaagctgctgcaaaggtttatactc

SEQ ID NO: 11802 - DNA, 101 bp, rice(Oryza sativa)
  misc_feature (71): n=a or g
gttgacagcagtgctgccattcctctggagtatgctgatgctaatattcttgctcccgcattggggcaaanatttaagactgagagagatgcctttaattt

SEQ ID NO: 11803 - DNA, 101 bp, rice(Oryza sativa)
  misc_feature (71): n=a or g
gtcactgtatcaccaatggatgaacggcggcaaggacatcagaggaaacttcacaaatcacatcaagttanccacatgctcgaaatactcgaagaaagcac

SEQ ID NO: 11804 - DNA, 101 bp, rice(Oryza sativa)
  misc_feature (71): n=a or g
cgcaacatcaggttacttctgattattatgttgcaacactggaactgctactacacaatattgtcagattncctgaaattacagcgctttctgaaggttcc

SEQ ID NO: 11805 - DNA, 101 bp, rice(Oryza sativa)
  misc_feature (71): n=t or g
atgaagaacttattagagaaggaagcgtcaatgagtagaccccgtccaaagaaggcaccacttaaaactgntgcgcaggccaagcagcctgtgaatccgac

SEQ ID NO: 11806 - DNA, 101 bp, rice(Oryza sativa)
  misc_feature (71): n=t or g
ccagcacaggcggcctctgggtagcaacaccaatatgtgaccccgtcagcgccgcagaccgggtccaggcngaagcgtcgcacggggcacagcggggcctt

SEQ ID NO: 11807 - DNA, 101 bp, rice(Oryza sativa)
  misc_feature (71): n=t or c
gaattataatttttattttcatattttaaaggtgcaaaacttgatttttacaggccttctgtatgagaacnactcgtaaaaagaatattttaagagttgct

SEQ ID NO: 11808 - DNA, 101 bp, rice(Oryza sativa)
  misc_feature (71): n=a or c
atgcagtcatgcacaacctggttatcctacttactctcctcccccccaaacctaataccctggaaaagcangagatagctgcagtggaagcgcaatggcag

SEQ ID NO: 11809 - DNA, 101 bp, rice(Oryza sativa)
  misc_feature (71): n=a or g
gtagccattttattgtaggtgtagcttctgcgactccctcgtcgtcaagtccaacctgctatgtccactcnccgtcgacgctgccctcgccgccgtcgatc

SEQ ID NO: 11810 - DNA, 101 bp, rice(Oryza sativa)
  misc_feature (71): n=t or g
gccacaggggtgctaattaactccggtcttagttcttaaacacccaccccaagcctctatgtatctcaacnccaagaacagaggtgcatgcaggtcgagga

SEQ ID NO: 11811 - DNA, 101 bp, rice(Oryza sativa)
  misc_feature (71): n=a or g
cactaatgcagatttaaagtaactcatgtgctcatccattccattgaaaaatggaacttgcgctgagttgntgatctttagatattaccgataatacaaat

SEQ ID NO: 11812 - DNA, 101 bp, rice(Oryza sativa)
  misc_feature (71): n=a or g
tctaacgagaagagtttcacccgccaacaccaatacaccttttctcattttcttccatggctgagacggcnccgttgcgtcgccatcaccttcgtcctagc

SEQ ID NO: 11813 - DNA, 101 bp, rice(Oryza sativa)
  misc_feature (71): n=t or c
cccgattaaacaagtgatcaaactcactgttaatttgtttaatcactgctgattgatgctgctgctgctgntgtgatttttttagggctaaagagtccaag

SEQ ID NO: 11814 - DNA, 101 bp, rice(Oryza sativa)
  misc_feature (71): n=a or g
aaattacctttttctttggctgattagacgattcgatgggagcctaaatatcctcatttttatcaaattcnaatacaattatattattctgtttaccaaat

SEQ ID NO: 11815 - DNA, 101 bp, rice(Oryza sativa)
  misc_feature (71): n=t or c
cagttcgtacgtcgctagctaggcgcttatcgacttgaggggttggagttaagcacaaccatccagtcttnccgaaaggcgaatacgcatctgctaataac

SEQ ID NO: 11816 - DNA, 101 bp, rice(Oryza sativa)
  misc_feature (71): n=t or c
aaacggagggagggagtagttttcaatctgttcatgatgcccagaaatgaaggcatgccttcattttaatngcgcgctagctctagctttcgtgatgatca

SEQ ID NO: 11817 - DNA, 101 bp, rice(Oryza sativa)
  misc_feature (71): n=a or g
caatcttccttggtttagagtgcttcaagttttcaggttgcgtgtgtagtgtgccttcaggttatagttgnccaaaaggcctggggctcaatgacccggcc

SEQ ID NO: 11818 - DNA, 101 bp, rice(Oryza sativa)
  misc_feature (71): n=t or c
tcagctttcaagagtaatgctcaaaacaagtccaaagtggtcactgggtaagacaggaagttccagtttgngaacttccttgcggaccttcttctccttga

SEQ ID NO: 11819 - DNA, 101 bp, rice(Oryza sativa)
  misc_feature (71): n=t or c
gtggattcagtaaaaaacgtacaagtaatatcttgtggttgaagtcataatatatatactccctccgtttnaggttataaaatgttttgactttgatcaaa

SEQ ID NO: 11820 - DNA, 101 bp, rice(Oryza sativa)
  misc_feature (71): n=a or g
gcccttaaacctagcaactcatagaatttgtcatccccaacaatatctaaccacccttcctcgtcatttcnggccagaatgtctaggctatcccaatccac

SEQ ID NO: 11821 - DNA, 101 bp, rice(Oryza sativa)
  misc_feature (71): n=a or g
catgaccggaatgccggtctgttgaaagcaatcaaagaactccaggaggatggtgatgtcgcatactactngcctgacatgcatagccgttggtgcatgca

SEQ ID NO: 11822 - DNA, 101 bp, rice(Oryza sativa)
  misc_feature (71): n=t or c
tctcctggtcatttcaccccagtcccaacgagatggaggcataccacttggtacgggggactgatggctcnagcctccccactgtatgtcatgaggcaccc

SEQ ID NO: 11823 - DNA, 101 bp, rice(Oryza sativa)
  misc_feature (71): n=a or g
aattggttcttgtgctgccaacttattataagagtgccttgatactgtgacatcttttttttttcttgtcncacatttgatcttttttatcttatcgatta

SEQ ID NO: 11824 - DNA, 101 bp, rice(Oryza sativa)
  misc_feature (71): n=t or c
gaaggattgaactacggaatatgattccggaggaaatacgacaaggattggattcacaaggatggattaancgagatccttggcacaaacatacaaatgca

SEQ ID NO: 11825 - DNA, 101 bp, rice(Oryza sativa)
  misc_feature (71): n=a or g
gctctgcgcactcactccctcgctcgatcgatcaatcgccactcaatctctgcaggtcggtcagtcagtcngtcagtcagtcaatgaccacctcatgcagg

SEQ ID NO: 11826 - DNA, 101 bp, rice(Oryza sativa)
  misc_feature (71): n=t or c
gtggcattgtggaacgagatggagaccaacgagcttagtcccggggttgacacatttgctatcatggtgantggcctcgttggccaaggcgtgctggttga

SEQ ID NO: 11827 - DNA, 101 bp, rice(Oryza sativa)
  misc_feature (71): n=t or c
ggaccataaaacttttgtatataaaagcacagtaatcctctccccaccctacacaggaggtcgtccgctcnttcgtgtttgcgtaactagtataggattta

SEQ ID NO: 11828 - DNA, 101 bp, rice(Oryza sativa)
  misc_feature (71): n=a or g
cctcaacacctcacacgccaaccagcaagttctcttgtgctccaacagaacaagtaacctcacttgacacnctttttccatcgatagctcagaaagttcaa

SEQ ID NO: 11829 - DNA, 101 bp, rice(Oryza sativa)
  misc_feature (71): n=t or c
gccttcgtcggatggctccaacagtggcagcagttgtttatccctcgactacctcttgttcacggacattngaggcacgtaacgatcactggcggtcaagc

SEQ ID NO: 11830 - DNA, 101 bp, rice(Oryza sativa)
  misc_feature (71): n=a or c
attgcctcctgaaacatcaaggtgaggctcttcctatcttttgacagcggcttcttactagttagaagctnaagaagaataactccgaaactatatacatc

SEQ ID NO: 11831 - DNA, 101 bp, rice(Oryza sativa)
  misc_feature (71): n=t or c
gtactcggtataagaagccatgcccatgcatcaacttgcacaagccatccctccaactgtattttgccatnctactttgcaccaacgacgacgactactac

SEQ ID NO: 11832 - DNA, 101 bp, rice(Oryza sativa)
  misc_feature (71): n=a or g
ctcttcaggatctgcgcatttggcgctgaagatccaggaaattatccagaactagagtctatcggtgaatntattgtccaaaagttgaatggctcagcatt

SEQ ID NO: 11833 - DNA, 101 bp, rice(Oryza sativa)
  misc_feature (71): n=a or c
agcacataggccactaggacactacagaacaagctgacgtaaggggagagaaaaaggaaaaaggacagagncagaaggacaagaggccaagtttagcaacg

SEQ ID NO: 11834 - DNA, 101 bp, rice(Oryza sativa)
  misc_feature (71): n=a or g
tcagaattgtgtgatgagttttcatagtcttcagttgacccagcagaatcttccgccaaagggaaacccgnagaagtttctttcagcttgattcttgcatt

SEQ ID NO: 11835 - DNA, 101 bp, rice(Oryza sativa)
  misc_feature (71): n=t or c
ttgtacacatcctggcaataaaatatatattgtagcagtagcggcagtaatacgtgctagctaggtaatgnattttagcacgatacgctagctgaatctta

SEQ ID NO: 11836 - DNA, 101 bp, rice(Oryza sativa)
  misc_feature (71): n=t or c
gatcgacgggcacgtcgttgaagacgacgacgagcaggtgattgggggcttggaggtagtcccacatcagngggagtggcacgagtttgagaggtcagagg

SEQ ID NO: 11837 - DNA, 101 bp, rice(Oryza sativa)
  misc_feature (71): n=a or g
ctgtaccgcaaccacagtggtgtcctccagggattaaacatacacgaaagcgacggctgcagaggttgcgngcattagaaatcagagaacaaaaggaggag

SEQ ID NO: 11838 - DNA, 101 bp, rice(Oryza sativa)
  misc_feature (71): n=a or c
tggatgtcctctcgaggggacaaaaatccacttccctataggtgagtgagagtgagagtgagaagtcgatngggggaagtatcgggtgcaatcacctaatt

SEQ ID NO: 11839 - DNA, 101 bp, rice(Oryza sativa)
  misc_feature (71): n=t or c
catatagtgcacaaagtttcaacagctaaagttttgcactaattagaaactctcttctctttgttcaggcntggagcttgtggaaagatggaaatgcagag

SEQ ID NO: 11840 - DNA, 101 bp, rice(Oryza sativa)
  misc_feature (71): n=a or g
tattgttttgccatgttatacgggctgcgcgtggtcaaaagagccttttagattctgaaataaattttggnagggtctacttttaaaacataaaaataaaa

SEQ ID NO: 11841 - DNA, 101 bp, rice(Oryza sativa)
  misc_feature (71): n=t or c
cgagtttttagtacctcagacacattgcagagtagcggacggaaaagtttgaattaaatgaccatcgtacncttttcaaatcaacggtgagatgtaagtgg

SEQ ID NO: 11842 - DNA, 101 bp, rice(Oryza sativa)
  misc_feature (71): n=t or g
cattagctctcccctccaccaccatcaacgagcttactggcagccattctctgtgaatgatgagggaggcngtcacgccccgaactagtaccgaccggaac

SEQ ID NO: 11843 - DNA, 101 bp, rice(Oryza sativa)
  misc_feature (71): n=a or c
tgttagtttgagtactgccgggaggaaattcaattcatagcacagcttctcccagtagcagaaaatagcanaaaaaaatttatgcctctttaaaagcacag

SEQ ID NO: 11844 - DNA, 101 bp, rice(Oryza sativa)
  misc_feature (71): n=a or g
gaacccaaagcttaggtcggcctactgctgcgcatcgccgctatccggcatggagctcctgatgaacatcnctgacccatacatcaccgctggattcctcg

SEQ ID NO: 11845 - DNA, 101 bp, rice(Oryza sativa)
  misc_feature (71): n=a or g
gtggtaagttcgctgttgcttttcacaacttgcctggtgtaacatgtaaggccattcacaatgcacatatntgtcattcattctcaaccctccacgtcaaa

SEQ ID NO: 11846 - DNA, 101 bp, rice(Oryza sativa)
  misc_feature (71): n=t or g
agagaaacagttagaggagatggtcaataaagagatatcacaaatagaggagaaccctgatgaggttcctncgcataagaagagagatggtaccaaaaaaa

SEQ ID NO: 11847 - DNA, 101 bp, rice(Oryza sativa)
  misc_feature (71): n=t or c
gctcaggaggagatcctcggtatcctgatattggagtttggaactgcataggacttcgccatggactgccnaccggtgaatagaggctgaattggaggagt

SEQ ID NO: 11848 - DNA, 101 bp, rice(Oryza sativa)
  misc_feature (71): n=a or c
gcgattgacctcctctacaaacgaatattgaaacaacaaaagtaccactatgtcaaggcagtttttcggcncataattacacttatatagacatgtatgga

SEQ ID NO: 11849 - DNA, 101 bp, rice(Oryza sativa)
  misc_feature (71): n=a or g
gcctacgttctctttcagattttgttactactgtctttccagctctcctcctctgcatcttctgagcacgncgacacgcccagggaggagaatccagagta

SEQ ID NO: 11850 - DNA, 101 bp, rice(Oryza sativa)
  misc_feature (71): n=a or g
ggaaaacgaaggtggtgtggttgggagctcaagctgccaaacgcagccttaggaagtttcacactatgccntgtttagttcacccccaactacccccaact

SEQ ID NO: 11851 - DNA, 101 bp, rice(Oryza sativa)
  misc_feature (71): n=a or g
agtatggcgtgatacgctgtcccgaaatcagcgactttgaagtagacgttctctgtgtgaaagttttcccnagtgccaaaggtgaccgggagaatgatctg

SEQ ID NO: 11852 - DNA, 101 bp, rice(Oryza sativa)
  misc_feature (71): n=a or g
cctaattttggaaactgattaattaaaaataactttacgggagatgaagaagatattgcaacttgtaaccngatcaggatcctctgcagtcgactataccg

SEQ ID NO: 11853 - DNA, 101 bp, rice(Oryza sativa)
  misc_feature (71): n=a or g
agaagcaccacgagagaatccactgctcttcctgcatgcaccagtacaagtttttcatcaagctgacatgnacaaataaattaacaaagctacatacatac

SEQ ID NO: 11854 - DNA, 101 bp, rice(Oryza sativa)
  misc_feature (71): n=a or g
ctcatagcatgacacatcaattagtaagaaaaattagtatgtatgggtttagaattcacttgttttcttgnaaactattttgatttctttcaggaatatct

SEQ ID NO: 11855 - DNA, 101 bp, rice(Oryza sativa)
  misc_feature (71): n=a or c
tctctgtgccactgacatcaactgtctctttaacagtcccctttaagcttgatggtttcgattgaaccttnttttccttcactgaatacatattctttgta

SEQ ID NO: 11856 - DNA, 101 bp, rice(Oryza sativa)
  misc_feature (71): n=a or g
aagaatagcaatgcctgtagcaaagaaacaaaccttggttgcagaagccgacgtgcagagaaggggttgcncggtgctgcggatctcggacaggaggcaga

SEQ ID NO: 11857 - DNA, 101 bp, rice(Oryza sativa)
  misc_feature (71): n=a or g
gtagtacgtacgtgcatgggaaccaataggaggcgcggcctcacgggatatatatacgtgatatgataatnctacatgcagtagtaggcgttgttcgaccc

SEQ ID NO: 11858 - DNA, 101 bp, rice(Oryza sativa)
  misc_feature (71): n=t or g
cattaggtatatcgcaaaaaagaactgacaatttcccaaaccagcatgattcactagcagtacttttgcantggaacttgcaacggaacacacgagaagca

SEQ ID NO: 11859 - DNA, 101 bp, rice(Oryza sativa)
  misc_feature (71): n=a or c
gatcggagcccattgtgacccaagcaacaaacttgggccaaacccatacataatataggaaaaagtacacngaaggtcccttaacttgtcatcgagttaca

SEQ ID NO: 11860 - DNA, 101 bp, rice(Oryza sativa)
  misc_feature (71): n=t or c
tggagcctgatcggatgctgccatttctgtctgctcgacttcttctctgagcttgaacgatggaaatgatngcattacttcctatcgatcgtctgtctgac

SEQ ID NO: 11861 - DNA, 101 bp, rice(Oryza sativa)
  misc_feature (71): n=t or c
gctccaattaggaaagttcactcaaactgaccaaaagccctcacaaaaacactccctttccgcccaaattngtccaaaaatttccaaaatccgattcaaaa

SEQ ID NO: 11862 - DNA, 101 bp, rice(Oryza sativa)
  misc_feature (71): n=t or g
ccctctagcaaagccaccattttatgacgtggaacatgccccaaaattgcagtgtgtacactaatttttcnatatgaacttggttgaaaatcgaaattgtt

SEQ ID NO: 11863 - DNA, 101 bp, rice(Oryza sativa)
  misc_feature (71): n=a or c
tgccattaccccgggagtttaggactgcagtagaattaatgcggggggaaaaaaagactttgacaatttanccatggagacaggcctagagctgcatgacc

SEQ ID NO: 11864 - DNA, 101 bp, rice(Oryza sativa)
  misc_feature (71): n=a or c
tattagactgttctcattactgtcacaatctgtttctgcatttcagaggtctgggatttttttttcgttcnaaaaaaaaagagtttttgggacgtggtaca

SEQ ID NO: 11865 - DNA, 101 bp, rice(Oryza sativa)
  misc_feature (71): n=a or g
aatactgcttctgacagccaaccttctgcatctgcaagccctatgtctctggcacataatcctggaattanttctaatcaaatgaggtaagtatgtttcgt

SEQ ID NO: 11866 - DNA, 101 bp, rice(Oryza sativa)
  misc_feature (71): n=t or c
tttcccaagttcgtccatccgtgaaccagatggagacttcggatgatgctgctcgacaagtcataaccaanactaggaatgagggacggatgggaccaacc

SEQ ID NO: 11867 - DNA, 101 bp, rice(Oryza sativa)
  misc_feature (71): n=a or g
cccgatgttgcaccactgctaccatagctcttctccttgaatctgatatcagacagcaatacagaatcaangggataatattcaaaatattggtattttgg

SEQ ID NO: 11868 - DNA, 101 bp, rice(Oryza sativa)
  misc_feature (71): n=a or g
gcgcataccttatcgaactgcggttgtttgacatgtcctagccaccacccctattgaacaatgggcgttcnatatgtccatttatatcccactccccaccc

SEQ ID NO: 11869 - DNA, 101 bp, rice(Oryza sativa)
  misc_feature (71): n=a or g
tcgttcgtagcatcttacattaagattcgtgtccctgtatatctaacttacagttacactcacttacaatncacttatgctcagctacaatgcatcaaact

SEQ ID NO: 11870 - DNA, 101 bp, rice(Oryza sativa)
  misc_feature (71): n=a or g
gttcaagaactataatcttatcagattttgacatgcctttgcttgacctactccagaaaaaagagtgtatnagataactatttaatttatgacaatgcaga

SEQ ID NO: 11871 - DNA, 101 bp, rice(Oryza sativa)
  misc_feature (71): n=a or g
ccaagagagctggaagccgcacacactgtcacacagtcaagagtgtcagaccattggacgttgtatagtanaaaaggcacatttcttttttctccgattag

SEQ ID NO: 11872 - DNA, 101 bp, rice(Oryza sativa)
  misc_feature (71): n=t or c
acagtcccatcaggaaaagttcttcgaagtaaaggcccattgtatgacatatccgggccgcaattgtggcncatccgtcgcaagtttcccgggcaaagcga

SEQ ID NO: 11873 - DNA, 101 bp, rice(Oryza sativa)
  misc_feature (71): n=t or c
agagatgtcaccatggacaacttcatctacatgtaacaaatggtgatcaccgatcaaagatttcagaaacntccatcacttgcaccccactccggcctcgg

SEQ ID NO: 11874 - DNA, 101 bp, rice(Oryza sativa)
  misc_feature (71): n=a or g
gttccgcaccctggcgcacagcttcgcctcctccatcttcttgaacagctccttggcccggtctctgatgntggccacgagctggaggcggtccgccatgt

SEQ ID NO: 11875 - DNA, 101 bp, rice(Oryza sativa)
  misc_feature (71): n=t or c
gtggcccaaatgaactttccaattaatttccacatctttttcaagtagcacgtacgtacgatattcgatgntactaattactccatccgtcccataatata

SEQ ID NO: 11876 - DNA, 101 bp, rice(Oryza sativa)
  misc_feature (71): n=a or g
tgaactacattagtgctgataccaatgtgcttggtaccatgcaataagttcatttgttctgcaggtatccnttgaaaattttgcggatgctgaggccttac

SEQ ID NO: 11877 - DNA, 101 bp, rice(Oryza sativa)
  misc_feature (71): n=a or g
tactcctaggacatggcaagttcagaacaagaaagaagcgtacactaggagctgactaaggtagtgtttgnatccagggacttaactttagtcattgtatt

SEQ ID NO: 11878 - DNA, 101 bp, rice(Oryza sativa)
  misc_feature (71): n=a or g
ttgtagtagtccctcctagctcgtgtatatatgcaggagaggcaacaactagatctccaagttggaaattnaagtcacacgagaggaatctgcagtggtat

SEQ ID NO: 11879 - DNA, 101 bp, rice(Oryza sativa)
  misc_feature (71): n=t or c
gctttggggccaggccaagtggagaaatcgttgccaaccctagacatggtcatctcgttcattagataaangttaaaacaacttttcttaatggagagcta

SEQ ID NO: 11880 - DNA, 101 bp, rice(Oryza sativa)
  misc_feature (71): n=t or g
tcttgtgctcttggccattgctactctgctctcgccggcagtgtccgcacggttcatctctctgcccaccnaccatcttccaatcactacgccgcccctcg

SEQ ID NO: 11881 - DNA, 101 bp, rice(Oryza sativa)
  misc_feature (71): n=a or g
atcttcgaattcgtcgtcgtacgtctagcttcttcttcgtatcaagagacgatcgatcgactaagttttanttgtgagacggaggatgcgtcttgggcggc

SEQ ID NO: 11882 - DNA, 101 bp, rice(Oryza sativa)
  misc_feature (71): n=t or c
gagcttattgccatgcatttagccatgcaagtaatccacttccttaatattcctgaaactaccttcctcanagataacctgataattgcagaagtgttcag

SEQ ID NO: 11883 - DNA, 101 bp, rice(Oryza sativa)
  misc_feature (71): n=a or g
ctgtgacatcaagcccgacaacatactgttggatgacaagaacaaccccaagatcaccgactttgggatcnccaagctacttggcgaccaatagatacaca

SEQ ID NO: 11884 - DNA, 101 bp, rice(Oryza sativa)
  misc_feature (71): n=t or c
ctcatcagccaaagaccgttgtccagtagtagggaagagtatcgcatgtttagaatttcccacaaccttcnctatgtcgctactatatgttgccttcaaga

SEQ ID NO: 11885 - DNA, 101 bp, rice(Oryza sativa)
  misc_feature (71): n=t or c
aatcagagcgctgcatttgcacaaaatgttggagtttctcaatttatgggtatgtttaatccccaacagcntaattatcccttctaccgtcatccaccgtt

SEQ ID NO: 11886 - DNA, 101 bp, rice(Oryza sativa)
  misc_feature (71): n=t or c
gcttagataattcatttgagtgcgtattacagagcggagagcgcattcacggggtgtgtgtagcaagtttnccaaaccaccgtacaaaaccgtacaaaatt

SEQ ID NO: 11887 - DNA, 101 bp, rice(Oryza sativa)
  misc_feature (71): n=t or c
atgggagaaggttctggctcacatgacatgacaacattgcctagcttataacacgggagaggggtatggcncacatgatgtgacaacatcacctagcatat

SEQ ID NO: 11888 - DNA, 101 bp, rice(Oryza sativa)
  misc_feature (71): n=t or c
gtttcatatatatgctgacttagtcaattggaccatatcaacgagccacatgttggcttttaatagttagnagccaacgatcaagatatgtggtattatga

SEQ ID NO: 11889 - DNA, 101 bp, rice(Oryza sativa)
  misc_feature (71): n=a or g
gttacagaaatgtctaatgcctgtttttgccatgtctcacagagtaaccaagaatctgctgatccccaatngtggccccagggacttggtggaaagaatga

SEQ ID NO: 11890 - DNA, 101 bp, rice(Oryza sativa)
  misc_feature (71): n=t or c
tgccacaggaaggaaagcttattattctgatgacatttgtggccttcttaaacttctcagaaacatcaggnagcacagtgcaagagcaaaagaggatgtat

SEQ ID NO: 11891 - DNA, 101 bp, rice(Oryza sativa)
  misc_feature (71): n=a or g
atacctagcttataattagctagagtgtgagcttataattagttagttagttgaaaacaagctaagatgangagcaaggcgtccatgttcttgaagcagat

SEQ ID NO: 11892 - DNA, 101 bp, rice(Oryza sativa)
  misc_feature (71): n=a or g
ttgaatgcaggcattttttcccattctccaggaattgggtaatgggaatcataaggctggtcactatttcntggtgtgccttaatctgaaagctgaaagat

SEQ ID NO: 11893 - DNA, 101 bp, rice(Oryza sativa)
  misc_feature (71): n=t or c
agctcgattacaaaatctgatccaatacttccaatgccctatgacccagattggccaaagaaaaaaaaatngaaatcgccagacctgcaccaaaggcatgg

SEQ ID NO: 11894 - DNA, 101 bp, rice(Oryza sativa)
  misc_feature (71): n=a or g
tccaccatcattcacaccaatccatagccatattttggtatcgaagctcgcttggcagctgtcacctctangataccgctgccgagagccttcgttgccac

SEQ ID NO: 11895 - DNA, 101 bp, rice(Oryza sativa)
  misc_feature (71): n=a or g
ccaccttgggatcaatcaggtactggtagctgtagaccacgacattggcgtacttgaccatctgcctcgcnaggaagtaggggcagatcccgcggtcgcgg

SEQ ID NO: 11896 - DNA, 101 bp, rice(Oryza sativa)
  misc_feature (71): n=a or g
atcgttcgacggccatggcgagaggctccaagaacaagaacaagaagcatgtcgaggaagacgcggagccngcccgatccgctccatggcttcccttctcc

SEQ ID NO: 11897 - DNA, 101 bp, rice(Oryza sativa)
  misc_feature (71): n=a or g
acactttgggatgtttctacggtcattctaagtggtttgatgcggattttcatttcatcttgcaaagactnggtgtgttcggcacccacttttttaaacct

SEQ ID NO: 11898 - DNA, 101 bp, rice(Oryza sativa)
  misc_feature (71): n=a or c
tcgtacgatttcatatgtcctaatgtattgctcgaagttcagtttgtactattggagaagtgattatcccntttagtaccggttataacaaccgcgactaa

SEQ ID NO: 11899 - DNA, 101 bp, rice(Oryza sativa)
  misc_feature (71): n=t or c
cgtagaatttattaatcataatggccggacgttttcggagggtattaagttgtaatcatttttgagcaagntgaagcgaaggtggacaacttgtgtgatga

SEQ ID NO: 11900 - DNA, 101 bp, rice(Oryza sativa)
  misc_feature (71): n=a or g
ttgggaaatgcgtgatttgcttgggcacaagccaatatgtgtgcatatcgttagggggtgatccacggcanacagacaggtggaggaggtgaatgactttt

SEQ ID NO: 11901 - DNA, 101 bp, rice(Oryza sativa)
  misc_feature (71): n=a or g
cgtgaggcggataggggatcggcggtttcaggatgagagctttgttgggttgtggggttttggactatttnccactctcccggtggcgtgttttcaaatgc

SEQ ID NO: 11902 - DNA, 101 bp, rice(Oryza sativa)
  misc_feature (71): n=a or g
tgacaagtgcgtgcaaagctgatcatcaaggtaaactcatccttaggtagcaatggagcaatatagtgagntaaaatatatgcgtagaaggaggccaagct

SEQ ID NO: 11903 - DNA, 101 bp, rice(Oryza sativa)
  misc_feature (71): n=t or c
agatgtaaccgtacttttgtgcttgagtttttttgttttgacttgctgtaggtctgggtctgccactgatngggacgagagcgacgggaggcgggcagcct

SEQ ID NO: 11904 - DNA, 101 bp, rice(Oryza sativa)
  misc_feature (71): n=t or c
gaggaggatagaggcggctggcgatcctggcagccatgttcactgccacacccgatgacaacaaagatgangatgcacatgtaccattgcagcgcccaccc

SEQ ID NO: 11905 - DNA, 101 bp, rice(Oryza sativa)
  misc_feature (71): n=t or c
cttttcccattaacatggttcactcatctggaagagcagccgatggaaacaattatcggaatccatagttnaagtcaactaaaatcattaacaaatacttg

SEQ ID NO: 11906 - DNA, 101 bp, rice(Oryza sativa)
  misc_feature (71): n=t or c
caaaattaggcaggagcatgttaaatcatcccatgtcaaccaagttcaccacattgactcgtaccatttcnttcccccattattcaatatgaaaaatgcca

SEQ ID NO: 11907 - DNA, 101 bp, rice(Oryza sativa)
  misc_feature (71): n=t or c
ggcgaggaggattcatcggcgacttcatcgttgacccaagcgaacttctccaagaacgggctgggcttgcnctccggtgggtacgcgtcgatgcagtcggc

SEQ ID NO: 11908 - DNA, 101 bp, rice(Oryza sativa)
  misc_feature (71): n=t or c
cgtcacatcaatggtgaatgctgaattttgcttatgcggacattcttccaaagaggatttcacggatattnatgtgtaaacaatgaaatactctctgtccc

SEQ ID NO: 11909 - DNA, 101 bp, rice(Oryza sativa)
  misc_feature (71): n=t or c
catgatgaggacgggcggtgacgcattccaacagcctttcccaggcttcaagaatggtttcatccctcgtntgctaaaagctggatattcttccacgaaga

SEQ ID NO: 11910 - DNA, 101 bp, rice(Oryza sativa)
  misc_feature (71): n=a or g
ataagaggggaggaaaaaaaattccaataagaggtgagtggttcagtaatctttcggtttggtgtgtttgncatcagaaacaggtttacaggcatttaatt

SEQ ID NO: 11911 - DNA, 101 bp, rice(Oryza sativa)
  misc_feature (71): n=a or g
atggcgatgcgcaagccatgtagaagagcttcatactcggcatcattgttggaagcagggaagtggagctngaggacgtagcgtagtttttctctcttggg

SEQ ID NO: 11912 - DNA, 101 bp, rice(Oryza sativa)
  misc_feature (71): n=t or c
tgcaggacaccatatacctcttgagaaaattaacaacaaatataactcaatgcttggattctttgaaaagnagaatgacatgattttaatggttttatcat

SEQ ID NO: 11913 - DNA, 101 bp, rice(Oryza sativa)
  misc_feature (71): n=t or g
ttttattttttataaaaacattccaccagtcactgactaccgggtgctagtgccttttttcagatttcccncttagaacttagttttgtttagcacatgtg

SEQ ID NO: 11914 - DNA, 101 bp, rice(Oryza sativa)
  misc_feature (71): n=t or c
gatattcttgtcacttccaccatgtatccaaaaagggaaagaaaacattcaaattaaaatttgctcaggtngtatacaggtagttataaaccgtaaatgac

SEQ ID NO: 11915 - DNA, 101 bp, rice(Oryza sativa)
  misc_feature (71): n=t or c
tctctcatgcgcctaccatcccacgattaatctcctcttaccacctcaactagccacctcgaaccctaatncggtggcattatcactatcttcgtcatcgg

SEQ ID NO: 11916 - DNA, 101 bp, rice(Oryza sativa)
  misc_feature (71): n=t or c
ttaatttcttcaggtatcagtgttgcaacatttcattggaatcgctccaaacattaatctatctatctatntattatattattaaaacagccttgaaagga

SEQ ID NO: 11917 - DNA, 101 bp, rice(Oryza sativa)
  misc_feature (71): n=t or c
aaaggcggtgttccctttacacgtattgggggtgtggttgttgcgcctagttgatggatggatgaatgganggatggcttctttggggcgctttgggcaaa

SEQ ID NO: 11918 - DNA, 101 bp, rice(Oryza sativa)
  misc_feature (71): n=t or g
ggatggatgattggcttgcagctcttctggaatgcgtggatgatccggttggcaatactctccagcttcgnggcacaactcctcctcgtcttcctcgccga

SEQ ID NO: 11919 - DNA, 101 bp, rice(Oryza sativa)
  misc_feature (71): n=t or g
tgtcaacctggaggaccattggactgggcaggtacaatatcatgcatcatttgaaaaatgtcaagcgatanatatatatatatctagagagagaaaactaa

SEQ ID NO: 11920 - DNA, 101 bp, rice(Oryza sativa)
  misc_feature (71): n=a or g
aagcatgcgaaagacatacatacagtacactacacttgatctacagttctttagtactccctccgtactcntaaagaaagtcgtttagaacaatgtttagg

SEQ ID NO: 11921 - DNA, 101 bp, rice(Oryza sativa)
  misc_feature (71): n=a or c
cccccggtacgagggagaagtagttgtcggagtagtggacagggaggattcttgtgtccttgtaaacatcntgactggatgatggctcagatgtgtgtacc

SEQ ID NO: 11922 - DNA, 101 bp, rice(Oryza sativa)
  misc_feature (71): n=t or c
aggcaaatgttgtgtcagttgccacagacagatcacctgcttcttaattatttctagaaccgttgtgagangatggcaaattagcaatgaacaatccaatt

SEQ ID NO: 11923 - DNA, 101 bp, rice(Oryza sativa)
  misc_feature (71): n=t or c
ggttctccccctttggcatcaaggcaccaaaagggaaaaagaggatcacacatcctcatcagaatcctcancctcctcacttgactcctcagcatagtcac

SEQ ID NO: 11924 - DNA, 101 bp, rice(Oryza sativa)
  misc_feature (71): n=a or g
ttaaaccgaatatttatgtgtgttagcaatagcatgatgaatggcaaacagaaggctttattaaaaagtcntaaggaaaaaccaggaaagaaaagaaaaat

SEQ ID NO: 11925 - DNA, 101 bp, rice(Oryza sativa)
  misc_feature (71): n=a or c
gatcatcatggctaatggaaagtatgtaccatcagcatgggcatctctgtggttaattttgtaatctgatntgtcgctgttagttttgtaatctgatctgt

SEQ ID NO: 11926 - DNA, 101 bp, rice(Oryza sativa)
  misc_feature (71): n=t or g
tcccttcctttgtccgtgtgcccgattgagtatgccttttaaatatccccgttcggctttctagtgtcctnttttagggagctaaagaaacgattgaaata

SEQ ID NO: 11927 - DNA, 101 bp, rice(Oryza sativa)
  misc_feature (71): n=a or c
ttgctcgcggtgagaagcgctcggttgaggctgtgaaggtcaccgatgagatgaaggcgttcaaggcctangctaattaagctccgtgttgagaggatgaa

SEQ ID NO: 11928 - DNA, 101 bp, rice(Oryza sativa)
  misc_feature (71): n=a or g
agtgatatgttcctgtgtttcaaaaatccgttcttcaggatcttcttcttcttgagtctcaacccaaacangaggaacattcaaatcattaatatgaaaca

SEQ ID NO: 11929 - DNA, 101 bp, rice(Oryza sativa)
  misc_feature (71): n=t or c
caccatgggcagcaagcattctcaggtagtatggcatcctcaaccacaacttcctcccaggcactatagcncagcccttcatagtgatcccaccgccatgg

SEQ ID NO: 11930 - DNA, 101 bp, rice(Oryza sativa)
  misc_feature (71): n=a or g
atttttttttataaaacttcatgtatgtccatactaattgctgcagcagcagaaggttcacagtgcacatntaatacaagccacacataataaggatcata

SEQ ID NO: 11931 - DNA, 101 bp, rice(Oryza sativa)
  misc_feature (71): n=a or g
tacaactgccagtctgttactgggagtacttaacaaaaccggtcggtgctctgctcccaaatccccaaaantccacatggagaacatacaaaatacaggta

SEQ ID NO: 11932 - DNA, 101 bp, rice(Oryza sativa)
  misc_feature (71): n=t or c
aaatgcgatagccaaagacgaaatgcggtttttggtgggtgtcagtcgcgtgcgtgctgaaacgaaggcangagggatttactaatagtaaggaattgctg

SEQ ID NO: 11933 - DNA, 101 bp, rice(Oryza sativa)
  misc_feature (71): n=t or c
aacctcaatgtactcctcatcattacaatctggatcaggataccaaaaagaaatcaactgcctagaacccnagtctattgactttgctaagtcagcactca

SEQ ID NO: 11934 - DNA, 101 bp, rice(Oryza sativa)
  misc_feature (71): n=t or c
ttctctctctctctctctccctcccctatcctctccagggcaatggccgatggggagaaggatgaggcggnggccgacgggagaggaattggtaggcagaa

SEQ ID NO: 11935 - DNA, 101 bp, rice(Oryza sativa)
  misc_feature (71): n=a or g
aaaataccatcgataaacattcaaatccaagaaatattatgggcgagtgcgagttccatatcaagcaagcnatttatccttgaaatatcatcaccattatc

SEQ ID NO: 11936 - DNA, 101 bp, rice(Oryza sativa)
  misc_feature (71): n=t or c
tccttgaccgcattgacagtgagagggcatgaatcagtaatccagaagtggcttagcccatgacccggacnctctgaaattttacaatacacaatgtagtt

SEQ ID NO: 11937 - DNA, 101 bp, rice(Oryza sativa)
  misc_feature (71): n=t or g
tgggccgtcagtttgttatacggaatatctgggccgtgcgtaatcaagtataggagatctcagctcgtttngaaaaaagtacaccaaaggtccctcaactt

SEQ ID NO: 11938 - DNA, 101 bp, rice(Oryza sativa)
  misc_feature (71): n=t or g
tcgagatgaaattgtggctaacaacagtcgaatttccgtgttggtctctttagcttagtaggagtagtagnagtagcttgttggtgccatggctggctaga

SEQ ID NO: 11939 - DNA, 101 bp, rice(Oryza sativa)
  misc_feature (71): n=a or g
tgcagcatcaaaagctatacaagagacccaagaagcactaggtgcaagtgcaaaggaaatagggattgcgnttagagaggcagtcgacagggtgaagaaag

SEQ ID NO: 11940 - DNA, 101 bp, rice(Oryza sativa)
  misc_feature (71): n=a or g
aagctccggcgtggcatggacaatggaggacctgctcacgatagccaccggcgacgagctttgttgtggcncgtggacagtggaggacctgctcaatgtga

SEQ ID NO: 11941 - DNA, 101 bp, rice(Oryza sativa)
  misc_feature (71): n=a or g
tgagaaaatatattcctaaaaactaaagaaagtttaaaaaagggggaaaaaaagaggccactttgtacccnaccaacttgctggggcatttgcacatgcag

SEQ ID NO: 11942 - DNA, 101 bp, rice(Oryza sativa)
  misc_feature (71): n=a or c
gtcgcctcttttactccgaagaacctttcgtcaattttcatacatggcggtgacacgtaagacacatgcancactattgcttgtattagttctctctctct

SEQ ID NO: 11943 - DNA, 101 bp, rice(Oryza sativa)
  misc_feature (71): n=a or g
tttatgtattgtggatctagggttttttgttttgatttttctttttgccaaattatttttgcgtgcggacngctcaagtgtccacctgtgaaaattggatt

SEQ ID NO: 11944 - DNA, 101 bp, rice(Oryza sativa)
  misc_feature (71): n=a or c
acctggggagcaatggagaagctatatgattctggtaaatctcgtgccattggtgtaagtaacttctcatnaaaaaaactgggtgacctgcttgctgtagc

SEQ ID NO: 11945 - DNA, 101 bp, rice(Oryza sativa)
  misc_feature (71): n=t or g
agaccacgaaagcgctgcatcattcgtctatttaggcgatcgttgtttttgtcagaggctttatagatganattaaaatcaccgatgatcagccattcaga

SEQ ID NO: 11946 - DNA, 101 bp, rice(Oryza sativa)
  misc_feature (71): n=a or g
tatgttggtgatggctacttgcttttttatggaacttggcaaagttaatcctcctgctggtggggtaattnaggggctttttatcccaaggcccaaagggg

SEQ ID NO: 11947 - DNA, 101 bp, rice(Oryza sativa)
  misc_feature (71): n=t or g
gaccctccatatgatttcgtctgatgatacagattatagtcaataaatcaagagctgtgtggcgtgctagngtggtaaaaattcctgttataattgaagac

SEQ ID NO: 11948 - DNA, 101 bp, rice(Oryza sativa)
  misc_feature (71): n=t or c
aaaaatacacatctataaaaaggacgaagattcattttatagcttaaaaagaaggcacgcagctgtagtanccatcactattcactgaaggtggacgacga

SEQ ID NO: 11949 - DNA, 101 bp, rice(Oryza sativa)
  misc_feature (71): n=t or c
accaatcgagttacgtacagtttactttgcttgatgatctcctaacgggggaagcaagccaaaggaaacgngcgttctgcttggatctagctgagctgtcg

SEQ ID NO: 11950 - DNA, 101 bp, rice(Oryza sativa)
  misc_feature (71): n=a or g
ccagtagtagcgatggctatgtcgagaatggctagttttgtgcatactttgatcctgttcgacacgcgtcnacgaggttcacagcataagtaaactactag

SEQ ID NO: 11951 - DNA, 101 bp, rice(Oryza sativa)
  misc_feature (71): n=t or g
cttttgtgtactactcaaggggaagctaactgacggtccttttttttcttgtgaaaagacaaaccctgacnatcttaagactgggatcattttttctttag

SEQ ID NO: 11952 - DNA, 101 bp, rice(Oryza sativa)
  misc_feature (71): n=a or g
ctcatagcaaaaacaacctacgacttaagctcgtcagggttaacagatgacccttttgctaagcccatatnggacaaccacggtcaagttaaatgcaagat

SEQ ID NO: 11953 - DNA, 101 bp, rice(Oryza sativa)
  misc_feature (71): n=t or c
ccattctctctcaaactcaaagctccctcctccaactatctcaccttccttctattctattctattccctntggcttagcttgtttttatcagttcttacc

SEQ ID NO: 11954 - DNA, 101 bp, rice(Oryza sativa)
  misc_feature (71): n=t or c
ctgtagcagttccatccaaatctgtttggcaactgcaacacttatgctatattttctttcacagctgcaangaaaacatgcaataatttgatctgttaggc

SEQ ID NO: 11955 - DNA, 101 bp, rice(Oryza sativa)
  misc_feature (71): n=t or c
cactccaatctctgatatgccacaacaataatatcatgtaaacctggcttctgaaggatagccagaaaccnagtttgtaggagccaataagtaatcaaaga

SEQ ID NO: 11956 - DNA, 101 bp, rice(Oryza sativa)
  misc_feature (71): n=t or g
atttcagatctgaagaagggaacactggactcttcatagaggaccaaagacgaagaataggaaggacacanaatgagactaactcgactacgagactaacc

SEQ ID NO: 11957 - DNA, 101 bp, rice(Oryza sativa)
  misc_feature (71): n=t or c
accacacccagttgtaagtgcacctgttgcaaatggcttgcagtgggtacccagatctcactcatctggcnctgaaatggacaatggtgaggattatgatt

SEQ ID NO: 11958 - DNA, 101 bp, rice(Oryza sativa)
  misc_feature (71): n=t or c
ggattatcgaagcagagaatgttggaatatctcttcagagttgtgactggcaaatcatctggtggtggcgntgtggagcatgtgcaagagaaggagcctac

SEQ ID NO: 11959 - DNA, 101 bp, rice(Oryza sativa)
  misc_feature (71): n=t or c
gagatcttccctctaccttttttttctggtataccttgtggttcacatcgtatacctcggacaattgcatntgatcatgcaaccataattcaagtttggtt

SEQ ID NO: 11960 - DNA, 101 bp, rice(Oryza sativa)
  misc_feature (71): n=a or g
ccagatcattgctgcttgaggacttttaatccccaattctgcaagaagagtttgtacccacataatttctnctgttgcatttgcaattgccttgtactcag

SEQ ID NO: 11961 - DNA, 101 bp, rice(Oryza sativa)
  misc_feature (71): n=t or c
ccggtgagtgggctgatgttgcccatcttcaccatggatctgccaaaatcccagaagaacttgtgggcatntgcgctgtaagtctccaccagctccttggt

SEQ ID NO: 11962 - DNA, 101 bp, rice(Oryza sativa)
  misc_feature (71): n=t or c
tcatccatcatatggcaaaaccaaaaaaactatatgtatgtttctaaccaataggtattaagatgtcttcntgtgtttcaatcaacgatttaatttagcac

SEQ ID NO: 11963 - DNA, 101 bp, rice(Oryza sativa)
  misc_feature (71): n=t or g
ccatgtgtgatctagaagtcgatgtgtgatgtactggtggctgttcatagtgaggcgaagaggatcaatgnctcgagtaaccatgtttcagaaacaggtat

SEQ ID NO: 11964 - DNA, 101 bp, rice(Oryza sativa)
  misc_feature (71): n=a or c
tcagccgtattttcaatttgctcatatgtaaaaaactcagaagacacgaactcttttgctcaacatgtaanaggtagaacatatgattttgttgaagaaca

SEQ ID NO: 11965 - DNA, 101 bp, rice(Oryza sativa)
  misc_feature (71): n=a or g
agcagtcggcgggaggtttatcagatgctgcatatgcttggccttgggatatttggttaaaaaccactcgnatggacgttttgatgtactttgacaatatg

SEQ ID NO: 11966 - DNA, 101 bp, rice(Oryza sativa)
  misc_feature (71): n=a or g
aaatataaagggccttcttcagcaacagtgaacacaacctccaaagcaggatcaaccaaagggacaaaagncactatctgcatattaccattagaatctga

SEQ ID NO: 11967 - DNA, 101 bp, rice(Oryza sativa)
  misc_feature (71): n=t or c
catcttatctcctcccaccaatttctctcctcttcagaaatcacgttcacacgacagtgccttcatcgctntgccgctccatctccctctccgccttctcc

SEQ ID NO: 11968 - DNA, 101 bp, rice(Oryza sativa)
  misc_feature (71): n=a or g
ttttttttctacaaatacaaaattgataaccaatcaactctgcaagttttttcaggagatgatcaagatgngttatttccccttgagaagtgagctggagc

SEQ ID NO: 11969 - DNA, 101 bp, rice(Oryza sativa)
  misc_feature (71): n=t or c
tggcagtcgcagaagcagaaagttgtggccttgtcgtcctgcgaggctgaatacatagcggcgacaacggnggcttgccaaggtgtgtggctggcgcgtct

SEQ ID NO: 11970 - DNA, 101 bp, rice(Oryza sativa)
  misc_feature (71): n=a or c
atggactgtgcggcccttcaatccttttctcccgactgtgttttatctagggtgaagccttcatgctttgncacatggccttcgacatgtggctttcaccc

SEQ ID NO: 11971 - DNA, 101 bp, rice(Oryza sativa)
  misc_feature (71): n=a or g
ctatcttcacatttgaacccaaagccgtcaggcttgtcaagaatctcaaatccattgtcatgcctgcaagnatcatagaccagcaacctcccatcttgagc

SEQ ID NO: 11972 - DNA, 101 bp, rice(Oryza sativa)
  misc_feature (71): n=a or g
tattataaacttttatatagaaatattttttatagaacatacagtttaacggttcgggaagcgtgctaacngaaaataaagatgttaccgcttagaaattt

SEQ ID NO: 11973 - DNA, 101 bp, rice(Oryza sativa)
  misc_feature (71): n=a or g
gagccagggtgggcttgctctgtaggttcaggccctaacccccaaggcaatattccaccaagaactgcaanttgtcagccgtgttgcgaaggcttcttctg

SEQ ID NO: 11974 - DNA, 101 bp, rice(Oryza sativa)
  misc_feature (71): n=t or c
tgcccacagccttgaacatctcttgcaaagccacaaactctggtgcctcactaatgtgcctccaagatatncatttatggtcggcaaaggctttggtggca

SEQ ID NO: 11975 - DNA, 101 bp, rice(Oryza sativa)
  misc_feature (71): n=a or c
ggcgatcctgtggagtgtggtttggtttgggaggagttcggttttttcagaatggagatggcctgtttgcnggtaaattgagtttgatctttccgtttctt

SEQ ID NO: 11976 - DNA, 101 bp, rice(Oryza sativa)
  misc_feature (71): n=a or g
gctacttgttatgatgttttccatgatgggttttacagtcaaactgtcggggaaatatatttcgtaccatnaatcattaactgaaaagaacatctattttc

SEQ ID NO: 11977 - DNA, 101 bp, rice(Oryza sativa)
  misc_feature (71): n=a or g
ggcgctcctcgacgacctggagatactagtgaagcgcctccgctccaagcagctgcggagaacatcctccntcgacacgatcaacggcagcggcggcgcgg

SEQ ID NO: 11978 - DNA, 101 bp, rice(Oryza sativa)
  misc_feature (71): n=t or c
aatttaattagcatgcatgccgcatgtgacacacgagattacacgtggtgtactcagaatgcattataccncatcggtgcatgcatatggttcaacttcac

SEQ ID NO: 11979 - DNA, 101 bp, rice(Oryza sativa)
  misc_feature (71): n=a or c
aaacgaggaagatttccccttggttcgttgttctgttctatccccttctactccaccgagcaccggacgcngctccgttcaattcacgcccagtcgaatca

SEQ ID NO: 11980 - DNA, 101 bp, rice(Oryza sativa)
  misc_feature (71): n=t or c
taaacttatgtgcaccatggttaggattggaaactataccaatagtagctcggcatcgggaatctatgagnttttcaacacccgatggtagctgcacaaga

SEQ ID NO: 11981 - DNA, 101 bp, rice(Oryza sativa)
  misc_feature (71): n=a or g
ctcgagactccatagcctctcttgatttttcgtttcctttcccagcgacgaaacttcctatcaaaaccgcngttttataccggttctagccgccaagaacc

SEQ ID NO: 11982 - DNA, 101 bp, rice(Oryza sativa)
  misc_feature (71): n=a or c
aggcgggcagggtggatgatctccgcaggaaagctcgagctcaccatagctgaattagttaaagcttgttntccagatattttcaccccctgctcatatat

SEQ ID NO: 11983 - DNA, 101 bp, rice(Oryza sativa)
  misc_feature (71): n=a or g
tcagctatgccccaggtttcattcgcatccaaagataaaatgtagtccgtttggctgacatggcaaatatntggctcatttgactaggtcttcatcctacg

SEQ ID NO: 11984 - DNA, 101 bp, rice(Oryza sativa)
  misc_feature (71): n=t or c
ttacaactgatgtgtaacgatgttccttccccatgtctcgcattgcccaccgttaattcttattcttctcnaattaacccgcttggacactgaatatatat

SEQ ID NO: 11985 - DNA, 101 bp, rice(Oryza sativa)
  misc_feature (71): n=t or c
cagcccatctcatatgttgcccaatgagctactacgaccttctcctacaagaagtgggtgaggtatgatcnaattgatattcttcaatggagacgacggat

SEQ ID NO: 11986 - DNA, 101 bp, rice(Oryza sativa)
  misc_feature (71): n=t or c
ggggccagatcacacggtggaagaaggggagcagcggtggaggccgcagcagcggagacgtttgatgacanggatccgagccggcggcagtgacggtggag

SEQ ID NO: 11987 - DNA, 101 bp, rice(Oryza sativa)
  misc_feature (71): n=a or c
atcaattattgatatagaagaaattactgagataacttgtggtgagaagcacttgaggctagaccaatggnttgctcttagtagctccctaccaaatgagc

SEQ ID NO: 11988 - DNA, 101 bp, rice(Oryza sativa)
  misc_feature (71): n=t or g
cctgatctaaacctgatctatacagtgcactccaatgtgtcgtgtcaataatttggtatggtatctctagnatgaccaccatgtataaattgtataccaat

SEQ ID NO: 11989 - DNA, 101 bp, rice(Oryza sativa)
  misc_feature (71): n=t or c
aggcctactagagcactgtcacaatggatataaaatctgtttgcaaaaccacagttttcaagaatcattanaacctcatcaagatcatcaactgcgccttt

SEQ ID NO: 11990 - DNA, 101 bp, rice(Oryza sativa)
  misc_feature (71): n=a or c
cccagaaggcccatcgccgctgcgctggcgtgcgagcgaccgccacacttcttttttctcgtttttttacnttttaaccttttttcccacttttttctgat

SEQ ID NO: 11991 - DNA, 101 bp, rice(Oryza sativa)
  misc_feature (71): n=a or c
aatttcttcttcgtcagtgtcttcatcatcattatcatccttccttctagatgcattggtacatttctttnttttcagcttcactagctctataagggata

SEQ ID NO: 11992 - DNA, 101 bp, rice(Oryza sativa)
  misc_feature (71): n=a or g
gcggtgaaagatgtgggtaatgtggccgcctcaaccagtgtggatgatgcggaaggcaagaaatcgaagangaaaaaaaagaagagtggaaggacagctca

SEQ ID NO: 11993 - DNA, 101 bp, rice(Oryza sativa)
  misc_feature (71): n=a or g
ctctctctcaaactcctgtcttatttcacttctctccgatctctttttcctcctgagtgaatggcagccgncgagggccgcgcacggtgggtggtagcaac

SEQ ID NO: 11994 - DNA, 101 bp, rice(Oryza sativa)
  misc_feature (71): n=t or c
cttgggcagggacaccccctacttgtgatgaaatggacaaaaaagctttttgcttctccaaccaaggtgantataggtgatggtcggaaagcgagcttttg

SEQ ID NO: 11995 - DNA, 101 bp, rice(Oryza sativa)
  misc_feature (71): n=t or c
tggaacatggcagcaaaattatccgtggagaaataagctggtatcagagccatggtttggttccttgatgnaatcactgttttgtgaaattttattttgct

SEQ ID NO: 11996 - DNA, 101 bp, rice(Oryza sativa)
  misc_feature (71): n=a or g
cagaacaaagtgaccctttcaaggaatgcaacacacccatcagacctcaactcttgcattctactccttgncaaatgcacgagtgtcattgcattaagaat

SEQ ID NO: 11997 - DNA, 101 bp, rice(Oryza sativa)
  misc_feature (71): n=t or g
aaacgttttcttttttgacaaaatatatataaacgtatttgcggcatcaaccgcagcatcattttctatgnctggctactgtggctacagcgctgcactat

SEQ ID NO: 11998 - DNA, 101 bp, rice(Oryza sativa)
  misc_feature (71): n=a or g
ttcgatcttaccattaccatgatggattatacatatattcacttggtttttactgaaagtaatactactgntagcacatcaagattattatttttctgtta

SEQ ID NO: 11999 - DNA, 101 bp, rice(Oryza sativa)
  misc_feature (71): n=a or c
ttttcactgagttcaagcagattaagtacagatatttcagggaaggaagttcgcctagaggtggaagatgntgccagtaactgcaattagagatatagaga

SEQ ID NO: 12000 - DNA, 101 bp, rice(Oryza sativa)
  misc_feature (71): n=t or c
tatatcatactcacctattgccacgattagctagggcatgacaatgtgatcaaattacttcaacattccangatgtgaaacctgatcgactatcactttga

SEQ ID NO: 12001 - DNA, 101 bp, rice(Oryza sativa)
  misc_feature (71): n=t or c
gagatgacaataagccgatcactgatggcagtgcctgtactagaccttggttctattccattgcgcaattngctgcaggtagagaaaaaggaatcaaagag

SEQ ID NO: 12002 - DNA, 101 bp, rice(Oryza sativa)
  misc_feature (71): n=t or c
ggatgtttcttgttggtgcgacgtccttgtggttgtctccttattggtaaggtgttcttgtggtgatgtcnttgttagatcgggttagctggtaatggcgg

SEQ ID NO: 12003 - DNA, 101 bp, rice(Oryza sativa)
  misc_feature (71): n=t or c
aatagtactcctactgaagtactgaaactattaattaaatctataataatctaagaactactccctccgtnccaaaaaaaacaaaccctggtttccgtgcc

SEQ ID NO: 12004 - DNA, 101 bp, rice(Oryza sativa)
  misc_feature (71): n=t or c
gctagacagacagcaacaagaaagcagagagacagaggtagagaggcttagagagctattgacgtgcaatncttgtgcgcgttcgcggcaatggatgtgga

SEQ ID NO: 12005 - DNA, 101 bp, rice(Oryza sativa)
  misc_feature (71): n=t or g
aaaccgatcaaaacttttattcatgaccaaactcacaacttcaactgagtccgtttcgaagactactctgnttgctgcaagtcttgcacccacccgcgtcg

SEQ ID NO: 12006 - DNA, 101 bp, rice(Oryza sativa)
  misc_feature (71): n=t or c
gagtctccatctccacagtgggcgtagctttacatgggacccaccaccaaacttttttttcacgtgggccncaccttcagagaaaaccgcgtctccccaac

SEQ ID NO: 12007 - DNA, 101 bp, rice(Oryza sativa)
  misc_feature (71): n=a or c
caaagcatcggaatatcgccatacacatcaacaagccaaaagaacatcagtgtcacagaagaaacaaaaancagtacgttttggcggctgcgagtgagatt

SEQ ID NO: 12008 - DNA, 101 bp, rice(Oryza sativa)
  misc_feature (71): n=a or g
caaagaacaaatagagatcaggagacacaccacacgtatcgattcaagcaagcaagaaataatttggggtnccttcaggaacatccgattaaaaaaaaagg

SEQ ID NO: 12009 - DNA, 101 bp, rice(Oryza sativa)
  misc_feature (71): n=t or c
agaggagaaaacatcgatctggcttccaccctactggcctgctcatgggcttaccatgttaactgaactgntgtttgggctgtgggtgcactatattgggc

SEQ ID NO: 12010 - DNA, 101 bp, rice(Oryza sativa)
  misc_feature (71): n=t or c
cgtcatttcgaaattcctctcccctctttcagcctgaaaattataaactaatgcttccagtgtcctacagncaattatataacttttatagtgtcaatcgg

SEQ ID NO: 12011 - DNA, 101 bp, rice(Oryza sativa)
  misc_feature (71): n=a or g
taaaaacaaatttaaaaaaaatacataggacccgtatatcattaaaaaaaatataaattgtaggacccacntgccatcctccctctgcttcccttcttcct

SEQ ID NO: 12012 - DNA, 101 bp, rice(Oryza sativa)
  misc_feature (71): n=t or c
gaaatattgtgctctacttgaaggtttcttgtttacgtattggtcctcatcaccaccagatccaggcgaanaggagagacgcaagggatgatgctagggca

SEQ ID NO: 12013 - DNA, 101 bp, rice(Oryza sativa)
  misc_feature (71): n=t or c
ccgacgaccgcctggccccgctcgacgccagaccggccaccacccctttcttgcgtcatcaggcatctcancccgacctcgcctccgcacgccacaagccg

SEQ ID NO: 12014 - DNA, 101 bp, rice(Oryza sativa)
  misc_feature (71): n=a or c
actgattgggtggtgaatatcacaaactcaattccttttttcaacgcatcggtatttctcaccgtgtgtcntgtccatatgcacatcaacaaaacgggtct

SEQ ID NO: 12015 - DNA, 101 bp, rice(Oryza sativa)
  misc_feature (71): n=t or c
cacatccgcatagaagaagtatgcaagttcgtgtaacagaaagctaattaatcttccattccaaaatcaanggataggatagcagaatagagtctgtgagc

SEQ ID NO: 12016 - DNA, 101 bp, rice(Oryza sativa)
  misc_feature (71): n=a or g
gcttcctcaaatacatcaagaaagtcttggagaactgcaaggagttctaaaggtgtatgagcccaaggctncacagtactctgcaaggtcttgcaatatag

SEQ ID NO: 12017 - DNA, 101 bp, rice(Oryza sativa)
  misc_feature (71): n=a or g
aaggcgcaatatgtggcttaccctgataagggaagtaatattccttcaccgattcatatcaatgtacagcntagactcccccattcacaaatgggaggtgc

SEQ ID NO: 12018 - DNA, 101 bp, rice(Oryza sativa)
  misc_feature (71): n=a or g
aaaaaatggtagaacatattgcacttttgtacaatgcatgcaaacaattgactgctgccgctttcacttcncgctccagaaaataattccttctaatcata

SEQ ID NO: 12019 - DNA, 101 bp, rice(Oryza sativa)
  misc_feature (71): n=t or c
gccattcagataaaagcagaagattctgacatcacttgtttgcattcattttgtagtagtataccagaacnggagtactccctatgacccaagatagtgta

SEQ ID NO: 12020 - DNA, 101 bp, rice(Oryza sativa)
  misc_feature (71): n=a or g
aagattgacagtgtgaggacatagatcatgaacacgtccagagcgtagtccatgttctgatttagcagctntctgttgcttaatcgttctgcgaaagcctg

SEQ ID NO: 12021 - DNA, 101 bp, rice(Oryza sativa)
  misc_feature (71): n=a or g
atcccgcttgttcgccgtctcaagctccgcgcgaagagacttgacttcgcccgtgagagttttgttctccncgttcgtcttctttagggcgttcgctacaa

SEQ ID NO: 12022 - DNA, 101 bp, rice(Oryza sativa)
  misc_feature (71): n=t or c
cttatattcacaggcatctgatccattgactgcttccattgaatatctctgcacaacagctggtctctctntctctctctctctctacataactgttagtt

SEQ ID NO: 12023 - DNA, 101 bp, rice(Oryza sativa)
  misc_feature (71): n=t or c
tgaaggttccagactggctactcctagccatagctatacccatttgtgtgtgcattatgacttttgccacnatgtatgcatttaaactatattttttaaaa

SEQ ID NO: 12024 - DNA, 101 bp, rice(Oryza sativa)
  misc_feature (71): n=t or c
atgaatttcgttagttcacttcacagaagggcattattacatcagactttacagaaagaatcgattcaacncttctcattagttattacagatcgatcgat

SEQ ID NO: 12025 - DNA, 101 bp, rice(Oryza sativa)
  misc_feature (71): n=a or g
gctattaccggagatgctctaaagaggtatttgtctttttatatgtgttagaaggcgtatttgcacaggtntaaatgagatgtgcatgcatggtggcgagt

SEQ ID NO: 12026 - DNA, 101 bp, rice(Oryza sativa)
  misc_feature (71): n=t or c
ataaaataccctaaatttctgcttttgcttttttaatttttttatttgtacttgcatatattgtttttagntgtgatcacagagctagatataatttccac

SEQ ID NO: 12027 - DNA, 101 bp, rice(Oryza sativa)
  misc_feature (71): n=t or c
gacaacagtgatcctcatccagaaccatatgatgctcctccatcagttatcagtactgaacagctaaatcntgctgctgaaccagttgtcggtgttgaagc

SEQ ID NO: 12028 - DNA, 101 bp, rice(Oryza sativa)
  misc_feature (71): n=t or c
attcattatgatacaaagatgataccaggagtaactgatgtattgctgccattattattgccagctaagtngagataataaacacataaaagcaagtttaa

SEQ ID NO: 12029 - DNA, 101 bp, rice(Oryza sativa)
  misc_feature (71): n=t or g
tgggctagaatttctcccaggaatcaaggaagtccggctccatggtgaattttatgccagaaacgagcaanccgcaccaagattgaaagaggacttgctgg

SEQ ID NO: 12030 - DNA, 101 bp, rice(Oryza sativa)
  misc_feature (71): n=t or g
aactgaaaggggtagatagaagcctgattgaacataacttggcaatcaagcaagagtacaagccaaaaaancaaaagttaagaagaatgtcaacagacagg

SEQ ID NO: 12031 - DNA, 101 bp, rice(Oryza sativa)
  misc_feature (71): n=a or g
tacgtttgtttctcaggttggttttagtaatctggtcaagcgagataaagaccagatgaggcacgtgtggntagctgaggcgacagagagctccacctata

SEQ ID NO: 12032 - DNA, 101 bp, rice(Oryza sativa)
  misc_feature (71): n=t or g
tcaatcagaatacttgaatcacatatttcaacacttgaattcaatgggaggagccatctttctttttcctngattttaccaatttaccatcaacaccattt

SEQ ID NO: 12033 - DNA, 101 bp, rice(Oryza sativa)
  misc_feature (71): n=t or c
cttcgatctctctcatataccttagcgaaaattaaacatgtcttgttttatttacaacactcacatcccantcacatcccattgtacatgtctaataaaaa

SEQ ID NO: 12034 - DNA, 101 bp, rice(Oryza sativa)
  misc_feature (71): n=a or g
agtttgatccaagatctgcctatatatatggtgtgtatatcatatcttgtgatatgggggatatgcaacangtgtgtgacaggggtaggtagatctcggat

SEQ ID NO: 12035 - DNA, 101 bp, rice(Oryza sativa)
  misc_feature (71): n=t or c
aatgcccacagtagcacaatcgatcaacacatatgctagatgttcaagccttgttaggcttccaatcccanctggcaccctcgcaaacccgtcgaagcata

SEQ ID NO: 12036 - DNA, 101 bp, rice(Oryza sativa)
  misc_feature (71): n=t or c
atttatcaaatcgaacgacccgaaatcatggaatccaacggctcagatcgttcaatggacccctcaacctngcctcccagcatgcatccccctaacctatc

SEQ ID NO: 12037 - DNA, 101 bp, rice(Oryza sativa)
  misc_feature (71): n=a or g
aacgtgcacgtgcatacgtgtacatgcggtattcagctgctagtgtcaaatactccctctgtttcataacntaagtcattttagcattgtatatatagatt

SEQ ID NO: 12038 - DNA, 101 bp, rice(Oryza sativa)
  misc_feature (71): n=a or g
ctcctcctcctcttttcagttttgtcatttctcttggttctttctttctgcgagcaaatttttactctggnaaaaaaattaatccggattgggttgtgttg

SEQ ID NO: 12039 - DNA, 101 bp, rice(Oryza sativa)
  misc_feature (71): n=a or g
tccccaatcttgacaaggttggagcttagtcgtctgagtgtaaatggcaagtttcttgatttctcgagctntccggcactgaaagagctgaagatgaccaa

SEQ ID NO: 12040 - DNA, 101 bp, rice(Oryza sativa)
  misc_feature (71): n=t or c
ggttttgctagctgtcttctatcagctgaaatttcagaaatcatctgtgaccttggaacaaggaaagaganaagcttcctaataatttgtggagaggatgc

SEQ ID NO: 12041 - DNA, 101 bp, rice(Oryza sativa)
  misc_feature (71): n=t or c
caccgccacatcaatcattgctattgaaaaagcctaactaccatggggaggtggcgatgctaatcaccacnattgttgtcgatttcgatggggatgatagg

SEQ ID NO: 12042 - DNA, 101 bp, rice(Oryza sativa)
  misc_feature (71): n=t or c
gtgccaccgaatcatgttgcacggcaaggtgatttggcacttctccagcttgttgtgtcattagggagctngtcgtgtcattagggagctcgtctccagag

SEQ ID NO: 12043 - DNA, 101 bp, rice(Oryza sativa)
  misc_feature (71): n=a or g
tactccatattctacgaagctttgcacgggagaggagaaaaaaatgtgcataattattttggacaaggcgngtacaatacaggctctcgtggctggccggc

SEQ ID NO: 12044 - DNA, 101 bp, rice(Oryza sativa)
  misc_feature (71): n=a or g
ttcgcagaagaaaagcttgtcatggaattcatagttaccatcaaggtagaggaacacgtagggaggcctanaaccagccagagactgatctgtattgtcac

SEQ ID NO: 12045 - DNA, 101 bp, rice(Oryza sativa)
  misc_feature (71): n=t or c
attggtatcccatgagaagctaggattagatcgtactgtatcctgtatccgtgcgtatcagagaagtatcnctaattatttcttttttctgaaaatcggga

SEQ ID NO: 12046 - DNA, 101 bp, rice(Oryza sativa)
  misc_feature (71): n=a or c
cacggccacattgttaaatatactttcacagtgcatatactgttgtgctgctcggtagtttgtactacttnctcagtcccataatatatcaacgtggtatt

SEQ ID NO: 12047 - DNA, 101 bp, rice(Oryza sativa)
  misc_feature (71): n=a or g
aataatttgcttcaaattaagccaagtttaaaggcgtatcataatattttggtctagcttgcaagtgtttnattgaatgtggcattttgactaactgtatt

SEQ ID NO: 12048 - DNA, 101 bp, rice(Oryza sativa)
  misc_feature (71): n=t or c
agctatattgagaccagtgaacctttaaacatatacaaggaggaggacaataaggacaagaaggaggaggnggaggaatcatcatcatcatcattgaagga

SEQ ID NO: 12049 - DNA, 101 bp, rice(Oryza sativa)
  misc_feature (71): n=t or g
cggtgatggtgctgctctaatctcaccaaccagtcgtatctccaccttgccaatacatggttctactatgnctgatacagggaaggaaaaaaatggatttg

SEQ ID NO: 12050 - DNA, 101 bp, rice(Oryza sativa)
  misc_feature (71): n=a or g
ctcgacgctggaagctgtctttgctggggtacctatgctcaccttaccattgttctttgatcaaccaattnatggccggctaattgtggaagagtggaaga

SEQ ID NO: 12051 - DNA, 101 bp, rice(Oryza sativa)
  misc_feature (71): n=a or g
aaagtttgcctccatatactccttgacctcagcggatgactcaatcttaggctggacctcgtagtatgcantcccatcatttgtcttgaaagttttgatgg

SEQ ID NO: 12052 - DNA, 101 bp, rice(Oryza sativa)
  misc_feature (71): n=t or c
gcaagtgcattgctgctacattaaatggacggtgtgatgggcagcggcagcaccagcccacggttgtcatnggcgcccgccgccgctgccacgtttgtgat

SEQ ID NO: 12053 - DNA, 101 bp, rice(Oryza sativa)
  misc_feature (71): n=t or c
gaagaaagacaagatataatgtacataaacatgaaccttgtcataggctggaaccatgctggcaatattanggacagtgaaggcctcaccaggttgtagac

SEQ ID NO: 12054 - DNA, 101 bp, rice(Oryza sativa)
  misc_feature (71): n=a or g
ctatatgcatcaagattgtcaatttcattcgagaggccattccaatttggctcttagaaaggaagttctcntaccaaccgatacagatgtaccgtttcagg

SEQ ID NO: 12055 - DNA, 101 bp, rice(Oryza sativa)
  misc_feature (71): n=t or c
aaacagaagaaacaaacagacacgtaaggaggagaaatttcccctcccttccctgctcttttcgtactacntgcaaggaggagaaagaagaacacgaggag

SEQ ID NO: 12056 - DNA, 101 bp, rice(Oryza sativa)
  misc_feature (71): n=t or c
ggcactaaacggagaaggcgacgcacaaaggaagaaatgaaaaatgctgctgcaaaatctgaaagtgcaanggcccatgaaggatcgcccaatcggaaagt

SEQ ID NO: 12057 - DNA, 101 bp, rice(Oryza sativa)
  misc_feature (71): n=a or g
cctttctcatcctcatcgcgcgcctccctcaaatccaacctgctaggatagtgacagcctgtttggcaagngaagggaggaggactaggagtttcaacgag

SEQ ID NO: 12058 - DNA, 101 bp, rice(Oryza sativa)
  misc_feature (71): n=a or c
accaaatcctcgagcgttctcagcaactccttcccaatcctcctcctcatcttcctcgcggcggcagcatncgttccccagatcgccatgtcggccgagca

SEQ ID NO: 12059 - DNA, 101 bp, rice(Oryza sativa)
  misc_feature (71): n=a or g
ttctggtgtatcataaccaaaactactctatgcttatctttttgttcagccctgaagaaatggagggtatnactggggtacagaaaacaatggcctcagga

SEQ ID NO: 12060 - DNA, 101 bp, rice(Oryza sativa)
  misc_feature (71): n=t or g
catttagtgtacctttccatagagagagatatagagaaaagacacttttcagtgggcctcacctgaaatanccccaattagcaccccttgggtgggatagt

SEQ ID NO: 12061 - DNA, 101 bp, rice(Oryza sativa)
  misc_feature (71): n=a or c
cctgttgcaacagaacggaggtggattggcagagtacgccgtggcggcagcgaacctgaccgtcaagaggncacccaacgtctcagcggccgagggcgccg

SEQ ID NO: 12062 - DNA, 101 bp, rice(Oryza sativa)
  misc_feature (71): n=a or g
aattaagctttttatgtttgaagttcagcacaaacatattcatctccctattcaggtatctatttacgcantatataagtagtaaatctagataacagggt

SEQ ID NO: 12063 - DNA, 101 bp, rice(Oryza sativa)
  misc_feature (71): n=t or c
cctaagaccaagaaacaattcgaaatccaaatccaaaacccaaattcgaatccactccaaattagtcttcnctgtaaaagtctattttgcctcctccgtgt

SEQ ID NO: 12064 - DNA, 101 bp, rice(Oryza sativa)
  misc_feature (71): n=a or g
ttgtttgactgtatcaatgttgttgtattttgtgatatagatgatcctgagccaggtaaggatatctcggnaaaagacttagagtcggacgaagccatatg

SEQ ID NO: 12065 - DNA, 101 bp, rice(Oryza sativa)
  misc_feature (71): n=a or g
agaccaaagagaaagactcgaacttacttgcagctatttcatctgaaaccaaccacgatgacaatcccatntcaaccctcccaacaagggaaggatggtcc

SEQ ID NO: 12066 - DNA, 101 bp, rice(Oryza sativa)
  misc_feature (71): n=t or g
ggctgttatatacccatcgatcctgatctaacggatacgatctaggtgactaggtgaggtgtttttttcanaaaagcgcccgcatactccatacaaatttg

SEQ ID NO: 12067 - DNA, 101 bp, rice(Oryza sativa)
  misc_feature (71): n=t or c
cccacgaggtaatatgggccaagcccatattctctatctctccctgccctgttcgtgcttctcttcctcangaccgttggcggcggtggtgtggagctgct

SEQ ID NO: 12068 - DNA, 101 bp, rice(Oryza sativa)
  misc_feature (71): n=a or g
ggtgggtttaggtttagatcggggaggatttgcgcgacggaatcgtgagctgctgtgacgcacgcgtctcntctcgtctcagcgagaggcggtgagagact

SEQ ID NO: 12069 - DNA, 101 bp, rice(Oryza sativa)
  misc_feature (71): n=a or g
ccaaaatcggctggtgaaaattttatcccgatctgagacgatagaatgagggatgccatgtgtcttgaaanctgttttgtcaactgcattggccacttggg

SEQ ID NO: 12070 - DNA, 101 bp, rice(Oryza sativa)
  misc_feature (71): n=t or c
ctcttttatttttcattgttttttcagaatgttaaagcatatctacgacgagggatcgcaagagaagctgntctgaatcaccaagaagctcttcaaggtgt

SEQ ID NO: 12071 - DNA, 101 bp, rice(Oryza sativa)
  misc_feature (71): n=a or g
agagaatcctcttccagtatcctctcttctggccgaagatctgaaatacgctactcctgtatatgtaacanaagaagtcagcaagagcgagctaatattcc

SEQ ID NO: 12072 - DNA, 101 bp, rice(Oryza sativa)
  misc_feature (71): n=a or g
acgtaataaagcccaaataaggcccgtatcaacctactgccagattcgaacgggaataagttcattctagntccctcaatttgtcgccgagtttgaaattc

SEQ ID NO: 12073 - DNA, 101 bp, rice(Oryza sativa)
  misc_feature (71): n=a or c
gcaaacgctgatcaaaaagtcatttcattaaaaaataaaacatctaaatgagatgatatacacaaccatcnctaccagaaactagattacttatgacggct

SEQ ID NO: 12074 - DNA, 101 bp, rice(Oryza sativa)
  misc_feature (71): n=a or g
acatgatgacctgacgacttgattacattgtttggtgtttcgtctaccaagttagatgttcggttcattcnaattgcaccagtcaatacaaacaaaatatt

SEQ ID NO: 12075 - DNA, 101 bp, rice(Oryza sativa)
  misc_feature (71): n=t or c
ttgcaaagcggcatcgcatcacgacgcgacggcttgattgaccggctccgcgtccgcgacagttcacagangcgactccgcgaacgccgaatacgccgccg

SEQ ID NO: 12076 - DNA, 101 bp, rice(Oryza sativa)
  misc_feature (71): n=t or c
aaaaatatgtttctgcagcctaccaagtaaggcaaatggacacggcgagcttgtgcactgtggagaagtgnagccccgtatgtccacgtcatcaccctcac

SEQ ID NO: 12077 - DNA, 101 bp, rice(Oryza sativa)
  misc_feature (71): n=t or c
tgaatggatgtcttcctcctctatgaaattcagttgttcccttagaagcaagaggttttgggatgtgcggngaaatatgatgtaaaatgacataaagtagt

SEQ ID NO: 12078 - DNA, 101 bp, rice(Oryza sativa)
  misc_feature (71): n=a or g
gcgggatccccgtgtttgggaggacccggacaagttcatacccgagaggttcaagggtttcaaagtcgatngaagtgggtggatgatgcccttcggtatgg

SEQ ID NO: 12079 - DNA, 101 bp, rice(Oryza sativa)
  misc_feature (71): n=a or g
ccttccttttaagaattttgacataaaaaacgtgtgatatattgtacctccttcttgagacccccacagcngcacgattttgtgatcacaagccgacatgt

SEQ ID NO: 12080 - DNA, 101 bp, rice(Oryza sativa)
  misc_feature (71): n=t or c
atcatttgactcaaccaatctcagttgatttgggtacaaactgaattaagctagagaatgggcagagacangccggccgccggcggcgatcctcaggtggc

SEQ ID NO: 12081 - DNA, 101 bp, rice(Oryza sativa)
  misc_feature (71): n=t or c
cggggatgtctgggtttagagcagatccggttccttgacgtgcaggtgcagtggtgtcacagtgaggctangctactcatatgtcgtccctgcagcactgg

SEQ ID NO: 12082 - DNA, 101 bp, rice(Oryza sativa)
  misc_feature (71): n=t or c
ctcatgctgttggagctgcgtactccttgaagatggacaagaaagatgcatgtgccatcacgtattttggngatggcggcacaagtgaggtagattgatga

SEQ ID NO: 12083 - DNA, 101 bp, rice(Oryza sativa)
  misc_feature (71): n=a or g
ttgcacgttcaaggaaataaatttgatagttactgcatgcgtacttctccttagggcagccacaatgtttntctataggctctctacaagagatccatgtc

SEQ ID NO: 12084 - DNA, 101 bp, rice(Oryza sativa)
  misc_feature (71): n=a or g
agcctcttttcctttctccaattcggtttggagctgcttgtttttggccttcgcctctttgagggtgttgncgagggcctccatctccaagctcttgcggc

SEQ ID NO: 12085 - DNA, 101 bp, rice(Oryza sativa)
  misc_feature (71): n=a or g
caaccaccatgtggcttctgatacacccagaaatagattccgcgtgaccgatatagcgacgacaattcacntacacatcaccatcacgtacacatcaccat

SEQ ID NO: 12086 - DNA, 101 bp, rice(Oryza sativa)
  misc_feature (71): n=t or g
taaatgttgggaagacatttgccatgcaattgctgaggctcatcaccttatttatataattggttggtcgntgtatcaccctgtcaagctggtaagggaat

SEQ ID NO: 12087 - DNA, 101 bp, rice(Oryza sativa)
  misc_feature (71): n=t or c
gatattattgagtattgtagattcgatcgttcttatcttttactcctgaattttttttaactaaccaacgncatatattatgagatgaagggtagtatcaa

SEQ ID NO: 12088 - DNA, 101 bp, rice(Oryza sativa)
  misc_feature (71): n=a or c
atctgaatgtacctaccttcttccatgcggtgtctactactagtaatagtaggacaccctgaagctgtaanaacggttcttgcattctccagtgctttgga

SEQ ID NO: 12089 - DNA, 101 bp, rice(Oryza sativa)
  misc_feature (71): n=t or c
tttttttttctgatttcggtttttttctttccgttttttgcggttttccattcgttttttttctttccagntttttctttttggtttttttagtatatacg

SEQ ID NO: 12090 - DNA, 101 bp, rice(Oryza sativa)
  misc_feature (71): n=a or g
aaaagataaatatgcaaacaagaaacaccactcatctctttctttcgatcaacggaatagccttgttcatntccagttcaggaaccaaccagtacaataag

SEQ ID NO: 12091 - DNA, 101 bp, rice(Oryza sativa)
  misc_feature (71): n=t or c
accgagtttctagcctgcgcaatttcctcgagctcatttatcctgccaattcaattccattttcagtccanaaaaaaaaaaggtctaataaattagcaata

SEQ ID NO: 12092 - DNA, 101 bp, rice(Oryza sativa)
  misc_feature (71): n=a or c
agaagaagatgcaagcaacaattaacagaacatctcctccattttgattagggtgttagcaatcttcagtnttaactcagatctttaatttatggtctacc

SEQ ID NO: 12093 - DNA, 101 bp, rice(Oryza sativa)
  misc_feature (71): n=a or c
atggtcgtgaaaaaggaggacggggtggtaggtcacattgctactaccgccgtccccaaatgttcatctcnaaatgttcatctcaaaatgtttatttctag

SEQ ID NO: 12094 - DNA, 101 bp, rice(Oryza sativa)
  misc_feature (71): n=a or g
actactgcacccccgtgatcaagcataattgaaggaaggagattgggagtaagaagctggatttcagactnaagacgagcaccagcattggaatgcaactg

SEQ ID NO: 12095 - DNA, 101 bp, rice(Oryza sativa)
  misc_feature (71): n=t or c
ttattaaccatgttaatttctccccatttctgcttcttcttcagttgatcgacttcagaagctaactctcnggcgcgataagaaagatgatccctccaccg

SEQ ID NO: 12096 - DNA, 101 bp, rice(Oryza sativa)
  misc_feature (71): n=t or g
attgtattcagatttgcatttaccctatgatagttccattatccagagcacttacgttttattactgactnacttgattttcaggtctttgaaggcacttc

SEQ ID NO: 12097 - DNA, 101 bp, rice(Oryza sativa)
  misc_feature (71): n=t or c
catatgacgttgcaatacgtttctattaccaccaacccaccattgcattatctgttaaattgccacggttnattcagttgcaaaataagtttttatttgca

SEQ ID NO: 12098 - DNA, 101 bp, rice(Oryza sativa)
  misc_feature (71): n=a or g
tgtgattgagtacatcagccctgctgtagtttttgtaagaagtgctcagtttctgctagaagcaagaaaanctcctgcatcctggagctaagcagtagcac

SEQ ID NO: 12099 - DNA, 101 bp, rice(Oryza sativa)
  misc_feature (71): n=a or g
gtttggtcctagggctttccctgtgcaagaggtgcacaagattgctgttttggatatgaggctagctaacncggatcgccatggcggcaacatactgattc

SEQ ID NO: 12100 - DNA, 101 bp, rice(Oryza sativa)
  misc_feature (71): n=t or c
aggaagagctcctggaggacgtgtgatccattacttcagaatacagaactaggggtttcattacgggtaanatgtattccgtaccagctaccctctatcca

SEQ ID NO: 12101 - DNA, 101 bp, rice(Oryza sativa)
  misc_feature (71): n=t or c
tcgagagagcgaacatgaccctctaaaaaccaccagcatgggggcgataaaaaagaaaaagaataacatanattgtctttgcttgagcttgaaagctgtca

SEQ ID NO: 12102 - DNA, 101 bp, rice(Oryza sativa)
  misc_feature (71): n=a or g
tggctgacccaaaacctttaaaatttgaggaaagcgaacaaatctgcatggttgctgacccaaaaccttcnaaatttgaggaacatgtccaaaaatccagt

SEQ ID NO: 12103 - DNA, 101 bp, rice(Oryza sativa)
  misc_feature (71): n=a or c
ttttatctcaactttaaactctcttaaataacatattatctcttatattcgtggcctgataaagcatattnttacttacaagttagtacaactaatatact

SEQ ID NO: 12104 - DNA, 101 bp, rice(Oryza sativa)
  misc_feature (71): n=a or g
cggcccatttttacgcagtattccagttccggcccactagaaaggtgtgtggcaatctcgttccgggcacntatgtaagagacagccgtcaccgccagcgc

SEQ ID NO: 12105 - DNA, 101 bp, rice(Oryza sativa)
  misc_feature (71): n=a or g
gaggcagtccctggagatgcgctcgtttaaggaggcggtagaatcctggataccggtagtggagaagaagntggacgtactccagtccgccatggatctgc

SEQ ID NO: 12106 - DNA, 101 bp, rice(Oryza sativa)
  misc_feature (71): n=a or g
gcttgcacacgaacgccatgtgggcgatgtcgttggtggagattccacgggctgctgctatcgtcgccatngcccgatcagggagctcactctagctggag

SEQ ID NO: 12107 - DNA, 101 bp, rice(Oryza sativa)
  misc_feature (71): n=t or c
tttacgctaagctgaatgatagtaccataaaaattgagaatcgctaggcttcgattgactagaactgtganaaattctagtcatatttaacctctagatag

SEQ ID NO: 12108 - DNA, 101 bp, rice(Oryza sativa)
  misc_feature (71): n=t or c
tatgatttaaggtttaggagatatggagcagatagatattcatacagcgagatagaatgacttcattcagngtcatttagtgtcgttcagtgtgattagtt

SEQ ID NO: 12109 - DNA, 101 bp, rice(Oryza sativa)
  misc_feature (71): n=t or c
gtatcagtggatccaacctaaaatacccatctggatttcgccgttaactcctctcggagtctcgggccctncgctcctcttcctcgcgagtcgctggacga

SEQ ID NO: 12110 - DNA, 101 bp, rice(Oryza sativa)
  misc_feature (71): n=a or c
actatccccacaagtggtgttcttgatagcatggggttcttccgtggaagtgataattcaactatcatgtnatttgacttagggtctgggattaagagaag

SEQ ID NO: 12111 - DNA, 101 bp, rice(Oryza sativa)
  misc_feature (71): n=t or g
gtcggagaaaatcccccctgtaatctctcacccacccctcgcaagaacgaaaacgaaaacaaaaaacctcnggtaaatcactacaataacagacttgggta

SEQ ID NO: 12112 - DNA, 101 bp, rice(Oryza sativa)
  misc_feature (71): n=a or g
tatgtagtgcttatggttgattagctaggtatagtaggcgaaattccgggcagtatgaataatacttttcnttttatcgttttgaagtgtcgaattttatt

SEQ ID NO: 12113 - DNA, 101 bp, rice(Oryza sativa)
  misc_feature (71): n=a or g
agtattcatactgaaactggtcatttaagggagccattaccaattatagggttgattctcttcaatgcggnttgccaaggtggtgcaggcgattcccagca

SEQ ID NO: 12114 - DNA, 101 bp, rice(Oryza sativa)
  misc_feature (71): n=t or c
tacaacaggtcaaagtggaacgtcaacgacgctaccctccaaaactactaagagagccaaattacaatggntttaatagttgggggtcgagatattcggta

SEQ ID NO: 12115 - DNA, 101 bp, rice(Oryza sativa)
  misc_feature (71): n=t or c
tgtctttggatctgtaaatttgttatgtgaattgtgactgtagatatagatgatttttggatgtggatgantttgtgatgtttatgtgaatgttgatgatt

SEQ ID NO: 12116 - DNA, 101 bp, rice(Oryza sativa)
  misc_feature (71): n=a or g
tgattggctcctcgtcgccgatatacatgacggcgagaaggttgaggagggactgcctggtgccctgcacnccggcgacggcttcgtagagcctctcgatg

SEQ ID NO: 12117 - DNA, 101 bp, rice(Oryza sativa)
  misc_feature (71): n=a or g
tattgggatggaccattgcaaatttgccatgcaatctagaaatcattgcatacacggtgggagatctatgngctgtttagatcgtagctaaaaaactttat

SEQ ID NO: 12118 - DNA, 101 bp, rice(Oryza sativa)
  misc_feature (71): n=a or g
accggctgcgagagcgccggggaagaagcgatagtggaagaagatgacgccatgaagaaaagaggaagaangctctgataccatgtaaagatgggtttaac

SEQ ID NO: 12119 - DNA, 101 bp, rice(Oryza sativa)
  misc_feature (71): n=a or c
gggtgaggagcgcaagcagcaagagcgaagaggagaaccttttcttggcttgagggcgagcgagagcgagngagagagagagagagagagagagagagaga

SEQ ID NO: 12120 - DNA, 101 bp, rice(Oryza sativa)
  misc_feature (71): n=a or g
acttagaaatgaacagactctagaagatgaaaaagccagtagtatagagtcggccattatgaaagagaganaacgccaagcgactgcagaggaggactcgt

SEQ ID NO: 12121 - DNA, 101 bp, rice(Oryza sativa)
  misc_feature (71): n=t or c
gtggctgctgcaaacatggctcaaccttgttgtcatgaaggttgtgaatcggccacttctgatagatgcanaattcccgaggctggagccgatcacaggtg

SEQ ID NO: 12122 - DNA, 101 bp, rice(Oryza sativa)
  misc_feature (71): n=t or c
cctgacactatagcaaccagagccgtggtgtccaaattcaccatctccctcgatcccatattcatcttccncacaaagacactaaactcgccgcccaaact

SEQ ID NO: 12123 - DNA, 101 bp, rice(Oryza sativa)
  misc_feature (71): n=t or c
ttgctacaacaagttaagaaacgtgtaaaggaaggaaaaactagagatttcactttggagtcctcgagagntgagcgattccatgggcatttatgtgtccc

SEQ ID NO: 12124 - DNA, 101 bp, rice(Oryza sativa)
  misc_feature (71): n=t or c
gatggcgtccgacgaggcttctggttgcaaagaatctgaccccacacgtcagagtaacaacaagtagcaanccgagttcatgggccacttgggccgctcta

SEQ ID NO: 12125 - DNA, 101 bp, rice(Oryza sativa)
  misc_feature (71): n=t or c
ccctcccaacagaagggagtagaaatcaacgtcgaaagcggacgtgccgatgacgacgtgctatgccgggnagcgtcccagcgaggcgacgcggtcgccat

SEQ ID NO: 12126 - DNA, 101 bp, rice(Oryza sativa)
  misc_feature (71): n=t or c
catgttctaaaagaaaacaagtcgtatgacctattgaagagaaactaagaagattcagaaggatgctgtantatctagttctacatcactgttacaaagtt

SEQ ID NO: 12127 - DNA, 101 bp, rice(Oryza sativa)
  misc_feature (71): n=t or c
gtgccgactggctccaatcaaagaaagatactacacgacctttgagtatgatgggaagactgaccccaacnaaaaggatcccgactccctcgaattcaaaa

SEQ ID NO: 12128 - DNA, 101 bp, rice(Oryza sativa)
  misc_feature (71): n=t or c
agcgccagcaccggcgcacgagccaatgatgctatgcacggtgtatgcgtcgggcacaagctcgttgtccngctgcatctcctggaagaggtcgagcgctc

SEQ ID NO: 12129 - DNA, 101 bp, rice(Oryza sativa)
  misc_feature (71): n=a or g
agttgtacatggaccggaccgataaaaaaaccgtgccggcccatgagcaaggaaacgtatagcaatgtgtnaatctccacggtgatataaacaaaattgtt

SEQ ID NO: 12130 - DNA, 101 bp, rice(Oryza sativa)
  misc_feature (71): n=a or c
attttttttttcacaatgacctctgtgctgtgcttctcaacaccaactttgaaccctgtaaacagcagtanattatgtagcagtatcaggtaactctgaaa

SEQ ID NO: 12131 - DNA, 101 bp, rice(Oryza sativa)
  misc_feature (71): n=a or c
aagaacctgacgattggatgcaaaccattgatttggtgcatgcctccgtaactcccttctcctcttttgcntccacttctcttttaacatctttttcatta

SEQ ID NO: 12132 - DNA, 101 bp, rice(Oryza sativa)
  misc_feature (71): n=t or c
gaacaattctccatcccaagtatgtgttctgaaagcttttcatcccattgcacaaaaagtcaggattctgntgtgaggatgagacccgatgacacccttgt

SEQ ID NO: 12133 - DNA, 101 bp, rice(Oryza sativa)
  misc_feature (71): n=t or c
ggtgcatcaattcattcagggtaattctaaatttactacgggactaggcgactaactatacatttgtcgtnaaattttaacttaaaattttttatagatat

SEQ ID NO: 12134 - DNA, 101 bp, rice(Oryza sativa)
  misc_feature (71): n=t or c
ccgaacatggagggcgaaccctcgtgccgcctctctttgttggaccggtgcggtgatgggagcgagaatcnggtggttccaccgcgagtcccctccatcct

SEQ ID NO: 12135 - DNA, 101 bp, rice(Oryza sativa)
  misc_feature (71): n=a or g
ttgctccaccgcttggtcttgctcgagaagatatggaggtggaacttcatccagtcgtcgtcatggaatcnccattcggggtcgacgaccagacagtggtc

SEQ ID NO: 12136 - DNA, 101 bp, rice(Oryza sativa)
  misc_feature (71): n=t or c
agtctctgggaaaattctgacaaatcttgcttcatgagtatgacctggaagtccagctccgacactcaaanggctatcggaacttatggttcagattattc

SEQ ID NO: 12137 - DNA, 101 bp, rice(Oryza sativa)
  misc_feature (71): n=a or g
cctctatcggcacattatcaggatggatgtcagtcaaggtgttttcataatcactatgaggatcatccctnaagtcaagagtgcatctcggagctcgaatt

SEQ ID NO: 12138 - DNA, 101 bp, rice(Oryza sativa)
  misc_feature (71): n=a or g
atggtgaagatcagaggccatacttaattctccacccaaacctctttcaattcaccgttattgtcttttgnaaaaagtccaaatacccttctaaactttcg

SEQ ID NO: 12139 - DNA, 101 bp, rice(Oryza sativa)
  misc_feature (71): n=a or g
ctcattttctgcatttcgtctgcgacttggagtcgttttcttctgcccatgacaatattaatggacacgcnaggtctccgctcggagtgtgtgagactcat

SEQ ID NO: 12140 - DNA, 101 bp, rice(Oryza sativa)
  misc_feature (71): n=t or c
catatattcgttaccagactgtcactgtttcatgtcatttaattggagccttcgagggtagtcgagtcagncacttgcctcctaaggaaatttacggtact

SEQ ID NO: 12141 - DNA, 101 bp, rice(Oryza sativa)
  misc_feature (71): n=t or c
cccgcatgtagagttgtgcgacagcttacggagactctgcgcctaatatcctcgtctttcttcagcttttncttgcctctacaggctacagctcttccctc

SEQ ID NO: 12142 - DNA, 101 bp, rice(Oryza sativa)
  misc_feature (71): n=t or g
tagcttaatgaaaagcatctgctgcatctttgtgccatcattaggctttaggccataatcttggctagctntccatgcaaatctaggtgtttggggttgca

SEQ ID NO: 12143 - DNA, 101 bp, rice(Oryza sativa)
  misc_feature (71): n=t or c
cactgatgtaaaccatacacctgcacacagcaaacaacacacgatctaacgactaccgatactactcttcngggaaggattgggtttaggtaagccctaga

SEQ ID NO: 12144 - DNA, 101 bp, rice(Oryza sativa)
  misc_feature (71): n=t or c
aaatatatagtgaaaacctgaaaataatcgttgaatttagaaatagtaaaagtttttactcttgattacgnggataaatttcaaacgtccatttttatatt

SEQ ID NO: 12145 - DNA, 101 bp, rice(Oryza sativa)
  misc_feature (71): n=a or g
attctttaggcccacacagattactataaaaaaaaagaatattgggttgtactccagctccacatagttantgggaagcaaccaagtcagctccatggctg

SEQ ID NO: 12146 - DNA, 101 bp, rice(Oryza sativa)
  misc_feature (71): n=t or c
tagggcgttacacattcgtgtggcccaaacctatataatcccctacgttaataactctctgattgggtccnggactcgaactggcccggctgaatctccaa

SEQ ID NO: 12147 - DNA, 101 bp, rice(Oryza sativa)
  misc_feature (71): n=t or g
agtggctgtgtcactttgtacatcctctctagaaacatgatgctgatagaggtccaagttcccggacctgnagtctacatatggagtagttcgaggaatgg

SEQ ID NO: 12148 - DNA, 101 bp, rice(Oryza sativa)
  misc_feature (71): n=t or c
tcgtgcatgatagatccaaacaagctagacatcgccattactttataaactttgcggtctcattacacggnatgtatacagtattagtagtacaagtggta

SEQ ID NO: 12149 - DNA, 101 bp, rice(Oryza sativa)
  misc_feature (71): n=a or g
tttctcttcatcctcaacctcaccaacaccggcctcgctggctcggtgccgaacgaaataggaaggctgcntcgcctcgagctccttgatcttggccacaa

SEQ ID NO: 12150 - DNA, 101 bp, rice(Oryza sativa)
  misc_feature (71): n=t or c
cccgatcttgatccagagccagaagttgaagccgagcttgaagccgaacttgagctagagctactagtacngccaataccaactccagctccaagcccaat

SEQ ID NO: 12151 - DNA, 101 bp, rice(Oryza sativa)
  misc_feature (71): n=t or c
cgttcaaatgcttgcgagttgttcgcctcttgttctgcttctacctatcaccggcgagacgtagccgggangacgatgctggcagccgtggacgccgtggc

SEQ ID NO: 12152 - DNA, 101 bp, rice(Oryza sativa)
  misc_feature (71): n=t or c
caaggaccccgtcaagttcgaggagtacaagctcaaggagatcaagaacggtatgcaatgcacccaacttntctttttttttttaataacgataacggttg

SEQ ID NO: 12153 - DNA, 101 bp, rice(Oryza sativa)
  misc_feature (71): n=t or g
ggagatggtcaaggattctacaatgaagacacgaggggatgccagcgcaacagagacacatacatcaccanaaaccacatccgccgttctagggacgacac

SEQ ID NO: 12154 - DNA, 101 bp, rice(Oryza sativa)
  misc_feature (71): n=a or g
taaaaacggtggatgcaacagcaagccagatcctttaaacttgacctctgtaatctcatcaatcctcctcnccatctccggcgtcaggtgattcctccaat

SEQ ID NO: 12155 - DNA, 101 bp, rice(Oryza sativa)
  misc_feature (71): n=a or g
attttggtgagcttggtgatcttctccattacctggtgaagttctcctcacaaaaagaagaggctttttancttatgagcttcattcactactagtagtat

SEQ ID NO: 12156 - DNA, 101 bp, rice(Oryza sativa)
  misc_feature (71): n=a or g
gtggtagtccatgtacaggaaggaattatcacagggagcatcaatattcagttattgctcctctccatganctgaagtcagagacaatgggactgttcact

SEQ ID NO: 12157 - DNA, 101 bp, rice(Oryza sativa)
  misc_feature (71): n=a or g
agccaactcctccgatccgacactcaatgcaactcgatcgatctccgaatccgattcatagtacaacagcnagtttggaggacgagggaaagcgggtggtc

SEQ ID NO: 12158 - DNA, 101 bp, rice(Oryza sativa)
  misc_feature (71): n=a or c
tagccttcactgtttcttgctgttttggtgttttcaatggcaggcgatgatgatgagaggacttcccaggnttttgcaaaggagatgacggaggccattac

SEQ ID NO: 12159 - DNA, 101 bp, rice(Oryza sativa)
  misc_feature (71): n=a or g
atgaaacggaaggagtatatcgtagaaaagtcaagaaatgtaaatagtaaggatcataccatgacacggancgtaaggctggcttgtgcaaacgagctgct

SEQ ID NO: 12160 - DNA, 101 bp, rice(Oryza sativa)
  misc_feature (71): n=t or c
agtagttggtgatgacagattaacccctcatcaccatcactgctctttttaaactagcatagaaatcatgnatgcaagctttttctttttttaaaaaaaaa

SEQ ID NO: 12161 - DNA, 101 bp, rice(Oryza sativa)
  misc_feature (71): n=a or g
atttattaaaaaactctcctatttttttcaaaagacgttcagtggctcgggaaacgtgtgtgtgaagatcnagaaatctttcctctctattttattgtttc

SEQ ID NO: 12162 - DNA, 101 bp, rice(Oryza sativa)
  misc_feature (71): n=a or g
ggagctacctgtcctgcagctgatcttgcagctgatgggcacgatccatttttcctgatggcccaatcaancaccgttgggaccatgttcttcccattccg

SEQ ID NO: 12163 - DNA, 101 bp, rice(Oryza sativa)
  misc_feature (71): n=t or c
aaaaggtcatggagccgtcgggcactaaccaccatctcctccgtcatgtctagatccgcagtatccatccnatctggcaattgccagttgaaatggtatag

SEQ ID NO: 12164 - DNA, 101 bp, rice(Oryza sativa)
  misc_feature (71): n=t or c
aacgcaatagatggtgatggcgacctcgatgatgacagcagtcgcagccgaaagagggcatcgacggcgangatggaggtgaggcggtcggcaccaaagag

SEQ ID NO: 12165 - DNA, 101 bp, rice(Oryza sativa)
  misc_feature (71): n=a or g
attcatgtgtttgactgttggacacggcatcttctgcagcttgtaactaaaatctcctcttgaattgtttncctgcaaatgtttttcttttacacgagtgt

SEQ ID NO: 12166 - DNA, 101 bp, rice(Oryza sativa)
  misc_feature (71): n=t or c
ttgcctatccttagtgaatctagcacaaaccctttcacacaaatcactccatgttaccccaatcaactggntgcgaactgactgtaaccagaatgctgcat

SEQ ID NO: 12167 - DNA, 101 bp, rice(Oryza sativa)
  misc_feature (71): n=a or g
agaactgggcagaggattaaatcatcaaacagaaatggaaggtggcgagacgaacaccgtggaatccagcngttcgcttcgctaaaaaactacgttagatt

SEQ ID NO: 12168 - DNA, 101 bp, rice(Oryza sativa)
  misc_feature (71): n=t or c
agaaaggggtttgtaactagtacccccaggcaagaaccagctcatgcattgcaacactacaatggaaatanatgggattgcattgtcatcacgggtcagct

SEQ ID NO: 12169 - DNA, 101 bp, rice(Oryza sativa)
  misc_feature (71): n=t or c
ttttcagtgaaacatccaaaggcacatattatttgtgttttgattttgatatctgtgagctgtagaagagngtggagattatgggtaccccatacccacac

SEQ ID NO: 12170 - DNA, 101 bp, rice(Oryza sativa)
  misc_feature (71): n=a or g
ttggtgacagaggtaagttgacatgtatcaactgctgaatcgactaataccatgcttatgatatgaaagcncctatttagttttttgtactcgtgccatta

SEQ ID NO: 12171 - DNA, 101 bp, rice(Oryza sativa)
  misc_feature (71): n=t or c
ttcattttgatgttcatcatcaggaggaacaaagacaagaacaggagtgaaaattatggtagcctcgtggntttcaggtacaaagatttgcgttctgcaac

SEQ ID NO: 12172 - DNA, 101 bp, rice(Oryza sativa)
  misc_feature (71): n=t or c
ctttggttttctgtacgttttacttgcatcaattgcacctccagggacttctcatcatctgaaaaacactnggacttgtggtaacaaaactcataaattga

SEQ ID NO: 12173 - DNA, 101 bp, rice(Oryza sativa)
  misc_feature (71): n=t or c
ccattgaggagaatctttgaagaggaggcaagcaaatttgagacccaattgtgccatcttgtttcgaagcnaaaacgttgtaggacttccagcaggaaaga

SEQ ID NO: 12174 - DNA, 101 bp, rice(Oryza sativa)
  misc_feature (71): n=t or g
attttaattgcttgctggtggagcatgcggaccttgattagtttgtctagataacctaccctagtaacatntcttctgtcagttctgtggatgtggtgata

SEQ ID NO: 12175 - DNA, 101 bp, rice(Oryza sativa)
  misc_feature (71): n=t or c
aagtttttgggacaaagtgagtaagataataagcgtctaaagaattaattatccagggctcattttttgcnacttttcttgagaccggcgcctccaagtgc

SEQ ID NO: 12176 - DNA, 101 bp, rice(Oryza sativa)
  misc_feature (71): n=t or g
gatcaagggcttatgtgtttccggaatggtggatggtggtcttcgattattttatgacatgctggcaagtngtcatgctgatccagatgtcatcagttata

SEQ ID NO: 12177 - DNA, 101 bp, rice(Oryza sativa)
  misc_feature (71): n=t or g
ttctatacataaagccataaggtgatgatgggataaacccccaattcactcaaaaaagttcaactaaaaanacattttaaaatcacatagattttagcaca

SEQ ID NO: 12178 - DNA, 101 bp, rice(Oryza sativa)
  misc_feature (71): n=t or g
ctagcattggatgtggcatatcccagtaatacgaatttaaacataggtatatccatattcctagtacaagnatatgccacgtccgttactatgttggtttt

SEQ ID NO: 12179 - DNA, 101 bp, rice(Oryza sativa)
  misc_feature (71): n=a or c
gcaggccaatggttattgctcgctggaggagatgttaggagcggcgagtgctgtggtgcatgacccgccantggtggagaaaacatctttcgtcggtcggc

SEQ ID NO: 12180 - DNA, 101 bp, rice(Oryza sativa)
  misc_feature (71): n=a or g
gatatattttgactaatttctcgatcgttcacgatgattataatatatctctgcacacggggagagagctngctgttgggaattaattaatgcacaaagat

SEQ ID NO: 12181 - DNA, 101 bp, rice(Oryza sativa)
  misc_feature (71): n=t or g
agaagtacaatgctatcgttgtgttatcacatgggaaccgtacacgccaagtctgattgttgggctgtctnccctatgcaaatttggatctgcagtttggc

SEQ ID NO: 12182 - DNA, 101 bp, rice(Oryza sativa)
  misc_feature (71): n=t or c
cccgataagcgcacacgggtgattgattggttcgttaggatggctgctgccgacgctgcctgaataagagnacctgcaatgataaagtaggtgttatctat

SEQ ID NO: 12183 - DNA, 101 bp, rice(Oryza sativa)
  misc_feature (71): n=t or c
caaggggaagaaagttacttggagctcggtctagaaagaagaggtgacgattagcgaagcaggaccattgntgtccggtggttgcagtggagcttgatcaa

SEQ ID NO: 12184 - DNA, 101 bp, rice(Oryza sativa)
  misc_feature (71): n=a or g
atttaagaattatttgttcttctctttattggtatcagtgtcttctaccgattgcaatccttgaatttctntggctttatccgagtctgattggccagaat

SEQ ID NO: 12185 - DNA, 101 bp, rice(Oryza sativa)
  misc_feature (71): n=t or c
aaatcctttatttttaaatgttatagtgtaaatcttaaatacaaccctcgagatcttctgcccacccatanaagctcatacatgcttatatgaagaaatat

SEQ ID NO: 12186 - DNA, 101 bp, rice(Oryza sativa)
  misc_feature (71): n=a or g
ttttgtttggttacattattcataccaatgaggacaatgtaaatgctaatttgaatccttctggtctaatnccatttacagtattcggatagcatttcttc

SEQ ID NO: 12187 - DNA, 101 bp, rice(Oryza sativa)
  misc_feature (71): n=t or c
tattgttgtttgagcctcctcgattctactaactgagctgacttagcttgatgcattgatcactgtagcangtaccatcctcctgatgctttccaagctca

SEQ ID NO: 12188 - DNA, 101 bp, rice(Oryza sativa)
  misc_feature (71): n=a or g
attagataatttggtggatgactgtggttcaatccgggccagatttgtagagattcaagccctagttccanatgatctggcgaataccatctctccagctg

SEQ ID NO: 12189 - DNA, 101 bp, rice(Oryza sativa)
  misc_feature (71): n=a or c
cgccctcgtgggcatcatcgagagacaggatcgccgcaaagctccgcgcggcgaggtcaccactaccaccncagccacaatcggaagcgtcgtcggacgcc

SEQ ID NO: 12190 - DNA, 101 bp, rice(Oryza sativa)
  misc_feature (71): n=t or c
aatatatattataatttgaaatagaggacaagctagtactctaccggcacttatcggttggcctaatatanagtactccctccgtttcatattacaagact

SEQ ID NO: 12191 - DNA, 101 bp, rice(Oryza sativa)
  misc_feature (71): n=t or c
gagattctgatcaaggcggtaatccaagctattccggtgtacgtcatgggaatttttaaactcccagaatntgtgtgtgatgaacttacaagaatcacaag

SEQ ID NO: 12192 - DNA, 101 bp, rice(Oryza sativa)
  misc_feature (71): n=t or g
tgcctgtggctgtgtagttagctcgccttggagtttcgaatataggccttcccaggatgaggagggggagngggaggcctggaggccggcccccctccgaa

SEQ ID NO: 12193 - DNA, 101 bp, rice(Oryza sativa)
  misc_feature (71): n=a or c
atttacttcaagatttgtgcaagtgaggaaggaaaaagtcatagggtgcgcacatgtgagaggattcgttntcacgatctccgttttcacgaaaataggat

SEQ ID NO: 12194 - DNA, 101 bp, rice(Oryza sativa)
  misc_feature (71): n=a or g
ccaattgggtcatcacagccgatcggcccatagtatgtgaatgtggattgatgaaccctgagttcctctcnacactcaaggctgttgttggcccgatcttt

SEQ ID NO: 12195 - DNA, 101 bp, rice(Oryza sativa)
  misc_feature (71): n=a or g
tcgcctccgtccggtcgtcgttcccccaagacgaagtgctggccatcatcatcgtcgtcaagtccgcagcnccaagcccgtcgtcctccgcctcttcatca

SEQ ID NO: 12196 - DNA, 101 bp, rice(Oryza sativa)
  misc_feature (71): n=a or g
catgcactttttgaacttctcatctcttagcaacgcacacccaaatagtgtgctctccatatggtggttcncacccacaaacattgcaagtggcatttcat

SEQ ID NO: 12197 - DNA, 101 bp, rice(Oryza sativa)
  misc_feature (71): n=a or c
acgtttcacgtggaaagagtccaatttgacccccttagctgtaggttgaatctgatttatatgcccatacntatctaaaaatcaggtattcgacccattca

SEQ ID NO: 12198 - DNA, 101 bp, rice(Oryza sativa)
  misc_feature (71): n=a or g
caacaatgacccaaataacatccttgccttcagatttaggtaaaccctccacgaaatccatagtaatgtgngaccaagccaaatctgggagaggaagaggt

SEQ ID NO: 12199 - DNA, 101 bp, rice(Oryza sativa)
  misc_feature (71): n=t or c
tgcgcgtctgcgccttttgcccgcatctcttgccgtaaactccatcggctttgggagaacattgggtcatngagcgttttgagaagaagaacacaagattg

SEQ ID NO: 12200 - DNA, 101 bp, rice(Oryza sativa)
  misc_feature (71): n=a or g
ttatttgttaaaccctacttgagtcctaggctatgataatttctagctctaccactggttatactcttagntactctgtcggtgatatgggaccgggagta

SEQ ID NO: 12201 - DNA, 101 bp, rice(Oryza sativa)
  misc_feature (71): n=t or c
taagtatctacctcaatttgtgagggcctactcctcaatgatatattctctggcaatctattactcagaanaggccagaacgtcttcaattcatcacgtac

SEQ ID NO: 12202 - DNA, 101 bp, rice(Oryza sativa)
  misc_feature (71): n=t or c
atcgcccgaggtcgatctgaagccacctctctcgatccgcgcaaccaatgtcatttcaccgccagcaactnggcagccaggggagggggatgtgaggggac

SEQ ID NO: 12203 - DNA, 101 bp, rice(Oryza sativa)
  misc_feature (71): n=t or c
ctccggaagcgccacccgcgagaacgtgctgtaactgtaagtgtaacaactatgaacaagcatgcggtcgncgtcgtcgtccatccgccagtagaagccgc

SEQ ID NO: 12204 - DNA, 101 bp, rice(Oryza sativa)
  misc_feature (71): n=a or g
acaggatcgctcatcaagtagatgtagaggtacctcgttgtccatggaagcacggcctccttctcgtgcangtgaacacgcaggttactgttatccacaaa

SEQ ID NO: 12205 - DNA, 101 bp, rice(Oryza sativa)
  misc_feature (71): n=t or c
tatgcaaagagttcttctaacatgtagacaaagttatcccatcggttgcttgctagctagatcgtggaacntttggtggatatattttcacaccttcgaga

SEQ ID NO: 12206 - DNA, 101 bp, rice(Oryza sativa)
  misc_feature (71): n=a or g
gatctcatttttcaatgaatgttggtcctaacacaatttgcagtagatgcgcacattccctctttcgaggntgaatcatcttgtctcatggtaattcactc

SEQ ID NO: 12207 - DNA, 101 bp, rice(Oryza sativa)
  misc_feature (71): n=a or g
caacccagaggttactgaactccgttcgagtcacattcagcaactgcagcatcaggccaccccaccagccngacatcagcaacccggcattttggatggac

SEQ ID NO: 12208 - DNA, 101 bp, rice(Oryza sativa)
  misc_feature (71): n=t or c
agctctgaagggatggtaccagttagatgattcacagggagatcaagctttctcaggtaggtgaggttgcntatggaaggatcaatggtgccagaaagatc

SEQ ID NO: 12209 - DNA, 101 bp, rice(Oryza sativa)
  misc_feature (71): n=a or g
gccgaggaggacctgctcgatgtcctcctgcggatccagagccaagacaagacgaatcccgccctcaccancgacaacatcaagaccgtgatcatcgtaag

SEQ ID NO: 12210 - DNA, 101 bp, rice(Oryza sativa)
  misc_feature (71): n=t or c
tcactatagatccaagacatttcagcttaagtatagaacaacttcatttagtgaggtatccactatggtcnattcaggcatcacagaagcatcagatgccg

SEQ ID NO: 12211 - DNA, 101 bp, rice(Oryza sativa)
  misc_feature (71): n=t or c
ccatccatggggtccaaaacacaaacataatcatcagacttctctatgcatctccaaccattttcctcgcnaaaactgaataatacccagtaaagaaaaca

SEQ ID NO: 12212 - DNA, 101 bp, rice(Oryza sativa)
  misc_feature (71): n=a or g
ttggactactcccgacttgtactaatacttccctacaagcctacacagagtcctacaccatcagaggaggnctgaataataatttagcagcaatcagtaca

SEQ ID NO: 12213 - DNA, 101 bp, rice(Oryza sativa)
  misc_feature (71): n=t or c
atatccactgaaccccggctcttcctccatgccggttggttccagtgatcacatcgcgtctcgctgtaatncttgttgcaaagaagcccattgaacgcgac

SEQ ID NO: 12214 - DNA, 101 bp, rice(Oryza sativa)
  misc_feature (71): n=a or c
ctcactatctcgcacgcaccgctgtgtctgaacgagcgatacagtcgcgcgatcgcgccacacccgtgtcngtgtgccaatcgtgcgccaccgctgacgca

SEQ ID NO: 12215 - DNA, 101 bp, rice(Oryza sativa)
  misc_feature (71): n=a or g
tgtcaacaacaatgacctacaactacaacagacgggtctattgcttggaaccaataattctcttagctagngacttcctatgagccacacgtgatttgcgc

SEQ ID NO: 12216 - DNA, 101 bp, rice(Oryza sativa)
  misc_feature (71): n=t or g
attttacctttatgattatctaaattagctggcttttgggcatgggatccacctttaatgcctgtttctgncaggggagtactaacagccggttgcacgga

SEQ ID NO: 12217 - DNA, 101 bp, rice(Oryza sativa)
  misc_feature (71): n=t or c
acaaattattggcgatccaaagagacacagcatgtatgcacataagttagtactagatcgatcaacgtagnccctccatcctacaataactaaaataactt

SEQ ID NO: 12218 - DNA, 101 bp, rice(Oryza sativa)
  misc_feature (71): n=t or g
catattttcggtttatctgctgtttttagctgtactacaatggatcaggagcagtagtacgtacttcagtnaatcagaagctcattaggaagaatgatgtg

SEQ ID NO: 12219 - DNA, 101 bp, rice(Oryza sativa)
  misc_feature (71): n=a or g
agtcccggttggaaaagaccatttcaccaccagtgatgggagccaggagcttttatctccctgcaaacgtntgagagggcgctaccaccgtctaggcttcg

SEQ ID NO: 12220 - DNA, 101 bp, rice(Oryza sativa)
  misc_feature (71): n=t or c
tcttgctgaccatatcaaccatttaagggctgttttccaaattttggttaaacatggtctgaaagttaaanagagcaaatgctcttttgctcaacagaaac

SEQ ID NO: 12221 - DNA, 101 bp, rice(Oryza sativa)
  misc_feature (71): n=a or g
aagaccacagctaatctcctcctcatcagagcctctagtgaatggactcaactccaaactgcaacccgagnagacattgtcattctgagcatgaatattca

SEQ ID NO: 12222 - DNA, 101 bp, rice(Oryza sativa)
  misc_feature (71): n=a or g
gttactgatcgatcgacgtgatgggcgacctgtgaatctgtgatgcctttgctacggaggagaggggatgngcagctcagttccataaatgcaacggcgac

SEQ ID NO: 12223 - DNA, 101 bp, rice(Oryza sativa)
  misc_feature (71): n=a or g
aaagagagagataagggagaaagagggaggcataaaggttggaaagagaatgacatgtggacccccacaantcagtggattctattataatttttgtgtgt

SEQ ID NO: 12224 - DNA, 101 bp, rice(Oryza sativa)
  misc_feature (71): n=t or g
catcaaagctgcatagcaagaagaagaagcgcgttgcaccaagcttaaacgaagagtatgagaaaaaacgngcagaggatgagaaggcaaagaaggagcgg

SEQ ID NO: 12225 - DNA, 101 bp, rice(Oryza sativa)
  misc_feature (71): n=t or c
tcgaagaaactatctcttattacacatggtttacaagtaaagcgtacctcagcttcttcctgggacatgcnctccttccattcatggtcaagcagtccata

SEQ ID NO: 12226 - DNA, 101 bp, rice(Oryza sativa)
  misc_feature (71): n=t or g
tagtgctccgcagaatgaccgagctcggctgcatacctcctgagatgaaacaacaattaacctttcttcanaagcatttttgccaacttctttaacctgaa

SEQ ID NO: 12227 - DNA, 101 bp, rice(Oryza sativa)
  misc_feature (71): n=a or c
gagaatccacttccgaaccaccatggtcagcctcatcatcggtctcgcagcaagagttcccaaatgaactngagcattccgtggtgtccccgtcttcctcg

SEQ ID NO: 12228 - DNA, 101 bp, rice(Oryza sativa)
  misc_feature (71): n=a or c
gtcatgataagaattatattcaacttgtcggactggaggagtttttctttaggatttattgaaatagcccntaaacatttaattatataagacaaaacacc

SEQ ID NO: 12229 - DNA, 101 bp, rice(Oryza sativa)
  misc_feature (71): n=a or c
ttgtgctttttctccacatcaaagcatgtctgaccctccagacattgacagaatcattgctggtctttgcnctagcacatcctctgttcatgagaagcctc

SEQ ID NO: 12230 - DNA, 101 bp, rice(Oryza sativa)
  misc_feature (71): n=t or c
gagtgaggttgggttagggcaatccttatttacagtgagaatccttcgtgaactactaaatgctatatttnataaaaaaaatacaataaaaggttttaaat

SEQ ID NO: 12231 - DNA, 101 bp, rice(Oryza sativa)
  misc_feature (71): n=t or c
ctggctaacgagtcaccgcacttgttcatgtcagtacccctaaccctccactctaaatgaataatgcatangtgagtcatggagatccccactagtatttc

SEQ ID NO: 12232 - DNA, 101 bp, rice(Oryza sativa)
  misc_feature (71): n=a or g
tatatatatatatatatatacacacacgtacgtatacgtacttccatatattgctactcgcgaaaaaaagnaacaaaatacataattatgattgaaaaaaa

SEQ ID NO: 12233 - DNA, 101 bp, rice(Oryza sativa)
  misc_feature (71): n=a or g
aaccatccggtctaggggccttattatgttctatcccaaacacagctacccggacatcttcttctgaaaangtgtcataaggaactcatttttcaacttcg

SEQ ID NO: 12234 - DNA, 101 bp, rice(Oryza sativa)
  misc_feature (71): n=a or g
aaatcctgaccatgttgcttttttaggagttcatcatgtgatgagtgattttaagaaagcccaagcggtcnagcttcgcatgagtggccttaggccctttc

SEQ ID NO: 12235 - DNA, 101 bp, rice(Oryza sativa)
  misc_feature (71): n=a or c
agcatgctatttgggttttcttttcaagaggcaagggctggaagcattggagaacaaacaagattagttcnacttcagttctttgcggatgcagtttttca

SEQ ID NO: 12236 - DNA, 101 bp, rice(Oryza sativa)
  misc_feature (71): n=a or c
gaagatttagcaaaactatcgatatcctacgatatttggatagtgataacttgctagttcttgtgggaatnaagcaatccatggtatgaaaattttgcttg

SEQ ID NO: 12237 - DNA, 101 bp, rice(Oryza sativa)
  misc_feature (71): n=a or g
actcccttattcagtacaattgatatatcgtgctttaatgcggaatatgtatacattgagtggtatcatangaatgggatctacgctaaaaagattgtgga

SEQ ID NO: 12238 - DNA, 101 bp, rice(Oryza sativa)
  misc_feature (71): n=a or g
atgattgctgatgaggtaaccatgggagaaattgtcatcttcaaacatcgccttagagagttacatgcacnaaggcgaccaagagcgataacaaggttcac

SEQ ID NO: 12239 - DNA, 101 bp, rice(Oryza sativa)
  misc_feature (71): n=t or g
aacgcggacaaacaaatctcttcaaccaccaaaagactccacggccaggtctgaaagtagacggccaaganaagggaggatcatcaaggaggggaggaggc

SEQ ID NO: 12240 - DNA, 101 bp, rice(Oryza sativa)
  misc_feature (71): n=a or g
cgtgcaaaccgctactgctaattaaactatgctgtcagtataattgatccgtaaattaattagtacccacntgacaagtgcgtgcgggacgtggtagcatg

SEQ ID NO: 12241 - DNA, 101 bp, rice(Oryza sativa)
  misc_feature (71): n=a or c
agatatactagcctccacttcttgagttcgtttgtggtggttatcaacctacatttactcgttttccgtangcacacttcctaaactactaaacggtatgt

SEQ ID NO: 12242 - DNA, 101 bp, rice(Oryza sativa)
  misc_feature (71): n=a or g
aacatggatttccacagatgaccggttggatagagccgaaggcagttcaaggttggtgtctccgaaaacanccatatcaagatatactgcagcatagaaaa

SEQ ID NO: 12243 - DNA, 101 bp, rice(Oryza sativa)
  misc_feature (71): n=t or c
tattgtaagctcgtttcaacatcgtacgtcgtccggcaaagaaatggaagagaaagagtgttggaaatatnatgctaacttgcgtgattctccacaatatg

SEQ ID NO: 12244 - DNA, 101 bp, rice(Oryza sativa)
  misc_feature (71): n=a or g
tagcggtgggcaatgagaaggaacaccttatatattggtccgctcaatctctccacccctggctcaatctnttcgtccctcctccctttgctccgctcgcc

SEQ ID NO: 12245 - DNA, 101 bp, rice(Oryza sativa)
  misc_feature (71): n=a or g
aggagatacgaatttataacgcaagaagctagtatacccgcgggtttgttcttaataatgcttaaaaaaangaaaaaatacgaattaccccttaaactatc

SEQ ID NO: 12246 - DNA, 101 bp, rice(Oryza sativa)
  misc_feature (71): n=t or g
ctgcttttgctgctgttgcgttgcgtgatacgctcgcctaactttggctaattctgctgatatttgctctncttctgtcatatcaccttgccgctgcttct

SEQ ID NO: 12247 - DNA, 101 bp, rice(Oryza sativa)
  misc_feature (71): n=t or c
tcctgctagcacgccacctcccccgatgcattgcacaaagtgtctcaatggacatactctgtttgggcggnggcgactgctaccacagggaagaggcgccc

SEQ ID NO: 12248 - DNA, 101 bp, rice(Oryza sativa)
  misc_feature (71): n=t or c
tacttatttgtgaaggacccctgtagcagtgaggttgtaagactgtgcttgtatcagcccctgtttgtttnagcttatgattattataatctagattatta

SEQ ID NO: 12249 - DNA, 101 bp, rice(Oryza sativa)
  misc_feature (71): n=a or c
agattctgactcaatatgcccatcccaagagcttggaagatgggtacttatgttctaacggacaagagtanatataggatgctattaaagtatggaaaaag

SEQ ID NO: 12250 - DNA, 101 bp, rice(Oryza sativa)
  misc_feature (71): n=a or g
attttataagtacatattattaaaatctgtgtgagaatctgaaactatttgtcggagctagagatttattntgaaagagcttctggtttttaagttcgctt

SEQ ID NO: 12251 - DNA, 101 bp, rice(Oryza sativa)
  misc_feature (71): n=t or c
ccatcttgtaaagtagcttcgacttgagaatcctttgaacccatggcaccacctaatcaacttcaggagcnaacctatatccaccataagttcagaaaata

SEQ ID NO: 12252 - DNA, 101 bp, rice(Oryza sativa)
  misc_feature (71): n=a or g
tctcaagaaaagatgattcggctattgaatgagcacatccagaatcttcagcaacaattgctgcaatgccntgtcaataataggacggccaattcttctgg

SEQ ID NO: 12253 - DNA, 101 bp, rice(Oryza sativa)
  misc_feature (71): n=a or g
caaccatacattgacataatttctcctctatattgatataattgcagtgggaagtatgttcggatgctcantgtaactgcagtcagccaaagggttgggag

SEQ ID NO: 12254 - DNA, 101 bp, rice(Oryza sativa)
  misc_feature (71): n=a or g
acatgtatttaactctttatttatatctgggtatactatctccttccaaaataaactaacataatattagnatgtgatatattatagtactaggacactag

SEQ ID NO: 12255 - DNA, 101 bp, rice(Oryza sativa)
  misc_feature (71): n=a or g
atttcataatcatatatatcagcaataaaggtacctgaaatggaaagtcggggtcgaaatccaatgtcccntggtccctttttatgcgagaatatgatttt

SEQ ID NO: 12256 - DNA, 101 bp, rice(Oryza sativa)
  misc_feature (71): n=t or c
tcgccgctttcatgcaagctccaactctgccaccgcagccatcacctttgtgcaagctccgctacctctancgatgcctttagtgccctctccaaggcgag

SEQ ID NO: 12257 - DNA, 101 bp, rice(Oryza sativa)
  misc_feature (71): n=a or g
tgttaactgggtgtcatagatgacaaagatgacagatcaatacatggagtaaagttgttatccacattagnggcctaccatgtataaaaatcattattttt

SEQ ID NO: 12258 - DNA, 101 bp, rice(Oryza sativa)
  misc_feature (71): n=t or c
atcgagtacctcacccttggagtggatgaccagcctctcttccatggaagaactgccatccaggttttagntgataagcaagccccaccaccacctgcaca

SEQ ID NO: 12259 - DNA, 101 bp, rice(Oryza sativa)
  misc_feature (71): n=a or g
caaagcacagtttttctttctagctgccatctttagcctcttctgtggtgtttacgattatgtgctaaggnacttaactaatgccttactgttggaaagct

SEQ ID NO: 12260 - DNA, 101 bp, rice(Oryza sativa)
  misc_feature (71): n=a or g
atagcatgatactcccctgccgactggctgtaggagaggaaacaatgatacttactcctatgaatccatanccatcacaagtacagaaacagccataagtg

SEQ ID NO: 12261 - DNA, 101 bp, rice(Oryza sativa)
  misc_feature (71): n=t or c
attaaaataatatctcagaaacattagaaatctggacattctgaaagtacttcaaatgatgcagaaagagnagacaaaaagaacctacaatatagcataag

SEQ ID NO: 12262 - DNA, 101 bp, rice(Oryza sativa)
  misc_feature (71): n=t or c
ttatcgcgtagatttcggttgttccgatgcaccgctgttctgcgaagtcgttgcggaggtcccaacaacangagagcaaggcaagtcatgcattacaattg

SEQ ID NO: 12263 - DNA, 101 bp, rice(Oryza sativa)
  misc_feature (71): n=a or g
gtttctcctgtccttcccgcgtaagggatctccttctgcgcacgggaaaggaaaaaaaaatagaatttctnttggtagtttaatagaagggcccactttta

SEQ ID NO: 12264 - DNA, 101 bp, rice(Oryza sativa)
  misc_feature (71): n=t or c
ctggatgctcaaaactgcagatttgatagtgttcccaaggacattgtcaagctcgtgaaattgaggaaggntagactgaggagtgatcttaacaaccagct

SEQ ID NO: 12265 - DNA, 101 bp, rice(Oryza sativa)
  misc_feature (71): n=t or c
ttttcaagattctcgcaaggagctcaatcatatcttcggagggcctgaagcctacgactccaaggggaagnagaagctgaccgatagggagattaatgccg

SEQ ID NO: 12266 - DNA, 101 bp, rice(Oryza sativa)
  misc_feature (71): n=a or g
ctggctgaccggtggccacacgttcgttgcctcctcttctattctcccttccttagttcctctcctcaacntttctcttctccttctgttgttgttgctgt

SEQ ID NO: 12267 - DNA, 101 bp, rice(Oryza sativa)
  misc_feature (71): n=a or g
aagatacttgttagcctagcatcatgtgtatctgtagccttccctatttttgacaatctcctatttcttcntagcacgtgtctccttcctatgttccgtcc

SEQ ID NO: 12268 - DNA, 101 bp, rice(Oryza sativa)
  misc_feature (71): n=a or g
ccaaccagtactgtcccatgaaagatcacttatcttgttacttcattacagattcgtctatggtgtcttcnccaatcctaagatatatcggcccagtcttt

SEQ ID NO: 12269 - DNA, 101 bp, rice(Oryza sativa)
  misc_feature (71): n=a or g
gacacccaaatattttcttttcgcgaactaaacaggaccaaagcaaggagaaaaacaatttggaaaaaaangaagagtacgataccctacgtactttgatt

SEQ ID NO: 12270 - DNA, 101 bp, rice(Oryza sativa)
  misc_feature (71): n=t or c
ccaatgatgaaaaatagtcctgtccatcatcaaaatatgaagctatttggtcaaagcccattaaaaacgcnatctggtcaaagcattcatagttgtttgat

SEQ ID NO: 12271 - DNA, 101 bp, rice(Oryza sativa)
  misc_feature (71): n=a or g
ctgcgccgtgaggacctccagcctccaattaacaagattgcgcagtggctgccactgtggagatcaaattngctccagccagccgggcgcctagcacttgt

SEQ ID NO: 12272 - DNA, 101 bp, rice(Oryza sativa)
  misc_feature (71): n=t or c
tacttagtaggcgacccatgcttcctcacgagaacaaaggtatgatccgctataacatgagcatttgtgangattctcctccccggaattacaaatcctac

SEQ ID NO: 12273 - DNA, 101 bp, rice(Oryza sativa)
  misc_feature (71): n=t or c
agaccactttgaaattcttctaaataaatatatattaatatagggggttgctataccacatgatcccgtcnggatatgatgataccatgcaggtatcagat

SEQ ID NO: 12274 - DNA, 101 bp, rice(Oryza sativa)
  misc_feature (71): n=a or g
gcaccttgtgcaggcatacgaactgctgatttgattcttggacatttgtaggaccgcaaccagaagcgctngcacataacctgagacgatatggcaccacg

SEQ ID NO: 12275 - DNA, 101 bp, rice(Oryza sativa)
  misc_feature (71): n=t or c
tgtgctctttctttattcttcttggatcttccatatcctatcttcttcgtgctacctctgacaaccagcantgcaacaataacaaactctttatggtacaa

SEQ ID NO: 12276 - DNA, 101 bp, rice(Oryza sativa)
  misc_feature (71): n=t or c
aaaatttaaaaaacattgaagcaaccatatactaggggagaatctctaaggctcgtacaagattctgattntgcaagctacaccaatactacattgtgctc

SEQ ID NO: 12277 - DNA, 101 bp, rice(Oryza sativa)
  misc_feature (71): n=t or c
ttgttttagacctaaataatataacctgtatattatatgatatattccttgattcttttcatactactatntctattttcttttagaattacactatacaa

SEQ ID NO: 12278 - DNA, 101 bp, rice(Oryza sativa)
  misc_feature (71): n=a or c
atcgtacactaggaggctcacccagaggaggcttcggagtatggccgatcaagcataagcatcatataccntgtacaacataggctattaaatagccctct

SEQ ID NO: 12279 - DNA, 101 bp, rice(Oryza sativa)
  misc_feature (71): n=a or g
cagcacaggattagagctggatattgattgaggaagctgccacatttgcatcatttcagatggtgtgtgtncaattggaacattccgttgcatctgttcag

SEQ ID NO: 12280 - DNA, 101 bp, rice(Oryza sativa)
  misc_feature (71): n=t or g
acttgtgtttctcacaagattattattcttcggtggcgaattggcaggaggaggatcgacgaccttcggcngcgcagttctaactgcagctggagactgtg

SEQ ID NO: 12281 - DNA, 101 bp, rice(Oryza sativa)
  misc_feature (71): n=a or c
accatggcatacaagaggactagttcgcgctatctggatatcagctctaagaaacgatgtgaaaccaagcnacttatgcaacagcctcaaggtaggattat

SEQ ID NO: 12282 - DNA, 101 bp, rice(Oryza sativa)
  misc_feature (71): n=a or c
cttgtgatatggttcattcgataagatcgaccctacggatcatatcaaaccatgtatttttctttgggggnatctagtaaagaacctaactgttgttcttt

SEQ ID NO: 12283 - DNA, 101 bp, rice(Oryza sativa)
  misc_feature (71): n=t or g
actgctcttgcctcaccaactacagaacttggacatcagacactgctcaaagctgatcctgcagctcgatncatttgtaggcgacacaacacgcaacctaa

SEQ ID NO: 12284 - DNA, 101 bp, rice(Oryza sativa)
  misc_feature (71): n=t or c
agctgaacaacagaattcgatggaaggtgctgggaaatatgattggcaattaggactaaaaaaatgtgccntaattttcatctgcctttcagggatatcta

SEQ ID NO: 12285 - DNA, 101 bp, rice(Oryza sativa)
  misc_feature (71): n=t or c
gaggaagacaccaccagtaaagccatagctcctctgtcggatgatgtgaagagaatgcttgaggatatctntcatcggctagaagcatcactagacaactt

SEQ ID NO: 12286 - DNA, 101 bp, rice(Oryza sativa)
  misc_feature (71): n=t or c
atagaggatatgtcttcttgatagcaacactttttttttcaattgtagcattttggagcaggcaattggcncaaccattaaagaaaaactagatgatgcca

SEQ ID NO: 12287 - DNA, 101 bp, rice(Oryza sativa)
  misc_feature (71): n=t or c
caagttttattgatccgttacagataaagggatctatagtagtgactggtttagacatcaactatccaacnatatggatattatcagatgatagtttaaaa

SEQ ID NO: 12288 - DNA, 101 bp, rice(Oryza sativa)
  misc_feature (71): n=a or g
gagctgtgtaatcatttgtagaattcgcggcgttcattcttcacatgaaggaactataacgacacacgagngagatgttcatctaaatttctcaaagagaa

SEQ ID NO: 12289 - DNA, 101 bp, rice(Oryza sativa)
  misc_feature (71): n=t or c
gtttttgtgataatgactggattgattttgagggccaagtggagggaatgcgctcgatgcatcgtttcgcngaccctttttttccgggggagaggattcga

SEQ ID NO: 12290 - DNA, 101 bp, rice(Oryza sativa)
  misc_feature (71): n=a or g
attaaatcatgcaaacaatctatgttgttctcagaaacaagaactgaccgagttccgagtgacagaaactncaaggatgaagccaaccaattatgcaacaa

SEQ ID NO: 12291 - DNA, 101 bp, rice(Oryza sativa)
  misc_feature (71): n=a or g
cgatatctagaagttaactttgaccataaaaaaaccttttgatgagagaattttaaattctcgaggaatcnttccttattgattcacttgaatagttatgg

SEQ ID NO: 12292 - DNA, 101 bp, rice(Oryza sativa)
  misc_feature (71): n=t or g
tcgacaagttgttcttccctcgaagaattgtcaccaaagatattcttccatgcttattttacattaggtgnggggggggggctcaaatttgtaaaagatta

SEQ ID NO: 12293 - DNA, 101 bp, rice(Oryza sativa)
  misc_feature (71): n=a or c
ttgccgctgccgaagttccaagtgagtgcaaagacggtggtgatgggctctttctggtggtgtttggatcnagggactaaaatttagtccatgtcacattg

SEQ ID NO: 12294 - DNA, 101 bp, rice(Oryza sativa)
  misc_feature (71): n=a or g
atgcccgtgacgccgtgcgtcgggatggcctacatatgtttatgttttgatatcgagagattggacagcantaattaaattaataattgggctacggagat

SEQ ID NO: 12295 - DNA, 101 bp, rice(Oryza sativa)
  misc_feature (71): n=a or g
ccagactctgatataggctatcattttggtacgcttttggacaatcatgaaggggtcgatgttgttcttantgtgggaggagagagatttcatgcacataa

SEQ ID NO: 12296 - DNA, 101 bp, rice(Oryza sativa)
  misc_feature (71): n=t or c
tgcaattcacaattcaatcacaaagaaagacaaattgcaagaacatcatacttgaatccatgcacaattgngcgcaatggccatcccggacggcgaggaga

SEQ ID NO: 12297 - DNA, 101 bp, rice(Oryza sativa)
  misc_feature (71): n=t or g
tgcttagtacgtattgaagaaaaggcttccatgtaatcacaggtactcaacattaacaatctttgcagcangagacagcagtgtgcaaagagccggcaaac

SEQ ID NO: 12298 - DNA, 101 bp, rice(Oryza sativa)
  misc_feature (71): n=a or g
attttattcaacttttgttggagaaaagaacaaggccatagtctgccccttcttttgcaactattttttgnaccaactattatttatataggtcattatag

SEQ ID NO: 12299 - DNA, 101 bp, rice(Oryza sativa)
  misc_feature (71): n=a or g
aaccaaatggatgtctctaattcccaaccaaccttcctgagtcggcttgcaaatgtcagaccaagattttnaacaaagaggtttcttgtcttggccttcct

SEQ ID NO: 12300 - DNA, 101 bp, rice(Oryza sativa)
  misc_feature (71): n=t or c
cctctggctgcagaagaaacgaacaggacagacacatcttatacaagggactactaagatgtgtctaatcnagtattaggtttcaatattttaagacgaag

SEQ ID NO: 12301 - DNA, 101 bp, rice(Oryza sativa)
  misc_feature (71): n=t or g
actaaacaatgtgttcgtcgagaagaaggacaagaccaagcgcatgtgtgtcgactaccgtgctctcaacnaggtcaccatcaagaacaagtactcgctac

SEQ ID NO: 12302 - DNA, 101 bp, rice(Oryza sativa)
  misc_feature (71): n=t or c
gctcacacatgcagctacataggatgccaccaatctagccaagctacatgtaggagacgaatcactctaanaccttatgcacaaaaattacatgataaaat

SEQ ID NO: 12303 - DNA, 101 bp, rice(Oryza sativa)
  misc_feature (71): n=t or g
ggagactggagaggcagtcaagcagagcaggaagcgaagcatgcatgaacacgtataaatgaagcagtgancgatatataggaggcgcgtacgtacatgag

SEQ ID NO: 12304 - DNA, 101 bp, rice(Oryza sativa)
  misc_feature (71): n=t or g
attcttgccaaaagagaccaccagtctcgtgcagttctcctgtaccactcgagaaaattttcctcaaaganatggtgtaggaattaactaccgtcatgagt

SEQ ID NO: 12305 - DNA, 101 bp, rice(Oryza sativa)
  misc_feature (71): n=t or c
ttgcaagtgcctctattgtatgcatgtgtatagtagattcaagcttgtacttactaaccaatagatcatgnaatgcaatgaaggtattcccattcatacca

SEQ ID NO: 12306 - DNA, 101 bp, rice(Oryza sativa)
  misc_feature (71): n=t or c
gaatgccagctacgtgcggcccatctaaatcgggtcgagttctcgagctttattcctcgaggcccattagncccttcgtttccatcacgtctctcgtcttc

SEQ ID NO: 12307 - DNA, 101 bp, rice(Oryza sativa)
  misc_feature (71): n=a or g
tagtgtgtacgtatgtactgtaccgtgtacttttgtgcatgtagcagcattgcttctgtttcttaaagccngttccaacccaaggcactacacatacacat

SEQ ID NO: 12308 - DNA, 101 bp, rice(Oryza sativa)
  misc_feature (71): n=a or g
aacgtcaatatgcccagtcttctaaaaatgctcatataggtgagtgtcacacgcgagaacgtttgtgtttntaccgtgtttcttaaaaatataaattaatt

SEQ ID NO: 12309 - DNA, 101 bp, rice(Oryza sativa)
  misc_feature (71): n=a or g
ttggttgggtttgggggcttccgagctccgaggcggacggttcgaggagatgagactgagaagtcaaacanttgagaataccacgagagactccagcagca

SEQ ID NO: 12310 - DNA, 101 bp, rice(Oryza sativa)
  misc_feature (71): n=a or g
catagatcagtgttgtgggactccagcaccttcatgataccgacacttctcatccttgtcaagcatccaangtttttcactatgtagctattggcttctat

SEQ ID NO: 12311 - DNA, 101 bp, rice(Oryza sativa)
  misc_feature (71): n=t or c
cgtgcacgcaatctgacaaaacataaatttggctcctccagcttcttcactctcacccaatgccatccaangccatgcctacctgaattcttgagctcatc

SEQ ID NO: 12312 - DNA, 101 bp, rice(Oryza sativa)
  misc_feature (71): n=t or c
ttcttgcctttgcccctcatattcttcgtgtcggcttcttgttttggtccaccatatccttctgctgctgntgccaacatctttggctcctcttttgctgc

SEQ ID NO: 12313 - DNA, 101 bp, rice(Oryza sativa)
  misc_feature (71): n=a or g
ttaattggatgtgtttgtgtgtgtgtatggcctttggttttgcatgaaggtccatagagaattaaggcaancagctatagtcagttattgttacaagtacg

SEQ ID NO: 12314 - DNA, 101 bp, rice(Oryza sativa)
  misc_feature (71): n=t or g
ggctccgagcttcgcagttcgaaagaccacatgggcaaagggtatatggcgaagggcatttagcgaagcanatggacatcacccaagacgggccctgggcg

SEQ ID NO: 12315 - DNA, 101 bp, rice(Oryza sativa)
  misc_feature (71): n=t or c
cgtatccccaaagaattcttcagttcagagtgtatggtttccagcagagttgacatcatcagcctctgtgnagttaaggcatccatatcacttttatttcc

SEQ ID NO: 12316 - DNA, 101 bp, rice(Oryza sativa)
  misc_feature (71): n=t or c
gctagatgtcgattgacatcatactcccaggatccatcagggttactaacatttctgctagtgctcgtgcngcgcttttcgctgaaattttcaggatataa

SEQ ID NO: 12317 - DNA, 101 bp, rice(Oryza sativa)
  misc_feature (71): n=a or c
tgtgcacttgcatgggctaaaaaaattatgtgacatcaattaactaacgtggaagctttattggtgcatcnaattactaaatatatgatttattctttgtt

SEQ ID NO: 12318 - DNA, 101 bp, rice(Oryza sativa)
  misc_feature (71): n=t or c
tgaaccgtaaaataattttgtactttacagaggcctgtttagcacatatcagaatcctctgcaatcgaagncatataactttttcactgatatataggtcc

SEQ ID NO: 12319 - DNA, 101 bp, rice(Oryza sativa)
  misc_feature (71): n=a or c
agtcagccatttcagactgtacaaaaacctacaagctacaacaggggtggcgaaaaaacagccagaagaantaccccacctcgtcctgaacccggcgcgtc

SEQ ID NO: 12320 - DNA, 101 bp, rice(Oryza sativa)
  misc_feature (71): n=t or c
tgtctttatgtcatcactcgtcactcaggagtaaggttataagtggattgacccgcgaactcacttatttngatctataagtgggatctataagtgggttc

SEQ ID NO: 12321 - DNA, 101 bp, rice(Oryza sativa)
  misc_feature (71): n=t or c
gatcaagcccaggctgcacactactactttgtaccaatccgtatcgatcagaggtgttctcgtagggatcnagatcctctgcattggagaagctaatgcag

SEQ ID NO: 12322 - DNA, 101 bp, rice(Oryza sativa)
  misc_feature (71): n=a or g
attccaattcattcccttggaaggattgcaaagacgttctggtatactcctactaatctagggccattttngtttgatgccaaaatgtgccctatcaaatt

SEQ ID NO: 12323 - DNA, 101 bp, rice(Oryza sativa)
  misc_feature (71): n=t or c
tcgcaaccctaactctttacgaaagccaccacaagcacgcaaataccactcaaaagaacttgtttggctanaggtagatttttttttagtttctaaatact

SEQ ID NO: 12324 - DNA, 101 bp, rice(Oryza sativa)
  misc_feature (71): n=a or g
ctccatccacaattatagaggattatggtccctgcgtttgtctaaaattatagaggattttggttatccgngaggattagtacaacaaccattatagcagt

SEQ ID NO: 12325 - DNA, 101 bp, rice(Oryza sativa)
  misc_feature (71): n=t or g
taaatcaaactcatcaggatatggcttttggtatgtacctgctcttcccataagctctatccagaagtgcnccattgttatactagccaatcgatcatatg

SEQ ID NO: 12326 - DNA, 101 bp, rice(Oryza sativa)
  misc_feature (71): n=a or g
gcgttttataggactcgaacatgagagacctctcttcgtacacagtatcccttaccatctcacgatcgtcngaaatttattcagcttggtttgctatctta

SEQ ID NO: 12327 - DNA, 101 bp, rice(Oryza sativa)
  misc_feature (71): n=t or c
atgacgttgctggggaaggctcgccagggatgatggtggacgggcgagcgatcttcgctgctaatcacaangctatcttcttcgccaatcgcaacgccatc

SEQ ID NO: 12328 - DNA, 101 bp, rice(Oryza sativa)
  misc_feature (71): n=a or g
tgaggggcctcgagcaccaccgctacctcgctcctcctccgccgctaagacgttgtgtagcgcccgttccntcgtggcgcctagcgggaaaatttaaattc

SEQ ID NO: 12329 - DNA, 101 bp, rice(Oryza sativa)
  misc_feature (71): n=t or c
ccttcgtggaaggatttctggattctagcatacgagggatgagtcaatccccgaagcatgggcacgacttnaggagtatgtggccgcctgtccttatcatg

SEQ ID NO: 12330 - DNA, 101 bp, rice(Oryza sativa)
  misc_feature (71): n=a or g
aggtgagcttccaagggcaactgaggaggtggaggacggcaaggagctcatcctcgaagaccgcattctgnaacagggaagcccatgtggatggtgaggtt

SEQ ID NO: 12331 - DNA, 101 bp, rice(Oryza sativa)
  misc_feature (71): n=t or c
atgggcttcagatatgtatcatcatattctagtctaggataatcatttctgttagtgggccaattccctanatgcccatgtaatttcacccaatcccttct

SEQ ID NO: 12332 - DNA, 101 bp, rice(Oryza sativa)
  misc_feature (71): n=a or c
taatacctgtctgaagctttgagcaaatacccaaattccgccatcgctgcttctcagcaaatctccaattntctttccctccctgtaataaaatgtagata

SEQ ID NO: 12333 - DNA, 101 bp, rice(Oryza sativa)
  misc_feature (71): n=a or g
gcgtaagctcttacgcacactgtgcagcgacgcttgcagtgagttgtatggtactagcattaacccctatntatgtgagtggccagagcccacgtagcatc

SEQ ID NO: 12334 - DNA, 101 bp, rice(Oryza sativa)
  misc_feature (71): n=t or g
ttttctactatcatctactgggattacagaaagctgccaatgtgttgctgtttcttgtgccaatcagatgngattacagaaagctgccaatgtgttgctgt

SEQ ID NO: 12335 - DNA, 101 bp, rice(Oryza sativa)
  misc_feature (71): n=a or g
cctaatagtaatatatcaagtctaggtcatatcggctgggctatcaatattgactattgacctctatttgntatattactatagttgatttgcctatatag

SEQ ID NO: 12336 - DNA, 101 bp, rice(Oryza sativa)
  misc_feature (71): n=t or c
taacagtagagacttttacatggtgggagtacaaactctacaacatattacgaggaactagtaccactatngattgggttaattatagccttatagggata

SEQ ID NO: 12337 - DNA, 101 bp, rice(Oryza sativa)
  misc_feature (71): n=a or g
ggccatagaccgaaacaagagtgccagaacccagcagagtgttggggaaagaacttaacaaccacagcagnccgggtgatacaaataacattagcagcaaa

SEQ ID NO: 12338 - DNA, 101 bp, rice(Oryza sativa)
  misc_feature (71): n=a or c
atctgctgtacccacatttcatttggccttgatctttccaacctctccttgcactcagcttgcagcttagntagctgcacacactgtcctcccacaagaca

SEQ ID NO: 12339 - DNA, 101 bp, rice(Oryza sativa)
  misc_feature (71): n=t or c
aatgttggacgacgacgaagccgggacgatacacctcgatggttcggcgatattgtttccaacactgtttncggccaatgcgcgttctgaatttggcaaga

SEQ ID NO: 12340 - DNA, 101 bp, rice(Oryza sativa)
  misc_feature (71): n=t or c
gagcagagacatgctataagtgaaaagacatgcatgcatgatataaattgcagggcaaacctattgctcangacgagagagctgccaatgcacacggcgcc

SEQ ID NO: 12341 - DNA, 101 bp, rice(Oryza sativa)
  misc_feature (71): n=t or c
ttaacacaagcaggtggaaattctggcatctgtgtcacactacttggggtccttcgtgctgtttgacgctncattatggccgcgcctgactcattgaagtt

SEQ ID NO: 12342 - DNA, 101 bp, rice(Oryza sativa)
  misc_feature (71): n=a or g
ttttgaggaggaaagctaatatatatgtactaatccacctaattaagagtggctagctggacatacttganttccatgtggcttcctatatgattgtacaa

SEQ ID NO: 12343 - DNA, 101 bp, rice(Oryza sativa)
  misc_feature (71): n=a or g
ataaatttgctagtaccattatcgtcaggatcaggttctccattctgcttcccatcaatcgtcaactcctngctaagaatatcaacatttgaggaatcatc

SEQ ID NO: 12344 - DNA, 101 bp, rice(Oryza sativa)
  misc_feature (71): n=a or g
tcaatttaaagtgttgatcagtccatagcatttcttacaacatgcagctacgagtaactgtagctgatacnatgacagaatctatctttgagaaagttttc

SEQ ID NO: 12345 - DNA, 101 bp, rice(Oryza sativa)
  misc_feature (71): n=a or g
caagagcgtgggaggtgttgcttcagtagaaggcgacaatcttgaaacttcacagttatctgagcttatantaattccagaggaggcatggtctgagcttg

SEQ ID NO: 12346 - DNA, 101 bp, rice(Oryza sativa)
  misc_feature (71): n=a or g
taaaatgacagtgatttctttccctgtagtggctagtaatggacacttaccagaaatgggtgtggaaggantgtttcatattcaaaagaatatgacgggat

SEQ ID NO: 12347 - DNA, 101 bp, rice(Oryza sativa)
  misc_feature (71): n=a or c
atcagcttcagtctgctcactgaactcgagtaaaccagcagcttctgtttcttggccacatcgagtaaaantgtcctcgtcgtcgacgagcggttcagccg

SEQ ID NO: 12348 - DNA, 101 bp, rice(Oryza sativa)
  misc_feature (71): n=a or g
cctcgtcgcacacccgtggtcctgccacataagaggggacggttcctggtgcacatgtcggaggagctcanctatcgccgcgcaggatcgccgccaccgtg

SEQ ID NO: 12349 - DNA, 101 bp, rice(Oryza sativa)
  misc_feature (71): n=t or g
ataaaataaagctaatacacatgtcaattgactgcaaaataaagatacaaaatatagatagatagataganagatagatagatagatagatagatagatag

SEQ ID NO: 12350 - DNA, 101 bp, rice(Oryza sativa)
  misc_feature (71): n=t or c
tgaatgtggatatacactatatccagattcatcccttggatcgtttttttatgggactagaaaaaataccngtgcgttataacgggtgaagtatattttaa

SEQ ID NO: 12351 - DNA, 101 bp, rice(Oryza sativa)
  misc_feature (71): n=a or c
cacgccacccatcccttgggattgaccacgttgccgtccaagtaggacgacatgaagatgacgcgggagtncgggtgccaggggcggcccaggtaggtgtc

SEQ ID NO: 12352 - DNA, 101 bp, rice(Oryza sativa)
  misc_feature (71): n=t or c
ctagttcattactcataatgaaggtggaggatccatctttttagattatttttctatttatttttccatcnaagattagaacaatatacttggtatatagt

SEQ ID NO: 12353 - DNA, 101 bp, rice(Oryza sativa)
  misc_feature (71): n=t or g
caaacaagttccaaagcattagatgtagtggagcaccaatgaatcatagagttggaaagcatctctaagancgagtacaatagcaagctacaagttagcta

SEQ ID NO: 12354 - DNA, 101 bp, rice(Oryza sativa)
  misc_feature (71): n=a or g
aattgagccagttgctcaggtgtcatggtgcttggtcttggagctcctgatgtcggctgttgttttggctncgctaatcctgacgccgacatgaagttttc

SEQ ID NO: 12355 - DNA, 101 bp, rice(Oryza sativa)
  misc_feature (71): n=a or g
tggatttgaacaacagagtttgctcaaactagacccttttactgttcaacagagtagcatgttaggaatgnactcaacaccacttgcccgcaatttctcct

SEQ ID NO: 12356 - DNA, 101 bp, rice(Oryza sativa)
  misc_feature (71): n=a or g
gctgcccctaggacaccgccgctaagaacatccaccgccatcgtctcaatctaccgtggccgaaccaaccntcaaccacaggcgctatgctgctgacccgc

SEQ ID NO: 12357 - DNA, 101 bp, rice(Oryza sativa)
  misc_feature (71): n=a or g
cgtagagaaacggaaccgcttcaatggattgaaaggaaacgaggccaaagagtgatcatccacctcatccngagcgtgccctagagcgatccgatacctga

SEQ ID NO: 12358 - DNA, 101 bp, rice(Oryza sativa)
  misc_feature (71): n=a or g
ttgggcagcagcagctacatgtctgtcatccggcacatagttttcatcaaaacggtgccaacactcagccncgacatgcccccgcttatagcagacttggc

SEQ ID NO: 12359 - DNA, 101 bp, rice(Oryza sativa)
  misc_feature (71): n=t or c
taaaaaaaaaaaaatcaaattctggccgtaaacctgaaccacgctatacgtatttaccatgttttggctcnctatgagttaacggttagcatgtaatatat

SEQ ID NO: 12360 - DNA, 101 bp, rice(Oryza sativa)
  misc_feature (71): n=a or c
ttgccatacttgaaattgataacattcaaacgatagatttagtattttactcactgccaatatgttgattntaaagttgcacgacttagttctgtttaggt

SEQ ID NO: 12361 - DNA, 101 bp, rice(Oryza sativa)
  misc_feature (71): n=a or g
gagttttaaaaaagaaaggcttaaggcaaggtgatccgtatctccaattatttttaacgttctcgtagacntgttagctatccttatcaagcgtgcaaagg

SEQ ID NO: 12362 - DNA, 101 bp, rice(Oryza sativa)
  misc_feature (71): n=a or g
cactatctaatgtgttatcacagtttcttatgtaatagaaatgcaattcatgtcatttcttagcatctaantgatcaacggatagaaaaaaaattatatga

SEQ ID NO: 12363 - DNA, 101 bp, rice(Oryza sativa)
  misc_feature (71): n=t or c
atgccaggagccatcgatgggtgttccaccatgaggaacatgaggtagttgtattggagcgtaatgggcgncgttcaccgcttccccacggtccctcaagg

SEQ ID NO: 12364 - DNA, 101 bp, rice(Oryza sativa)
  misc_feature (71): n=a or g
actccttcggccaaagataatgttgccaagtttccaaagcacgtacaagagcatagagttctttatcatanacagggtaattcaattgtgcactaccaagc

SEQ ID NO: 12365 - DNA, 101 bp, rice(Oryza sativa)
  misc_feature (71): n=t or c
taggccacaaaatacataacttatatggtgggcataaatgcggcatcttatatagttctatctcggcctanagagtctatctaaagtctctgatctctaat

SEQ ID NO: 12366 - DNA, 101 bp, rice(Oryza sativa)
  misc_feature (71): n=a or c
atccaagggtagagggtataccttatccttaaccctgacagaattacatgtagttatactcaaatttattntatagttacacttgaaattgttttatccag

SEQ ID NO: 12367 - DNA, 101 bp, rice(Oryza sativa)
  misc_feature (71): n=t or c
acccgaggggaaagcgtcgtcggtgaagcttgcttcggtttgccgaggagatccagctgttgacgaagttngccaacctcgtcgtgcaaatcctgaatcgc

SEQ ID NO: 12368 - DNA, 101 bp, rice(Oryza sativa)
  misc_feature (71): n=t or c
caacctcgatagtccaaattatcgggcaccctcccgctcacttcatgtatacacgcggttgctctgcctcntctctctctctcttctctctgcgctcttta

SEQ ID NO: 12369 - DNA, 101 bp, rice(Oryza sativa)
  misc_feature (71): n=t or c
caaccgccgcgcgaagagctccatgctgctctaaacttagcccccttccgaccgctataagaccagatttncctccacaaaaaccactctcgttgatcact

SEQ ID NO: 12370 - DNA, 101 bp, rice(Oryza sativa)
  misc_feature (71): n=a or g
cacaagcttacttcttcccaagtagttgaagcaagtggatcactagaagcacttgcacccttcgacttcgntgtaacagaaccatctaggagtgtggaagt

SEQ ID NO: 12371 - DNA, 101 bp, rice(Oryza sativa)
  misc_feature (71): n=t or g
caacccacaaaaccgaccccacctgtcattggctctacaacgaataggtgcatgtccatcatttatccaangtaataaccagtaggtaatttgcccaatcc

SEQ ID NO: 12372 - DNA, 101 bp, rice(Oryza sativa)
  misc_feature (71): n=t or c
tcgtttaacagtttagttatgattcccagctaacagtgataattggactatgtatgtagatgtttgaatanaaaatgagagtctttttagtgatggttatc

SEQ ID NO: 12373 - DNA, 101 bp, rice(Oryza sativa)
  misc_feature (71): n=t or c
agcccgttcagttctcgtatgaatcagaagaatccctagaaccatggcctgaactgtctccatttgttgtnatctttttgtttgataccttgctaatattt

SEQ ID NO: 12374 - DNA, 101 bp, rice(Oryza sativa)
  misc_feature (71): n=a or g
aactgggtattctttttaggtcttcggaaactttggttttgccaatgagtaccagtcatcgaagctgtgcnaagcaaagttttcagagtgtgaagataaaa

SEQ ID NO: 12375 - DNA, 101 bp, rice(Oryza sativa)
  misc_feature (71): n=a or g
cgtctgaaaattctgagttgtaactgaaaattcttacggcccctttgaaacgtatgattatcaaaacacgngaatagaaaaaacgtaaaaatagtatgaca

SEQ ID NO: 12376 - DNA, 101 bp, rice(Oryza sativa)
  misc_feature (71): n=t or c
aaccataacacatgccatgcgtaaactttaagttgtggctttagctgtagggctgtgcctatcagagagtngatacaatgatagattgattattttctatt

SEQ ID NO: 12377 - DNA, 101 bp, rice(Oryza sativa)
  misc_feature (71): n=t or c
aacatatctaggttctcttgtagcgagattccttcttagggaatctcagggtcagaccccttgcaagggangaaatccgaacggtcggggcagtgtgggcc

SEQ ID NO: 12378 - DNA, 101 bp, rice(Oryza sativa)
  misc_feature (71): n=a or g
ggtatctgtccagtcaaattgttgtatgagagattcaatattgcgagagatgttagggatgccaactcctntgggattgcttctgagagctgattcaaaga

SEQ ID NO: 12379 - DNA, 101 bp, rice(Oryza sativa)
  misc_feature (71): n=a or c
taagcattcatttattaagcaacaacattaaagcaaattataatattatatttcaacaatgaagaatgccngcgcaggtgtgcgggttatcttcctagtta

SEQ ID NO: 12380 - DNA, 101 bp, rice(Oryza sativa)
  misc_feature (71): n=a or c
gctgctgtggcattgatgcaagagagtgttctacttgaattgagtactaagcaatctaagcgattgatgtntaaaccattgcctaccaaaggggagttgcc

SEQ ID NO: 12381 - DNA, 101 bp, rice(Oryza sativa)
  misc_feature (71): n=t or c
tccacgattgaagttaactgaaggataacttgaaatacgatggtcaagcagagctcaagcactgttggtanaagcttttgcagcaagaaggcaagctgtaa

SEQ ID NO: 12382 - DNA, 101 bp, rice(Oryza sativa)
  misc_feature (71): n=t or g
tttgggtagctaatctcgtacttatgtcatcatcggtgtacggggattttcttcctttatatgtgtgtgcnctaagaggatgaggggcgagtccatagcgt

SEQ ID NO: 12383 - DNA, 101 bp, rice(Oryza sativa)
  misc_feature (71): n=a or g
tactaatcatgtttcttgtttacgtgcgactaatcatccgtctgaaaactcactttagaacacaccctttnaatataattttataatataaatataataaa

SEQ ID NO: 12384 - DNA, 101 bp, rice(Oryza sativa)
  misc_feature (71): n=t or g
aaaacacacgacaagatgtgtcccgcacccaacccttgatgataggaaagcaaatatctgccactgttgancactacaattttaactttgtccattaataa

SEQ ID NO: 12385 - DNA, 101 bp, rice(Oryza sativa)
  misc_feature (71): n=a or c
ttgttagttgttcctttcttttctatgaggaaatcaaaagcaaactaactgtgctcagctcagattaattntgaattaatcaaactaatggtggaactggt

SEQ ID NO: 12386 - DNA, 101 bp, rice(Oryza sativa)
  misc_feature (71): n=t or c
gtcatttgataactgagttcgtgtaattaacccggaaagctatcgaattctacggctctcctctaacatgnatgaacttcaaagtttagtttatttctacg

SEQ ID NO: 12387 - DNA, 101 bp, rice(Oryza sativa)
  misc_feature (71): n=a or g
ctctcaagcctaaggaactaaagaacatggtgatgtgaaaaattgtgagtttgtgaatgtgatggtagatngatggccgatgggggaggggggaagggcta

SEQ ID NO: 12388 - DNA, 101 bp, rice(Oryza sativa)
  misc_feature (71): n=a or g
tgcaagtgtcaagcatgtatgaagataagtatcatagatggattatattctatctatcactttgtgcctgnacataaccataatcttgccactagaagtca

SEQ ID NO: 12389 - DNA, 101 bp, rice(Oryza sativa)
  misc_feature (71): n=t or c
ctatgtacagttacactactacagaaatacttattagtgccggttgtaaaggccttataggtgtcggtttngggtccgacacctattagtgacatcaatgg

SEQ ID NO: 12390 - DNA, 101 bp, rice(Oryza sativa)
  misc_feature (71): n=t or g
ggaaggaataaaagtaccaaggctagcacagctaaccgaaatcatagactcaagtatgaggagcatgacangacaaatatctgacaaagtatttatcacac

SEQ ID NO: 12391 - DNA, 101 bp, rice(Oryza sativa)
  misc_feature (71): n=t or c
caggatgattggttggaagttctgggatgtggagtcactgagcaggaaattttgaaaaacaacggcagganagataatgtggcatgggcctttggactagg

SEQ ID NO: 12392 - DNA, 101 bp, rice(Oryza sativa)
  misc_feature (71): n=a or g
gttcaacttcgccatgccgctgcgtctgatgaacacgtattcgtactcctcctccctttaccccgtccccnccgctcactaggcataggaaggagaggaag

SEQ ID NO: 12393 - DNA, 101 bp, rice(Oryza sativa)
  misc_feature (71): n=t or g
acatagtattttgtcttaaaaataacacgctctcaagatctgtcgccaacgtattgcgtctgtttgttcantccatagaagccaaatgaaatactggttcg

SEQ ID NO: 12394 - DNA, 101 bp, rice(Oryza sativa)
  misc_feature (71): n=a or g
agatcagtttaacatggcattggcaacaaaacctgtactctggtagacgtgtttttttacttctctcattntgctttcttcttacagtgggacacccaacc

SEQ ID NO: 12395 - DNA, 101 bp, rice(Oryza sativa)
  misc_feature (71): n=t or c
atccacgcatctcagcagcctccaaaagaattcaccacaatgagcagcgaaagcccagattctcagcactncttggcacaggcgctcttggccttgtgcct

SEQ ID NO: 12396 - DNA, 101 bp, rice(Oryza sativa)
  misc_feature (71): n=t or c
cggctaacacttatgcaagcaaagttaaaatcaaagtgtacctgagggatgatgtctggaaagagatctgncatatatgtcgaaactagatttcggcaata

SEQ ID NO: 12397 - DNA, 101 bp, rice(Oryza sativa)
  misc_feature (71): n=t or c
aaaaacaatatgtgtacagaagagtactccctccgtttcaaccataaaacgttttaaccttcgtcaaactnaaattgatttaagtttgatcaagtttatag

SEQ ID NO: 12398 - DNA, 101 bp, rice(Oryza sativa)
  misc_feature (71): n=a or g
gttatatacagcatgttgaagctagccttgtttctctctagcgtttgtcccttctgctgcctttataaaanatgtgagtgttctcaacatgtactggtgca

SEQ ID NO: 12399 - DNA, 101 bp, rice(Oryza sativa)
  misc_feature (71): n=t or c
ttgaatacataaatctttagtgtgagtatgagtatggtcaggaagaacatatcaccaaacaccaacatcanatggtaaaattgtgcatctctgaggagata

SEQ ID NO: 12400 - DNA, 101 bp, rice(Oryza sativa)
  misc_feature (71): n=a or g
cggaagttgcaagtccgcgtcgcacccgcctgtcattggtgaagatacgtcgcttgtgcgccatccaaagnaagatcttgcatttggtttgagcatggttg

SEQ ID NO: 12401 - DNA, 101 bp, rice(Oryza sativa)
  misc_feature (71): n=a or c
cagcataagaatagatacttcaacattacatgatttaaaagggtatccaattgaaccatccaatggttganaatgcatgaggactaactgtaagacaatac

SEQ ID NO: 12402 - DNA, 101 bp, rice(Oryza sativa)
  misc_feature (71): n=t or c
taaaattctgcgttgcagctaatgaatacttcacatcggccctaaaggtagctgactattctaagttgacngttgttcaatttttattcaacccattagag

SEQ ID NO: 12403 - DNA, 101 bp, rice(Oryza sativa)
  misc_feature (71): n=a or g
cccttacaagctaatctatggacatgaaacggttctaccgtgggaaaataacatcggttcacgaagaatcnagctacatgacgagttgacagccgatgatt

SEQ ID NO: 12404 - DNA, 101 bp, rice(Oryza sativa)
  misc_feature (71): n=a or g
tctagctagctagctagctacttcatatggatgttgaataagggatcatatcggaggaagacatgcatgantgcttatgcaactatgcaagcatgcccgtc

SEQ ID NO: 12405 - DNA, 101 bp, rice(Oryza sativa)
  misc_feature (71): n=a or g
ccgctagaacaaactgccaagttgatgcataagtggcagtttgttgggccacatctgcccgatgaattttncctctcgattcacatcttaacggggacatc

SEQ ID NO: 12406 - DNA, 101 bp, rice(Oryza sativa)
  misc_feature (71): n=t or c
ttctcaacttgtgtgcagatatttgtcgttacatccgccacgatgtttgtaaccatttgggcgaattctangatccggagagcgaccttgcaaagaatgac

SEQ ID NO: 12407 - DNA, 101 bp, rice(Oryza sativa)
  misc_feature (71): n=t or c
catcaggattggggtcttcctctctctggttcgttctttccccagccaaggacgaccctccaaaatttttntagccataactgaaaacaaatcgaggcagc

SEQ ID NO: 12408 - DNA, 101 bp, rice(Oryza sativa)
  misc_feature (71): n=t or c
ggcagtgcggcctcgaggcagaacaatcacgacgagctgagcaccaagaaccactccctcattaaatcaangatatgttcagcttatttattcatgcattt

SEQ ID NO: 12409 - DNA, 101 bp, rice(Oryza sativa)
  misc_feature (71): n=a or c
tcccctagttgatgtactgattattgccatagggtcaccctgaattgttaattagagcagttgctgctgtnaaaaaaaaacatctcctctcttgggttgtg

SEQ ID NO: 12410 - DNA, 101 bp, rice(Oryza sativa)
  misc_feature (71): n=a or g
cctcccacttcttcttcttcttcttccccccatttctcacttactccggcgatcaccgtggttgagcgtcngcggcggaggaggaggcgatgattaccatg

SEQ ID NO: 12411 - DNA, 101 bp, rice(Oryza sativa)
  misc_feature (71): n=a or g
gtattcttttctgtggtaatacttttgggctagtcatattggtttttgataacttgccatcataggtttcncactcagaattgtactagcaactttccact

SEQ ID NO: 12412 - DNA, 101 bp, rice(Oryza sativa)
  misc_feature (71): n=t or c
gcaagtatcctaaacctaggcgcctggcagcatcggaaatacctgaaattgtcgaacaatatcgtcaagcngccattaatgccattgaagcaggtaaagat

SEQ ID NO: 12413 - DNA, 101 bp, rice(Oryza sativa)
  misc_feature (71): n=t or c
gctccccagcaggtcgctcacctgaaccacaagtccacaagaaacaaaaggttttgttttagttttttacntttttacctgcaaaattcacttctttaatt

SEQ ID NO: 12414 - DNA, 101 bp, rice(Oryza sativa)
  misc_feature (71): n=t or g
attgccatttgttttcaattagtgccatcgattttccatcgtgctgatgatttattccacctgcagctgtnatccaacaaatgacagagctatttatggga

SEQ ID NO: 12415 - DNA, 101 bp, rice(Oryza sativa)
  misc_feature (71): n=t or c
gcttttcaagtggatcgcacagaaaaaaacttaactcatttcctttccactcacttcaaaattttcacatnatctctcttcttttttcctttttattctcc

SEQ ID NO: 12416 - DNA, 101 bp, rice(Oryza sativa)
  misc_feature (71): n=t or g
ggtatcgggacggggttagcgatgaatcggatcgaattgctgatcctcctcgtgttcgtgttcgtaggtgnggggcgtacgcgtttgtattagatttaatt

SEQ ID NO: 12417 - DNA, 101 bp, rice(Oryza sativa)
  misc_feature (71): n=a or g
ttcttgatccttggaactccatgtttctgggacgttcaatcatcgaaataaccaaggcagtgaataggaanaagtatcatagtggcaaaccaaagttcttt

SEQ ID NO: 12418 - DNA, 101 bp, rice(Oryza sativa)
  misc_feature (71): n=a or c
gagaaagaagtgagacagagacagagacagagcagagaaggatcgagagtaacagaaagaaaatagaaatntatacctacttaaaaaattcgtaaggtttc

SEQ ID NO: 12419 - DNA, 101 bp, rice(Oryza sativa)
  misc_feature (71): n=t or c
aggattgaaggctgatggagatactggtcatttggagaagtggggcttcaggggttttcgtgttctcctcngcataaaagtttgttgatgtatgctggctt

SEQ ID NO: 12420 - DNA, 101 bp, rice(Oryza sativa)
  misc_feature (71): n=a or g
cacgctgtaccaggaaagccctgttcagatggacggcatggaacacgatggtggtgatgccaagcttatcnggtattccattctcaactcggagcaaaatt

SEQ ID NO: 12421 - DNA, 101 bp, rice(Oryza sativa)
  misc_feature (71): n=t or g
accaaatgccaatattcctattcccctccttatttagaattaacaagcacatcaagggggtagaaaaagtnatgcatatcatatcacaacagtgctctatc

SEQ ID NO: 12422 - DNA, 101 bp, rice(Oryza sativa)
  misc_feature (71): n=a or c
gtgccttttttccgacgccacccattctcagataaatcaactttggtagcaagtgatgctgcaggccctgnagcatgtgtatgaatttaccatctatcgtt

SEQ ID NO: 12423 - DNA, 101 bp, rice(Oryza sativa)
  misc_feature (71): n=a or g
atctcatattttatgcccttgtttgctaagacaaactagaatctaccgatggctccacccatcggctttcnacgatactaaaactaagtatggctaagcat

SEQ ID NO: 12424 - DNA, 101 bp, rice(Oryza sativa)
  misc_feature (71): n=a or g
ggggcgcgtacgcgccaattatgatttgcactagatcaaacctagcctagccaggcaagaccaggcgtttngaattgtgaaaaaatcctaacttttgaggg

SEQ ID NO: 12425 - DNA, 101 bp, rice(Oryza sativa)
  misc_feature (71): n=t or c
gattgatctgatatgctgtttatgcattggttcaagttcaatgaagggtttccaaaaccgccggttcgcgnggttaccgtagagtacagtaagagaaaaac

SEQ ID NO: 12426 - DNA, 101 bp, rice(Oryza sativa)
  misc_feature (71): n=a or g
agaagaaggccaagatcgatcccatcccatgtagtccaagcagcggtaactagctcgctagctagtctagngtagagcaaaatcgcttcgttttctcgtgc

SEQ ID NO: 12427 - DNA, 101 bp, rice(Oryza sativa)
  misc_feature (71): n=a or g
ctagaaaaccaccgcagttctcatatttcttgtcctatctgcacttgcagagctgatgctgctgggcttcntatccctgcttctcaccgtggcacaggcgc

SEQ ID NO: 12428 - DNA, 101 bp, rice(Oryza sativa)
  misc_feature (71): n=t or c
aacaaactcttagcctcatccaatttgtgcacattacaaagcccctgaatgagggcaccatagagtgaaanatcaagttccaatcctttattcttcatctc

SEQ ID NO: 12429 - DNA, 101 bp, rice(Oryza sativa)
  misc_feature (71): n=t or c
ccctaattaccttagtgtattttatcttcgtcattcttactaatcatgttctctgtatgctttatatgttnctcacctcaaggtatttaagtatgttagta

SEQ ID NO: 12430 - DNA, 101 bp, rice(Oryza sativa)
  misc_feature (71): n=a or g
atccttggagaaatattcttggggcagttgacgcgctgcggggtctgatgcagcaatggaggaactacccntcgagctggaactccggcgacccctgcggc

SEQ ID NO: 12431 - DNA, 101 bp, rice(Oryza sativa)
  misc_feature (71): n=t or g
gcttgatgctactaccaacatagtttcctatgagtctacactgagaaaccttgtaactccatggtggattnttgcgaaatatgttagtatatacccaacca

SEQ ID NO: 12432 - DNA, 101 bp, rice(Oryza sativa)
  misc_feature (71): n=t or c
atgggctaggcttttgccggcagctccctcttcaattcaaaccagtctccgctagcatatggacctatcangcctgctagctctttgctgggcagcccacc

SEQ ID NO: 12433 - DNA, 101 bp, rice(Oryza sativa)
  misc_feature (71): n=a or g
gctcccaccctccacgagccattgtcgcctcactgtgcgctgatgctccctttctctgtgagccgccgccnccggtgctccctccctccccgcagcaccac

SEQ ID NO: 12434 - DNA, 101 bp, rice(Oryza sativa)
  misc_feature (71): n=t or c
gtcaatctatgtatttatctaaccatgatcgatcaaacaggtacaaaatagccaaggacattagatcgggnctgctctacctacatcacgagtgcgaccca

SEQ ID NO: 12435 - DNA, 101 bp, rice(Oryza sativa)
  misc_feature (71): n=a or g
gcgtttgtgaccatttttttcagcaactgctatgatcaacttcagtttaagcttcgtttagccgctggctncactgcaccttctgtagcttgatcaatctt

SEQ ID NO: 12436 - DNA, 101 bp, rice(Oryza sativa)
  misc_feature (71): n=t or c
agaagcaacaggaagataagcaaattatttgagcttaggaaaaggcacttacgacgtcacagagccaaaangagaaaaaattgtatataaatcttcatcct

SEQ ID NO: 12437 - DNA, 101 bp, rice(Oryza sativa)
  misc_feature (71): n=t or c
cgagatcatggagtacgacgaattcggcttccgcaacaacaatcaagatcttgacgacttcgacgaaagcncggaagataactacacccctttctatttca

SEQ ID NO: 12438 - DNA, 101 bp, rice(Oryza sativa)
  misc_feature (71): n=t or c
cgtacgacgattgctccgagttggataggcctatgtatgtgacgcacggtatgcaaaaccatgcagttatnacacagttaccccgtacgataacatcctca

SEQ ID NO: 12439 - DNA, 101 bp, rice(Oryza sativa)
  misc_feature (71): n=t or c
tttaagggggcctgttacctgaaatgttgcactcttggcttgtgtttctcttgcgttatgcttgcatgctnttctagtatcttggataatttactgcatat

SEQ ID NO: 12440 - DNA, 101 bp, rice(Oryza sativa)
  misc_feature (71): n=a or g
tcatactaaagcttttacacattcccacctaaatttacattctagattcatcactaggtggccgatgtccnggtagcttctgacgcagtggtcagcgcgca

SEQ ID NO: 12441 - DNA, 101 bp, rice(Oryza sativa)
  misc_feature (71): n=t or g
ccttgtggcactcacaactgagaacactgcagagtgcgactctgcttgctaggtacaccgcatagtatccngtggacaggcaattcatgcaagaacaaaag

SEQ ID NO: 12442 - DNA, 101 bp, rice(Oryza sativa)
  misc_feature (71): n=t or c
ttctgaccgcatccagcatttatatccccaagagatgcaacaatttccacaggcttcttcacttgtccatnaatcccacaagattggcgattcatgtcatc

SEQ ID NO: 12443 - DNA, 101 bp, rice(Oryza sativa)
  misc_feature (71): n=a or g
atgctttacttcagagatgaatgtcatggttgttttcgccattatttttctgaatgagtgttggagaaggntagtgtagaagtgcagaatattggtgattc

SEQ ID NO: 12444 - DNA, 101 bp, rice(Oryza sativa)
  misc_feature (71): n=t or c
ctattatatttatggatgaaaagagtagtgtgatgaagaaggatgagagtgaatccgaatcttccgccatncatcaaaccatgtggtcaaactggtggcca

SEQ ID NO: 12445 - DNA, 101 bp, rice(Oryza sativa)
  misc_feature (71): n=a or g
agccgaacccaaacccccaaccgttaccacagccaaacccaaatccccagcctttacctcagccagacccnaacgctccgccgttgcctctgccgcagcct

SEQ ID NO: 12446 - DNA, 101 bp, rice(Oryza sativa)
  misc_feature (71): n=a or g
agcttgcaatggcggctcatcatgtcatgagcatcgccgcagcagcagtagccatgcttctcctgatggcntcgtcgccggcagtcgccggcacggcggtg

SEQ ID NO: 12447 - DNA, 101 bp, rice(Oryza sativa)
  misc_feature (71): n=t or c
tctgccatgatgcacctgcaacaatatcaaagtcttcactggatgacccgtttccaatatcatgaccagantttgctggtgttttcttaagtgattttcct

SEQ ID NO: 12448 - DNA, 101 bp, rice(Oryza sativa)
  misc_feature (71): n=a or c
ttttgggtgttgttaaggcttctaacatgcagccttgagctgatttgtgttcgaacatattttgtacatcncaaccaagttataatattctgaaagcattt

SEQ ID NO: 12449 - DNA, 101 bp, rice(Oryza sativa)
  misc_feature (71): n=t or c
agataatgtaactgtgatgcccgtggtgcctttattaatattaagatggcaaaatttgctatgagacacgnaaaaatcgtgtaattggctgagggacaccg

SEQ ID NO: 12450 - DNA, 101 bp, rice(Oryza sativa)
  misc_feature (71): n=t or g
ttttcaaaagtaggattttcatgacaactgcgccaagtaaatgtgcttggtcccatgtcaatctctcttangttagcttgttcaataatggcattgaaaac

SEQ ID NO: 12451 - DNA, 101 bp, rice(Oryza sativa)
  misc_feature (71): n=a or c
aggcaatgttgtgtcgcatacggtgcatcatcatgattttgatgggctcataccattcaagggaaacaccncgaaggtcctcaaccaaggtacattaacat

SEQ ID NO: 12452 - DNA, 101 bp, rice(Oryza sativa)
  misc_feature (71): n=a or g
tgtcttagcaagctaaatttagctctacgctatagggagatacaatcgtgttgtttggttgactgtgtctnttgagttactggattttgtttgtttagtta

SEQ ID NO: 12453 - DNA, 101 bp, rice(Oryza sativa)
  misc_feature (71): n=a or g
aacaaaaacggaacattgatatagatagcatgtcctgcctcttcccaatggaaagtatagtaaccaggggngatagaaaccaacttcagtaaaagtaggtt

SEQ ID NO: 12454 - DNA, 101 bp, rice(Oryza sativa)
  misc_feature (71): n=t or c
atttatacctttcttgactaaccacgctgtgaagcgtgtgcaatttctctgccaatgtccatatgatgcanagaagtggcagtagggacttgtacttaaag

SEQ ID NO: 12455 - DNA, 101 bp, rice(Oryza sativa)
  misc_feature (71): n=a or g
caaattaatgtctctcaatcacaaaaccgaatatttcacgatcccaactaatgaaaccggtgcaaaaggantttttttttgagagctctccactttgagaa

SEQ ID NO: 12456 - DNA, 101 bp, rice(Oryza sativa)
  misc_feature (71): n=a or c
atatcttcactcaagcaacggtttttgactctatgatctgttgtttttcaactaagcatagtcaggagctncacaaatacaaggctcaaaattcgacaagc

SEQ ID NO: 12457 - DNA, 101 bp, rice(Oryza sativa)
  misc_feature (71): n=t or c
atgttagatagtgatgatcttacttgacatccgaagctgctgcaaagaaggttaagtgcatcctcacatgnattagagatatcacgatcggagacatcatg

SEQ ID NO: 12458 - DNA, 101 bp, rice(Oryza sativa)
  misc_feature (71): n=t or c
attgctgacgtcggcaataagcagcagctatcacctaaccctgtttcagagacactagtacagatccttcnatctgtgacgacccctaacaagactggaat

SEQ ID NO: 12459 - DNA, 101 bp, rice(Oryza sativa)
  misc_feature (71): n=a or g
tactggttgatagagcagaatcaagaattgttttttgttggttgagctgacttgttgcaatacctgtaggnttattgtcattctgaacctggaagttcttg

SEQ ID NO: 12460 - DNA, 101 bp, rice(Oryza sativa)
  misc_feature (71): n=t or c
caatttagtacaatttgttaagtttttacactaaatcgcacctatctattaattagttgttgcactacaangctcacttctcaagttcttgtactaaattg

SEQ ID NO: 12461 - DNA, 101 bp, rice(Oryza sativa)
  misc_feature (71): n=t or c
tctctattatctcaaccatattgaaaaagcagacaaggtctcgatccattggctcctcaacaaccattgcncctggaccacgatcatgcttgaaaaaccgc

SEQ ID NO: 12462 - DNA, 101 bp, rice(Oryza sativa)
  misc_feature (71): n=a or c
tgcatagccaataaccagcaagtgttgttgcagtttccatgggcatagtaaagactactcatttgccttcngttctggttaattcagtgtggattaaacca

SEQ ID NO: 12463 - DNA, 101 bp, rice(Oryza sativa)
  misc_feature (71): n=t or c
tcatcatagattttattgaacaaaaaagggtacctgtagatccatcaggtgaagccaatagccctcggaangaacaattcccatccttgtcacgagaagca

SEQ ID NO: 12464 - DNA, 101 bp, rice(Oryza sativa)
  misc_feature (71): n=t or c
cgccaacggcaccgtcatgtcacctcgcagctttcgtcaccaccaacacagccatcgtcgtcctcgagctnagcttccatctcgccatcaacgagctctct

SEQ ID NO: 12465 - DNA, 101 bp, rice(Oryza sativa)
  misc_feature (71): n=t or c
atttctaccagatttgatgcccagttgctaggcaatctgccagataagttaacctcttggatctgtacctnggttaagccagctggaaacgttcctgagaa

SEQ ID NO: 12466 - DNA, 101 bp, rice(Oryza sativa)
  misc_feature (71): n=a or g
gattttgggtataactataaaggcatgatgagaacactaaccttatgcgcgctgcacatcgtaaccttgangcaacgattatgcagctttttaccaacttc

SEQ ID NO: 12467 - DNA, 101 bp, rice(Oryza sativa)
  misc_feature (71): n=a or c
cacaacaagcttgaataattccgaaccggtgatagaaaatgcagtatgttgatcaggctgtgtccagacanttaatgcaccatcattgagaacaataaaaa

SEQ ID NO: 12468 - DNA, 101 bp, rice(Oryza sativa)
  misc_feature (71): n=a or g
actatttatttatcacctttctatgtatcattcttcttattatcatctccatacttcagattgacgtagtngtgatgtccattgtcctctttgtacttcag

SEQ ID NO: 12469 - DNA, 101 bp, rice(Oryza sativa)
  misc_feature (71): n=a or c
ttgaatctctggttttaccaaactagatttttttaaacagattttagagcctaacagaacaaaaacctttntttgggtcacataaaaattcttgttatcca

SEQ ID NO: 12470 - DNA, 101 bp, rice(Oryza sativa)
  misc_feature (71): n=a or c
gttcataatttgtacaggctacactatcccaaaaggatcaaagatcatgcttagtccttccaatattcatntgaatcctacggtatataaggaccccaatg

SEQ ID NO: 12471 - DNA, 101 bp, rice(Oryza sativa)
  misc_feature (71): n=t or c
ccgccgacggttgacgggacttctagaaaattaaaaatgaattaaaaataaagagtaggcgaccgacgggntgtagaggggcatagtggcatcgtttgatg

SEQ ID NO: 12472 - DNA, 101 bp, rice(Oryza sativa)
  misc_feature (71): n=t or c
gaaagaggccaatgcaccacattcacggccaataaagataacctgtgcagctgctgctgctagcctccgtncagggtttacaataacgattgaccactaaa

SEQ ID NO: 12473 - DNA, 101 bp, rice(Oryza sativa)
  misc_feature (71): n=t or c
atatcttacagccaattcaattcattgtgtgagaatccaaccaaaaccagcttgtaacttgcaagtcttgncctcttaaggggtggtcagcacacattcaa

SEQ ID NO: 12474 - DNA, 101 bp, rice(Oryza sativa)
  misc_feature (71): n=t or c
ccaaagtggaccgtggactaaaatgccatctaaacgacaaagtgagcagtccatcttaaactcggtgggcnaataaagccctcgtttagttctaaaccttt

SEQ ID NO: 12475 - DNA, 101 bp, rice(Oryza sativa)
  misc_feature (71): n=a or g
cgtctctggctgcacgttgtggcggttggttatgccaactgaaacgggtacagccgagctagaagctggcngcgcggtggcagctgctgccgatgaaacgc

SEQ ID NO: 12476 - DNA, 101 bp, rice(Oryza sativa)
  misc_feature (71): n=a or c
gcatgtatatacgatggtattggcgagttaaattatacaggaacactaatgagggatacccatataggtgncgattcatttaaaactgacatttacagagc

SEQ ID NO: 12477 - DNA, 101 bp, rice(Oryza sativa)
  misc_feature (71): n=a or c
tagcttcagattaagaaaaaaaacttcagattttcagttttgagtgcgtggccttttgctatagctcgtanaatgtaaggtataattcataattggttgaa

SEQ ID NO: 12478 - DNA, 101 bp, rice(Oryza sativa)
  misc_feature (71): n=a or g
agccatggaagctccattcagtaaagaggcataaacaagccatgggcccatcatccaaccgaggttagtangccatgcaacaacatcacctctgcgaatat

SEQ ID NO: 12479 - DNA, 101 bp, rice(Oryza sativa)
  misc_feature (71): n=a or g
ccttttcctttgctccatcgatggatataaggattatctactcgtacttggtacatattgatatcttcttnaagatccatccatccattatattattaaag

SEQ ID NO: 12480 - DNA, 101 bp, rice(Oryza sativa)
  misc_feature (71): n=a or g
cgtggtcgattgaagctagagctagttagttgaggggattctcggacttggttgacacactgcacctatantagtcgttgatgatatgtgggattgggtcc

SEQ ID NO: 12481 - DNA, 101 bp, rice(Oryza sativa)
  misc_feature (71): n=a or g
ggtctgacaattttgtcaaacttcttgggtgttttgtgcaagcctaaactgttagattggtcaaaaacatncttcagtctttcttggatttccatcacttt

SEQ ID NO: 12482 - DNA, 101 bp, rice(Oryza sativa)
  misc_feature (71): n=t or c
agggaccagttcgaaactgcactgaaaattccaattcacctatttctattacgctggttgcttgacgaaangagagccaacgatagaagcaacatgaatga

SEQ ID NO: 12483 - DNA, 101 bp, rice(Oryza sativa)
  misc_feature (71): n=t or g
ccgatggcactctttgcatccatgaccaccgggagcgaagagcaatgcccatcagctccaaatttggtacnctaagtgtaagttcaagtgccttaatttgg

SEQ ID NO: 12484 - DNA, 101 bp, rice(Oryza sativa)
  misc_feature (71): n=t or c
tcgatttagagggggtgagaggatttgggatctagggaccctatggagagagagaaggggaacggttattnagggcaatgcggtcgagatagaggagcatg

SEQ ID NO: 12485 - DNA, 101 bp, rice(Oryza sativa)
  misc_feature (71): n=t or c
aagcgacacagatcaagctctgctcgtgcggtagatttgtcaatggaaacgaattagcttgtagtcaaggncgtcggtctgttgtttgatctccaccggtt

SEQ ID NO: 12486 - DNA, 101 bp, rice(Oryza sativa)
  misc_feature (71): n=a or g
tcatctcctttattttattatgttatgcttggatttcgaatcaaaactgagatagatagatagatagatanagagagagagagagagaggatgaattggtg

SEQ ID NO: 12487 - DNA, 101 bp, rice(Oryza sativa)
  misc_feature (71): n=t or c
atcttcttcaacctcttgtggacctgcaactgtaggaagtggatctaaatcatcttgatgttgttgctganatctcttctttgtcttcacaatatcctcaa

SEQ ID NO: 12488 - DNA, 101 bp, rice(Oryza sativa)
  misc_feature (71): n=a or g
gatctaccatacgaactacacaaaaaacaacaataaacaactcctcgtggacatcatcaacctcaacctcnaatcatccatttcatacatccggaaaaatg

SEQ ID NO: 12489 - DNA, 101 bp, rice(Oryza sativa)
  misc_feature (71): n=t or c
ctgttcaaagctgttcctcatcaatctcgcctgatggatcatgtgccgtttgctgttgtagacattgacgnggccttcagcatcggctactgacaacctga

SEQ ID NO: 12490 - DNA, 101 bp, rice(Oryza sativa)
  misc_feature (71): n=t or g
ataaatatagacaatatctccaccttgtcaaattggtatatagctagtgagacctctagaacatggaatanagatatttcgaaatatacatctacttgtgt

SEQ ID NO: 12491 - DNA, 101 bp, rice(Oryza sativa)
  misc_feature (71): n=a or g
aatcaaacaatattagcaaactaagcaccatcccaccctagtcaaagtgtggtcaaagggctcccaccttngtcaaaccagtctgctaactcaccccatat

SEQ ID NO: 12492 - DNA, 101 bp, rice(Oryza sativa)
  misc_feature (71): n=t or c
aggtgaaatatgagtgcacgcattggtgggaaaatacccatatgttaaatacatccactctcgacaaatcnttcctagctaaaattttcattcgaacaagt

SEQ ID NO: 12493 - DNA, 101 bp, rice(Oryza sativa)
  misc_feature (71): n=t or c
cagttccatgctaaagctggtggtggccttgtgcttcttcgctgtggccatctccctgtgttgcgtctgcntcagctcgggttgcggtggcagtggctgtg

SEQ ID NO: 12494 - DNA, 101 bp, rice(Oryza sativa)
  misc_feature (71): n=t or c
cctttcttttttagggacccacttctggtgttggttgtacttttgacataatcaaaaaattcatcgtgcanaatgcttgtaataaacaaacaaatcttcat

SEQ ID NO: 12495 - DNA, 101 bp, rice(Oryza sativa)
  misc_feature (71): n=a or g
tgatcatccgctggccatttgcccacacaatcactcgttgaatgttgagttatgtcccatcgccatgaacnccttcctcgagctcgagcccttctccactc

SEQ ID NO: 12496 - DNA, 101 bp, rice(Oryza sativa)
  misc_feature (71): n=t or c
ggagaaacttctctctctggcgtagcagagtgcgtcatgtggcttaagattcggactattctggccttctnggcaatgtcggcatgtggaacggacgacta

SEQ ID NO: 12497 - DNA, 101 bp, rice(Oryza sativa)
  misc_feature (71): n=t or c
atcccgtggttgcggcgatcttctccgttcccctcatcccctcttcttggcgctgaccgattggattctcncccgcacaagcacacgaatccgtggagcgg

SEQ ID NO: 12498 - DNA, 101 bp, rice(Oryza sativa)
  misc_feature (71): n=t or c
atctagccatgatttctagggtggtatgtcctgagctctaaccctatgcaaaagtagggtaaaatcttcanggaaaagagatttccaggagttgaatgtgg

SEQ ID NO: 12499 - DNA, 101 bp, rice(Oryza sativa)
  misc_feature (71): n=a or c
gtagccctccatcacctcactcatgtggccgaaggtgacgtcattctctccccatgctgacttgaaggtgntggtattggaggtggaaccgcggcaagggt

SEQ ID NO: 12500 - DNA, 101 bp, rice(Oryza sativa)
  misc_feature (71): n=t or c
cttgctatgagtagtccactgtactaatacttgctcttatacgcatagaataagaggcgcgccacgcgagnagtacgcgacgcgacgcggtggtggtggcg

SEQ ID NO: 12501 - DNA, 101 bp, rice(Oryza sativa)
  misc_feature (71): n=a or g
ttccaaagatactcatactctacaaataacgtaggcaggtatcgcctgttgacaatggcgctctaggtagngggcttggtgctatataagataacacaaaa

SEQ ID NO: 12502 - DNA, 101 bp, rice(Oryza sativa)
  misc_feature (71): n=t or c
tagcggtggtggtgggtgacgacagatttacccctcatcaccacaattgagtatggatttttcaacctacncttcacgcactgaaccatgtgtcttggacc

SEQ ID NO: 12503 - DNA, 101 bp, rice(Oryza sativa)
  misc_feature (71): n=a or g
acaccttgtgctgcacattgcttggatttgctattggaggatattgggaagataaaggccttcaatagttncatcaattgtgcaaagaaggcgtgccggtt

SEQ ID NO: 12504 - DNA, 101 bp, rice(Oryza sativa)
  misc_feature (71): n=t or c
gcacccagtgatcaataccgtacaattatctagagtcaaatcattaatattcaaatcttattacagtaaanagatactcagtcattctagcatttcccaca

SEQ ID NO: 12505 - DNA, 101 bp, rice(Oryza sativa)
  misc_feature (71): n=t or c
aagctgtttttttttcctttttgaaaagaagcatattgctgtcttcagggttgtggacttgtggatttggnacatagcccttttacggttgtgctacatat

SEQ ID NO: 12506 - DNA, 101 bp, rice(Oryza sativa)
  misc_feature (71): n=a or g
ccctcttgataacgaagccaagcccaagggttccgccatccgctggagaagagggcatcacgacaacggcnccgataagaatagatccaaatcaatcctct

SEQ ID NO: 12507 - DNA, 101 bp, rice(Oryza sativa)
  misc_feature (71): n=t or c
ttttcttatccagcgatggtgagtgccactgtcccatagttgaaaaaatcagaccgggtcgtcagttcgantggaaaagtacggaaccagaagtctccata

SEQ ID NO: 12508 - DNA, 101 bp, rice(Oryza sativa)
  misc_feature (71): n=a or g
gatgttggtggtggtggtggttctgccactcccacctacttcatctgtcgcaaaaagaagtccaatcctgnatataaacctgaacacacacatatatctag

SEQ ID NO: 12509 - DNA, 101 bp, rice(Oryza sativa)
  misc_feature (71): n=t or c
atgaagaaggcctgggacaacatttggaagtgtaatgtgcccaacaaagtcagggttttcgcatggaaagnagcttccgactgtttggctaccatggtgaa

SEQ ID NO: 12510 - DNA, 101 bp, rice(Oryza sativa)
  misc_feature (71): n=t or c
ggaaaaggattattacagtttatcagtaaagcaatagtaccttgtgctgtgtcataagaggtcagaacagntgttgccttaagaggttcaattatcaattc

SEQ ID NO: 12511 - DNA, 101 bp, rice(Oryza sativa)
  misc_feature (71): n=t or c
ctatatttaatatttgggataaaacacaaatatggtaggctggtagctcgaattggcattataagtggaanggtaattaggccctgtttctttcagcttgg

SEQ ID NO: 12512 - DNA, 101 bp, rice(Oryza sativa)
  misc_feature (71): n=a or g
aacggttcttaaaaggttttgtctgtgggtgctaacagttcgtcccaaaaccgatataatgtatgatgcanagctttgtctttaggcctgtgggtgcaaac

SEQ ID NO: 12513 - DNA, 101 bp, rice(Oryza sativa)
  misc_feature (71): n=t or c
caaccactcggatcttgctcatccatagaaattgctagctatttcagctcttccaccaacagctcccatgngacactaagatcatcgactacgacgacttc

SEQ ID NO: 12514 - DNA, 101 bp, rice(Oryza sativa)
  misc_feature (71): n=a or c
ttggagactgtgtcgatgtccaaaacatgaaacaaaagagaaactggggtagtaccttttcttttggttcntcctactaaaaacacatatatgagcaaaaa

SEQ ID NO: 12515 - DNA, 101 bp, rice(Oryza sativa)
  misc_feature (71): n=t or c
caagtgcagagctacctatcaaatccaaacgcagtttcattacacgtgaggtgcgttgacatgttgtttangtgacgcttacttggcatttgcaatcaaaa

SEQ ID NO: 12516 - DNA, 101 bp, rice(Oryza sativa)
  misc_feature (71): n=a or g
cactgctggggtggggggcccaatgcagcagccaaaatgcgtgccatctatgatgcacatgttatacaatntactccgtaccccacgtacacatactccta

SEQ ID NO: 12517 - DNA, 101 bp, rice(Oryza sativa)
  misc_feature (71): n=a or g
tgaacattaagaaatgcggcaatcatgcttatttgaaaaggaaaatttgagcattagatattttcctactntctgcacttgatatgcagatatgcaagagc

SEQ ID NO: 12518 - DNA, 101 bp, rice(Oryza sativa)
  misc_feature (71): n=t or c
cttatccccttcgtcgagggggtaagtaatcttgtctcgccagctggcaacccgagcttgttcaccgaacngaatgagttcgacgaagggtgttctgccat

SEQ ID NO: 12519 - DNA, 101 bp, rice(Oryza sativa)
  misc_feature (71): n=a or c
ggtgtcgctcttccaaaggtgggaaaccctcaatcgtcaagttttgtagtttgtgtaaattacgggaagcnaacacattgtcatctaaaacttttagatcc

SEQ ID NO: 12520 - DNA, 101 bp, rice(Oryza sativa)
  misc_feature (71): n=t or c
acactttcctgtagactaaatatctcgtgttcctccccttcccaagttcgagggagcattcagccagctgntgcagcagcaccggctgctccttccccttt

SEQ ID NO: 12521 - DNA, 101 bp, rice(Oryza sativa)
  misc_feature (71): n=t or c
tgaaagctaatttaccgaaaagagttcaacaaaccccttcgagagcagcagaaaagattatataggaaatnagaacaaaatattaacaaaagatcccaatt

SEQ ID NO: 12522 - DNA, 101 bp, rice(Oryza sativa)
  misc_feature (71): n=a or g
tttttaaaaaaatgttcaaacccacaaatcaaatctgacatgtgagtctcaccgtttttattctttttatnctaaccagactaccacgtgtgtcacatgat

SEQ ID NO: 12523 - DNA, 101 bp, rice(Oryza sativa)
  misc_feature (71): n=t or c
tttgtccgtacagtctatatctcagttactagctgttgtgccagatgatagtttcttttttaaatcacacntatgtttaggatctaaaactttcagctact

SEQ ID NO: 12524 - DNA, 101 bp, rice(Oryza sativa)
  misc_feature (71): n=a or g
tttcggcctaagcccaaactgctccttcatgacatctgcgattagatcggcccatggttgttgttgaggcnttccttgaggctgctgtggcatgggctcaa

SEQ ID NO: 12525 - DNA, 101 bp, rice(Oryza sativa)
  misc_feature (71): n=t or c
ccgagaacgatgccggaggatgtggccggcggcatcaatggcgacattaatttgaatgaacttcaaatccnggcgattggggacgggattagagggggaaa

SEQ ID NO: 12526 - DNA, 101 bp, rice(Oryza sativa)
  misc_feature (71): n=a or g
ccaagatcgctacaccacccaagagttggcaacaaggcgaattaccttcgcacgcaagctgttcgagatcntggatagatgcgcccatgcagatgacgccc

SEQ ID NO: 12527 - DNA, 101 bp, rice(Oryza sativa)
  misc_feature (71): n=t or c
gacacgcgacgctgatacgtgatgttgctcgtcgtccatatgttgccatcctgccatcaggacatgtactncctccgtctcaaaataagtgcagttttata

SEQ ID NO: 12528 - DNA, 101 bp, rice(Oryza sativa)
  misc_feature (71): n=t or c
agacaaagaatcacgacctttcaagctgtaaagatttcctcatcgtcaccaagatgtcatctcccaaggtncagcagccaggcaagacccttagagatgaa

SEQ ID NO: 12529 - DNA, 101 bp, rice(Oryza sativa)
  misc_feature (71): n=t or c
gtccagaaccagttcaaaaactgagaaaaatctgtgggctcgtttgtacttgtacctcagtgagaacacgntcctcggcagctatggcgtccggagcacga

SEQ ID NO: 12530 - DNA, 101 bp, rice(Oryza sativa)
  misc_feature (71): n=t or c
tataactagcaacttacattttgcattggaagggacaaactcgaaggattttggcgattccttctcatccncctctgctggtggcgactccaacattgcat

SEQ ID NO: 12531 - DNA, 101 bp, rice(Oryza sativa)
  misc_feature (71): n=t or c
caacaggtgctgggtttccttctttccacactttccaaagagatcctcacccaagtcatcagtatggaatntgccgcacaagtatggaaggccatcacgga

SEQ ID NO: 12532 - DNA, 101 bp, rice(Oryza sativa)
  misc_feature (71): n=t or c
gggcgaaatacccacctgaatatattacttccaacgatcttacacaaggtgggtttcgcctatgcaagcgnaggagccctagaggataataggaaaaaata

SEQ ID NO: 12533 - DNA, 101 bp, rice(Oryza sativa)
  misc_feature (71): n=t or c
ctctgttaatacaagagtggcaaagcttccccttcttaaagaggaaaaaaaaagacctccaataaggaacngtacatgagaccaccaatattggtgtatct

SEQ ID NO: 12534 - DNA, 101 bp, rice(Oryza sativa)
  misc_feature (71): n=t or c
tcgccttcctccatgctcagcagggggtacactggctcggtctccggtaatccatccttcttgaagtcatncagttcccacagagttccgaagcgcagctc

SEQ ID NO: 12535 - DNA, 101 bp, rice(Oryza sativa)
  misc_feature (71): n=t or c
gaatacatcccgttgatatttttttcggatatcatgaaacacaagcttatatcccgttgaaaaatcacttnagtgatgtgtaatccagttgattttatcac

SEQ ID NO: 12536 - DNA, 101 bp, rice(Oryza sativa)
  misc_feature (71): n=a or g
ctatcatattggactctacaaaccatgttgtgtagtgtagcctcatgtcacatccaatccaccaattattnaataatgagaatatatattggccttaccaa

SEQ ID NO: 12537 - DNA, 101 bp, rice(Oryza sativa)
  misc_feature (71): n=t or c
catgccgtgacaacgcctccaagtcaaaaccggcgtgccttacaagtcaggccatcgccagttgtcgagcngtccgggtgctgcagcggccatcggtcgga

SEQ ID NO: 12538 - DNA, 101 bp, rice(Oryza sativa)
  misc_feature (71): n=a or g
gtcttcccttcagttaactttgtgtacatgtcgccatgtctctgaacattcggtccgacaaatgcaggttncgtcatgaagagcacgtacagctccaacgt

SEQ ID NO: 12539 - DNA, 101 bp, rice(Oryza sativa)
  misc_feature (71): n=t or c
gggtgactacgagatcgaacctccagaacacacttttgggacaccacaacatattgctagattacttgagngtgacagccaagttcaaagtcgaacaatgc

SEQ ID NO: 12540 - DNA, 101 bp, rice(Oryza sativa)
  misc_feature (71): n=t or c
agaagggttaaggggttatgcttcacttgcggagagcgctggggtaaggatcataaatgtgcacagactgntcaattacaggtggtagaagagttacttga

SEQ ID NO: 12541 - DNA, 101 bp, rice(Oryza sativa)
  misc_feature (71): n=a or g
aaaagagtggctccgacacagttgttaagcccctgtcgtcgtttatttttcattgatgtttgccatgcgtnaattcctaaacatctaatttattcaacatg

SEQ ID NO: 12542 - DNA, 101 bp, rice(Oryza sativa)
  misc_feature (71): n=a or c
aagaatttgaaacctatttaattactaccaaaacctaccaccatacccacaaatgcatgatcaaaatgtgnctataatctggtgaagggaggtgtaggtgc

SEQ ID NO: 12543 - DNA, 101 bp, rice(Oryza sativa)
  misc_feature (71): n=t or g
gtgtcatcttgacaagctcattgatggtgtgcgcttagttggtaagcatgatgatgacgttacagatttgnccttatctcaatggatgactacccgactgg

SEQ ID NO: 12544 - DNA, 101 bp, rice(Oryza sativa)
  misc_feature (71): n=t or c
aagtcctcatcttcttgtccttctgtctcttcctcgacttcttttcccttcttccccaacccttctttgcntactgtattatgagagcaaaaattagctaa

SEQ ID NO: 12545 - DNA, 101 bp, rice(Oryza sativa)
  misc_feature (71): n=a or c
tctttttatcctatggcaggattgctggagaaaattgaccatctatgcaaagctaaagaaatcatgcaggnagctcaaattcctagccccacatctctgcc

SEQ ID NO: 12546 - DNA, 101 bp, rice(Oryza sativa)
  misc_feature (71): n=t or g
atgattttgtagagccatcaagcgattccaagtgttcaagtaatggtaacctgcatcctaagaaggctatngtggaattaccggtccgtgtcgactttgtc

SEQ ID NO: 12547 - DNA, 101 bp, rice(Oryza sativa)
  misc_feature (71): n=t or c
ccgagcaatactaaggctctgttcgagagtatgtgttgccaatcctcatctctctcatttttcatacgcangtttttcaaaccgcttaacggtgtgttttt

SEQ ID NO: 12548 - DNA, 101 bp, rice(Oryza sativa)
  misc_feature (71): n=a or g
acacaggaatccggtgcggtcacacactgtcaccaccacattgtataacttctcggtggctagtagtaacncgcttgggttcgaaaacttcattagaaggg

SEQ ID NO: 12549 - DNA, 101 bp, rice(Oryza sativa)
  misc_feature (71): n=t or g
tgggagggaagggagcggatctgggcgatccgttgacgtagccgttctacaacagtcgtgtccctcgcacncatttcatcacaagaaattggacattctgc

SEQ ID NO: 12550 - DNA, 101 bp, rice(Oryza sativa)
  misc_feature (71): n=t or c
aggcatgatttcttcaaagaccatgaatttctcttcaggtgtcgcattttgaagcttttgttgtataaagnggctcccacactaatcaatgctaaaaaaga

SEQ ID NO: 12551 - DNA, 101 bp, rice(Oryza sativa)
  misc_feature (71): n=a or g
tgcagataaaaggaatgggatgaagctttgattcggcacataattttcactctcgatgctgatgaaatccnaaaaatcaagcttaccctaaatgtctgaag

SEQ ID NO: 12552 - DNA, 101 bp, rice(Oryza sativa)
  misc_feature (71): n=t or c
aaatgttgtattactataaactctcccgaacaaggacgaaggagtgcaagcagcttaaaatccacataacntccttaacgcctcgttattttctgattaag

SEQ ID NO: 12553 - DNA, 101 bp, rice(Oryza sativa)
  misc_feature (71): n=t or c
cactttgtgttatacaggaaatatacaacctttatatatctattgaaccgcggttcaaccaacggttttcnggtcggaccatcggaccggtgaaccgaggg

SEQ ID NO: 12554 - DNA, 101 bp, rice(Oryza sativa)
  misc_feature (71): n=a or g
ccagtgaaagaacatagaagaaagaccaacatcccaagaccaccacacagaaaaagaaaggggagataatnatcaagacctagctaggtcaaggtcacata

SEQ ID NO: 12555 - DNA, 101 bp, rice(Oryza sativa)
  misc_feature (71): n=a or g
catctttcacttgtacacggcattaattatcccatcagaccaccgagccctagctatgtgtatcatatgcnggtcaacaaagaggctgacgacggggctag

SEQ ID NO: 12556 - DNA, 101 bp, rice(Oryza sativa)
  misc_feature (71): n=t or c
gtaattatcatttttgttgtatctccaaagcagggagattctctgtgattctgttgcaccatgccatcacnttttcaatttatagtcagatatttactttc

SEQ ID NO: 12557 - DNA, 101 bp, rice(Oryza sativa)
  misc_feature (71): n=a or c
attctggtaaagcaactttgacagcatacagattacagacccttgtaacatgataactgtaaaacataggnctgccaacagaacaaaatattgcttcatca

SEQ ID NO: 12558 - DNA, 101 bp, rice(Oryza sativa)
  misc_feature (71): n=t or c
aggcgaacgggaatgagactgggatcgtgaatggtacctccttggacttctactcctactacggcttctgntataatgtcgccttctgcaccaggtaccat

SEQ ID NO: 12559 - DNA, 101 bp, rice(Oryza sativa)
  misc_feature (71): n=a or g
aatggagaattgggacattggaaaagcagaggagattttttcctaggaattcaaacatctgtgaacacctntttttttccttagctaggtccgaagcaaat

SEQ ID NO: 12560 - DNA, 101 bp, rice(Oryza sativa)
  misc_feature (71): n=t or c
atgagccattagtaaactgtaaacatgcctttttggtgctacctttttatcaactgcttacacaattatgnaacactggtgtgttatctatgcaagctgac

SEQ ID NO: 12561 - DNA, 101 bp, rice(Oryza sativa)
  misc_feature (71): n=a or c
ggtctacaagagcttgatatgcccccaatgccaaggctacttgcgactttaacaaacttctctgctgtggnttcaatgtaattgtgttttcttctactttc

SEQ ID NO: 12562 - DNA, 101 bp, rice(Oryza sativa)
  misc_feature (71): n=t or c
tattttctaatatatatactccaatatttagtttccaaaaagtgaataccaataaccaaacaagcagggcnggccctgagacagtgcggacggtgcgactg

SEQ ID NO: 12563 - DNA, 101 bp, rice(Oryza sativa)
  misc_feature (71): n=a or g
attgggccctaattttcagaataatttcttcttcctgcctgctgatggtaccagggggggtattattttgncagcagatgacaactactatagactttccc

SEQ ID NO: 12564 - DNA, 101 bp, rice(Oryza sativa)
  misc_feature (71): n=a or g
tttttgcataggcctcctgagcggcccaactactacacttggactctttctctctcattccactctgagcngaactcttcttgctcgccaccgccgccggc

SEQ ID NO: 12565 - DNA, 101 bp, rice(Oryza sativa)
  misc_feature (71): n=a or g
acgcaatattgcatataattctataagtaaatcctcgagaactggaagcaaagtaggattgatagagggtncttctgcctccaactcgcaactctctgcac

SEQ ID NO: 12566 - DNA, 101 bp, rice(Oryza sativa)
  misc_feature (71): n=a or g
aagtatgaaaagaaacataatatctagacaattaagcctttgattttttttatgggtgatagataccttanctaatctagatcgatgaaacaatttaacta

SEQ ID NO: 12567 - DNA, 101 bp, rice(Oryza sativa)
  misc_feature (71): n=t or c
cactctgcggtccagctcttcagtgctcccatcttatgcagatccaacaccttgatggccacagctgttcngctgcgcaacactgccttgtacactgaacc

SEQ ID NO: 12568 - DNA, 101 bp, rice(Oryza sativa)
  misc_feature (71): n=a or g
acacttaatggtagtagaatcgtggagggtacttttgcccaggaaaaattatctacggagggatattttcntcctttccccccgaatcgcgcatctggagc

SEQ ID NO: 12569 - DNA, 101 bp, rice(Oryza sativa)
  misc_feature (71): n=t or c
caagagctgcattgttacaagacactaatcccaacgctgcatacaagaacctctaaaacacattagggccntttgaaacgtaggattttaaaaacacagga

SEQ ID NO: 12570 - DNA, 101 bp, rice(Oryza sativa)
  misc_feature (71): n=t or c
caagcaaacaaaaacgttcccaaaagaacaggatgcttttgtctggaacatctgaatcaccactggaaaangttacaatgccaaagtctcaccctgataat

SEQ ID NO: 12571 - DNA, 101 bp, rice(Oryza sativa)
  misc_feature (71): n=t or c
tctaaataagaaccgacacctattctaaggtgtcggttttctaaaccgtatctttaatatattataggtgncggcttttaaaaaaacgacacaaacataaa

SEQ ID NO: 12572 - DNA, 101 bp, rice(Oryza sativa)
  misc_feature (71): n=t or c
gctcgtccatgattccaccgtggcaggaacggccggtgtatttttatctaaaatgactactcatcatggcnatttaaagtaactagtactccagttagggc

SEQ ID NO: 12573 - DNA, 101 bp, rice(Oryza sativa)
  misc_feature (71): n=t or c
taaatatggcgcttgatctaacaccatcgattagctaacacacatcaaccatgcaagtatatatgcaacanatgaacaaaattaacaattcacctgccgat

SEQ ID NO: 12574 - DNA, 101 bp, rice(Oryza sativa)
  misc_feature (71): n=a or g
ttttaacgttgagaaaaaaaagtttgagtagtagtgttgcatggattaacggaagcactagcacaccattnttgcaagttgcaacttgtgagtagatttat

SEQ ID NO: 12575 - DNA, 101 bp, rice(Oryza sativa)
  misc_feature (71): n=a or g
actcccagcgctcctctttctcccatcatggtttcatggaattgttccttctggctgcttggaacatctgnaaggagagaaacggtctgatctttcaaggg

SEQ ID NO: 12576 - DNA, 101 bp, rice(Oryza sativa)
  misc_feature (71): n=a or g
cagaggagaaaccagaggaagctgagaagcctactgaacccacacatgatgagatcatggacagctcacanattgagctgcctgaggtagacatagtgaag

SEQ ID NO: 12577 - DNA, 101 bp, rice(Oryza sativa)
  misc_feature (71): n=a or g
catatatatactcaactgaaaccctaatctaattccccactcccccctcctaccccaatcacacaatggcngcggctgcgcaagcaggtagtggcggcgcg

SEQ ID NO: 12578 - DNA, 101 bp, rice(Oryza sativa)
  misc_feature (71): n=t or c
ttgtaagttctgtcttactacaacatttctactaaatgaaataaactaacggtggtttgtggtgaacttgntaccctcaccacctctttagttgatgtctt

SEQ ID NO: 12579 - DNA, 101 bp, rice(Oryza sativa)
  misc_feature (71): n=t or c
tcgacgtggagaggagaggagagaggaagtgagttgagagggagggtaagaagtggctgacatggactgtntgacatgtggggcccacgtgggtcctacgt

SEQ ID NO: 12580 - DNA, 101 bp, rice(Oryza sativa)
  misc_feature (71): n=a or c
cagagcaaggcgccgatggtttcctcctccgtgaatccgtgatcgatctgcaaaagaaaattaagggacgntgttgtacgccggcgtgctggtgtagatga

SEQ ID NO: 12581 - DNA, 101 bp, rice(Oryza sativa)
  misc_feature (71): n=t or c
atcagctgaaccctttgagcattggttcaagcatttctatgatggtttcccaaacgatacagaaatgtggnatgcctatgaaaatttcgaagactttgaat

SEQ ID NO: 12582 - DNA, 101 bp, rice(Oryza sativa)
  misc_feature (71): n=a or g
tagactataatatccaatagtagcagttaagctgagttggcatctcctcagcacacaattggttgaaactngaaacattgtcctgatgttttccaatccca

SEQ ID NO: 12583 - DNA, 101 bp, rice(Oryza sativa)
  misc_feature (71): n=t or c
tggaaactaaaatataatgctgtacctttagtgtcatgtcacactgatcccaagttgctattacaattggncatcttcttgcagcttcatttcgcaaattc

SEQ ID NO: 12584 - DNA, 101 bp, rice(Oryza sativa)
  misc_feature (71): n=a or g
gtgaatccttgtgagccctaacaatctggtatcagagcccttccgtgctgcatttcctcttgatttggctntaaatttttctccagagcgaggtgggattt

SEQ ID NO: 12585 - DNA, 101 bp, rice(Oryza sativa)
  misc_feature (71): n=t or c
ccacaccacagttgcactagcttaaaaatacgaccaaccatagttctctcagccttaaatcaagaaaaccnagataaaacttgaaactctcttagtattaa

SEQ ID NO: 12586 - DNA, 101 bp, rice(Oryza sativa)
  misc_feature (71): n=t or g
cttcgtctaatgttacggctggcccgccatgctaaagcattggctcttcatcaccatcgactttgttgccngctcgctgccggcgccggcgccggccatgc

SEQ ID NO: 12587 - DNA, 101 bp, rice(Oryza sativa)
  misc_feature (71): n=t or c
gactcgtaacgggcggataaggtactcaatctttcatatatagagagctcctaattctgttttcctcgtanatctatctgcatttcatgagtgagctgagc

SEQ ID NO: 12588 - DNA, 101 bp, rice(Oryza sativa)
  misc_feature (71): n=t or c
tgctccttcatacataaaagaactagactttgattgatgccattattcaactctaccttactattgactanagcacttgcctaccacctttctcaacacac

SEQ ID NO: 12589 - DNA, 101 bp, rice(Oryza sativa)
  misc_feature (71): n=t or c
atgcctatgttattcacctgtgaatggtattggatctatgagcacgggagcccatcacggtcagagatagnagttatatccgtgtattgtcccattttgtc

SEQ ID NO: 12590 - DNA, 101 bp, rice(Oryza sativa)
  misc_feature (71): n=a or g
tccgatgtttttttctttaaattagatggatccgatataaagtccacatcctttggagcatctacactgcncttcttcaatgtttttttctttaaattaga

SEQ ID NO: 12591 - DNA, 101 bp, rice(Oryza sativa)
  misc_feature (71): n=a or c
aaaaaaaaaaaaaaacagtactcccctacacaaaaacaaacgtatagtaggagaaagatagtatacctccntcctaaaataagtgttgttttgcactattc

SEQ ID NO: 12592 - DNA, 101 bp, rice(Oryza sativa)
  misc_feature (71): n=t or c
taattcaaaccgacataaatatcataattatatacaattgccaaacgagctcaatctctttatggaaatancagttattccaatctatgcccaaaccgagc

SEQ ID NO: 12593 - DNA, 101 bp, rice(Oryza sativa)
  misc_feature (71): n=a or g
gaagaagtcgacgaggacatccatggcagaagcaaccagaatgaaggagtcggacgccgatgaccccctcnagctatacaaaatggggttaacccgactat

SEQ ID NO: 12594 - DNA, 101 bp, rice(Oryza sativa)
  misc_feature (71): n=t or c
tcttctcttcttgtaaaactagcgaaacaacgtgcagttcatcttgttattccagctccagctagcgtctncatgggttccaagaaggatgcccaaacctg

SEQ ID NO: 12595 - DNA, 101 bp, rice(Oryza sativa)
  misc_feature (71): n=a or g
agaatggaagaacaagtaaaagtgctgaatgaatgggttaagacaagaaaaaagaatgcatagtccagccnaaatgtcaggttggttgggcctggcagcaa

SEQ ID NO: 12596 - DNA, 101 bp, rice(Oryza sativa)
  misc_feature (71): n=a or g
aaggggaagaaatcccctagttcctcaaaagttcattcggatcggcctgggaaggtgggtttaccagcccnttccactctagaccctagggaaatcttgtt

SEQ ID NO: 12597 - DNA, 101 bp, rice(Oryza sativa)
  misc_feature (71): n=t or g
ttcttctatcggtatatgccaaaacgtattgccggctgacactatatgtagtgacttgtcgacattgcttncatcaacattggcacatgcatgccggtcca

SEQ ID NO: 12598 - DNA, 101 bp, rice(Oryza sativa)
  misc_feature (71): n=a or g
cccacacctggtcttgtctctctattcgcaaaaacggggacagtgcgccagaaggttaggtttacggatcnatctgtgccgcctccttcgtacgccgctgt

SEQ ID NO: 12599 - DNA, 101 bp, rice(Oryza sativa)
  misc_feature (71): n=t or c
ctctaagatggcctgctctgccaagaacgcctacgagcaggcacttgaggagctggacgaacttcgtgatnggtacaccaacttagaagcccgttaccagc

SEQ ID NO: 12600 - DNA, 101 bp, rice(Oryza sativa)
  misc_feature (71): n=t or c
gttcccacgttgctttttggctctgttgcgtttgcccttgccaaatgaacttccagtctgggtattcccgntgggaacatttttcttctcattcgcattta

SEQ ID NO: 12601 - DNA, 101 bp, rice(Oryza sativa)
  misc_feature (71): n=a or g
ttcttcgatcccttccccttcctcttccaacccttgtcaggcatcggcttggcgcgcttcttcttcttccngacggaagacctcgccatcgcctgcccctc

SEQ ID NO: 12602 - DNA, 101 bp, rice(Oryza sativa)
  misc_feature (71): n=a or g
agggcaatggtaagttatatatgatatatgtatctctataccacccatcagtcatcatgtatacttagatncacatatttgatccgcattactaaccatta

SEQ ID NO: 12603 - DNA, 101 bp, rice(Oryza sativa)
  misc_feature (71): n=t or c
aactccaacaccaatcccacgctccttggtatcatagaaagctgtgaagcttgttgcacagggaaccaagnagaacaaatgcaaaacttcgttgcattcaa

SEQ ID NO: 12604 - DNA, 101 bp, rice(Oryza sativa)
  misc_feature (71): n=t or c
ttcttttattaaaaaaacgatgggcccaaatgtcatatctctcttctctctatctttatcctctctcaccnctctctctctccgccgctcgccgctctcct

SEQ ID NO: 12605 - DNA, 101 bp, rice(Oryza sativa)
  misc_feature (71): n=t or g
cgtacgcaatatatcagtgcagcatctatacaacttccgaatatagctaagctaccgcggccttgtttagntcacgaaaagaatttttttgggtgtctcat

SEQ ID NO: 12606 - DNA, 101 bp, rice(Oryza sativa)
  misc_feature (71): n=t or c
tatatagctcttcaagaatgtcttattttagccattccaactatgatacaacaaatggtgatctggatccngcagctattctcattccagccaatgataac

SEQ ID NO: 12607 - DNA, 101 bp, rice(Oryza sativa)
  misc_feature (71): n=t or c
attcagttaattgctttacatcgatgtatcctgcatttgtccaagactactcgtcccgccagcacacgtgntcgtaacccgagtgagagttggtattcatg

SEQ ID NO: 12608 - DNA, 101 bp, rice(Oryza sativa)
  misc_feature (71): n=a or c
gttgttatagaaagggttattttgcagttagcagtaaagcagaaacagcttgacgtacataagcatagccntgagatccagtctatttttttgtcatgttg

SEQ ID NO: 12609 - DNA, 101 bp, rice(Oryza sativa)
  misc_feature (71): n=a or g
tggtgctggtgtggcagcactagcggatagggttctacatacggcggtgcgtggctacgtgcgttcatggngtcgaggcgttgagtagttgtacttcgatc

SEQ ID NO: 12610 - DNA, 101 bp, rice(Oryza sativa)
  misc_feature (71): n=a or c
atcttcatactggatgttgatactctacctgataggtgaaggcttgttttgcaatgcatcctatttcctantactagaaaatttctgggaaaaaaatggtt

SEQ ID NO: 12611 - DNA, 101 bp, rice(Oryza sativa)
  misc_feature (71): n=t or c
ctttgccactgctactactacctctctgtgaatctgtgcagtttcattgtacgctgatctctctggtcgancaccggcttagctgagagatcctactcgtg

SEQ ID NO: 12612 - DNA, 101 bp, rice(Oryza sativa)
  misc_feature (71): n=t or g
atggtgacctagggtgcaaatccgatagccaatgccatcgtatatgcatgtatcgtgtataataaggatgngtaaatttcataataggctcatcaattatc

SEQ ID NO: 12613 - DNA, 101 bp, rice(Oryza sativa)
  misc_feature (71): n=t or c
gcgcccttctcggtctccagcaggtcgacgagctgctggttcaggtcagacgggggtacagtgacgaatgntgtggctgatgggatctcggtcgtcttctc

SEQ ID NO: 12614 - DNA, 101 bp, rice(Oryza sativa)
  misc_feature (71): n=t or g
aaataggacagcagggggcgtgagggaggatcaggcggcgttcacgtacagataaatataatgtgatttgnttttctttttcaaaagataaatctaatgag

SEQ ID NO: 12615 - DNA, 101 bp, rice(Oryza sativa)
  misc_feature (71): n=a or g
tgagttcactgaaactgtaatctctgggagaagacaaggacatgtttgagtttcggttgatcactgacatnaccattgtaatctgcaagagtagaagaaat

SEQ ID NO: 12616 - DNA, 101 bp, rice(Oryza sativa)
  misc_feature (71): n=t or c
agagaaagagaggagaaaaatatcagcgaatcaacaccgagaaaaccttctcatggaagctgacagttcgngagtggtgcttaggtcggcccagccacgac

SEQ ID NO: 12617 - DNA, 101 bp, rice(Oryza sativa)
  misc_feature (71): n=t or c
cactccattgttggctttggtcgggaaaggatgtttcatctcgcgttgggagcaaattaacgacgggtgcncggaccgatggatgacgaagatggtcatca

SEQ ID NO: 12618 - DNA, 101 bp, rice(Oryza sativa)
  misc_feature (71): n=a or g
gcggtggtggttggggcgaccatgggattggatttgtggccttgtgggtagcaattggatcgtgctcatcncggcccaataattattgggccttatgaatc

SEQ ID NO: 12619 - DNA, 101 bp, rice(Oryza sativa)
  misc_feature (71): n=t or c
gtcatcgtaaaaattttaaaatagatacgggcccaaatgtaagtgactacctctcatcccctctctctctntctcccgtgccgtgcagccacactcgccaa

SEQ ID NO: 12620 - DNA, 101 bp, rice(Oryza sativa)
  misc_feature (71): n=a or c
tcatattataagttgttttgactttttttctagttaagatttgttaaacccgaacaaattcacatgaaaanaatagtaacacttaaaatattaaattattt

SEQ ID NO: 12621 - DNA, 101 bp, rice(Oryza sativa)
  misc_feature (71): n=t or g
aaatgacatctggtttgagttcactgaagatgaagaaaaaacaattgaaaatcatgcagccataaggtaanctgttaccatgcttgttttctttatttaaa

SEQ ID NO: 12622 - DNA, 101 bp, rice(Oryza sativa)
  misc_feature (71): n=t or c
gccatacatccaacaaggggaatttgttattctgacaaaccaccacagcctaatgcatttgtctgaacaanggttgcataccccttggcaacaaaaagctt

SEQ ID NO: 12623 - DNA, 101 bp, rice(Oryza sativa)
  misc_feature (71): n=a or g
cgagacctaaattatgattagtggggtgtactccgatagaacagtttacagttcagaactcaaaagctacnaatgaattcatgacaaaaggcgacaagtga

SEQ ID NO: 12624 - DNA, 101 bp, rice(Oryza sativa)
  misc_feature (71): n=t or c
cgctccgtgtcttggcattggtgttgtgccttgagtgacttgtgctcttcatcttgatacttctctaatgnattctcttcttcttcttcttcttcttcttt

SEQ ID NO: 12625 - DNA, 101 bp, rice(Oryza sativa)
  misc_feature (71): n=t or c
cgctcgatgcgcgagaccaggaacagtccgagcacgaagtagttgtcggagaggagcaccatccagtcgangcgccacaatgcgtccagcccgtcgtcgca

SEQ ID NO: 12626 - DNA, 101 bp, rice(Oryza sativa)
  misc_feature (71): n=t or c
atggcgatcagtcaacaacagtgcgcaacaagatttctctggatcctttaggaagtacttcctccgtactnataagagcaagtataatagtgagctataaa

SEQ ID NO: 12627 - DNA, 101 bp, rice(Oryza sativa)
  misc_feature (71): n=a or g
tatattttcttcatttggtgatttgttttggagaagagcatgaaccctaggtttgtcgtttttgtgagacnaggaagatcgacttcatttatcggttaggt

SEQ ID NO: 12628 - DNA, 101 bp, rice(Oryza sativa)
  misc_feature (71): n=t or c
acaaccaataaattatgaggtaatatgtataatgtaggtttgctactactccctctgtcatataataatanaagggattttgagtttttgcttgcaacgtt

SEQ ID NO: 12629 - DNA, 101 bp, rice(Oryza sativa)
  misc_feature (71): n=a or g
ccagagtgtatcctcactccactagtgctctgctgcatgtctaaattagaccctctgtctcataatataanggattttgtatttttggttgaactgtttga

SEQ ID NO: 12630 - DNA, 101 bp, rice(Oryza sativa)
  misc_feature (71): n=a or g
atcgataaattagtgccatttacagggatggaagctcgcgcttctgagctatagctaaacttattttctanatgctatgttaaagaatggggaagcaacaa

SEQ ID NO: 12631 - DNA, 101 bp, rice(Oryza sativa)
  misc_feature (71): n=a or g
ttacctagcttctgataaagttttccattcactttaaagaatacatccggatcataattctttttgcgacnctccttttcaaccttgcttcgtctaggagc

SEQ ID NO: 12632 - DNA, 101 bp, rice(Oryza sativa)
  misc_feature (71): n=a or g
gaagcacaagcttcgacacaaagcgtcggtgtcctctctccctatgcatcctcacaagagctgcgccatcnccgccaccgaatcgtccagcgaggaggccg

SEQ ID NO: 12633 - DNA, 101 bp, rice(Oryza sativa)
  misc_feature (71): n=a or g
gtagttctttacctcgcaatacaatatttcttcacgtgccacctctgatgctaaccgatcacagatacccncaacattcagttgcttgcgcataccacgtt

SEQ ID NO: 12634 - DNA, 101 bp, rice(Oryza sativa)
  misc_feature (71): n=a or g
gccttacagcctctgacaacccccaccacgatcacgatggattataagtgttggaagactagaggtcggcntaggggtgtcactcacgcgacgaatgcttg

SEQ ID NO: 12635 - DNA, 101 bp, rice(Oryza sativa)
  misc_feature (71): n=a or g
agtgctttaagtgaacctgcaaatacgctgagttatacaacagtcatgaatcaaaattttggaagcaacancatggttatattgttgattcaataagtttt

SEQ ID NO: 12636 - DNA, 101 bp, rice(Oryza sativa)
  misc_feature (71): n=t or g
aagcattgagtgtattctgtgagatgcaagctgctcagatgccttgcactcaagttacatactcgagtgtnctccgggcttgtgcaagcacagcatcaata

SEQ ID NO: 12637 - DNA, 101 bp, rice(Oryza sativa)
  misc_feature (71): n=t or c
ggcttacagcacacatctcttttgtggttcccgtattcttctcaagcaaacactgaaaacactactccacnatatgtcagtaggtcgcacatttacaacac

SEQ ID NO: 12638 - DNA, 101 bp, rice(Oryza sativa)
  misc_feature (71): n=t or c
cagtgaggtaggtgttcatgaaaattgagtagccaagaatctgcgcatagactgtggaaacagatagccgngatgaagcactgtaacctatactacagcaa

SEQ ID NO: 12639 - DNA, 101 bp, rice(Oryza sativa)
  misc_feature (71): n=t or g
aaatcttagtaaaaaaatcactaacgtctttatgttttctcacaatatccacaagaaccaattggagttgntgagcaaaacagtgaacataataagctgaa

SEQ ID NO: 12640 - DNA, 101 bp, rice(Oryza sativa)
  misc_feature (71): n=t or c
ggattcatgccgaggtgacactttgggtgtgtatgttagagttcactgaaagagagcgaacatttggctcnagaaatacttttgtcgttggaaattcctcg

SEQ ID NO: 12641 - DNA, 101 bp, rice(Oryza sativa)
  misc_feature (71): n=t or c
gaaaaaggtaagaaaccaaagctgtggaaagcatgaaggtgaaatggaagtgtgacgcaagatgggattcnctgattgatgtcatgtatgcttatgtcacg

SEQ ID NO: 12642 - DNA, 101 bp, rice(Oryza sativa)
  misc_feature (71): n=t or g
tctcctcatataatcccaagaacctagccaagagatgatgtattgtcacttctaaattaccagcaaaatanccatgctttgctatgggtaaaagaaaatat

SEQ ID NO: 12643 - DNA, 101 bp, rice(Oryza sativa)
  misc_feature (71): n=t or c
gccttaacggtgccttgaggcttcttctcatgttcatccaaccgcttcatgagaaggtccagctttgcagngagcatttccgtctccttgacggtgtgcat

SEQ ID NO: 12644 - DNA, 101 bp, rice(Oryza sativa)
  misc_feature (71): n=a or g
cggcgcgggccggcgatttttttttgttcgtttcctccattctcgcaggcgggccgttcgttgtggtgcangcggacctctctcccgcctgggaaaattag

SEQ ID NO: 12645 - DNA, 101 bp, rice(Oryza sativa)
  misc_feature (71): n=t or c
gcaagttgtaaatatgggtgcaacagcacattctgttagagaaacatcaacaacattttgcttcctggagnccttcctcttcttcagcggtttcatgcact

SEQ ID NO: 12646 - DNA, 101 bp, rice(Oryza sativa)
  misc_feature (71): n=a or g
gcgaaggcttggggtgatgatcagatgtaggccacctctcctctccttccaaaggctccatgcaatgatcntatgttttcttatactcttcaattgaatag

SEQ ID NO: 12647 - DNA, 101 bp, rice(Oryza sativa)
  misc_feature (71): n=t or c
aaagaaatatttgcttatgttcccctatgcactttcaattaaaaagtgtcgtgtttgctatggggttgttnagattgatgtcattttcaaccatatatttt

SEQ ID NO: 12648 - DNA, 101 bp, rice(Oryza sativa)
  misc_feature (71): n=a or g
ggggagagctaagattagggcggtgcatgacatgaatttttgaaggtggtgccggttcttatgggaggcgncggcggcgttagttgggctcgggtcgatgg

SEQ ID NO: 12649 - DNA, 101 bp, rice(Oryza sativa)
  misc_feature (71): n=t or c
ttaagagatgggaggggaggagcgtcttccttccttgttgtttggggttgcggggaaagtacgcgatgctnggcttgctgccccccctttttcactctgcc

SEQ ID NO: 12650 - DNA, 101 bp, rice(Oryza sativa)
  misc_feature (71): n=a or g
actgatcaaaattaaccagtgagagcacatgtagtaaaaaagctattggcactgtggtaattactcaagtnaaaaaaaaaggggttcaatttttgtttctt

SEQ ID NO: 12651 - DNA, 101 bp, rice(Oryza sativa)
  misc_feature (71): n=t or c
aaaacaaattagagtgttcatatcatgtggatatctgtacaaactctgcaaagcctaaaactgtcacatcnagaaatttagcccaaattttcagactattt

SEQ ID NO: 12652 - DNA, 101 bp, rice(Oryza sativa)
  misc_feature (71): n=t or g
aatttaaacatcgtcttaaaaaaggagcagagcaagcttaagtgatcgaaaaaaaaaagaattagaggggnggaacaggttgggccgctctatagctccac

SEQ ID NO: 12653 - DNA, 101 bp, rice(Oryza sativa)
  misc_feature (71): n=a or g
attcgacaacacatatcctctatcccgtggcgatacgttgagggattagctcattggtggcatttgcaacnaccgtcattcctcctttcttaggtactact

SEQ ID NO: 12654 - DNA, 101 bp, rice(Oryza sativa)
  misc_feature (71): n=a or g
atggagcacacatgtagctattttggttatttcaggtgtcatgctttattgagcagtgcataaactggttngtctcatcattaccacgctcacaatcatgt

SEQ ID NO: 12655 - DNA, 101 bp, rice(Oryza sativa)
  misc_feature (71): n=a or c
cagcgcgacggcggtggcgctcctccggatccatgctctcaggcgcaacgacagtgagcagggagggagcngctcgtccattgcggcagatcggcagtgac

SEQ ID NO: 12656 - DNA, 101 bp, rice(Oryza sativa)
  misc_feature (71): n=t or c
tagtaggagtatgcactctaacgttattagcggctagtattctcattaatatagtaataggttaacactangaaggatatagaatatcttatgcttttaaa

SEQ ID NO: 12657 - DNA, 101 bp, rice(Oryza sativa)
  misc_feature (71): n=t or g
tgagtgctgtgctgtccacatccatagtctggacataactaatggcattgactggttcccaactatgaaanttcttcagagatactccatctagtccagtc

SEQ ID NO: 12658 - DNA, 101 bp, rice(Oryza sativa)
  misc_feature (71): n=a or g
gctcgcatggatctctgacacgttgtgtcctctgctgctgctcaattcttcaggacaaagccgctggcgtntgacccggcgagcttgcccaagctcccgct

SEQ ID NO: 12659 - DNA, 101 bp, rice(Oryza sativa)
  misc_feature (71): n=a or g
cggccatgaaaacaccgaagaaaagtggagtgtaattgtcctcgaggttgtcgccgatgtcttcgagattnttgaaggtgttgaagtcgtcatcatagttg

SEQ ID NO: 12660 - DNA, 101 bp, rice(Oryza sativa)
  misc_feature (71): n=t or c
tgggggttggagtggattacggtgcgtgttttctgcatgtaataatcaatctgtgtggttcggcgaggttnttttaccggagatttctgctgtttttttgg

SEQ ID NO: 12661 - DNA, 101 bp, rice(Oryza sativa)
  misc_feature (71): n=a or g
tataagaaacatgtgttagtaacaaaacgggatgaaattatgcccatgatggtggaatcatttttcatctntcttgccaatttataagactgacattgaac

SEQ ID NO: 12662 - DNA, 101 bp, rice(Oryza sativa)
  misc_feature (71): n=a or c
tgagacctgggtactgttccttcctgaagatccgaacaaatacttgctggcacgaattaagaaaaacacangcatgtgtggtcgacagcgctgcaaatagc

SEQ ID NO: 12663 - DNA, 101 bp, rice(Oryza sativa)
  misc_feature (71): n=a or g
tagtttgaatgaagcttagtaggtcggagccttatgtgtactgggaagacataccacgtcgaccgaatcgncgtggtgaagcctggggccagtattaccag

SEQ ID NO: 12664 - DNA, 101 bp, rice(Oryza sativa)
  misc_feature (71): n=a or g
aatcattatcaacagtagtttgtccaattgaatcaacattggcacaatcaaggagtaccgaatttgatacntctgaggaatctatcctatgttcaataaaa

SEQ ID NO: 12665 - DNA, 101 bp, rice(Oryza sativa)
  misc_feature (71): n=t or c
cctagtcagacatagatagggtaacaagcagagtaaaattcatctggatacggtttagaattgagatcctnggcagcgcgcccgtgcggaagtgcatcttg

SEQ ID NO: 12666 - DNA, 101 bp, rice(Oryza sativa)
  misc_feature (71): n=t or g
ccaaacgcattagtttctttcatagatcctatgataagatagaggaacaaatctaccacgcatagctaccntaagttcttcccaagtagtaggtaaaaccc

SEQ ID NO: 12667 - DNA, 101 bp, rice(Oryza sativa)
  misc_feature (71): n=a or g
caggccatacaaaggctacaaaattattagcaatgtcgtaaaacttgatattgcgtggccagcaatttttntacggtgctatttctcaatttctttagatg

SEQ ID NO: 12668 - DNA, 101 bp, rice(Oryza sativa)
  misc_feature (71): n=a or g
atagactagtaagcactattgacttgatctacacttcctttctcctcaggtataaccaattgtttgcaccntagaagtagatatttacagtagtcagttat

SEQ ID NO: 12669 - DNA, 101 bp, rice(Oryza sativa)
  misc_feature (71): n=a or c
aagttaaacatgctaatgtaaatgattccctgaaggaatactctgttgagatctacgaatggtctgggacnagctggaagccgtatgttgctgatgatgtt

SEQ ID NO: 12670 - DNA, 101 bp, rice(Oryza sativa)
  misc_feature (71): n=a or g
atcctgtgaatacacatacaaacattatctcctacaagaggaaaatatttgtaaaaaaaagccaagaaaanttatatagatccgagagactactatatatt

SEQ ID NO: 12671 - DNA, 101 bp, rice(Oryza sativa)
  misc_feature (71): n=t or c
ctgttgatcggctcaatcaacgaaatccccgaaaacgagcgggtgcactccacttattactattatgctancaatattattaagaataaaatagttattta

SEQ ID NO: 12672 - DNA, 101 bp, rice(Oryza sativa)
  misc_feature (71): n=t or c
caattaacccttttatttatacaatagagatgttctagatcgtcttcatatggttacaaagacaccttctnaaagcgtcataggaacgtatttgttgagac

SEQ ID NO: 12673 - DNA, 101 bp, rice(Oryza sativa)
  misc_feature (71): n=t or c
ggcgaaattatccttagattctcccttatctctcacatctcccccaaatcacatttgatttctcctctatngaggtgccgctgtcctgtgtgcatcgtctt

SEQ ID NO: 12674 - DNA, 101 bp, rice(Oryza sativa)
  misc_feature (71): n=t or c
tgtggatggtagagcgagacagccacctcgccccgacgaagctggaactcatctaggaaggcctgctcgangtcgcgcggtgtagtggtcgacggcgcgtg

SEQ ID NO: 12675 - DNA, 101 bp, rice(Oryza sativa)
  misc_feature (71): n=a or g
tacagttgaggtcgactgaatagtgaagctctgaacgttatacgcattgaggcgtaaggtgttaggagcancacttcgactttagatttgggttttgtctg

SEQ ID NO: 12676 - DNA, 101 bp, rice(Oryza sativa)
  misc_feature (71): n=t or g
gatgaaatcgttcaccttcatgttaaagactcgaacaatcacatctggtctgtcagatggttgctgaccangctcgaagcggatagtttcagcaatctctt

SEQ ID NO: 12677 - DNA, 101 bp, rice(Oryza sativa)
  misc_feature (71): n=t or c
acattatagcaaatgatatacatgaactaaatcaggaactggagagcattagatcagagagtacactgctncatctgaatccagtggcagaagatcaaatc

SEQ ID NO: 12678 - DNA, 101 bp, rice(Oryza sativa)
  misc_feature (71): n=t or c
aaccttgtaatctccaactttaaacttgtaatcttttgggctgtaataaataacttctatcgtcagatttntgtcttcaaattttgctttttgaaatccaa

SEQ ID NO: 12679 - DNA, 101 bp, rice(Oryza sativa)
  misc_feature (71): n=t or c
agggtttcccaaccggcaccaagcccgattttttaccagtcagtggtaaaggctgggatcaaacccaggancactgggttgtgtgatgcatgcactaacca

SEQ ID NO: 12680 - DNA, 101 bp, rice(Oryza sativa)
  misc_feature (71): n=a or g
atctactgctgttagattatttttttgcgacaaattgattcgctttattgtcttttggcatgcatgtaccngtgcctgatgcttttgccgatccaacgaac

SEQ ID NO: 12681 - DNA, 101 bp, rice(Oryza sativa)
  misc_feature (71): n=a or c
taattttgtttgcgtggataattccagcctgattcgcacggaagtcaagattcgtacgaaagtcaagttantataccaaaatgaactatttacaacttgtt

SEQ ID NO: 12682 - DNA, 101 bp, rice(Oryza sativa)
  misc_feature (71): n=a or g
ccaaagtttctacctgaagttcatcattccaatctataatgttctctcttctgttcaaccaacgccgcttncttgtcttctcagcaatattttatttaccc

SEQ ID NO: 12683 - DNA, 101 bp, rice(Oryza sativa)
  misc_feature (71): n=a or g
tttaagttcgtattaactgtagcataggtgtaatttagttttgttttttcttcatgttacatgtttgactncatttggtttgtgatgccaaatggcctgaa

SEQ ID NO: 12684 - DNA, 101 bp, rice(Oryza sativa)
  misc_feature (71): n=t or c
tgggggttggtgatgggcccccagccagcctaggcccagggccgaccctcacatcggatatatgaacacanatttgaagtattagacgtagtctataacta

SEQ ID NO: 12685 - DNA, 101 bp, rice(Oryza sativa)
  misc_feature (71): n=a or g
aggaaaagaaaaaggttcttactccaaggcaatcttgcatactccaaattccttccctcacaaaagaaaangagaagaaagaaactgttgaagctgaaact

SEQ ID NO: 12686 - DNA, 101 bp, rice(Oryza sativa)
  misc_feature (71): n=t or g
ccctccgtcaaaaaaaacctaatctagttgggaatgacagtacctaactaggttaattagggttttttttnatagtgaaaataactacttgtattattttc

SEQ ID NO: 12687 - DNA, 101 bp, rice(Oryza sativa)
  misc_feature (71): n=t or c
tgagtgatttgggatattagaaaccatgcagaaaaagtaaagtgagcctgataccaagctcaattcaatcnggtttggaatgttaaacttttaatatagtc

SEQ ID NO: 12688 - DNA, 101 bp, rice(Oryza sativa)
  misc_feature (71): n=a or c
aagggactatcgctatcgctaccgctaccacaaggaggagaagagctgccatggaatggaaggagaagatngccgtagcttagctagcagtagcatccatg

SEQ ID NO: 12689 - DNA, 101 bp, rice(Oryza sativa)
  misc_feature (71): n=t or c
ccataaatatttgcatgatgtttaaggagtggatggactttcctttgagaattaaaagccagttagaaacngaatgtgaaaacaatatttggctgataaag

SEQ ID NO: 12690 - DNA, 101 bp, rice(Oryza sativa)
  misc_feature (71): n=a or g
tttgtgcttgctgttgctgctgctgactgctgttggttagccggttgccatccaagtggagcaagcaagtncgtcgtcgtggcagtggagggacgtactac

SEQ ID NO: 12691 - DNA, 101 bp, rice(Oryza sativa)
  misc_feature (71): n=a or g
atgtccaaaatggatggatcgtgcttagctcatgggagtagcatcgatatattggccctgtttggatctgnagggctatttaatagcctttcagaatcttg

SEQ ID NO: 12692 - DNA, 101 bp, rice(Oryza sativa)
  misc_feature (71): n=a or c
ttaaaattagacgggggagtgacagttttgaagcgttgatgacataaaagtgggcatccacaatgtgcatntaaagtggatagtaaggaataaaatactac

SEQ ID NO: 12693 - DNA, 101 bp, rice(Oryza sativa)
  misc_feature (71): n=a or g
tgatgaggaaatacattaaagcacttgtccctctgactagaacgtaatttcaaagcattgttaacttcagncattcaacagccaaaagtaacatttttacc

SEQ ID NO: 12694 - DNA, 101 bp, rice(Oryza sativa)
  misc_feature (71): n=a or g
ataaaaagttatagaatcttttgaagaaatcaaataagatagatcatcaatacgtgataactttataaatntacaaattcaaattggaaaaacaaaaataa

SEQ ID NO: 12695 - DNA, 101 bp, rice(Oryza sativa)
  misc_feature (71): n=a or g
cgggcgtacatgtgtgcaggatcggaactcgtccatgtgtttaccgacgggaaactgttttaagagcagtngacgtctacccatttattacatatcatcta

SEQ ID NO: 12696 - DNA, 101 bp, rice(Oryza sativa)
  misc_feature (71): n=a or g
gattcggagtgtcatgccctgcgcatggcccggcatcgcaacttgattaggatactcaccacatgttctancctggatttcagagctttggttcttcccta

SEQ ID NO: 12697 - DNA, 101 bp, rice(Oryza sativa)
  misc_feature (71): n=a or g
tttttcctcttcatcttgggctgtgacatatatatgataaaaatgtctattttctcaccctcctctttggnctgtgacatatatataactaaaataagtct

SEQ ID NO: 12698 - DNA, 101 bp, rice(Oryza sativa)
  misc_feature (71): n=a or g
ctagcattgtactggcaactaccagcatcttgctagatcttctcatcaatcgtatcgagccggatctctcnatccgatcatgatgattatcaactacctca

SEQ ID NO: 12699 - DNA, 101 bp, rice(Oryza sativa)
  misc_feature (71): n=a or g
tgcgaaaacggaagggaattgatgaggatttaaagcgtgcaaacgcatgcacgcacgaggcgtggtggcgntcgagcgaagccggcctgcgcgtttgcgga

SEQ ID NO: 12700 - DNA, 101 bp, rice(Oryza sativa)
  misc_feature (71): n=t or c
caatatccgatataacgtgtccctcaacttacaatacctaggtacctgaggtcctaggataattttgtgtntggttttgactgatgttaactacggtcaat

SEQ ID NO: 12701 - DNA, 101 bp, rice(Oryza sativa)
  misc_feature (71): n=t or g
acgaagctgcatctcgaacatatacatcaacagttatggacaaagtttaataaatgggcatcagtctacgnatgagtcgcgataggggcgaacgtctccat

SEQ ID NO: 12702 - DNA, 101 bp, rice(Oryza sativa)
  misc_feature (71): n=t or c
taaactgaatagtcaaacatatattgaaaagtctacaaattataaaaactagagggtagtatataattctngacacaaccccttttatccatggcagatca

SEQ ID NO: 12703 - DNA, 101 bp, rice(Oryza sativa)
  misc_feature (71): n=a or c
tcctgacattgttaagacaattgccaagaaaccagctgtaaatctctcgctgagtggattgtagtaataanttctaaggtactaataacactgtaagttgc

SEQ ID NO: 12704 - DNA, 101 bp, rice(Oryza sativa)
  misc_feature (71): n=a or g
aaattgcaacgacgacaagagattgtgtggcggaggggctaatgcttttccaacaaagcaaaaacaaatantcacgatataaacaagttccacctaatagg

SEQ ID NO: 12705 - DNA, 101 bp, rice(Oryza sativa)
  misc_feature (71): n=t or c
ggttgcactcgatgaataatcggttattcagttagcagttgctagttgctaccagcgtatgtacgaagagnagtactacatgtacgaaaaatctatctatc

SEQ ID NO: 12706 - DNA, 101 bp, rice(Oryza sativa)
  misc_feature (71): n=a or g
cgcctcttcccttttccagacatctcttcacctcttcttctaagggccacaatggcaatagtaccacacancagtagagtttatgttccatgatatacaat

SEQ ID NO: 12707 - DNA, 101 bp, rice(Oryza sativa)
  misc_feature (71): n=a or c
aaaaatgttgtctgcacgtgtgctctatactgaacaccattgtaatatctgacacactatagcttatttanatatttgagtgcagaaaacaccgattgcta

SEQ ID NO: 12708 - DNA, 101 bp, rice(Oryza sativa)
  misc_feature (71): n=a or g
acaggatttacaaggagtgggtcctattaatttgaacaactactagattgaaggcttttctttccatcggnttgacgccattttacaattatctagttttg

SEQ ID NO: 12709 - DNA, 101 bp, rice(Oryza sativa)
  misc_feature (71): n=t or g
tttgatcatgcataaacggtatgcgcggtgacacgctgcacacgacagcagatgtatttattaaatatgcngatagagatgaatatgccaaacaacagaga

SEQ ID NO: 12710 - DNA, 101 bp, rice(Oryza sativa)
  misc_feature (71): n=a or g
cttggtgtgctctcaaggtgccaaaagagcatagcaagtacaaccaaaaacactgttgacggtcgttagcnatcagtttcgcctgtcaatactaccaaaat

SEQ ID NO: 12711 - DNA, 101 bp, rice(Oryza sativa)
  misc_feature (71): n=t or c
acaacttcacaggtgaaatcccttcagagttgtcgaatctctctcaacttcaactgttagacataagcaanaacggtttgacaggattgattcccaaatct

SEQ ID NO: 12712 - DNA, 101 bp, rice(Oryza sativa)
  misc_feature (71): n=t or c
atccctacctgcatctgtagcatctgtccaacctggttgcgtttctgagtctgtcgcatgagaaccattantttctcggcccaatcggcaaccttgaccct

SEQ ID NO: 12713 - DNA, 101 bp, rice(Oryza sativa)
  misc_feature (71): n=t or g
tatctgcagttgtcattcctaactctcgttcggataatatgcaaattcgactgcccatgatgaatcgatcncatgaactctgtagtgtgctcgattttcta

SEQ ID NO: 12714 - DNA, 101 bp, rice(Oryza sativa)
  misc_feature (71): n=a or g
tttcggttcacccattgactgctccactcttaggaaatgatcatgcagagtttcgtcgccgtggtatcccngtaagataattaaactgccatactgaaagc

SEQ ID NO: 12715 - DNA, 101 bp, rice(Oryza sativa)
  misc_feature (71): n=t or c
gttccacatgatgttttggatttgcaagttcgtatttggccctcttttatggattgagatggttgaacagnaaaatctatgcatccaagtgctggctcgag

SEQ ID NO: 12716 - DNA, 101 bp, rice(Oryza sativa)
  misc_feature (71): n=a or g
ataagacaataaagaagaaacagttccattaaagcacccatttgcttttagttacatgaagacaatagggngatttttttttttttgggttttgttttctg

SEQ ID NO: 12717 - DNA, 101 bp, rice(Oryza sativa)
  misc_feature (71): n=a or g
tcttcggtagaacatactaggggactgtagagtgtaaacatggggctgttttggattaaaaccaaaacatnccctaccaaaattttagtaactcaaatagt

SEQ ID NO: 12718 - DNA, 101 bp, rice(Oryza sativa)
  misc_feature (71): n=a or g
aattgattacgtcggtcactgtcctaatcgtatgggatttacctgaatatatctcccgcgtattacagctnctacctccgtcccaaaataaatacagccgt

SEQ ID NO: 12719 - DNA, 101 bp, rice(Oryza sativa)
  misc_feature (71): n=t or g
tttttatctcgtccatgatcaggccatgattaatgcgtgctttttcctcgagtggttcatctgcatgactncatcgcattgcttttaacccacttttgttt

SEQ ID NO: 12720 - DNA, 101 bp, rice(Oryza sativa)
  misc_feature (71): n=t or g
gccctcgccgccaccgtcctcctcgttggcccattgctcctggtagtacgcggccagctcggcatccctcncctcctcctccttcttcctcctcgcctccg

SEQ ID NO: 12721 - DNA, 101 bp, rice(Oryza sativa)
  misc_feature (71): n=a or g
cgtgttgctcctacacgccgcggtcgaggagtctgattgcgacaagatccacaagggcgtctacgctggcncgggcgtactggtcctcgtctccacggtgc

SEQ ID NO: 12722 - DNA, 101 bp, rice(Oryza sativa)
  misc_feature (71): n=t or c
tttttatggaacggagtaagtagccaataagagcacacacttcgtggtctaggattgataacgttgctagntcagccactgctgtcaatctctttggtgat

SEQ ID NO: 12723 - DNA, 101 bp, rice(Oryza sativa)
  misc_feature (71): n=a or g
ggtagtgcccttcctagacctttttcgttttttctacgaactccagtggatggaggccggcagggtgtcgngatgctgcaggtgcaggggctaaccgggga

SEQ ID NO: 12724 - DNA, 101 bp, rice(Oryza sativa)
  misc_feature (71): n=a or g
cggatgtgttataggattgtacacgaagaataaaacctatcgaagggggtaaatggtacataacatcaacnaaagtcaaattatcaaactttaaaagatca

SEQ ID NO: 12725 - DNA, 101 bp, rice(Oryza sativa)
  misc_feature (71): n=t or c
caaagtatgtcagtatttgcatgctccaacaacagaacattgggctgttgccaagaggattctgagatatntaaagcatacagttaagcttggtttaaaga

SEQ ID NO: 12726 - DNA, 101 bp, rice(Oryza sativa)
  misc_feature (71): n=t or c
cggtgtcaaatattttaaaacggatggagtaataagaataagaggcgcatcagccgtgacgacgtttgtgnggaggcagcagcggcgaccaacggatggcg

SEQ ID NO: 12727 - DNA, 101 bp, rice(Oryza sativa)
  misc_feature (71): n=a or c
gcagcatagggaggaagggccgaagggggaagaggaagcagaaagaggatgccatgtaactatgtgagtcncttatgatgactcaatgagtggaccaggtc

SEQ ID NO: 12728 - DNA, 101 bp, rice(Oryza sativa)
  misc_feature (71): n=a or g
ttgaactatcaaactgaacaacagaacaagttacaagcatcgtcttatggtcttaggttgctaccacgganagtcagagacaacgcagttgcaaccaccct

SEQ ID NO: 12729 - DNA, 101 bp, rice(Oryza sativa)
  misc_feature (71): n=t or c
aaaaatagtagaggaatccaaaataggcttaatcaaccatataaggaatggcccaaagagaaggggaatanaaaatagacttattttctagccatatggac

SEQ ID NO: 12730 - DNA, 101 bp, rice(Oryza sativa)
  misc_feature (71): n=a or g
atgtttgttcctctccattattaggatagcacatcatgggcaatgggtcttattattggatcagttattgntggatatcttgcacaggtataaaaaatatt

SEQ ID NO: 12731 - DNA, 101 bp, rice(Oryza sativa)
  misc_feature (71): n=t or c
tcacccggccaccacgtggcagagtgagtgggcagagcaggaagcgctgctcagcgtcttaaatgcgcgangccccaaccatccctcgctgcatttaatgc

SEQ ID NO: 12732 - DNA, 101 bp, rice(Oryza sativa)
  misc_feature (71): n=t or c
ctgaataaaaaggcaaatgaaatgatggatatgtggaaaaacaccaactagcataactgtatctgctaacnaaaacatgctattattgtcaccaaactaca

SEQ ID NO: 12733 - DNA, 101 bp, rice(Oryza sativa)
  misc_feature (71): n=t or c
tgaatacttataattaacatcaacttaaaatatagtttccaacagtcaattcaaacagcaaacaatggtangtttggttatattcaataagtaaaacataa

SEQ ID NO: 12734 - DNA, 101 bp, rice(Oryza sativa)
  misc_feature (71): n=t or c
ccaataactattcaaattaatcgaacttatctaacactagtatacactccgtccgtttcaggttacaagangttttgacaaattgctttaactttgatcaa

SEQ ID NO: 12735 - DNA, 101 bp, rice(Oryza sativa)
  misc_feature (71): n=a or g
aagaagaagaagaagaaattcacaaaacacgcacatcttgtctgcctcccaattgctccgcgccatctacnagcagcagtaagaagaggcggcggcggcgg

SEQ ID NO: 12736 - DNA, 101 bp, rice(Oryza sativa)
  misc_feature (71): n=t or c
gggcgagaccgcggctgccccagagcgccaataaaacgagtccacgggacccacaaccctcccgctatcgngtgttgaaaccgcgatatcgacgccactct

SEQ ID NO: 12737 - DNA, 101 bp, rice(Oryza sativa)
  misc_feature (71): n=t or c
ctagcgcacacattggtaagtagcacagtaattgacatgggagtggattctaagagcaggtacaataaganggtagatgctggcgataggacgaccatgtc

SEQ ID NO: 12738 - DNA, 101 bp, rice(Oryza sativa)
  misc_feature (71): n=a or g
gtattattctgtttaaaacgggatcccgcacaatagtagccccttcaaataaacgaggaagttttattcgntttaaagcaaggctaataatacagctgacc

SEQ ID NO: 12739 - DNA, 101 bp, rice(Oryza sativa)
  misc_feature (71): n=t or c
ataaattagttagatcagaaaatgggcttaatgtattcctccaagataatggttggcaggaaaaacgatanggacggtaaagaaaacataaatatcactag

SEQ ID NO: 12740 - DNA, 101 bp, rice(Oryza sativa)
  misc_feature (71): n=a or c
tttgcacaaatttgagatctgagcctactgcttttctacttttccccaattacatgttgcgcgcacaattntgcacaaatgcacaccacactaacacacac

SEQ ID NO: 12741 - DNA, 101 bp, rice(Oryza sativa)
  misc_feature (71): n=t or c
ctttggtgagtgcctccctctaagcttagaacaggaatgatttggctggttaagacagtaaagggacaganagaatgcatcgttttgcctcacttgatcaa

SEQ ID NO: 12742 - DNA, 101 bp, rice(Oryza sativa)
  misc_feature (71): n=t or c
agatacatggaatgagctgctgttctaccatctggtatcctcacaacaaaagggtgtaacaagctagatanatggaatgagctgctgttctaccatctggt

SEQ ID NO: 12743 - DNA, 101 bp, rice(Oryza sativa)
  misc_feature (71): n=a or g
tcaaacatgagcccaaacctcttggttttggtttccttttggaagtccaatgcatcatctctcctttcaantctaatcttgataatattcttcctctaaaa

SEQ ID NO: 12744 - DNA, 101 bp, rice(Oryza sativa)
  misc_feature (71): n=a or c
gatggaagtataggatgggataagcaatactgcaatagattgggaaaagtaggggacaagaagtagggganggaaggacacaaggcatatgcatgcggggg

SEQ ID NO: 12745 - DNA, 101 bp, rice(Oryza sativa)
  misc_feature (71): n=a or g
agcacgtgtagtagataagagaggagagagaagaaaagcggattacatatttgtagtcatccgcagtacgnaaaatattgtgtatatgagatgtggaacta

SEQ ID NO: 12746 - DNA, 101 bp, rice(Oryza sativa)
  misc_feature (71): n=t or c
tgtcagatacaattttgtaaaggaaaagcagtgagttccattcttataccaaggtattctcactcatgtgnattgtatttgacaaaatacaaatttagaac

SEQ ID NO: 12747 - DNA, 101 bp, rice(Oryza sativa)
  misc_feature (71): n=t or c
tgcttgaatagacgtcaaaatatttagtccttaacgacccagacggagctactgcatcaggggaaacatanctcccatcatcgccctaccacccgtccaag

SEQ ID NO: 12748 - DNA, 101 bp, rice(Oryza sativa)
  misc_feature (71): n=a or g
atttattaatgacgagtaagctagcaagaaagcggaaacaacaagcataccaggggatcttcagagcctgnaagtacagggaaccctgaaagaaacaaaaa

SEQ ID NO: 12749 - DNA, 101 bp, rice(Oryza sativa)
  misc_feature (71): n=t or c
aaatttattactaccactcattttttaacgaaggaagctgcggttttctgttcagtgctcgctcactcacngggcaccagcagcggcagcttcaggccaag

SEQ ID NO: 12750 - DNA, 101 bp, rice(Oryza sativa)
  misc_feature (71): n=a or g
atctcttccaggtatgtgtgatcgagattttgtgttgactacaagcattgatcagtttgcacgacgaactnatctctactattataaaaattgaatatgtt

SEQ ID NO: 12751 - DNA, 101 bp, rice(Oryza sativa)
  misc_feature (71): n=a or g
tattttcagttatttactagaattttcttgcataggcagatataagcatatgtattgtgtatctagcctcncaattgcatgggggaattcagctaagtttt

SEQ ID NO: 12752 - DNA, 101 bp, rice(Oryza sativa)
  misc_feature (71): n=t or c
ttggtgatccactttattatctatcttttgttctcttaacaatacgggatgccgtggtgtagatttttctnaaaaaaattacattaacacgatgtaaaacc

SEQ ID NO: 12753 - DNA, 101 bp, rice(Oryza sativa)
  misc_feature (71): n=a or c
ttctttgtctagctggaggggttgagctactcatgtgcgtttcccgcactgctactggccttatgagacantattctctccccatacaaacttgatagtat

SEQ ID NO: 12754 - DNA, 101 bp, rice(Oryza sativa)
  misc_feature (71): n=a or g
gaggggacatggcgatcaagaggtggattggatggatcttaacactgaattgataagtgccaggctgccanctgcctggccggggcaagctaaccagcttt

SEQ ID NO: 12755 - DNA, 101 bp, rice(Oryza sativa)
  misc_feature (71): n=a or c
gcatgtcaaccatgaagccaagcccgcaaacccggtctagtcgtctagaaacgtcacagaagatcggtttncccagtactctcgtatcagatttttttagg

SEQ ID NO: 12756 - DNA, 101 bp, rice(Oryza sativa)
  misc_feature (71): n=a or g
tccccttccctctccccttctcttctccaccaccggcgactaagacggaggcagaagccactcacgcgganacgacagccttagggcaggcggtagccgat

SEQ ID NO: 12757 - DNA, 101 bp, rice(Oryza sativa)
  misc_feature (71): n=t or g
gaaactaaaaggcctttctcagggtaaacatgaatgggtcaatgggaatccagttggtgccttaagaaaanatctatatgatacctaaacaattgtactgg

SEQ ID NO: 12758 - DNA, 101 bp, rice(Oryza sativa)
  misc_feature (71): n=t or c
ggatcaagcatcacatcactcggagttggtgatcggtgcatcggtttcaattactgaaaatcgagatgtgntaaatggagagcttggtctgattgaagctc

SEQ ID NO: 12759 - DNA, 101 bp, rice(Oryza sativa)
  misc_feature (71): n=t or g
ttttgaaccaggaaattatattgtacttcgaagacccactattgttggagccaacacacatgcttgagcgnatgagccaacagccaacatacatacttggg

SEQ ID NO: 12760 - DNA, 101 bp, rice(Oryza sativa)
  misc_feature (71): n=a or g
tgttttctttggaaaatctcgaaaaaagtttcacatacaggaaacagtcctactccggtgttttctactcngagtagaaagtaatttgggcccttgatcat

SEQ ID NO: 12761 - DNA, 101 bp, rice(Oryza sativa)
  misc_feature (71): n=t or c
ctgtaaggataatagcaatagtaccttgctttcttgattcggaattgatgtatagggcacattctttatanacacacacacacacacacacacacatactg

SEQ ID NO: 12762 - DNA, 101 bp, rice(Oryza sativa)
  misc_feature (71): n=t or c
aaacgacttaacaaaaccgctcagagcgaaatttggatcaaacaagagttggaggggccagactaacatanagacagtcaattaaagttagggggtattta

SEQ ID NO: 12763 - DNA, 101 bp, rice(Oryza sativa)
  misc_feature (71): n=t or c
ccagaacgcagcaacagaaagtaagcgtgggacgagaacaagtcaaaccagccaagccacgtagacgttangttagtcgaaatcgttctccaaatcgtctt

SEQ ID NO: 12764 - DNA, 101 bp, rice(Oryza sativa)
  misc_feature (71): n=t or c
tgccagcgaccgccatcaatctctcctaatgcttcttctaatttccaatgtactacctactccctccgttncccccaaaaaaaataaaccctagatttccg

SEQ ID NO: 12765 - DNA, 101 bp, rice(Oryza sativa)
  misc_feature (71): n=a or g
ttgaatggtagtaatcccttctaatctcacctctaatcccaccttctactccaaattgctagccaacaggnaaatcccagctagcgaacaggggaatagag

SEQ ID NO: 12766 - DNA, 101 bp, rice(Oryza sativa)
  misc_feature (71): n=t or c
gcttcgccactactttgaggggattctagtctctcttgaggagcggacaaagagctagatctttttcaacngttcctcatgaggttgcataaatgcactcc

SEQ ID NO: 12767 - DNA, 101 bp, rice(Oryza sativa)
  misc_feature (71): n=a or g
tgagagcgctctagccagctccatatcttttttggtggtgttgaaaccgtttggttgggctccaactctangagaggtggagctggaattggagctgtgcc

SEQ ID NO: 12768 - DNA, 101 bp, rice(Oryza sativa)
  misc_feature (71): n=a or g
gaccgatttcttttagataatggatagtaatcaagcctctgtatccataagtgaatatacacggccaaagnttatatgaaaacttatattccaggtcccat

SEQ ID NO: 12769 - DNA, 101 bp, rice(Oryza sativa)
  misc_feature (71): n=t or c
caccaattcggtggaggttgatttgtgcacctaatctaactgctccaactataggacacacacacgctganaggtcaaacatgccgtctacatgtatggtg

SEQ ID NO: 12770 - DNA, 101 bp, rice(Oryza sativa)
  misc_feature (71): n=t or g
ttcttgtttcagacagataatcacttcattgcattcaatctttatcttcaaatttcaaatcacccatttcncatgaaatttatcaaacattcttgcttcat

SEQ ID NO: 12771 - DNA, 101 bp, rice(Oryza sativa)
  misc_feature (71): n=t or c
tggccgccacgaccgtgccgcagagatccctcctcgtcgcctttgagcgtgccaccctcgttgccttgggngcagctcactcgccggcgtggagtgcgccg

SEQ ID NO: 12772 - DNA, 101 bp, rice(Oryza sativa)
  misc_feature (71): n=a or c
ctctctcacggcttgtggttttacgtgtgtttagtataacacgccgccgtccacacggcgtgactcccttnctgtcaacgcggtcagcggggactgggaga

SEQ ID NO: 12773 - DNA, 101 bp, rice(Oryza sativa)
  misc_feature (71): n=t or c
tacctacgcagctagtctaagttcaaatctttcctttggatagagtgctatatagcaaagtgaacttattnttaagcggagtaaaattgcaccggttttga

SEQ ID NO: 12774 - DNA, 101 bp, rice(Oryza sativa)
  misc_feature (71): n=t or c
gtgaccgaggcatgttggagtcagtgtgcaaaaaaaaagttttttttttgtaaggcatcagcaatgtatcnttcccaagtagtaaataaggtgggaccaac

SEQ ID NO: 12775 - DNA, 101 bp, rice(Oryza sativa)
  misc_feature (71): n=a or g
aggacgcctgtgaaaatgatttttgtaggcgaactgaaggccacctgtgaaaatggacgtattttcgcagnccttgaagtacagatagagtgaatgtccgc

SEQ ID NO: 12776 - DNA, 101 bp, rice(Oryza sativa)
  misc_feature (71): n=t or c
cacattacgatccgattacaacggtagagcgacgattaccttaccttttctttttctttcaactttttttntgtttgaaaaaagtgcatattgaaagctaa

SEQ ID NO: 12777 - DNA, 101 bp, rice(Oryza sativa)
  misc_feature (71): n=t or c
acaagcaggaatgtcctggcgccggtgatacaggacgacagggatggcgcgtcgtatcatcaccgaatacnaagggtgtgtttagttgaggaaatgaaaat

SEQ ID NO: 12778 - DNA, 101 bp, rice(Oryza sativa)
  misc_feature (71): n=a or g
cgtagtctgtcaagacatgaactggagcggctgtggtgtggaatccacggccacagaggcggatcttggcngcggcggcggatccctgcggcgctggtcga

SEQ ID NO: 12779 - DNA, 101 bp, rice(Oryza sativa)
  misc_feature (71): n=a or g
ccatgaacaatttgtttgggacacagctttcagccaaaagagttcttttcgtgctttatgcttcctgccgnatcctgttctctcagttgagagaggcagag

SEQ ID NO: 12780 - DNA, 101 bp, rice(Oryza sativa)
  misc_feature (71): n=a or g
ctctgaacagactgcaattaacaatcagctacaggtttaattaacattctactagatcagtcagaacaggntaacaaagaactcatcataaaaaaatatac

SEQ ID NO: 12781 - DNA, 101 bp, rice(Oryza sativa)
  misc_feature (71): n=a or g
gattattcacatgcggcgctttgtctggtgaagtggtgaacgcatctcaggccattcacagtgggcttacntgtcattcagcctcgagcttacatgtagga

SEQ ID NO: 12782 - DNA, 101 bp, rice(Oryza sativa)
  misc_feature (71): n=a or g
aacaaattctcttttatacggtcgtaagaatctcctttattaatgcgagctacagcgagatactactactntactccctctgccgatgtgccctttctagt

SEQ ID NO: 12783 - DNA, 101 bp, rice(Oryza sativa)
  misc_feature (71): n=a or c
acaatttatgttcatcagcaaccttccaagttaggccttcataccaacaatttctcaaacgtaactgcaanagaaactttgaaataatttggactctttga

SEQ ID NO: 12784 - DNA, 101 bp, rice(Oryza sativa)
  misc_feature (71): n=t or c
ttcgagtagcaagtgaagctccactctccatatacccacttgttcttttatcatcttcgtcttcactagantcatcggatctccaccttgacacacctttc

SEQ ID NO: 12785 - DNA, 101 bp, rice(Oryza sativa)
  misc_feature (71): n=a or g
gctccgcatgtcatggtgaccaagtcattaccctgtcctcttctcctcgtctgagcaggccggcagatcgnggaggagggggaggagaccagcggggtgag

SEQ ID NO: 12786 - DNA, 101 bp, rice(Oryza sativa)
  misc_feature (71): n=t or c
agcagccacagagaatctgttcgccgctacgatttgtagccctggcaaaagcgaccaatccatggactcangcagcagcagcagcagcagggcgcgtatac

SEQ ID NO: 12787 - DNA, 101 bp, rice(Oryza sativa)
  misc_feature (71): n=a or g
tgtgcgacggcgccccaataaataaccgtgtggaaattaatcgatttcgtcgtcgatggaatgtagtattncgtcgttgggaatgtctttgctggggcctg

SEQ ID NO: 12788 - DNA, 101 bp, rice(Oryza sativa)
  misc_feature (71): n=a or g
attcaatcaccatataagttagcaccccgttcctattctctatcttgtacttactatatttggcaactcangccatataacacacataatttagaagaaca

SEQ ID NO: 12789 - DNA, 101 bp, rice(Oryza sativa)
  misc_feature (71): n=t or c
cttgccgtgtcatagagaagcaagtggatcaaccccaaaactcatttatatatcaaattagttggtaaccngcgagtcaaaccgcgggttatccactcatt

SEQ ID NO: 12790 - DNA, 101 bp, rice(Oryza sativa)
  misc_feature (71): n=t or c
agtcaaataacaatctgcttatcctttttccaatccttccgctccaagttcccttgtgtggcttccactgnaagcctgaaacttcgggcctatttgacaca

SEQ ID NO: 12791 - DNA, 101 bp, rice(Oryza sativa)
  misc_feature (71): n=a or g
tgacggagagacggacggacggtgaggcctatatagctttcatcatttgaacagagacatttcgccgggantctgctctcccctcttgacccacccccaac

SEQ ID NO: 12792 - DNA, 101 bp, rice(Oryza sativa)
  misc_feature (71): n=t or c
gtaagtagtccatgcatcttatccattgtgttcctgaatttcaagtgagacatgacaaaagggagggctancatcaacatctaaaactaaatggttcttat

SEQ ID NO: 12793 - DNA, 101 bp, rice(Oryza sativa)
  misc_feature (71): n=a or g
atttatcataaatactgcaaatctcgtatatgttttcacactaatcttacatgatgatgtcccaaaggtcnagcttaagtgtcacgcccggaatttctatc

SEQ ID NO: 12794 - DNA, 101 bp, rice(Oryza sativa)
  misc_feature (71): n=t or g
gtgcaacactgcatatgctcttagtcgctggtctgtgttgtctctcctcaagtcccatctctagcttactnttaaaaccaatgtggcagattttcagctag

SEQ ID NO: 12795 - DNA, 101 bp, rice(Oryza sativa)
  misc_feature (71): n=a or g
gaaatttcgaatcagcggaccagagaaagggagcagaaggcatgaacataaatgggagtgaaattagaatngtaaacttaggatttccaaatccaaatcga

SEQ ID NO: 12796 - DNA, 101 bp, rice(Oryza sativa)
  misc_feature (71): n=t or c
cggatttttcctatatggatgataacacgttagttacatcatagttacatactatttacactataactagnatggcggcccgcacagattgcgcggctagc

SEQ ID NO: 12797 - DNA, 101 bp, rice(Oryza sativa)
  misc_feature (71): n=a or c
tagggtgtttttggttggatgaaagatggtgatccaggttttcagtgtgtttagtaggcagtgtttagttncttcaaacattcaaaaattccatcacatta

SEQ ID NO: 12798 - DNA, 101 bp, rice(Oryza sativa)
  misc_feature (71): n=t or g
gctgtcaatgggtataatcacctattgattctctgttgtttgattccatttggtagagtttagtgaactcngtttgttttctcattgttgctcatagaagc

SEQ ID NO: 12799 - DNA, 101 bp, rice(Oryza sativa)
  misc_feature (71): n=a or g
ccaatactgactgaaatggtcattggaaacggcagccgaaaatcttaaaaattttcgtaccgttttcaccnctaatcggagccgccggatgggggggtcgg

SEQ ID NO: 12800 - DNA, 101 bp, rice(Oryza sativa)
  misc_feature (71): n=a or g
acgtatctcggtcggtcgagacgtgtagagctcgcggtcggagttcgtgaggcggacaaaaaaaaaagganggtgcatgaggatacatgggattgtgggtg

SEQ ID NO: 12801 - DNA, 101 bp, rice(Oryza sativa)
  misc_feature (71): n=t or c
tgccaacgatgtagcgattctcccactacctatgcgatttattgggtacaactatacgcctgggctttgcntagtgtggtggttatctcatcatctacgtc

SEQ ID NO: 12802 - DNA, 101 bp, rice(Oryza sativa)
  misc_feature (71): n=a or g
ttatttgcaccgcgctccaatataacggcgtcaatgatattggcatcattcctctcgccccctcgtgaaanctaaatcactcatgtaaatagattggtgcc

SEQ ID NO: 12803 - DNA, 101 bp, rice(Oryza sativa)
  misc_feature (71): n=a or g
tactcctatacaatatgcttataatgcttagggggggtgtcaataggtgattatacggccgattacacagnaatcggctataggcaaaacctagataacgg

SEQ ID NO: 12804 - DNA, 101 bp, rice(Oryza sativa)
  misc_feature (71): n=a or g
gaagggtaaattgtaattcttccacaactcttcactgcggaggggctagctataagtgtgttgcctacgtngaatgccacatcggccacatcgacgatcag

SEQ ID NO: 12805 - DNA, 101 bp, rice(Oryza sativa)
  misc_feature (71): n=t or c
ccggacgacgacgcttacaccgcctggaacgccatcagctcccagtttcttgacaacgtcgtccagcgcantgtccagacccggcaggcgttccacgctct

SEQ ID NO: 12806 - DNA, 101 bp, rice(Oryza sativa)
  misc_feature (71): n=t or g
gcagcgcaggctctcattccttttttatacccacctgtcacctgtgacgccatttaagggtacgtttaagnggcttctagctcctgtagcttctcctataa

SEQ ID NO: 12807 - DNA, 101 bp, rice(Oryza sativa)
  misc_feature (71): n=a or g
tgacctgccgccctgccctcacagttcctctctatcgccttcccccaccatgtcatagccaaaagtctgtncacccgctaggacgacgatagagctggggc

SEQ ID NO: 12808 - DNA, 101 bp, rice(Oryza sativa)
  misc_feature (71): n=t or c
gaaattcggtatgtagaattgcagatacaatgcatgcactgttctacttcctctattccatattgtaaganggtttaattttgtcctaagtcaaacttctc

SEQ ID NO: 12809 - DNA, 101 bp, rice(Oryza sativa)
  misc_feature (71): n=a or g
ccggacgattttttgcttaaaaccggcgaccaggctatactaaaccggcaggtcagctaggagatgggccngccttccaaggcccacttcacttccggcgg

SEQ ID NO: 12810 - DNA, 101 bp, rice(Oryza sativa)
  misc_feature (71): n=t or c
aatagtcgactataggagtaacttgtacgatagctaacctctgtaccttctataatcccttaacatactcnttcagtactactccctccgtcacagaatat

SEQ ID NO: 12811 - DNA, 101 bp, rice(Oryza sativa)
  misc_feature (71): n=t or g
cttaacttatatttcttatttaaaaaattataattgttatttattaatactgttggagatatgggcccggnggtatgcgaagtgaggggaatctaccttcc

SEQ ID NO: 12812 - DNA, 101 bp, rice(Oryza sativa)
  misc_feature (71): n=a or g
tcggttggtgcagcctccacggcaacacatgcagcagcacaagcataacaacatatgaatactagctctgncgaggccatggtgaataaggctccgacaca

SEQ ID NO: 12813 - DNA, 101 bp, rice(Oryza sativa)
  misc_feature (71): n=t or c
ggtgtagctacattttaaaaatatgaatattcagctgagcgttgctatgtccacccctgtatccgatgcangttggagtgcacggcaaagaaaaatatcag

SEQ ID NO: 12814 - DNA, 101 bp, rice(Oryza sativa)
  misc_feature (71): n=a or g
cgaaatttttcacccgtggatctaagcccaaatctcgcgaccattgcagctttgacagacacctcctcttngccagataggtagtacaaaataattaatta

SEQ ID NO: 12815 - DNA, 101 bp, rice(Oryza sativa)
  misc_feature (71): n=a or g
ggcattctgtctgctgattgattcttccctgcaactgtacatatatacggaccaagattctcccaacaganccacttgattacatggttgatatatatatt

SEQ ID NO: 12816 - DNA, 101 bp, rice(Oryza sativa)
  misc_feature (71): n=t or c
ccagccacaagccatcacaccatgctcgtcgtgcgcctcatcggctagccaccatcaccgccaccggactngccatgacagcctccatggcgtcatctgtg

SEQ ID NO: 12817 - DNA, 101 bp, rice(Oryza sativa)
  misc_feature (71): n=t or c
accgcattggtaatgcaattacagtaggtgcttatagcttgctcgctacttgttgcgtaatacatatgatngaaggatgtctgttgtggcactgcgggata

SEQ ID NO: 12818 - DNA, 101 bp, rice(Oryza sativa)
  misc_feature (71): n=t or c
atgattttttaaaaaaatcctgcaaaaggctctggttttccttatatttgttcagactattttgtgtccangttttgaggatggattaatttcccaagcac

SEQ ID NO: 12819 - DNA, 101 bp, rice(Oryza sativa)
  misc_feature (71): n=a or g
tgccatgacaatgaagagagatggtgcaacggcaactgaattatatactctactatgctcgtccaacttgncaggctggtgccaaagagtctgcctcatgc

SEQ ID NO: 12820 - DNA, 101 bp, rice(Oryza sativa)
  misc_feature (71): n=a or c
tgatctcatactgtcagtgcttgtgattctgctcattttattcaagacttatttactgctcagattatctnaacaagagatatatagtcatatatatcatt

SEQ ID NO: 12821 - DNA, 101 bp, rice(Oryza sativa)
  misc_feature (71): n=t or c
ccaaccgaagatgatgagggtaatgagatcacaacacaccaatgcatgtctttcggagaggcagcttctanctatgctggatcagaacaatcggctgagtt

SEQ ID NO: 12822 - DNA, 101 bp, rice(Oryza sativa)
  misc_feature (71): n=t or c
gggagcaaaaaaattgatgaatgggaaagggattgtgttatcttgggattccaaatagtaacttatattgngggacaaattatagaaacaaaatttcttag

SEQ ID NO: 12823 - DNA, 101 bp, rice(Oryza sativa)
  misc_feature (71): n=a or g
atatcactaaaggaaaaaaaatgtatgggaataatgttagaaaatggaaatgataaatggaaacaaaaacnaaaatgacattgttgttgttttcgtatttt

SEQ ID NO: 12824 - DNA, 101 bp, rice(Oryza sativa)
  misc_feature (71): n=a or c
cacagaaggaaacaaatttcatcaaagggcaactaagtcatttggctataccgttacccaccgttaccatnaaaaatggacggaatggtgtggagggcacg

SEQ ID NO: 12825 - DNA, 101 bp, rice(Oryza sativa)
  misc_feature (71): n=a or g
gttgccggcggaggagaggccgagaggacggatagtacagtgccatgcatgagacgagaggatcaggagtnattaattaagcaaagacatagtttagtact

SEQ ID NO: 12826 - DNA, 101 bp, rice(Oryza sativa)
  misc_feature (71): n=a or g
tgcacctctctgatgtgcgaacatggcttcatctgcagcttcgattcttggaatggaacccaagatatttnaagacatgatccgtcagactcatgcaggaa

SEQ ID NO: 12827 - DNA, 101 bp, rice(Oryza sativa)
  misc_feature (71): n=a or g
attggaagagttttcttttactttattgaactgatactgatatttttctggaaaccgatacggatggactntttatttttggaaagtgataatgatggtta

SEQ ID NO: 12828 - DNA, 101 bp, rice(Oryza sativa)
  misc_feature (71): n=t or g
atatttctaaacaaaattcaaataaccagaatgtttatatttgttgatgaagagagtaccattcaagtagntacaattcatatatcctgattctgtcaaat

SEQ ID NO: 12829 - DNA, 101 bp, rice(Oryza sativa)
  misc_feature (71): n=t or c
gagctgtgcatatgatgatatgcatgcatgagccaacatcatttgtcataaatgtaggagtaggagagtanctgctcatctcatcccatcccatcccatcc

SEQ ID NO: 12830 - DNA, 101 bp, rice(Oryza sativa)
  misc_feature (71): n=a or g
atattatttttacattcactcatccatatcaatcattaaaaaaaatctcccgggtaagaaactacataacntacaaggaggagaaaaaatacacatatccc

SEQ ID NO: 12831 - DNA, 101 bp, rice(Oryza sativa)
  misc_feature (71): n=a or c
attcttgattatggtgtttccttccataagatatcagataagtcttgcctttcgtctatttgttctccttnagttcctataactgtctgaaccaccgattg

SEQ ID NO: 12832 - DNA, 101 bp, rice(Oryza sativa)
  misc_feature (71): n=a or g
tgacttaggcattaattaattgccttaattaaagtaatgcttttcttgaggtggattgaaagagctactanctcagagccaggacagcaatgttcccagca

SEQ ID NO: 12833 - DNA, 101 bp, rice(Oryza sativa)
  misc_feature (71): n=a or g
aagtacagacattggaatgaaatgatgtaacacaactcgactggatggtacctgaaggaagaatgctggcnaaagttgaagttgtcattcacctttccaga

SEQ ID NO: 12834 - DNA, 101 bp, rice(Oryza sativa)
  misc_feature (71): n=a or g
ttcagacagcgtagtatcaaatgccttctcccgcaagctgtatctgactaaccatatactcccgcaagganttgtacagtaaaagtaaaactacccgataa

SEQ ID NO: 12835 - DNA, 101 bp, rice(Oryza sativa)
  misc_feature (71): n=a or g
aataattcaacctactcttaaaacgaagtcttcaagaaaggatacaacggtgacatcgcccaatccaaacnaatctagtgttttcacccaaagaaatccct

SEQ ID NO: 12836 - DNA, 101 bp, rice(Oryza sativa)
  misc_feature (71): n=t or c
agcgagagagaggaaaagggggaggccggagacatgcgcgaaagctgccactgtttgcaagaacgctactntcttgctatggctagctcatctcgtgcgct

SEQ ID NO: 12837 - DNA, 101 bp, rice(Oryza sativa)
  misc_feature (71): n=a or g
actacgcttaattcgcttgagggcgagacttgttctcctactcctacccagtagctttgtcaaattccgcngctgaaactggcaggcagccgcctcggcac

SEQ ID NO: 12838 - DNA, 101 bp, rice(Oryza sativa)
  misc_feature (71): n=t or c
cgtaatttatttttcaccattgacttttaattcactagaaatatactactccatccgcccattttaagtgnaaccataagtttccgcactcaactaacttt

SEQ ID NO: 12839 - DNA, 101 bp, rice(Oryza sativa)
  misc_feature (71): n=t or c
aaaaataagcagtgatatattgaatattgttaccaccttactttttatttttttgggttagtgatcaggtngctgagggcaggtgcatacttaataaaatg

SEQ ID NO: 12840 - DNA, 101 bp, rice(Oryza sativa)
  misc_feature (71): n=t or c
cagaaaacagttcaattgcacacatgggtacttgagtctttttttttaacgaatcggcatagactgtgtcnatttcattgaatatagtggaagaaaaaacc

SEQ ID NO: 12841 - DNA, 101 bp, rice(Oryza sativa)
  misc_feature (71): n=t or c
acccagagggaccaacaagttgtgtgttcgctactcttggcagtatcaccaaccactaccgatcatatccnttccagctgcgctttacagagcgagagttg

SEQ ID NO: 12842 - DNA, 101 bp, rice(Oryza sativa)
  misc_feature (71): n=t or c
agttttaggaggaagccctttgattatgagtttctgttcgggtgtaagcttgtctaaagtggtggtttctntgccaagagagaatgttgttgaaactcggt

SEQ ID NO: 12843 - DNA, 101 bp, rice(Oryza sativa)
  misc_feature (71): n=a or g
atacaaaattaccccctccttccttctccctctctcctctcttacccaagattcagttgaaaccacggtcnccggcgacggagctagcagcggcgtggtta

SEQ ID NO: 12844 - DNA, 101 bp, rice(Oryza sativa)
  misc_feature (71): n=a or g
acatccactatccaaacaacgtacttccccttaaacacacctgcatgaacggtaaagccaagccaagacantcgtcgcaagaaacccaacgagaaacacct

SEQ ID NO: 12845 - DNA, 101 bp, rice(Oryza sativa)
  misc_feature (71): n=t or g
agaccaggttttgactcccacgcgtcctgatccaaaccaaaccgtgcacgcatcttaaagtatatcggacnaccaaaaaaaacgacaaatatcgggagaag

SEQ ID NO: 12846 - DNA, 101 bp, rice(Oryza sativa)
  misc_feature (71): n=t or c
actccgcattgcacttgtttcatatatatactcaagtttcatatatatactctgcagtaccaaggaagaanttcccgactcttgcacttcgagttcctcct

SEQ ID NO: 12847 - DNA, 101 bp, rice(Oryza sativa)
  misc_feature (71): n=t or c
tgaacaaaatgacgtttccccatgctgatattttgttatcaatgtacttctcttctcagttttgctttggntaacactcacctcataatgaatcgacgagc

SEQ ID NO: 12848 - DNA, 101 bp, rice(Oryza sativa)
  misc_feature (71): n=t or c
caataaacttagtgattaagtaacatgaggatagaacaacgctgcacttgctcactctttccgtctttcgngtggcgatgaacaactaaattctcagtgta

SEQ ID NO: 12849 - DNA, 101 bp, rice(Oryza sativa)
  misc_feature (71): n=t or c
gagggacatgaccagctttggaaatggcagcacgggaaggactttacgatctgcatcgtagttctccaganaaggtagaagcaagccacctccaattcgat

SEQ ID NO: 12850 - DNA, 101 bp, rice(Oryza sativa)
  misc_feature (71): n=a or c
tccaaaagccattccacctctgcatgtatgtagaagctactagagtaattcccaactcctacccctctccntgttttatttatagcggccagtggaaacat

SEQ ID NO: 12851 - DNA, 101 bp, rice(Oryza sativa)
  misc_feature (71): n=t or c
ctccaattatccacgattgtctagtggagtcatgctcctcctggacatcctccggtccaattatccgacgncatcgacatctcgcagcaacttagcctccc

SEQ ID NO: 12852 - DNA, 101 bp, rice(Oryza sativa)
  misc_feature (71): n=a or c
tgatgcctggctctgaggctctgggcgctatcctaggcgctagctacgaattcacagtacttcctccgtcntagagattttaagtttttgcttgcaacatt

SEQ ID NO: 12853 - DNA, 101 bp, rice(Oryza sativa)
  misc_feature (71): n=t or c
ggctttcttaaatcaatctgggcccaatagatcttttctttcatgtcgcctaagcccaataaattgagagncaaggtgtatcaaaagccgaacagtaaatt

SEQ ID NO: 12854 - DNA, 101 bp, rice(Oryza sativa)
  misc_feature (71): n=t or c
aagatcgtattacccttcgccttcgcctcgtcggccattacacgcggcagcggccctcatggacccttttnggaagcttctggaaggggtccaagagggcc

SEQ ID NO: 12855 - DNA, 101 bp, rice(Oryza sativa)
  misc_feature (71): n=t or c
aaaaacgaggagccgaagattttagggggcgggagaaaaggtcaagtctaagcgacatatggcgtagcgtnggagactatgtgctataatgctgaactaag

SEQ ID NO: 12856 - DNA, 101 bp, rice(Oryza sativa)
  misc_feature (71): n=a or g
tccacggtgaaaggtatgggcggcgctctagtggaagaatatggattgattcttcaggctattccactgtngccttgtttagttctaaactttttctttaa

SEQ ID NO: 12857 - DNA, 101 bp, rice(Oryza sativa)
  misc_feature (71): n=t or c
gctggttcatctccacctaccagcatttggaaatcttaatggtgcctacgctttgtgtcagacaagtttantaagaccttgtttagatgggactaaaactt

SEQ ID NO: 12858 - DNA, 101 bp, rice(Oryza sativa)
  misc_feature (71): n=a or c
tttcaagatctgaattttttggccacgctagcagaactgacgtggcaaaacaatactctcactctaccctnactagtgtggcaagacaaaactgtcgcgcc

SEQ ID NO: 12859 - DNA, 101 bp, rice(Oryza sativa)
  misc_feature (71): n=a or c
tctaactcgctctcccctctcttcgtggagcagttaaagttgacagcgagctccatccgtggagagacccncaccctctcggcttggagctccacgctatt

SEQ ID NO: 12860 - DNA, 101 bp, rice(Oryza sativa)
  misc_feature (71): n=t or c
caatggcgaccatgtggttgttcaagcgagtgcctatcacggcagcctccttttgcatagcttcgctgctntgcatcgcctgtcgcaggagctcaatcttc

SEQ ID NO: 12861 - DNA, 101 bp, rice(Oryza sativa)
  misc_feature (71): n=t or c
aaatatgacattcaactagactaggctgggtttgaattttgcttatctctcgtttatcgtgaacacgcttnccaaccaaaatgccaaacgtatattatttt

SEQ ID NO: 12862 - DNA, 101 bp, rice(Oryza sativa)
  misc_feature (71): n=a or g
ccaaaacccactaggggcatagatgctcttttactttaaagcatagtcgtcccccttccgactccttatcntgcgtatgatggtggttctctttcaagaat

SEQ ID NO: 12863 - DNA, 101 bp, rice(Oryza sativa)
  misc_feature (71): n=t or c
cccccgtcgacaaattgtaagccgtaaaggcttattattgaaaacaaggcttattatcgaaaacagataanttataggtaaaacttttataagtgtattta

SEQ ID NO: 12864 - DNA, 101 bp, rice(Oryza sativa)
  misc_feature (71): n=t or c
ctacagaggaagaaaatcgaggattgagcggaagaagaaccaaatctacgaggaaaagaagggatttagcngatggatacttacctcgatgtattcggtgg

SEQ ID NO: 12865 - DNA, 101 bp, rice(Oryza sativa)
  misc_feature (71): n=t or c
ggtagactcaccttgatcaatgctagtctgagtagtgtgcctctttatatgttatccttttatgagttacnaaaaggagtacaaaaaagactagatttttt

SEQ ID NO: 12866 - DNA, 101 bp, rice(Oryza sativa)
  misc_feature (71): n=t or c
tttgggagagagtttgtcaaccaaaaaatacaggtggtttgggtgttattgatctcaatcttcagaatgcngctctcttgatgaaaaatttgcataagttc

SEQ ID NO: 12867 - DNA, 101 bp, rice(Oryza sativa)
  misc_feature (71): n=t or c
cgagaattttcagaatagaccactcaattcgtaccaccttcaggattaaccactcaattcgtaaccctttnaaaatttgccactgaacacgcgaattgttt

SEQ ID NO: 12868 - DNA, 101 bp, rice(Oryza sativa)
  misc_feature (71): n=t or c
tcaattattgatattattttgaagctttgtccattatttaaaggactgaatatatgagtaaattgccaacnatatgaacaaccaatgttatcaattattca

SEQ ID NO: 12869 - DNA, 101 bp, rice(Oryza sativa)
  misc_feature (71): n=a or g
agatgtctactgttacaattaacagggccaagcagcattgaatgccttagttataccagtaattatctggngtaaatttcagacaaaaacttaaactatca

SEQ ID NO: 12870 - DNA, 101 bp, rice(Oryza sativa)
  misc_feature (71): n=a or g
ctgttaaactatgttaccaagaactgccaaaaaaaatgcttcccataagacaaggttacaatcatttgtgnttaatattgggttgatgtgataatgtgata

SEQ ID NO: 12871 - DNA, 101 bp, rice(Oryza sativa)
  misc_feature (71): n=t or g
attatggaatacttgctcctactcatggtgtctagcatgttattggattgtgatggtcacgaataattacncttatctcatggggttcaatagtggcatgt

SEQ ID NO: 12872 - DNA, 101 bp, rice(Oryza sativa)
  misc_feature (71): n=a or g
ttttggtcaactccatatgaggaacagttttgttaactatggttttctgcacttttacctctaggttctantgaagaggatctgtttccttcacctgtaaa

SEQ ID NO: 12873 - DNA, 101 bp, rice(Oryza sativa)
  misc_feature (71): n=a or g
gggcttctgttaaggcccacaaagatatcattggttctctatatcaggcctcaagttgggtcccgtcactnataggtgtcatccgtgacgggctctatgca

SEQ ID NO: 12874 - DNA, 101 bp, rice(Oryza sativa)
  misc_feature (71): n=a or g
ataacaatgcaaaaaaaacaggactcgagctctcaacctaacgcacacaacattaccagcttaaccaagtnatctagaagaggaacttgttggaaagttaa

SEQ ID NO: 12875 - DNA, 101 bp, rice(Oryza sativa)
  misc_feature (71): n=t or c
aatagatgaaatttctatgggattttaatcctacaaaattactccgtaaatcttgtgaaatttgtttcaanagatcatctcaaaattatcgtttgattagc

SEQ ID NO: 12876 - DNA, 101 bp, rice(Oryza sativa)
  misc_feature (71): n=a or g
cagatcggcacggaaggtaaatgtgagtgaactactccgtcccaaaaatagaaaaaaaagataaaccctantttccgtgtccaatgtttgaccgtccgtct

SEQ ID NO: 12877 - DNA, 101 bp, rice(Oryza sativa)
  misc_feature (71): n=a or g
gggggatacagatctagcagcctctcgcgcagatccatctaaactcagatcggagcccgagcatgagcaangcagacggggagcgtaggtcgggagcgacg

SEQ ID NO: 12878 - DNA, 101 bp, rice(Oryza sativa)
  misc_feature (71): n=t or g
ttctccagggaaggccaggatttgaaggtgtttttccaatggcttgtttttggattggtcgacctaaaagngattctgttggtttcggctatgataaactc

SEQ ID NO: 12879 - DNA, 101 bp, rice(Oryza sativa)
  misc_feature (71): n=a or g
ccatgctaagggttcctatgaatatttaaattgtcaacaaccatcttaaccaattacttgtcactgatttncccacaaacccatcagaatgcactgaaact

SEQ ID NO: 12880 - DNA, 101 bp, rice(Oryza sativa)
  misc_feature (71): n=t or g
gataagatatatttctgcagttttaacagattgcaggactgtaaatgaccaatgtacattatttactatanaatcgatttttttttcatagtaggcatgaa

SEQ ID NO: 12881 - DNA, 101 bp, rice(Oryza sativa)
  misc_feature (71): n=a or g
aactgccataaccgtcattagcagctataaaaggagcttctctcattccattctacacacacctcaagaanaagatcaagagctctcccaagtttagttta

SEQ ID NO: 12882 - DNA, 101 bp, rice(Oryza sativa)
  misc_feature (71): n=t or c
tggtcaaataccaaatgataaactatagtaattaaggcaatttcggtgtcattcaagagggagtggatganatgtgatagcgagaggaaagagttattagg

SEQ ID NO: 12883 - DNA, 101 bp, rice(Oryza sativa)
  misc_feature (71): n=t or c
ccaatctcgccgaattcatatttggcgaagctgactacgctagccattgaccacatgtgagagctcaatgncgttgggccgacatggactatattaggtca

SEQ ID NO: 12884 - DNA, 101 bp, rice(Oryza sativa)
  misc_feature (71): n=a or g
tggccctccccctgctgcgctagggttgtaggggcgttggtgtgaatttccgggctaaggaaaggagaganaaacggaatttgctgccatgacatgcctgc

SEQ ID NO: 12885 - DNA, 101 bp, rice(Oryza sativa)
  misc_feature (71): n=t or c
gggtcgtacgcctcgtgccatgctaccaattgaaacggagaggaacacagatctaacctaatcctttagtngattatccgccgccatctatctctaccggt

SEQ ID NO: 12886 - DNA, 101 bp, rice(Oryza sativa)
  misc_feature (71): n=a or g
cgtgaagacgtcgttttttatgactctgctttggggtgatgttctaggtccggcgacgatcacacatagcngtggtctgttttagtggcagattattaaaa

SEQ ID NO: 12887 - DNA, 101 bp, rice(Oryza sativa)
  misc_feature (71): n=t or c
taagagcggttttgaatgatgtggcgttgacatgacgcttaattttttttaaacaataatcatatgggganccacgtgtcagtgaaacaatatattcttcc

SEQ ID NO: 12888 - DNA, 101 bp, rice(Oryza sativa)
  misc_feature (71): n=a or g
ttgctaatattttcaggttggtactagaagtaattcataaagacttgacatgatatatatgtctgtggtangtggaagctaaattcatgattgaaggatag

SEQ ID NO: 12889 - DNA, 101 bp, rice(Oryza sativa)
  misc_feature (71): n=a or c
ttgtagatcctgatgagaggatcaactctgttgttgatcaactctctacatattttcggaaatatggcgangccctccaccgagcccggcgccgccgccac

SEQ ID NO: 12890 - DNA, 101 bp, rice(Oryza sativa)
  misc_feature (71): n=a or g
ggccatctataccgcccaccgtagatctcctcaccagctccttcatggtcacgccttctccacttgtgcgncagctagcggtgggcacgaggcttccttca

SEQ ID NO: 12891 - DNA, 101 bp, rice(Oryza sativa)
  misc_feature (71): n=a or c
ataatcagcaaatttcaaaagtcattttctgacttgacagcatgaaaatatataaccttgctatccctttntagtttgaatttggattagtcattactaga

SEQ ID NO: 12892 - DNA, 101 bp, rice(Oryza sativa)
  misc_feature (71): n=a or g
tcgatgtcgctgatcctgattacatcaaggacaagagtgaagccctagatgcatggctgtggcagctcagngatgcagtcgaggaggctgaggatgccatc

SEQ ID NO: 12893 - DNA, 101 bp, rice(Oryza sativa)
  misc_feature (71): n=a or g
ggacgccgggtcgagcacgcggagcaacaggttgttgtcgacgaggagagccatgccgcaacgcgtggacntccaccacctccctcccgtaggcgttgagg

SEQ ID NO: 12894 - DNA, 101 bp, rice(Oryza sativa)
  misc_feature (71): n=t or c
tacgtgctttctgtatgtcaagctccttcttaattcttttcggccacttctcacgcttttgtaatgcagcngtcacgaacttatgcctatcaacaaaccac

SEQ ID NO: 12895 - DNA, 101 bp, rice(Oryza sativa)
  misc_feature (71): n=a or g
acagaaacaaatatttttatacaggttcgggcctcttcataggagggtaacaatcctactcctgttggccnaaaccggtcttgctcttattcatcagaatc

SEQ ID NO: 12896 - DNA, 101 bp, rice(Oryza sativa)
  misc_feature (71): n=a or g
ttttaacttctgagtgaatctgcgagttaaaattttaactcatggagtcatggtgacgtggacgaatctcnaagatttatttcttgatccaaagatagttt

SEQ ID NO: 12897 - DNA, 101 bp, rice(Oryza sativa)
  misc_feature (71): n=t or g
aggcaaccagcagtgctacggacttttagtcaaaggctgagcaggtgatttttttataaattattactcancaattaatatttttttcacctgtttaatct

SEQ ID NO: 12898 - DNA, 101 bp, rice(Oryza sativa)
  misc_feature (71): n=t or c
tttttttagaaaataaaattgcctccaacaatcccctagttagtttcccaacgcgttgaggatcactctanaggagagggagggatcgcacatgagaggtg

SEQ ID NO: 12899 - DNA, 101 bp, rice(Oryza sativa)
  misc_feature (71): n=a or g
tgaccgccttgcaacaagaggctggcaaaataatgggcattgccctctctgccgttctgaacctgagacangaatacacctagtcggcaagtgcagataca

SEQ ID NO: 12900 - DNA, 101 bp, rice(Oryza sativa)
  misc_feature (71): n=t or c
agatagatagatagatagggttgacaatgggatcgatgatgaaccaaacgcaatgcaagattcgacacggnaacgggtatagatcagctgcgctgcacgta

SEQ ID NO: 12901 - DNA, 101 bp, rice(Oryza sativa)
  misc_feature (71): n=a or c
ttataataggcttgttatcaaacctccttgatgagttcggacgatcaatccttcccggaggaggtgcaggnaggggaagaattctatggtgctgatgagtt

SEQ ID NO: 12902 - DNA, 101 bp, rice(Oryza sativa)
  misc_feature (71): n=t or c
gtgattgattttgcccccctaggtggatagggtggaaagaaggctaacagctagttcaatgttcttacctnaaggagatagattgactttaataatttctg

SEQ ID NO: 12903 - DNA, 101 bp, rice(Oryza sativa)
  misc_feature (71): n=t or g
tggttttgtttaagcatttccatgtcttttattatacaattactttgcaaatttattctcctcgccctatnttattttattttcccaactatgccataatt

SEQ ID NO: 12904 - DNA, 101 bp, rice(Oryza sativa)
  misc_feature (71): n=t or c
gagccatcaccttccttagacgtttgtacgtacgttgctaccttcaactgctacatctgcatgcatatatngatactacctctgttttagattataagact

SEQ ID NO: 12905 - DNA, 101 bp, rice(Oryza sativa)
  misc_feature (71): n=a or c
ccaccccagtatctccacttcccgagtcaatatcgaaggcagcatcaacattgatcattagcattccttcnggaggtttcttccaaccgttctgaattttt

SEQ ID NO: 12906 - DNA, 101 bp, rice(Oryza sativa)
  misc_feature (71): n=t or c
ttttggacccctcccatacaaactacacagaatccccccaaatccctcccagtcccattctcccctaatangaagattgcgagggagagtggcaagtgagt

SEQ ID NO: 12907 - DNA, 101 bp, rice(Oryza sativa)
  misc_feature (71): n=a or g
ataggtcctgcatgctacagtggcgcatagtagcgcaaagtgatttttctattttatgtttttatcccttntcaaattatagttgttcaatatgtaccctt

SEQ ID NO: 12908 - DNA, 101 bp, rice(Oryza sativa)
  misc_feature (71): n=a or g
aagatacagtaacgtttagggatgaatcttcactgttctaacaaaaagataatttttagggggttttaagnaaaatatgaagtgaaaccctgaaaattacc

SEQ ID NO: 12909 - DNA, 101 bp, rice(Oryza sativa)
  misc_feature (71): n=a or g
ggtttctaccttcgttttttcttaaaaaaaaggaaaatgaacaaacgaggagaatcattttctatttcttnatgtgaacaagattacttccctaggtttgg

SEQ ID NO: 12910 - DNA, 101 bp, rice(Oryza sativa)
  misc_feature (71): n=t or g
ttccactcaggcacaaccgcacaagccggcccagttgttcattaatcccttatgtttgctaatttgtttanagtagtataaaagttgttaaggaacataga

SEQ ID NO: 12911 - DNA, 101 bp, rice(Oryza sativa)
  misc_feature (71): n=t or c
ggcagccaacgtgtgtttcgggccaagagtattatgaaattttgtttcataaataaggctgtgtttagttnaagctaaaattgaaagtttggttgaaattg

SEQ ID NO: 12912 - DNA, 101 bp, rice(Oryza sativa)
  misc_feature (71): n=t or c
tcaatatataaggcaaaatctcttgcctttccttcaaaaaataaaaggcaaagatgaaagtgcttaggctntcctgcaaaagagtgtgctggatttttcac

SEQ ID NO: 12913 - DNA, 101 bp, rice(Oryza sativa)
  misc_feature (71): n=t or c
ggcttcgttgtactattgggggcccaactatttctcccctttttgaaccggctcgaaaaatactcggctancgcaattttcacaaggccccccctgcccga

SEQ ID NO: 12914 - DNA, 101 bp, rice(Oryza sativa)
  misc_feature (71): n=t or c
tgatgcctgagctcactgagtcacgttcaccggctcactgcctcccagtcttccagcgatgcatcggcgancatcaatggcctcatcgtcctccttgcgcc

SEQ ID NO: 12915 - DNA, 101 bp, rice(Oryza sativa)
  misc_feature (71): n=a or g
ccaagccatcaaaaccacctccaatttgcatacttcctagagataggcagtcaaattgtcaatcaggcaanaccaatccttcatgacttgattaacaacca

SEQ ID NO: 12916 - DNA, 101 bp, rice(Oryza sativa)
  misc_feature (71): n=t or c
tgctaattactgggattattacttggtaaaccctgctactgcctccgtcacacaatataaaagattatgtntttttcttaataaattaacaaagtagtaaa

SEQ ID NO: 12917 - DNA, 101 bp, rice(Oryza sativa)
  misc_feature (71): n=t or g
atacaacaagagggcggcaatacaattagccctaatacaatggcaaaacatcattagttcactacgttcanttcaatagtataactataagtgttcactgt

SEQ ID NO: 12918 - DNA, 101 bp, rice(Oryza sativa)
  misc_feature (71): n=a or g
acggaggaggatgggtggggagtctcgtgtgagtcgtgtctcgcggttgatggcgtgtaagagcgtggccnccgatggtctcgtgtctcgcttgctcagct

SEQ ID NO: 12919 - DNA, 101 bp, rice(Oryza sativa)
  misc_feature (71): n=t or g
aggtttaacgaagatattgttctctaattgaatattggcttgtacttctcaggtcctaatccatgggatcnctcatcatattggttgtgttaccaccatag

SEQ ID NO: 12920 - DNA, 101 bp, rice(Oryza sativa)
  misc_feature (71): n=t or g
ctatggtggtggatatggccaccctggatatggcggtggctacggaggtggatacggccaaggatatggcngtgggtatggtcatcctggtcacagtggag

SEQ ID NO: 12921 - DNA, 101 bp, rice(Oryza sativa)
  misc_feature (71): n=t or c
tgcatgagcatagctgtacagtccctgttaaatgttttaaaaagtggtatgcatgtacaaatttatcatcnaaccttttctgtataattaccaatttaaca

SEQ ID NO: 12922 - DNA, 101 bp, rice(Oryza sativa)
  misc_feature (71): n=a or g
ccctaccccccatcacacgcgcacacacaaccgtacccctaaacatggaaatgtttataaatgactatganctcaatcctgattactgcgaatattgtgta

SEQ ID NO: 12923 - DNA, 101 bp, rice(Oryza sativa)
  misc_feature (71): n=a or g
agggtataaccacacaccagattgtcagatcaataccacaatcggcagaatatttccctaaacaggagtanggtattacttctcatcgagaaagcctgaac

SEQ ID NO: 12924 - DNA, 101 bp, rice(Oryza sativa)
  misc_feature (71): n=t or c
atttgccgaattgatctattattcggcggcgacgttgcatagtcaataggaaattaatctacacagctgcngtcgacacgttcaatccggtctgcactttc

SEQ ID NO: 12925 - DNA, 101 bp, rice(Oryza sativa)
  misc_feature (71): n=a or g
ttaaatttaggtgttgaatttgtaattggctacaacaccagccgcctttaggatgagtttagttccaaacnttttcttcaaactttcaacttttccatcac

SEQ ID NO: 12926 - DNA, 101 bp, rice(Oryza sativa)
  misc_feature (71): n=t or g
ggaaaaatggaaagtaagtatatgtgaaaatggaaactaagtatgtaacactaaatactgatcattggttnttggaaacatggaaactaattagttggaaa

SEQ ID NO: 12927 - DNA, 101 bp, rice(Oryza sativa)
  misc_feature (71): n=t or c
tatcatgctaaagaagccttaggggctgcttgcttcactctctcattttaccaaactttgccacacttctnaagacatttgtttgtttcaatgccaaagtt

SEQ ID NO: 12928 - DNA, 101 bp, rice(Oryza sativa)
  misc_feature (71): n=a or g
gtatgagtttatagaaatccgacgaatatggatgctaatgcggatacggatgtggtatctaaaatccgacngatacggattatccgatatctctatcggat

SEQ ID NO: 12929 - DNA, 101 bp, rice(Oryza sativa)
  misc_feature (71): n=t or c
tttagcgattatttcaacagagttgtatttggaacctagcaatcatgtagtataatgctgagtttagttcnaaactttttcttcaaacttctaacttttct

SEQ ID NO: 12930 - DNA, 101 bp, rice(Oryza sativa)
  misc_feature (71): n=a or c
attttttttcttggaaggaacactatctactcccatgcgtcgccggctgtatctgatctgcaggcacactnaaataagagtgaaaagaaactgcacgatgc

SEQ ID NO: 12931 - DNA, 101 bp, rice(Oryza sativa)
  misc_feature (71): n=a or c
atagtaattcctaagactttgaatgtaaataaagtattagatatcctggactttctttgcatgtaaaaggncaacatacctttggtttgtattgccgcaca

SEQ ID NO: 12932 - DNA, 101 bp, rice(Oryza sativa)
  misc_feature (71): n=a or g
tgtcgtggatcgctcggatgtttctggaaaagcagtgctgccaccgcttcctcatccatcgcaatcgagcngaggtggagagagcgactccttccgccgcc

SEQ ID NO: 12933 - DNA, 101 bp, rice(Oryza sativa)
  misc_feature (71): n=a or g
ttaactttgttgccatttttaagatgtggaaatgaaggatttgtcactcgttgtccatgacatgtgggtgntaaatcctttatcaccacttgcaaaagtgg

SEQ ID NO: 12934 - DNA, 101 bp, rice(Oryza sativa)
  misc_feature (71): n=a or g
gatgcaaagatcatcgatgaagtaaaccacatccgcctacacgcgatatcgacaatccaaaatttcttggnttgatgtaataatataaatcttaaaaaatt

SEQ ID NO: 12935 - DNA, 101 bp, rice(Oryza sativa)
  misc_feature (71): n=a or g
ttcgtatctcttaaccacaataccagatatcttaaccccctaaccattaaaacgatgcaatttaatttctntcgacgggtgatacccgtagaccggatata

SEQ ID NO: 12936 - DNA, 101 bp, rice(Oryza sativa)
  misc_feature (71): n=t or g
tatcatatcttagtgactcaattgcgaataattaatatatctccatattctgtttatgtcataatatcagntggcatagtatactgttagattgaatttat

SEQ ID NO: 12937 - DNA, 101 bp, rice(Oryza sativa)
  misc_feature (71): n=t or g
tactctcacggtctcaccactgcacactgacaccacattcacacatatgtgagttcactccaaacacaaanattaaagaaggttatataaattcctattga

SEQ ID NO: 12938 - DNA, 101 bp, rice(Oryza sativa)
  misc_feature (71): n=a or g
cacgcgaatcacaacacccagaagctcggagcaggaatactcgatctgagagaggagatggggagagaganagagagagagagagagagagagagagagag

SEQ ID NO: 12939 - DNA, 101 bp, rice(Oryza sativa)
  misc_feature (71): n=t or c
gaatggtgtatgaaatgtgcgagtactactcgttattcaggctatttttgcctattgttgagtcgggtacnctccctagcccccagccttctcctcggaga

SEQ ID NO: 12940 - DNA, 101 bp, rice(Oryza sativa)
  misc_feature (71): n=t or c
catatgtcgataacaatgaagaagagtactatgcatacattttgttagatgaatcattaaacgtatacggngtgctagacatctctggtcagcttatcata

SEQ ID NO: 12941 - DNA, 101 bp, rice(Oryza sativa)
  misc_feature (71): n=a or c
gctgcattcaactggtgaatcaccacaggaagaatcactccattgagggctgtagagatcctactcttctnaaaaagaatcaaggttttctccctaattgc

SEQ ID NO: 12942 - DNA, 101 bp, rice(Oryza sativa)
  misc_feature (71): n=t or c
gggaggggcattagttaatttttgcgcgcgtaacggaatggaattttcttttcttgttcgtggtcaagtgnacgctgctgctgctgcttctgaatttgctg

SEQ ID NO: 12943 - DNA, 101 bp, rice(Oryza sativa)
  misc_feature (71): n=t or c
aaaggcttgccgattcctatatcaacgttactatactttccaaccattgagaaaactcagattcatccatnaaagggatatccccttattttgcgtgtcac

SEQ ID NO: 12944 - DNA, 101 bp, rice(Oryza sativa)
  misc_feature (71): n=a or g
gacaccaccatgcttatgttacacgtcaacaagctaaaggtacatacgttctatgttaagtttacttaggncctgtttggtagggctccaactcttagatt

SEQ ID NO: 12945 - DNA, 101 bp, rice(Oryza sativa)
  misc_feature (71): n=a or g
ggagcttggtggttcccagccttcagtccagagaaccctttgctcaagtcctgagctgttaatagttactnctccttccgtccctaaatattttatgccgt

SEQ ID NO: 12946 - DNA, 101 bp, rice(Oryza sativa)
  misc_feature (71): n=t or g
gaacgtcacaatctaattgaggcacgctagcttgtaaagagagaagatgaaatttgtgctggtcttgcttncgttgttaaattacagaggatccctacgcc

SEQ ID NO: 12947 - DNA, 101 bp, rice(Oryza sativa)
  misc_feature (71): n=a or g
ttgctagaggacacttgcgactcaattgtaaagataaattcttaggaaaaaagataatgcccctaggaacncatgcttcaaacatagtgatagagtgaaga

SEQ ID NO: 12948 - DNA, 101 bp, rice(Oryza sativa)
  misc_feature (71): n=a or g
tttaattttttatgttaatgaatgttatttagaatgtcgcaacgcaggcattatatatgtacagttatatncttacgttgcaacaactttcgccacctata

SEQ ID NO: 12949 - DNA, 101 bp, rice(Oryza sativa)
  misc_feature (71): n=a or g
tgcagccgcaggctcggccggttgctgcccaagtacacccctcaccacctggccaaatgtcacaagtaatngcggaaggggcttcggccttgtaggcgtag

SEQ ID NO: 12950 - DNA, 101 bp, rice(Oryza sativa)
  misc_feature (71): n=a or g
ccctctaatttttttagagtatttacacgaaaatgctactcaactacccctacaatcctcctttcctcccnttctctctcctcccctcccaatcccgagcg

SEQ ID NO: 12951 - DNA, 101 bp, rice(Oryza sativa)
  misc_feature (71): n=a or g
gagttgacggaggaaaatgtgcacaccgcgtaccgtctagatgggaaggccctctatggagttctcaacancaggggttgcgaagacagccatatgcaagg

SEQ ID NO: 12952 - DNA, 101 bp, rice(Oryza sativa)
  misc_feature (71): n=a or g
gagtgcttctagaagacaagaaaacgcctttgcttaccgcaagcgcagcagaaccacgcgacgtcatcgantgcgtctcccacgggcagtacggccacggc

SEQ ID NO: 12953 - DNA, 101 bp, rice(Oryza sativa)
  misc_feature (71): n=a or g
aagaatgggtaaagtgatacatgcgatgtgctatgcagttttttttgttgctttgcttggttgttgcttcntgagagaagtagctggtctattggtggatg

SEQ ID NO: 12954 - DNA, 101 bp, rice(Oryza sativa)
  misc_feature (71): n=a or g
taaacctatatattctagaattcagatccatagaactattggattttagttacaaaagatatagtttgtgntgaaacttgatgtttaatcgatacaatacc

SEQ ID NO: 12955 - DNA, 101 bp, rice(Oryza sativa)
  misc_feature (71): n=a or g
atgtttattttcatattgcttatagaattaatagcatgccttatgtatttccatggccgtattttttttgntagttatgcctgtcagggttacggataagg

SEQ ID NO: 12956 - DNA, 101 bp, rice(Oryza sativa)
  misc_feature (71): n=t or c
gggattctaaatacaattgaggaacctaatgatggggatccggcaattgagcctaggaagctcaatacaancctttttcttttgagactctacattcacaa

SEQ ID NO: 12957 - DNA, 101 bp, rice(Oryza sativa)
  misc_feature (71): n=a or g
acaaaattcacatatctctcatctggttttataaactataacgtagatatgaccatcatctgtgacgggcnccaacttgaggccagattgagatgtggaat

SEQ ID NO: 12958 - DNA, 101 bp, rice(Oryza sativa)
  misc_feature (71): n=a or g
taccatatagtgatggtctctactcgtaatagaaactatgataagtagaaataattcgaatcgttaatttntgaattttatcatcaaatagaaggaaaaga

SEQ ID NO: 12959 - DNA, 101 bp, rice(Oryza sativa)
  misc_feature (71): n=a or g
cgatccatcgctagtatatcaacaccaaaaaatgaaaccaaaattttctacacgagtagaaacaaaaaaanaaaacttgtaaaaatgtgtactactatgcg

SEQ ID NO: 12960 - DNA, 101 bp, rice(Oryza sativa)
  misc_feature (71): n=t or c
caattattcgttcgacctcacctttacctgtttttgttttcagccgtcttgttatatactccctccgtttnaaaaatgtttgacaccgttaatttttagta

SEQ ID NO: 12961 - DNA, 101 bp, rice(Oryza sativa)
  misc_feature (71): n=a or g
cacaaagttatacgtggattggatttacaatctacggtgactataatatcaattacttaatcaatggtcanatttttctagctaacgtgggaactcgtaga

SEQ ID NO: 12962 - DNA, 101 bp, rice(Oryza sativa)
  misc_feature (71): n=a or g
aattaattcaatcagcattctcgctttgtataactcataactaccaggctcttaaacaacacttttgccanctcaagtaataatagaaaggttggagatac

SEQ ID NO: 12963 - DNA, 101 bp, rice(Oryza sativa)
  misc_feature (71): n=t or c
tagtgtgattttcttacacatgcatcttcctcataattgcagtataatttttcctattttctacatgtatngcatctctaatcccttctctatgcagcatg

SEQ ID NO: 12964 - DNA, 101 bp, rice(Oryza sativa)
  misc_feature (71): n=a or g
tgacataaacaccagcttaattaggctgagtttttatgtgaatgtcccaaccttttctaacttgtttttcncgcacacgcttcacaaactattaaacaata

SEQ ID NO: 12965 - DNA, 101 bp, rice(Oryza sativa)
  misc_feature (71): n=a or g
aaaaaagcagtagtaaatgggtaaatcttggaactgaaacagtagtactccctccaacctataatatttgncacagtcttcaaaactaatgtttgacttat

SEQ ID NO: 12966 - DNA, 101 bp, rice(Oryza sativa)
  misc_feature (71): n=t or c
cgcatttttgctttcttaattatctgccttttattgggaaaaaaaagaggaagactgatcagtcatcagcnacaattttgtgccgtttttgtgttttttta

SEQ ID NO: 12967 - DNA, 101 bp, rice(Oryza sativa)
  misc_feature (71): n=a or c
ctggttactgctaatcacaggcggtttgaccgtattaccactcattttgcttactacttgatctgagccgnttagctcggtaagaagtaggtgagtagcct

SEQ ID NO: 12968 - DNA, 101 bp, rice(Oryza sativa)
  misc_feature (71): n=a or g
tgggttccgtcaaatgtacacgtaccgggttaactgttagtggggattgtctgcaatattgcacttgtagngatccaacatgtcagtggcagctactgtaa

SEQ ID NO: 12969 - DNA, 101 bp, rice(Oryza sativa)
  misc_feature (71): n=t or g
gaggattattttctttgtataggtgtggtgggcatggcatggctgtcagcgagaggaaggagaagcaggtncagaataatcagtgcggtgtggggcccacc

SEQ ID NO: 12970 - DNA, 101 bp, rice(Oryza sativa)
  misc_feature (71): n=a or g
ttttcgtttttttttctgactaggctgccatgtatgccatatagaccaaaaaccactccgaattgagttangggggggtgattcgttcggatttaagagtt

SEQ ID NO: 12971 - DNA, 101 bp, rice(Oryza sativa)
  misc_feature (71): n=a or g
ttagctttagaacaccgcacgaagtgccttttaggggaagacactatcaaaacttggatattttcttgtgnacgccgcacctattaaaataataatttccg

SEQ ID NO: 12972 - DNA, 101 bp, rice(Oryza sativa)
  misc_feature (71): n=a or g
aaatctagaaaaaaaaatagtatatactctctatatgagagaatctcttaatgccactagaatttcaccanttcccttatatgccacttaaaattggcttc

SEQ ID NO: 12973 - DNA, 101 bp, rice(Oryza sativa)
  misc_feature (71): n=t or c
aaagccttgtttcttagggcctctttggttgggcctaggtttattgtgttaggcttttaagttaacttttngctttatatttttataagccgatggcttta

SEQ ID NO: 12974 - DNA, 101 bp, rice(Oryza sativa)
  misc_feature (71): n=a or g
ccgcatcttttcacgcaccccttgccacacgcagcgatcgggcttgcgcttgagttcgttttccacacgcntcttcgcacgctgttgcgattgggcccgta

SEQ ID NO: 12975 - DNA, 101 bp, rice(Oryza sativa)
  misc_feature (71): n=t or c
tttatataaatcgttatgcaggatttctttttaatcatacgagaaataggatcttgcatagcctgatcaanttaggggtagcactgattaatatttttccg

SEQ ID NO: 12976 - DNA, 101 bp, rice(Oryza sativa)
  misc_feature (71): n=a or g
gagggaggagagagaggaggcgtgggagaacgagagatttgtggtgggggaggcaagtacggataaggacnggagatgtcgcgctcggctcggtttttgaa

SEQ ID NO: 12977 - DNA, 101 bp, rice(Oryza sativa)
  misc_feature (71): n=a or g
ttaagttcacccattgcaaagcacatgactcatactagatatcttaaagcgcctgcgtttgccgctcccanagcgatttggctcctgttgactaatccgct

SEQ ID NO: 12978 - DNA, 101 bp, rice(Oryza sativa)
  misc_feature (71): n=a or g
catcccttggtattctctatccccctaaattgtagtttaactagatgctagctttgtactgatccaccctntgtgtttatagagaatcaagcatgcatgga

SEQ ID NO: 12979 - DNA, 101 bp, rice(Oryza sativa)
  misc_feature (71): n=t or c
agctcctcaagctctctctctcccatgtctcccatgtccggccatcactaccgttggccgatctccctcancggagttccactggccatatccttgcgcca

SEQ ID NO: 12980 - DNA, 101 bp, rice(Oryza sativa)
  misc_feature (71): n=t or g
attattgaatttgcgagaaataaactaacagagattctgattatatagaattagtgaatgatattaaatangttcatttaaatgagcattagataccttag

SEQ ID NO: 12981 - DNA, 101 bp, rice(Oryza sativa)
  misc_feature (71): n=t or c
tttctttatgatttaattatttttaaattcataaataatatacttgattggagacttagttgtagcttctnaagtctaaaatttataatcaataataaata

SEQ ID NO: 12982 - DNA, 101 bp, rice(Oryza sativa)
  misc_feature (71): n=t or g
ttcaaaaaataaactaaaagccagactaaaaaatccaaccttttcatattttgacaactctatattttcanattgtagcaactctacttttccaggccttg

SEQ ID NO: 12983 - DNA, 101 bp, rice(Oryza sativa)
  misc_feature (71): n=a or g
gccacctcacgcatgcacggatccaccattgtcgactgccgccgaacagggcctctcgtgccatgcactcnccgctgcctcaaatgcgcgagggcacaccg

SEQ ID NO: 12984 - DNA, 101 bp, rice(Oryza sativa)
  misc_feature (71): n=t or c
atatatggtatatattttagttttgtcctaaagtcaactatttttatctttaactacggtatctaaaattntgtatagtttaacaacatacgagtacatat

SEQ ID NO: 12985 - DNA, 101 bp, rice(Oryza sativa)
  misc_feature (71): n=a or c
tgcccctgcacgcgcgggtacagaaggaacagaagcgagtggtagctagtctagtcaagcaatagctaagnggcttgccgctccgctgctgtgtgcctgtg

SEQ ID NO: 12986 - DNA, 101 bp, rice(Oryza sativa)
  misc_feature (71): n=a or g
tggacttgatgccatcgtgagtgagacaaagcgatggaaaccgagcgcgggaggcaaaaaaagtagcggcncggactcagaaggacgagggcaatcgcggg

SEQ ID NO: 12987 - DNA, 101 bp, rice(Oryza sativa)
  misc_feature (71): n=t or c
cgacttatgtacgtagaccaacattgccacacgtcatgtgtgtgcactgtgaatgacctaattactactgnctccgtcccaaaataagtgtagttttgcac

SEQ ID NO: 12988 - DNA, 101 bp, rice(Oryza sativa)
  misc_feature (71): n=t or c
aaacgttgtactccatcaaagtatcaaacgaatccacttggaaatttcggaccgaccggttttagattccngccaactgagcctgtgaaaatagtaaccga

SEQ ID NO: 12989 - DNA, 101 bp, rice(Oryza sativa)
  misc_feature (71): n=a or c
gataaataaacatacaggtggggcagagtacaaaaatgaatggatcattgaaatctaccagcaatatcccnaaattgagttctgaacgcccaaattagcct

SEQ ID NO: 12990 - DNA, 101 bp, rice(Oryza sativa)
  misc_feature (71): n=a or g
ccctcgcgaaccccaaccccactcgggagaggagccgccaacatcgagcccttccttccggccgtttgccnctacgacaccatcttgggagggggcaaggg

SEQ ID NO: 12991 - DNA, 101 bp, rice(Oryza sativa)
  misc_feature (71): n=a or g
gtggaggcggccaggtgggcagatggcgtgtggacgggcggtgtgttggagcatgacgccatgacgggatnatgtgtggaccgcggcgtgtggccaggcag

SEQ ID NO: 12992 - DNA, 101 bp, rice(Oryza sativa)
  misc_feature (71): n=t or g
catgtgcaagctgttctagcttacaaccttctgaaccctgtggttgatcaaatctctgcaactccttattncctttctgatgaacgaaatcggccagcgat

SEQ ID NO: 12993 - DNA, 101 bp, rice(Oryza sativa)
  misc_feature (71): n=t or c
gatttgattgatcatataatctactcgttcttcccgaaaacataataatctaggatcggattgatatgtcnaatccaattctaaattattatttcctccgt

SEQ ID NO: 12994 - DNA, 101 bp, rice(Oryza sativa)
  misc_feature (71): n=a or g
ccttgaaaggttggatctaccacaggaagttagggggcaaagaaaaagtgctccgtgcttcgatggtgctngtgttgaatagtcccacattagttgtggaa

SEQ ID NO: 12995 - DNA, 101 bp, rice(Oryza sativa)
  misc_feature (71): n=a or g
tcccctcagccgctcgctcaaccactggcgcgcccgacattgaagtcgaccattactgtgccttcgccgcnacgcgatgcctaccgccgcgcctacgagct

SEQ ID NO: 12996 - DNA, 101 bp, rice(Oryza sativa)
  misc_feature (71): n=a or g
tcctgttcagcgaagcaaaatctcctgttcgaggtgaagcaattttcttcaatgtcctcactaattgtcantactagaacttcaatgtcttgaactcggtc

SEQ ID NO: 12997 - DNA, 101 bp, rice(Oryza sativa)
  misc_feature (71): n=a or g
aagtggcaaggcaaagagctgaggtagatcagaagtagagaacataagaactgagagatttgtattcctgncaaaagaatagattctgggataaaccaagg

SEQ ID NO: 12998 - DNA, 101 bp, rice(Oryza sativa)
  misc_feature (71): n=t or c
caagatttgattagagtgtttttgtaaacaagtttttgtgcgtgtatggtgtatcattttcccaactggancgcacgccctgccatgtaggccggaaacgg

SEQ ID NO: 12999 - DNA, 101 bp, rice(Oryza sativa)
  misc_feature (71): n=t or g
atgttccccttgaactagaggtcaaatcgtacagaaaagagagaataaatcacaaaatcacaactccactnaatcacaaaatcacaaatccaacaacaatg

SEQ ID NO: 13000 - DNA, 101 bp, rice(Oryza sativa)
  misc_feature (71): n=t or c
tatgaataacttctcaaatatttgcgttagaaacatgaagactatgcatatgcgcctgtttgcacagctcnaactacaactccaccttttctcgagctaga

SEQ ID NO: 13001 - DNA, 101 bp, rice(Oryza sativa)
  misc_feature (71): n=t or c
ttttggtcatacatggcatacacacactagccaaaaacaaatctaaaatcggtagggcccacttctccganatcctccccccccctcctatgttttttttc

SEQ ID NO: 13002 - DNA, 101 bp, rice(Oryza sativa)
  misc_feature (71): n=a or c
taaggagtcgtatgcgaaaatgccaacacggcaagttgtggtccttttgcaaaaattatagggtctcgtanacaaaaatcgtttgtgtagtagtgaggggt

SEQ ID NO: 13003 - DNA, 101 bp, rice(Oryza sativa)
  misc_feature (71): n=a or g
gaaatgataaaattgaagcagagtcgatgctaatgtcagagacgcgcaaatgtcgatgaggtgatgagcancgcaaacccgatctctgatcaggagaaaaa

SEQ ID NO: 13004 - DNA, 101 bp, rice(Oryza sativa)
  misc_feature (71): n=a or g
ttggttcttgtcgtttccatttcctttgctcttctatcttgattagcttaacttaggtatttgcttgccgngcagacctcgaaagtgcgcttgcttatcgc

SEQ ID NO: 13005 - DNA, 101 bp, rice(Oryza sativa)
  misc_feature (71): n=a or g
attactagcaacaacagtcaacggcagcactcaattggcagcactcaattgtttagttcacaccaaaattngaagtttggttgaaattagaacgatgtgac

SEQ ID NO: 13006 - DNA, 101 bp, rice(Oryza sativa)
  misc_feature (71): n=a or c
gtttaaaagtaaacggtgtcatctattaaaaaacgaaacgaagggagtagtttacaacaagtcatctaagnaacatagtaaaacaaactattttaagaata

SEQ ID NO: 13007 - DNA, 101 bp, rice(Oryza sativa)
  misc_feature (71): n=t or c
aatatatctggtacggctctgttcatgtttcttctctctaactattctccatctctttcaacaaattaatnttttcttttttttctttgcaaggaacaaaa

SEQ ID NO: 13008 - DNA, 101 bp, rice(Oryza sativa)
  misc_feature (71): n=a or g
accctgttttttttttgaaacaatgtttagttggagcatagtgaaaatgacactaaaattcagggagaaanacaataaaaagcactactactagtgtacta

SEQ ID NO: 13009 - DNA, 101 bp, rice(Oryza sativa)
  misc_feature (71): n=t or c
atatgagtattctatcaggccaggcccgtttacatctggcaactttcataggtctaggtcatagaatgtcntcacagaccaacgcaagtcttttctgcaca

SEQ ID NO: 13010 - DNA, 101 bp, rice(Oryza sativa)
  misc_feature (71): n=t or c
tcatcttgatccccaagaaaggtttggggatatcggacctggtactgtataatagaaaatctatcccttcngagtaggactttggaaatcacttgactcgt

SEQ ID NO: 13011 - DNA, 101 bp, rice(Oryza sativa)
  misc_feature (71): n=a or g
ccccaagtcacagctcaagagccaatcagatacagtagtgtaaagttttggacggtctgataagagcaagnctaatagtgaaagtagtagtcggcggtagt

SEQ ID NO: 13012 - DNA, 101 bp, rice(Oryza sativa)
  misc_feature (71): n=t or c
tgagtacatcgcatatatttgccatatggttgaaggggattgatttagattccaatctcaagtttaggtcnatggtgaacattggtacaatgtcattcatc

SEQ ID NO: 13013 - DNA, 101 bp, rice(Oryza sativa)
  misc_feature (71): n=a or g
ttacagagattaaatatttcagattacaatacaccatcctcttttcttttgattctttttaaaagataatnaccatcctcttttgatgcatttacagtcct

SEQ ID NO: 13014 - DNA, 101 bp, rice(Oryza sativa)
  misc_feature (71): n=a or g
taacttaatattttatttgttgattaactgaaatatgaccatccaatttttttaagggatcggacgatccntagattccacaaaaatcatgcgtgatcctt

SEQ ID NO: 13015 - DNA, 101 bp, rice(Oryza sativa)
  misc_feature (71): n=a or g
gtaatgcgcactcatccacgtctgaagacagagacaaaaagcatgcattcagaagtcaaactaaacttgtntaagctagtctgtattactttcattatcat

SEQ ID NO: 13016 - DNA, 101 bp, rice(Oryza sativa)
  misc_feature (71): n=a or g
ggaactcgataagattggaggtggctattgatctctcctaacttttatagcgcttattggatcgtgtcttngctcttgtgactgcttgtccactctctttc

SEQ ID NO: 13017 - DNA, 101 bp, rice(Oryza sativa)
  misc_feature (71): n=a or c
ttttaaggaaaacgggtacctttgttcgtgcttgttttttttttcgagcacggaggtttttcaggaggacnggtttatacgtactattttttttaaagaat

SEQ ID NO: 13018 - DNA, 101 bp, rice(Oryza sativa)
  misc_feature (71): n=a or g
atctcaaacaagagtaatctccgcagtccacacgaattagtggtccgtcaaataagatctgctacgctgtncatactacaagaagctttccacgttctgaa

SEQ ID NO: 13019 - DNA, 101 bp, rice(Oryza sativa)
  misc_feature (71): n=t or c
catgctgccattgtaaatcaacaacagaaccagaagaacagttcgacaataataggtctgtaactactaantacacattatcttcttgtttttttttaact

SEQ ID NO: 13020 - DNA, 101 bp, rice(Oryza sativa)
  misc_feature (71): n=t or c
agaaccaattaataaaagtgagaaacgcaacttagacccaagatttcctaatgaaatttacaatagcaacnaggaccttacctttacttcaaatcctagag

SEQ ID NO: 13021 - DNA, 101 bp, rice(Oryza sativa)
  misc_feature (71): n=a or g
cactgaagaaattataggagactaataatttacaataaagcggtgcatcgtattggcataagctaaacccntatgtgaaagggcatgtagcctaatagttg

SEQ ID NO: 13022 - DNA, 101 bp, rice(Oryza sativa)
  misc_feature (71): n=t or g
ttgccttgatatatgagagaacacaagcaataggtatcttattataaaaaccatgccttacattgtcgtangcatgctctaaattataatccaaaattacg

SEQ ID NO: 13023 - DNA, 101 bp, rice(Oryza sativa)
  misc_feature (71): n=t or c
tttgatcatctgaactatgcatttttgctcatcactcgaccttgcaaccaatttacatccacatcggcatnaaacctcttaaaaaatcatagtttttaaaa

SEQ ID NO: 13024 - DNA, 101 bp, rice(Oryza sativa)
  misc_feature (71): n=a or c
tttaccttaccctgcttaggccaaaccaaggcggatttcacctgcatgatgttgatgtggctatccaatangaaaaatcctaaaaaaaaaattacagagtc

SEQ ID NO: 13025 - DNA, 101 bp, rice(Oryza sativa)
  misc_feature (71): n=t or c
tctcttttcgaattaattttgcccgtccgtgcttgggctcgtgacctgagaaattgtgtccaatgggctgncgcccacgctcttcgccagcttggtccatg

SEQ ID NO: 13026 - DNA, 101 bp, rice(Oryza sativa)
  misc_feature (71): n=t or g
aatggcagtgttcatcaccgcactgatgctgctagctgaaggtccatttagaatgctcattcgcttggcanatttggtttgttcttttaaactttttttaa

SEQ ID NO: 13027 - DNA, 101 bp, rice(Oryza sativa)
  misc_feature (71): n=a or g
ttgtgaaactgtaggttgtagaagaaatacctgttgtcggtgatataggtccggggtaaaaaacttaaagngaagaagccccccccccaactttcacgtgg

SEQ ID NO: 13028 - DNA, 101 bp, rice(Oryza sativa)
  misc_feature (71): n=a or g
tgccaattcagcaattgtctttgaccatgtcaacttggactttggcatgtccagctaccaaatccacgccntacactcttgtttctggagtagatgttgac

SEQ ID NO: 13029 - DNA, 101 bp, rice(Oryza sativa)
  misc_feature (71): n=a or g
tgatgacggtgcatggtcagcggaagaataatcctaaagcggcggcggcggtggtctcaaatccaagacangggcattggcgcgccgtccttgccagtgca

SEQ ID NO: 13030 - DNA, 101 bp, rice(Oryza sativa)
  misc_feature (71): n=t or g
tcaaacttaagattatatatatatggcccctgagtacaatgtatctattcctttcttgtgcacaagagcanaacaaaggagtaaagaagcagtggatgagt

SEQ ID NO: 13031 - DNA, 101 bp, rice(Oryza sativa)
  misc_feature (71): n=t or c
catatgtcaagctggattgaagttcattaaaggcactgttactaagatacgggagagtgctaaatacgtcngtagttcgtacggtcaaaaagaggagttca

SEQ ID NO: 13032 - DNA, 101 bp, rice(Oryza sativa)
  misc_feature (71): n=a or g
tcagatattttctttctccctttcatatattctttggagctcctgcaactgaactcaacgaatttcaaaanccataaattcagtttggatcaaactctagt

SEQ ID NO: 13033 - DNA, 101 bp, rice(Oryza sativa)
  misc_feature (71): n=t or c
ttgtagaaatgtttgttctaggattgcttgcattttatctgtagtaagatagtgtatgtggtagggatcanagtgaaatctcgatgacacacaagggattg

SEQ ID NO: 13034 - DNA, 101 bp, rice(Oryza sativa)
  misc_feature (71): n=a or g
caaggatttgaacatgaggcggggcaagaggcaatggcataaaagatgacaatatatattctgcatctagngtaatagagcatatctatatatattacata

SEQ ID NO: 13035 - DNA, 101 bp, rice(Oryza sativa)
  misc_feature (71): n=t or g
tcatcaaactttatttcttgcctcacggtagctgagaaatagagagtagatgggatgggaacgtgcacagntgcgcacggcaaacggagcggtccattagc

SEQ ID NO: 13036 - DNA, 101 bp, rice(Oryza sativa)
  misc_feature (71): n=a or c
tgatcttagataattatatcaagatgatacaatcactctaaggttgtgttctttgttcagtgttcccaacncctctccctcgtgttccgtacacacgcttt

SEQ ID NO: 13037 - DNA, 101 bp, rice(Oryza sativa)
  misc_feature (71): n=a or g
acaggagagtactgttgactacataatatgtgtgtgtttctaaaaagaggtgctaggcgaggtaggcaccncttagccacccgactactgccgtgtttagt

SEQ ID NO: 13038 - DNA, 101 bp, rice(Oryza sativa)
  misc_feature (71): n=t or g
ttaaaaacaatgaatgcaacttttgagatttttcaagttttttagagcaagagatacatgaatgtggtttncacaatttcaccctaaagtatctctcactt

SEQ ID NO: 13039 - DNA, 101 bp, rice(Oryza sativa)
  misc_feature (71): n=t or c
gtccacataaacatgattaaaacttttacctcgagtaaacctctattcgtagttaaatctaggagtaaaanttgaacattcattttctttaatttatggta

SEQ ID NO: 13040 - DNA, 101 bp, rice(Oryza sativa)
  misc_feature (71): n=a or g
tatgtaccaactagggagtgaactattgacgtcaggtactattgtgaagtgttatatgtttggaaatctcnaataaagtaagtagaacatatgtagcttga

SEQ ID NO: 13041 - DNA, 101 bp, rice(Oryza sativa)
  misc_feature (71): n=a or g
ttcgcgaactaaacggggccttaccatatccttaagaacatctccgaaatattaggttaacatatcttaanattaacgaagtcaccatgggtctatgtcta

SEQ ID NO: 13042 - DNA, 101 bp, rice(Oryza sativa)
  misc_feature (71): n=a or g
cagacttcctaagaaaaaaaaaatcagattcgtcttttttatcccgtcccgtccgcgtccggctccgaccnatcgatggcgatgcaaccacaggaagcgac

SEQ ID NO: 13043 - DNA, 101 bp, rice(Oryza sativa)
  misc_feature (71): n=t or c
gctgtatagtttcttcttgagaagttacagaaattctatgtgactacatctgtttactcccatagttgcangttcatttaaattaacaacatgtgggaaat

SEQ ID NO: 13044 - DNA, 101 bp, rice(Oryza sativa)
  misc_feature (71): n=a or g
caaagggaaggtggctagggctgacctacctcgtgggaagctagctctgctgggtggcccttaggggcctncaacaggccttacccgccagcatgtgacaa

SEQ ID NO: 13045 - DNA, 101 bp, rice(Oryza sativa)
  misc_feature (71): n=a or g
catgaaaaacaacatgggacccacccgccagcctcttccttgtgtccatctccctctccgatgcacgcggncatgacatcatgggcgaccgggtgcttggc

SEQ ID NO: 13046 - DNA, 101 bp, rice(Oryza sativa)
  misc_feature (71): n=a or g
gttgtagtgaacttgcaattcgctgagactgcagattcaacagaacaagttagattcaggagagctaagtntgaaaactaagtatatggtgtagcaattgc

SEQ ID NO: 13047 - DNA, 101 bp, rice(Oryza sativa)
  misc_feature (71): n=a or c
gttggattccccaccaaacaaacaagattccttttttttcacatggggacaaaatagttgaacacttggantcgatatgaaagactagtagaatataaaca

SEQ ID NO: 13048 - DNA, 101 bp, rice(Oryza sativa)
  misc_feature (71): n=t or c
tgttggaggtgcttgccagcggccaccaaacgtcatgctcaccatcccggctcaccgacgtcggcctacgntccactgtcaccaacttaatgtaccgccac

SEQ ID NO: 13049 - DNA, 101 bp, rice(Oryza sativa)
  misc_feature (71): n=t or c
cttcaatgaacacctacaaccagaagaaatatactgggtgatctaggcagtgtgccatgcctcggttcggntcatgtgcttcggacccttttgattttcct

SEQ ID NO: 13050 - DNA, 101 bp, rice(Oryza sativa)
  misc_feature (71): n=t or g
gtattgttttcaaggacttaattttcccattctcaattattcgttgcaacacataggcatcttaataaaanatgaaatccagcagcactagaagcaacaag

SEQ ID NO: 13051 - DNA, 101 bp, rice(Oryza sativa)
  misc_feature (71): n=t or c
agcggtctgaccgggttgcccgatagtcagaccggtagactctaggagggaatcggtttcgggttgttttngtacaatttctagattgctttatgtatatg

SEQ ID NO: 13052 - DNA, 101 bp, rice(Oryza sativa)
  misc_feature (71): n=a or g
ataaaaagtcctcttcgtaaatacgaggaatcaatcgaacaaacccttagaaagaacattttctcactttncctgctctctctgcttagtatgtgtttgga

SEQ ID NO: 13053 - DNA, 101 bp, rice(Oryza sativa)
  misc_feature (71): n=t or c
atacggttggcctattatgccgccgttgatgggtgtcttcactatcatcgtcagtcgcctcaagctgcttntttggctggtgttttcattgccaatgatgg

SEQ ID NO: 13054 - DNA, 101 bp, rice(Oryza sativa)
  misc_feature (71): n=t or c
cccctcagtgatttaactacacgctaaacaaccgatcatcaacgagggtttttcttcagcgatttaacagnacgctaacaactgtgacgggccgctggcct

SEQ ID NO: 13055 - DNA, 101 bp, rice(Oryza sativa)
  misc_feature (71): n=t or c
gcactcggattgatttccttttgtttgttggtgatgagactctgctggaatttcagctagctgaactgaanccccaatgcaccgcgtttgctcagcacctc

SEQ ID NO: 13056 - DNA, 101 bp, rice(Oryza sativa)
  misc_feature (71): n=a or g
acaagtactcgaacatccaaaatggagttcatatgcaaaatccttgaccgttttaccatgggactatcctngttgtccaaaccatccaaaccttcttattt

SEQ ID NO: 13057 - DNA, 101 bp, rice(Oryza sativa)
  misc_feature (71): n=a or g
ggaggtatggatggttgcatgaggacgaacaggagagaggaaggtggagactgcccgtgtgttctgaactnatttggatcgaagctattgcctagaatcca

SEQ ID NO: 13058 - DNA, 101 bp, rice(Oryza sativa)
  misc_feature (71): n=a or g
atgtcactggccaactcatctccctctagtccccatctctcactttctcaagcgttggagtggggtggctngtgagcaggggaccgtggcggtccgtagca

SEQ ID NO: 13059 - DNA, 101 bp, rice(Oryza sativa)
  misc_feature (71): n=a or c
ataccacccttagcactgtagcattagttgattgttagtcacatgttattttttttaaatgaccaatatgncttctcaactaaaaaatgtgtaaactttaa

SEQ ID NO: 13060 - DNA, 101 bp, rice(Oryza sativa)
  misc_feature (71): n=a or g
gaatgggtccatataccgtcatcgacacttcatcactgtaatgccccgagtttcgaaatagtatatttcanggaatattagctcagacacgcaacagttca

SEQ ID NO: 13061 - DNA, 101 bp, rice(Oryza sativa)
  misc_feature (71): n=a or c
ttcatatggttgcccttggtgtgcataaatcttctcaatattatttgaaacctgctgtcttgtgaggacantggaaaattagaggcaaatctaacggaata

SEQ ID NO: 13062 - DNA, 101 bp, rice(Oryza sativa)
  misc_feature (71): n=t or c
tccttctgtcactaacagtcaggtcccacaaccttttctttagtaaaacaattatttttgtaaaggaatanagtgagtcaatgacaggtggggccatagtc

SEQ ID NO: 13063 - DNA, 101 bp, rice(Oryza sativa)
  misc_feature (71): n=a or c
gccgcgtgtaggcaccaagtgaaacgcgtggacggcgtgccgcgcttatccgtctcgtccccagcatcatngtctccgccccacgttcacgggacgggacc

SEQ ID NO: 13064 - DNA, 101 bp, rice(Oryza sativa)
  misc_feature (71): n=t or c
cccaaggtcaaaacataatttaatcttcatgttgagttggctaactgcagaagcatctcattcaggaatangtattgatgaaatctgatcccccaattgct

SEQ ID NO: 13065 - DNA, 101 bp, rice(Oryza sativa)
  misc_feature (71): n=t or c
ccattggtttaaatttagcatgtagtatatttattagtttatcttgtaatgattatatgttgttaatgtgncaaggagaggatgtatctttttacacaaaa

SEQ ID NO: 13066 - DNA, 101 bp, rice(Oryza sativa)
  misc_feature (71): n=t or c
catgaacaattgttaccatacccattgttttgctgtcctttttttccaatgtgcacaggtcttattgtcancgaacaaagcaactgatatattgcgcatta

SEQ ID NO: 13067 - DNA, 101 bp, rice(Oryza sativa)
  misc_feature (71): n=a or c
atggcctgccttcgaagagatcttctaatctcttctcccatcgatcaagtgcctttggtgtaatgtaagangagttagggccatctaccagttcatcagtt

SEQ ID NO: 13068 - DNA, 101 bp, rice(Oryza sativa)
  misc_feature (71): n=a or g
gttaaccgataggagaatagaatgctgcaacaggagtaagaaaaattacacaagattagctcacaaactcncaaacaaggtgcaacaacaaatgaagtgta

SEQ ID NO: 13069 - DNA, 101 bp, rice(Oryza sativa)
  misc_feature (71): n=a or c
accgacggatcacgcgaaatgtcttcctgtggagatagagcacgcgtgacagctcgaagcgaagaagtgangtgacgttctgctcgaaaactctattggtg

SEQ ID NO: 13070 - DNA, 101 bp, rice(Oryza sativa)
  misc_feature (71): n=a or g
attagatcaattttgtaacgtcccgccactttgtcctcgctcgtgcgtatccgggaagaattttccggttngtcgcccatcccaggaaaagaagttgtaac

SEQ ID NO: 13071 - DNA, 101 bp, rice(Oryza sativa)
  misc_feature (71): n=t or c
aataagaggtatgcgtatcttcttccttttgttggtgggattcaaatttgtcttctcgtcttaccgtgctnagatatttttatctttggttttgaggtaag

SEQ ID NO: 13072 - DNA, 101 bp, rice(Oryza sativa)
  misc_feature (71): n=t or c
aaatgtctactcttatttggtggatcctaactacagctatcaacaaccacggcatattaaactcaaaatanaagaaagggtttccattacccaaacatata

SEQ ID NO: 13073 - DNA, 101 bp, rice(Oryza sativa)
  misc_feature (71): n=t or c
cttatatctcccctcccttcccactcggggattctctctcactttcatctagtgcgtgacggagcgctggnggtacaccagtcccccagccccttctctag

SEQ ID NO: 13074 - DNA, 101 bp, rice(Oryza sativa)
  misc_feature (71): n=t or c
cattattgaaaaatgaacggacatatattaagatcgacgaaattgtcacgaacgtctcgttgtcgatatgnatatcacgtaccactaaaagaataattaat

SEQ ID NO: 13075 - DNA, 101 bp, rice(Oryza sativa)
  misc_feature (71): n=a or g
tgcatcacaaaattatgtaagcagcaaaatgatttccctagcatctgcgtggccgccgccggtggtggtgncggcggcgcacacacttcgtttggtcgccg

SEQ ID NO: 13076 - DNA, 101 bp, rice(Oryza sativa)
  misc_feature (71): n=t or c
gacaagagaataacaaggctcaaattagtatcaccttgctaattgagcaatagtgaatcaacttatccctncaaccatattattcccaaattaacctttta

SEQ ID NO: 13077 - DNA, 101 bp, rice(Oryza sativa)
  misc_feature (71): n=t or g
ttaggttttttcttttatatcttaatataaactgaactgacaactatatcaaaacggatggtgtagctaangacacgcatttgttcgcatgacatgtatac

SEQ ID NO: 13078 - DNA, 101 bp, rice(Oryza sativa)
  misc_feature (71): n=a or c
cctgcggcccaacgggcatgttctcagctgagggggcagcgaactcgtggatagtcttctcggccatagtnttgaaggttggtggcgctggaacggctggc

SEQ ID NO: 13079 - DNA, 101 bp, rice(Oryza sativa)
  misc_feature (71): n=a or c
ctcgtatagtgtctttgatcatattcacgttcttgcagtgtcttttagccaaaactgttgaaaatttgatnataattcgatatattttaatccaaaatatt

SEQ ID NO: 13080 - DNA, 101 bp, rice(Oryza sativa)
  misc_feature (71): n=a or g
ctaaaaagcacatttcaaagcaaagtattataaatgataagaaaaccaaagaaaatgtctatttggttagntcacaaaaattacacatgagttagatgaga

SEQ ID NO: 13081 - DNA, 101 bp, rice(Oryza sativa)
  misc_feature (71): n=a or g
tcttgaccgctcgatgagttgaaaaccgggcacgtaacctgttcacaactgtccatcaggaggcgtgcctntccctcactagaatcattgttgtagcatgg

SEQ ID NO: 13082 - DNA, 101 bp, rice(Oryza sativa)
  misc_feature (71): n=t or c
tacattgtgaaacggaggaagtactccttatatcccaaaatataacctaggcatagacgattagaaatccnagtacaatgaatctaggtagacccctgtcc

SEQ ID NO: 13083 - DNA, 101 bp, rice(Oryza sativa)
  misc_feature (71): n=a or g
gtcatgttgtcgcctgctaccccggtaaaccctagcgagagatgccaccgaggcaccaaatctggcctccntcagccccctcgctccgtttccatgttgcc

SEQ ID NO: 13084 - DNA, 101 bp, rice(Oryza sativa)
  misc_feature (71): n=t or c
agcttaaaaataaatttattttttatataaaacatactccgtttagccgtccagtaaacctattaacaaanaaaaaggagttgcccaaagcaatagccgct

SEQ ID NO: 13085 - DNA, 101 bp, rice(Oryza sativa)
  misc_feature (71): n=t or c
gtaaaatgtgtgtgttagacatggatcatcattgcccatttgtaagtttgacaactctaaaactaacttcngataccattattcttctctacttaattgac

SEQ ID NO: 13086 - DNA, 101 bp, rice(Oryza sativa)
  misc_feature (71): n=t or g
gcctccgggatgggatgaagggagaatacatccccttcaaatgcatgttctcgaggaagaagtggagaaanaaatggttcttcctccatgttgacgatacc

SEQ ID NO: 13087 - DNA, 101 bp, rice(Oryza sativa)
  misc_feature (71): n=a or c
agaggaggaagaagggtggtagagactgatatatgggtcctatttgtaatagagatggtagatagagaggntgttgaaataaacaacttgttggactagcc

SEQ ID NO: 13088 - DNA, 101 bp, rice(Oryza sativa)
  misc_feature (71): n=t or g
gttacaagcaacttaaataagcaagccactaacaataagaaaggccgtgccgtaaacaaatctacagtgcnctcttggatctcagaggttgagaaaaaaag

SEQ ID NO: 13089 - DNA, 101 bp, rice(Oryza sativa)
  misc_feature (71): n=t or c
gtgccatgaaaaagtagaagaaagcttgagaaatgatcccctgcccctattagtccgaggtaaaccactangataaattttgatatgttttctctttttta

SEQ ID NO: 13090 - DNA, 101 bp, rice(Oryza sativa)
  misc_feature (71): n=a or c
atttttaaaaatctcacacattagagttcagttcctataaaagacaaggaaaaagaacaattcttgcatcncaaatggtattgcaataggaaattatttct

SEQ ID NO: 13091 - DNA, 101 bp, rice(Oryza sativa)
  misc_feature (71): n=a or g
aattactgcatcaaatagtattgtaagcatgaaactttggtgaattatattcatgaatcaaaaaaaacgcnaatattaggaaaatatctaatatcaaataa

SEQ ID NO: 13092 - DNA, 101 bp, rice(Oryza sativa)
  misc_feature (71): n=t or c
aaggatctgatggatataaactccttatgctggaagactcttttgtttctttccttccagacttcccatgncgtgaggaggattaggtgtagactcccttt

SEQ ID NO: 13093 - DNA, 101 bp, rice(Oryza sativa)
  misc_feature (71): n=t or c
aatcaagttcctttttgaataaaatcctggaacacgtgctagcggctgcgtgatctatttcccgagaaccnaggggcttatgcgcaaaagtgtagtcgctg

SEQ ID NO: 13094 - DNA, 101 bp, rice(Oryza sativa)
  misc_feature (71): n=t or g
attctttgtcaactctgcaacttccacaccctgaattattgtcatgatgagttagtggaatttttcaattntcatgttattagtaaatgaagtaggatgaa

SEQ ID NO: 13095 - DNA, 101 bp, rice(Oryza sativa)
  misc_feature (71): n=t or c
atgtaaaaaaagtggccctcgctctcgcctagtcagcatgaaaacattaatttaatggatgaagtgtctcntggcaaataaccacatttttagagtgtgtt

SEQ ID NO: 13096 - DNA, 101 bp, rice(Oryza sativa)
  misc_feature (71): n=a or g
agcgctgagagtacggcagagacgctcagagtactcccccacgtagtcgtctacggagtactcttcacttncgggggaatcgtcggcgtaagcctaacgcc

SEQ ID NO: 13097 - DNA, 101 bp, rice(Oryza sativa)
  misc_feature (71): n=t or c
attagctgattactcaataaatacacacacccaagattcagcctgaccaagaatcacggtactacttattnaccgccctgctaccgttgttggcctccatg

SEQ ID NO: 13098 - DNA, 101 bp, rice(Oryza sativa)
  misc_feature (71): n=a or g
cctcacctccctggaaccctggaagagaacagagtgacaggacagaagagagtaggctaagttcttgcttntgtttaataatgaatgccacctctgttgta

SEQ ID NO: 13099 - DNA, 101 bp, rice(Oryza sativa)
  misc_feature (71): n=t or c
ctgagctcaaaacgaaacttcaaggaccatattaactattcaccctagttttaatcgcactcgtgcaaagnaagtattccctatgtccctaaatataagag

SEQ ID NO: 13100 - DNA, 101 bp, rice(Oryza sativa)
  misc_feature (71): n=a or g
agaccgccatgggggctgcagtcagaccggacagcatacctcggtcaggccgctataagggctgcagtcanaccgcaggtcacttttcagctcaaccgacc

SEQ ID NO: 13101 - DNA, 101 bp, rice(Oryza sativa)
  misc_feature (71): n=a or g
ctttgagaatcacaccttgcaatctatcagccatcaatttggtaaggaacttaaggctcaaacccattagngaaattggcctgaaatcattaactgtttct

SEQ ID NO: 13102 - DNA, 101 bp, rice(Oryza sativa)
  misc_feature (71): n=a or g
tggaagaagtttcatttacaacagcagcatggttgggggataccgtcctttgattatttgcgtctgaaggngagcaagcactagctgcaggaacagcagat

SEQ ID NO: 13103 - DNA, 101 bp, rice(Oryza sativa)
  misc_feature (71): n=a or c
tcaaaccgcagctagctaagctagctggagtagctcgctcggagaggaggctgggtcggcaagaaactccnagcactggtggagaagtgctttttagtccc

SEQ ID NO: 13104 - DNA, 101 bp, rice(Oryza sativa)
  misc_feature (71): n=a or g
aagaaaatcacctcacttttaatttgagcttccattcttaaacctattctcgaaacaaactaatacgcatncctacacgaatgcgcgggttaccttcctat

SEQ ID NO: 13105 - DNA, 101 bp, rice(Oryza sativa)
  misc_feature (71): n=a or g
aacataggctaggtccttccatctagtatttgtaaatctattttctaaagctgtgtcgaagcaagatttcngcaataataaaagggggtggctgtcaagct

SEQ ID NO: 13106 - DNA, 101 bp, rice(Oryza sativa)
  misc_feature (71): n=t or c
agaaaacgaagccgcccctagtcggccatggccattggctacttgctgccgttcgtcgatcatcgcctccnactacgcgggtacaggtcaagcaaatcccc

SEQ ID NO: 13107 - DNA, 101 bp, rice(Oryza sativa)
  misc_feature (71): n=t or g
aaggcgggaaagcccgagcacttcttcatcctctttaacggtaaccccccagtcatgcgcgaggggggganatccgaagcagacaaaactgctcgcagagg

SEQ ID NO: 13108 - DNA, 101 bp, rice(Oryza sativa)
  misc_feature (71): n=t or c
acggtactaccaatgccacaatcaggtgagtgatgaaaatttcgtttgcttgcttgttttttgtttgagcntgccatatttttctgctatcctaatagatg

SEQ ID NO: 13109 - DNA, 101 bp, rice(Oryza sativa)
  misc_feature (71): n=t or c
aaacgtatgggtaccacgagatatgatatggttctaaaaattgaaaatattactgcacgtggtaaccgtangataatcgtacggttttgtcaacctactat

SEQ ID NO: 13110 - DNA, 101 bp, rice(Oryza sativa)
  misc_feature (71): n=t or c
gccaccccctcctttgttttgccgtctgttcccctcctctctcttcttgtgcacagccgcctcctcttctngctcaccaccatcgaatgactcaagcgccg

SEQ ID NO: 13111 - DNA, 101 bp, rice(Oryza sativa)
  misc_feature (71): n=t or c
aacaacaagttacacacaatttctgcattctaaaactcctatggatcaactagctagtatgccacgtcttnctacatttttcctgtttctgtatttttgaa

SEQ ID NO: 13112 - DNA, 101 bp, rice(Oryza sativa)
  misc_feature (71): n=a or g
cttagagagtttgtcacttataatgacaggagactccgcatcgccgttcaaaaatgcatagcgtagacctnaaggtaagggctttagctcaattggggctt

SEQ ID NO: 13113 - DNA, 101 bp, rice(Oryza sativa)
  misc_feature (71): n=a or g
cggggttattgtcattctcgactagtcgatctcggcgtgaagatcgtagagacaaggagtaatcgacaacnctatgtgaaattcaatgggcgtgagtgaat

SEQ ID NO: 13114 - DNA, 101 bp, rice(Oryza sativa)
  misc_feature (71): n=t or c
tctttttttccccctataatgggtctgaatattctgaagttgaggcagtatttgccagctgcagtacttgncaggtagtaatactctgctccaagagtgtt

SEQ ID NO: 13115 - DNA, 101 bp, rice(Oryza sativa)
  misc_feature (71): n=a or g
acggaattaaatttagaaatatattgtttacctattttttatttaaattgttcggggtgtaattattttgngagaaatatattatcaatatcgcttcgcga

SEQ ID NO: 13116 - DNA, 101 bp, rice(Oryza sativa)
  misc_feature (71): n=t or c
tcgaaaagaaaaggaattagtatatcctttgttcagtctcagatatactacatggcctagtctaaataganctgtaacacgtatctatacacggctaacat

SEQ ID NO: 13117 - DNA, 101 bp, rice(Oryza sativa)
  misc_feature (71): n=a or g
ttatgcgcatgattggcatctttgttcaccgttgacctcggaagtctgtcttgtcgattgtagagatgctnatgatgaggatgtccagcagcgcgggtagc

SEQ ID NO: 13118 - DNA, 101 bp, rice(Oryza sativa)
  misc_feature (71): n=a or c
cacactctatagggctcagaatatgatagaaaacgatatgtcccgtagcagaacatcatcttggtaagtantctctccgtttcgaaatgtttgacaccgtt

SEQ ID NO: 13119 - DNA, 101 bp, rice(Oryza sativa)
  misc_feature (71): n=a or g
tcaaatttcaatgtttttataaaccaatggcatccacaagaaactaaagagctgttgctgcatttgcattncaggcccttgaacttgttcccagaaagatt

SEQ ID NO: 13120 - DNA, 101 bp, rice(Oryza sativa)
  misc_feature (71): n=t or c
catcatcactacttccctcttctctctatatttctagttttcttttcctttttgttttttcttgcttcttncccgatggcatccggcggctagccgtgagc

SEQ ID NO: 13121 - DNA, 101 bp, rice(Oryza sativa)
  misc_feature (71): n=a or g
agaaaatcttttagctatgctaattaccatgggtaatttggttacggtaatgatcaccggtgctatagccntcgaaagtggcggatcagaatgaaatagca

SEQ ID NO: 13122 - DNA, 101 bp, rice(Oryza sativa)
  misc_feature (71): n=t or c
ccattgaatcggcaaaagctccatcgctgcatgctaagctgcttgaactgacaaaatctgagaattgcagnctcccaagtcccaaccttcttctctagttt

SEQ ID NO: 13123 - DNA, 101 bp, rice(Oryza sativa)
  misc_feature (71): n=t or c
ttcctttaatacccatgtatgctgggaataagcccactatgagtccctcaaatatatgtccaatttgattngtatccctcaactgcaatatcggatatctt

SEQ ID NO: 13124 - DNA, 101 bp, rice(Oryza sativa)
  misc_feature (71): n=t or c
agttggttttagctgattgctacaaaggtttcactgacatcagaacaccagccggtgtatgcttaaccttnggatcaaacaattattctatcatatcatta

SEQ ID NO: 13125 - DNA, 101 bp, rice(Oryza sativa)
  misc_feature (71): n=a or g
tcgaacagcaatttctgacgtagaggttgttgagactttttattgtgtatgatggtggttgcaattgcacncataactaaaattgatctgtttgtttgaaa

SEQ ID NO: 13126 - DNA, 101 bp, rice(Oryza sativa)
  misc_feature (71): n=a or c
attcaaactcgacgtcaagatgagggagctgaaatgaacttattcgtagttattgcccatgtaaaattagnggtaggcttaatctcggcctgttgtttgcc

SEQ ID NO: 13127 - DNA, 101 bp, rice(Oryza sativa)
  misc_feature (71): n=a or g
gtaagcttgatgcccctctaataatagcttaggatttttggaggcattgatagctgcaatcagtgctcatntcatcattcaatgacctgtaacaatttcaa

SEQ ID NO: 13128 - DNA, 101 bp, rice(Oryza sativa)
  misc_feature (71): n=t or c
gccccccgcagcggcggcgatgagaacggcgcgtatggctccatcgtcgccaagatccatgcaatggcgangcctcacttcttggcctgcgatgctgcaac

SEQ ID NO: 13129 - DNA, 101 bp, rice(Oryza sativa)
  misc_feature (71): n=t or c
tgtgctggggagaaacagatcgattgtggctacccctaccggcgaagtcgatcgaagtcgtcagtccatcntccggaggatggggctgggatattggctga

SEQ ID NO: 13130 - DNA, 101 bp, rice(Oryza sativa)
  misc_feature (71): n=t or c
taatgatgtactcctacatattatttatgatcactttattcaattgccaggctatagaaacaggaactggntatggagcatggctccatggggaggctgtt

SEQ ID NO: 13131 - DNA, 101 bp, rice(Oryza sativa)
  misc_feature (71): n=t or c
cggctccgcggagcgaggcggccgtgatggactccgactaccggtcattcctcgagatcgtgttcgagaanagcgaggacagcgtccagatctggcacctc

SEQ ID NO: 13132 - DNA, 101 bp, rice(Oryza sativa)
  misc_feature (71): n=a or g
agcaacgagagatcgatcgaatcgtaggcaaaccactgtgctgcagctagccagcaaacatcgctgatggnccacggttcgcaacagagtttgtgaggagt

SEQ ID NO: 13133 - DNA, 101 bp, rice(Oryza sativa)
  misc_feature (71): n=t or c
cgagtcgagccgagccgagctggctcgatatccaaccctagatatgtactactccgtcccaaaaagaatcnaatcctagcaacgaatctggacacacatgt

SEQ ID NO: 13134 - DNA, 101 bp, rice(Oryza sativa)
  misc_feature (71): n=a or g
attcgtatcaacatatgagttttgtgtacttgtgtgctagaattgtactcccttcgttcccttcgtttcanattataagttgtttcagctctgatgaaagt

SEQ ID NO: 13135 - DNA, 101 bp, rice(Oryza sativa)
  misc_feature (71): n=t or c
acagaatcaaacatatactagtcagcatccaagaacacagatctcgaaggaagagaacgacataccgtcantgctactactcttcgtgatgaagttctcca

SEQ ID NO: 13136 - DNA, 101 bp, rice(Oryza sativa)
  misc_feature (71): n=a or c
ccctacttttttttaaggaaaaaaggcgggtgggactaaagggtcatatatcaactatttctcaccaaccntatattttttgtgagaagaaaaaaatagtg

SEQ ID NO: 13137 - DNA, 101 bp, rice(Oryza sativa)
  misc_feature (71): n=a or g
aagacacgacgttttattccagggaatccccaacgaaaaatgcacactaccccctcttttttatcgaatcngtcataaccactgcctacattccacaaaat

SEQ ID NO: 13138 - DNA, 101 bp, rice(Oryza sativa)
  misc_feature (71): n=a or g
ctttcttaccttaccttaccaacccactcatcgatactactttcttgaagtgggtaacagggtaagtgatntaagtgggcttaaaaattaccacatcagat

SEQ ID NO: 13139 - DNA, 101 bp, rice(Oryza sativa)
  misc_feature (71): n=a or g
tttggcaataaagtgaatgccaataccgtgctcggttgttaggagctctgtctgccgacttcgaagttctnggttcaaccctccgtcacgacactttgcac

SEQ ID NO: 13140 - DNA, 101 bp, rice(Oryza sativa)
  misc_feature (71): n=t or c
gtcatgtatatcttgagattgatagcgttaccacatgtctcactatcaatgaatacgcactacgccggacnaggtcatctctgacgggcccaaaccctcac

SEQ ID NO: 13141 - DNA, 101 bp, rice(Oryza sativa)
  misc_feature (71): n=t or c
gaaaaagactaaccataccgaatgtggcccaacaactcaatcgcacgtcgttagtgcttcatgggctgcangcggcccagtagtgctgcatcccagagatg

SEQ ID NO: 13142 - DNA, 101 bp, rice(Oryza sativa)
  misc_feature (71): n=t or c
taattaattattctcacctgtctaggagtattcatctactagtatttcattatccaaagaaagaagggtanagtcgaagatataagtatttcattatatat

SEQ ID NO: 13143 - DNA, 101 bp, rice(Oryza sativa)
  misc_feature (71): n=a or g
taccataacaaaacaaaacaacaaaaagggaaaaactgaagcagttggctaaagagatgaatttttacttntgaaactaaaactccaaaagtatcattttt

SEQ ID NO: 13144 - DNA, 101 bp, rice(Oryza sativa)
  misc_feature (71): n=t or c
gaattcatttttttactttctagaagacccaccaatcatcggtggctttgtcattgtattcctatacaacncgcccactgcctcttatttttatttgtaat

SEQ ID NO: 13145 - DNA, 101 bp, rice(Oryza sativa)
  misc_feature (71): n=a or g
gtcacttattccctccgtcccaagataagtgccaccgtgaactacactttcgctgcacttattttgggacngagtgagtatatctataagttagaataaac

SEQ ID NO: 13146 - DNA, 101 bp, rice(Oryza sativa)
  misc_feature (71): n=a or g
gcgaagaaaccttccacctggatctaaactgctgtaaaaatcccagtttttacaagcagaccaaagcaccncctgcaaaaatgattttcacaagcagcagt

SEQ ID NO: 13147 - DNA, 101 bp, rice(Oryza sativa)
  misc_feature (71): n=a or g
tcgcaagttaccaaaaataaattttacattacatggagggaaaatattaaagaaaaaatgacacatatccnagcaaagcgtgcaacatgacagtccagtca

SEQ ID NO: 13148 - DNA, 101 bp, rice(Oryza sativa)
  misc_feature (71): n=t or c
ctatctagattagattagctcctttcttattttgtccggccttactcctcatcctctttaatctttctctncaacgttgattactcttgtctctagtctct

SEQ ID NO: 13149 - DNA, 101 bp, rice(Oryza sativa)
  misc_feature (71): n=t or g
gtacgtggcagtacaatagaggtgccattccaattattttctcgacataaccaccattagtatagtcaaanacttaaaagaattattaccactcttgtttg

SEQ ID NO: 13150 - DNA, 101 bp, rice(Oryza sativa)
  misc_feature (71): n=a or g
ctataccaaacagccccttactcagaaaatatgatttctagcgtagatgtataggctacaaccaaaatccnatcgattttttttatatctaaacacacgca

SEQ ID NO: 13151 - DNA, 101 bp, rice(Oryza sativa)
  misc_feature (71): n=t or c
accttttgtagttatttgcgagttaataagttgatgtaaaacctaaagtgttgtccttggtcttgactttngctttatgtatgcattgatttgtggattcc

SEQ ID NO: 13152 - DNA, 101 bp, rice(Oryza sativa)
  misc_feature (71): n=t or g
aagtacgattcatgtccccgaaaaaaaaagagaagtaccattcatggtaaaatacaccagttgtctctatnaatttccaaatttaaggtcatatattgtat

SEQ ID NO: 13153 - DNA, 101 bp, rice(Oryza sativa)
  misc_feature (71): n=t or c
agttgcaccacggtatcgcggatttagatcagttttactgatcccttttactgtgtttgcaatcctgagtnaccaacccctcttcgttgtattccgcgcgc

SEQ ID NO: 13154 - DNA, 101 bp, rice(Oryza sativa)
  misc_feature (71): n=a or g
tcttggaaatgcggtttccattaacatagatagaatcctttgagatgtcaactttggtctacataaaaaanaatgtataagaatcatatgtaacaaataat

SEQ ID NO: 13155 - DNA, 101 bp, rice(Oryza sativa)
  misc_feature (71): n=t or c
ttattttttataaaataaactttatgtgtatatgtataaagtttattcatatgcgtataaagtatgcatgnatatgcataaaattcatacaatatgtatga

SEQ ID NO: 13156 - DNA, 101 bp, rice(Oryza sativa)
  misc_feature (71): n=a or c
aacctcggcccacaaaatttgacagttgtatctttctccaataccttttatctaccctatccacgcactantatttttctattgataatgaataatgagta

SEQ ID NO: 13157 - DNA, 101 bp, rice(Oryza sativa)
  misc_feature (71): n=t or c
ggatcaaacccgctctggtttgagttaggagggtaattcgtctggtatgatagttgagggtgaaatatatntgttaaggggtaattcgtaatcacccaata

SEQ ID NO: 13158 - DNA, 101 bp, rice(Oryza sativa)
  misc_feature (71): n=a or g
cttcatagcatgcagcgcagggcgagatggagaagaggggatgagagaatatgactcagcatagccccacntcaagcaattgcaatgctgactcagcatca

SEQ ID NO: 13159 - DNA, 101 bp, rice(Oryza sativa)
  misc_feature (71): n=t or c
tcttcacggccacagagagcaaggcatcgagtcacgacgccgctggccagctgcacgcaccgtcatccctnacccgcgcacgtgactacctgtcggctgct

SEQ ID NO: 13160 - DNA, 101 bp, rice(Oryza sativa)
  misc_feature (71): n=t or c
ctgtttcagatccgattccactcatagaatgagttcaaagttttttgtgctaggacctacaaatacttcancaatgcaaccaatcacaaaacatttgcatt

SEQ ID NO: 13161 - DNA, 101 bp, rice(Oryza sativa)
  misc_feature (71): n=a or c
accccgcactattgaaaatggttcacttcacatcccccccaaccaacgctacctctcttctttagttctcnctgtataagtcatattttacgtcaacattc

SEQ ID NO: 13162 - DNA, 101 bp, rice(Oryza sativa)
  misc_feature (71): n=t or g
gtttttttttttgatacgttgaacaggaaatacaagatacaggttaaaccatatgtatgtaaaaaaaatanattctaatttatagaacttacagataaaca

SEQ ID NO: 13163 - DNA, 101 bp, rice(Oryza sativa)
  misc_feature (71): n=a or g
attgagagagagagagagaggaggaagtgaaaggagggaaaagagatgatgacgtggagtgaaaaggaggngaaagacatgtgggctacgtgggtcccacg

SEQ ID NO: 13164 - DNA, 101 bp, rice(Oryza sativa)
  misc_feature (71): n=t or c
cagcccattgcaatccttttatttaatcacatacaagcggccacatatccttccttaagctggattaacangcgcggcactagaagggtagagcacttgct

SEQ ID NO: 13165 - DNA, 101 bp, rice(Oryza sativa)
  misc_feature (71): n=a or c
tcccatcatagctagcattaattgtcccaggtgcagggccctgtgcgaaaatcaattgcaactcccgcgtngctctcgcgcgggcggctcgggaggcgaaa

SEQ ID NO: 13166 - DNA, 101 bp, rice(Oryza sativa)
  misc_feature (71): n=t or c
aaacttgggagggcatagcggcaatttgttgggccttgtggcttagtaggaatgacatcgtctttaatggntataatcatatttctttcttacaggtaata

SEQ ID NO: 13167 - DNA, 101 bp, rice(Oryza sativa)
  misc_feature (71): n=a or g
attgacttatttgacgttatgaggtacccaacaattcgtcaaccgtttcaaatgaaaaaaagatcaaaacnatgaatgttgaatgctatatattagtagag

SEQ ID NO: 13168 - DNA, 101 bp, rice(Oryza sativa)
  misc_feature (71): n=t or c
gcctgatacctatatgtatcatccatgatacatgtgggtattagataataagtatcaagtctgatatgcangggtatcaagtatggtacccaggtactatg

SEQ ID NO: 13169 - DNA, 101 bp, rice(Oryza sativa)
  misc_feature (71): n=t or c
accccatagcctcccctgatcagcagcgcactgctgtacgcattaccggtgaaaatgccagtgggactacnggactatggctgtgtttagttgaatccaaa

SEQ ID NO: 13170 - DNA, 101 bp, rice(Oryza sativa)
  misc_feature (71): n=a or g
attatggcttcttcttactttccgaaatatagaaatgcagaactaaatatagagtatattctaatccaatnaatctgaacaacttcttatcaagattcatt

SEQ ID NO: 13171 - DNA, 101 bp, rice(Oryza sativa)
  misc_feature (71): n=a or g
tgtcccccgcgagctttctggctgatgtccttatagaagagggggaagatgggggaggaaaggtcgagtcnccgaactctcgcagcgatgggcttgcctca

SEQ ID NO: 13172 - DNA, 101 bp, rice(Oryza sativa)
  misc_feature (71): n=a or g
atgagaaattaagaacatcttactggtggagctggtttgagagtttttgttgccaatttctttcttcacancaattttttttctgcaaagacaagattaat

SEQ ID NO: 13173 - DNA, 101 bp, rice(Oryza sativa)
  misc_feature (71): n=a or g
aacagaaacaaatcaagaaacgaagccatacatagctctcgtgctctcattcgagaacaatcttggcgccnatagctcgcatcttctcggcgatgctctcc

SEQ ID NO: 13174 - DNA, 101 bp, rice(Oryza sativa)
  misc_feature (71): n=t or c
cgccccgtcaccagcgactaacatgccaataaccaccagcgactaacatgccaataactagggatgaaaanggagcgtatatggatggataatgctcatac

SEQ ID NO: 13175 - DNA, 101 bp, rice(Oryza sativa)
  misc_feature (71): n=a or g
caaatttgtcggtacggcagcacagtactactgtgtactagcagaaaatgaaatcaatagagttgctatanaacattgaccaaggtctctcccgctccccg

SEQ ID NO: 13176 - DNA, 101 bp, rice(Oryza sativa)
  misc_feature (71): n=t or c
ttcggctatggggagatctaacccgaccgaagtatgtcttccgattagatcggaatcatcatcaactattngatccgccgagatcgaccaagcatcaagac

SEQ ID NO: 13177 - DNA, 101 bp, rice(Oryza sativa)
  misc_feature (71): n=a or g
aattagattataaaggtaggaatgatcaacacggatgatagccgaattagtcatggcttgaaggtttagtncggagcaggatcattttaacttctcaccat

SEQ ID NO: 13178 - DNA, 101 bp, rice(Oryza sativa)
  misc_feature (71): n=t or g
tcggtggatgccgtcgtgagtaccacgtcaaggctagcggcgcctcactgccactgccatcgatcagcagnacaccacctctgcccgccgcaatcaccgtc

SEQ ID NO: 13179 - DNA, 101 bp, rice(Oryza sativa)
  misc_feature (71): n=t or c
agctgcagcacccacaattaaaagtttgaaacatgccctagccagtagtcacccaaactgatgaggacatnctaaactattacccattggcagagacgcta

SEQ ID NO: 13180 - DNA, 101 bp, rice(Oryza sativa)
  misc_feature (71): n=t or c
ccacggttcctgatcgcctaatcgaacaatggtttaaaatttaatgttttgcgcgtttgttctaatattcnccgaaatatactaattcgaaattcggggta

SEQ ID NO: 13181 - DNA, 101 bp, rice(Oryza sativa)
  misc_feature (71): n=t or c
acagtatgcatgcagtacacatgtgataataataaataattgtacatactcccaactacccacccacttcngaacaactcttatttaataggggtatctag

SEQ ID NO: 13182 - DNA, 101 bp, rice(Oryza sativa)
  misc_feature (71): n=a or g
cgcccagcgcgatcgctggcgatcgattgcccattagaagggccccccagttttagccacgaaaagtacanctgttgcttaaaacagcggatgggccatac

SEQ ID NO: 13183 - DNA, 101 bp, rice(Oryza sativa)
  misc_feature (71): n=a or g
gaaggataaaaaactaatgcaaacaataattattctagttgcatgtagaaaattcaagtatgttgaatccntaaaagaaaaatatgaaaagattattgcta

SEQ ID NO: 13184 - DNA, 101 bp, rice(Oryza sativa)
  misc_feature (71): n=a or g
atcccgtgaggcatttttggccatcgccctcagcctgaaaaactccacggtagtcgcagtggtggcaaccncccatctccgccgctgtgtatgatggccag

SEQ ID NO: 13185 - DNA, 101 bp, rice(Oryza sativa)
  misc_feature (71): n=a or g
ctcacaaaatgaactagagagtgctaggtttaggctcctccacagcttcactgcagaccaacctcctaaanctaaatttggaagttgtagctctgccaaac

SEQ ID NO: 13186 - DNA, 101 bp, rice(Oryza sativa)
  misc_feature (71): n=t or c
gatccacttcccctgagctcgctgggtggattcacctccctcgagcttgctgagatacccctactggcggngaaacacgcttgcggcggcgtttcggcggg

SEQ ID NO: 13187 - DNA, 101 bp, rice(Oryza sativa)
  misc_feature (71): n=t or c
aatattattacatacgtctattcgtatccatactatttgattatacgtaaaattagaactattgctatcancgtcacggtttccatcttcttctccatctg

SEQ ID NO: 13188 - DNA, 101 bp, rice(Oryza sativa)
  misc_feature (71): n=a or g
caatccggaatcaacccaggttttcaaattatgaatcatgattatggagatgtttcactttctgttggtanaatgttcaacatgattgaaaattttctttt

SEQ ID NO: 13189 - DNA, 101 bp, rice(Oryza sativa)
  misc_feature (71): n=a or c
tgtcgagctcgaactccctcttcacgtactcgtactcgctgttggccatcgccgtcaccccctcaccttanccgcacgacgaccagactacgcctgcaatt

SEQ ID NO: 13190 - DNA, 101 bp, rice(Oryza sativa)
  misc_feature (71): n=a or g
cgtcctgtgccaaagatcaggaagtcttccaggtataactcctacaatgatctcccttgcggtgatgcgcnctcggtgcaacaataatgctgataatcgaa

SEQ ID NO: 13191 - DNA, 101 bp, rice(Oryza sativa)
  misc_feature (71): n=t or g
agggctgggactcttgccaccctcggcttgaggagagggggagaagaaggacagggaaggagagaataccncctgactgggttcttgctggtgcctttcag

SEQ ID NO: 13192 - DNA, 101 bp, rice(Oryza sativa)
  misc_feature (71): n=t or c
cacagtcaaccaccaagctgtttagcgatgatgcctctagccgatctaaaatgcttcctagagttttcttnacatcatcagataaaggagccaaggctttg

SEQ ID NO: 13193 - DNA, 101 bp, rice(Oryza sativa)
  misc_feature (71): n=a or g
gcttaactaaccttgagtttatgagccccagctaacattctaacaggagtctctcgtgcccaccccccgtncagagttgcaataatatccacccattaatt

SEQ ID NO: 13194 - DNA, 101 bp, rice(Oryza sativa)
  misc_feature (71): n=t or c
gttacgatggcattagagtctcggacatgcacgaatctctgaactaattgcacagtgaaagaatcgactgnaaactggaaagaaatatggcgccatattaa

SEQ ID NO: 13195 - DNA, 101 bp, rice(Oryza sativa)
  misc_feature (71): n=a or c
tcctcgccgacgccatccgcttgttccagcagatgccggagcggaaccacgtctcttacaccgtgctgctnggtggactccttgatgccggccgtgtcaac

SEQ ID NO: 13196 - DNA, 101 bp, rice(Oryza sativa)
  misc_feature (71): n=t or c
aattttattctttttcctggttaatttgaatgctaatggatcatccactaataagagggagtgcatacacntgggtgtacgaaagagtcgtcatatatata

SEQ ID NO: 13197 - DNA, 101 bp, rice(Oryza sativa)
  misc_feature (71): n=t or g
ctcaaagtcaaataagttatagatgatttttttggtattatttcaaccgttgaaatgcatatggatatgtntctgagattaagtaaataagttgtcaaaga

SEQ ID NO: 13198 - DNA, 101 bp, rice(Oryza sativa)
  misc_feature (71): n=a or g
tttttttggggaaaaaacaggtacttcaagatgaaggcttttctcaagattgatatttgatgataacaggnggggcatgcccctcccagatgcttggaagt

SEQ ID NO: 13199 - DNA, 101 bp, rice(Oryza sativa)
  misc_feature (71): n=a or g
gtgtgattgcgcaagcttgcctcctcctctcctcttcgtcaggggatgcgtcgacctcggtggctttcacntcttgataaattcatcctgaattaaaaatc

SEQ ID NO: 13200 - DNA, 101 bp, rice(Oryza sativa)
  misc_feature (71): n=t or c
actctaaatgaaatcgaattcaaacttatatgtttatgacgtgatatattataatgtatcttctccgtttnaaaatataagatattttgaacggtagaagt

SEQ ID NO: 13201 - DNA, 101 bp, rice(Oryza sativa)
  misc_feature (71): n=a or g
agtttgaaagtgagcttggattttgctattcccgtgtttactgtgagcatactttctaaactattaaatgntgtgttttttaaatactttttatataaaag

SEQ ID NO: 13202 - DNA, 101 bp, rice(Oryza sativa)
  misc_feature (71): n=a or c
actaaacccaaaaactcatttcgattttcatcatcaattcactaacaatggccaagctagcccgaaccccnaaaaaaaaaaaaatcatgtacagacacaca

SEQ ID NO: 13203 - DNA, 101 bp, rice(Oryza sativa)
  misc_feature (71): n=a or g
taaaacgaggatgaatatatccggagaatgctccagtactagttgagacattgttggtgttgttgcctccnttggtattgccgttcttaccttctccagta

SEQ ID NO: 13204 - DNA, 101 bp, rice(Oryza sativa)
  misc_feature (71): n=a or g
aaactatgtgggccccattcgtcattcaaaaaaaatactaggtcaacatcaccacgtcaataaaaccgccntccaaaaccgctgtcaaattgttcagggag

SEQ ID NO: 13205 - DNA, 101 bp, rice(Oryza sativa)
  misc_feature (71): n=a or g
gcgcctccccgcctaggcactagcccccacgggccacggctctcacgcactgcgcgctattagtgctaacnatcatacttaatgttaatactagtatttat

SEQ ID NO: 13206 - DNA, 101 bp, rice(Oryza sativa)
  misc_feature (71): n=t or g
ctctccgtttttttttataataatgctccttcacgtttctactaccggtttaccattacctaaggtgatantataaataaatctgaaccctttaatcaaat

SEQ ID NO: 13207 - DNA, 101 bp, rice(Oryza sativa)
  misc_feature (71): n=a or t
ccatcgggtctcgggccttttggctatttatagtgtgtgctatgccaatgtcatacttgtgttcaggcgancgcatgactaaatttgatggagtgctattc

SEQ ID NO: 13208 - DNA, 101 bp, rice(Oryza sativa)
  misc_feature (71): n=c or g
gagagtactccatagtagcgctgctgctgctacagtaccagttatgaatcaatttcgttgctgctgctaancaccactgctaagcttcttgttggtcgcat

SEQ ID NO: 13209 - DNA, 101 bp, rice(Oryza sativa)
  misc_feature (71): n=t or c
cacgtaggctcgaattaagtaaaaattgccaagatttggaaagtcaccgccgtgtatgggccggtcagacngtggcttgagggctggtctgaccggcggca

SEQ ID NO: 13210 - DNA, 101 bp, rice(Oryza sativa)
  misc_feature (71): n=t or c
agagcagcaaggagctgagcaaggtgctggacatctacgagcagcggctggaggaggcggagtacctcgcnggcgacaagttcaccctcgccgacctttcg

SEQ ID NO: 13211 - DNA, 101 bp, rice(Oryza sativa)
  misc_feature (71): n=a or c
ctactccctcggtttcaaattagttgttgttttagccttgtcctaggtcaaatattcctaattttgacaancaaattcatatattttaacattataagatt

SEQ ID NO: 13212 - DNA, 101 bp, rice(Oryza sativa)
  misc_feature (71): n=a or g
ttcacatgacgtggaaccaacacagaaaaaacgcaaccaacccaacccaagcgggcggccgggggcagcancagcgcccgcgagaaggcacgtcgcgtacg

SEQ ID NO: 13213 - DNA, 101 bp, rice(Oryza sativa)
  misc_feature (71): n=t or c
acgtgtttttcttgtattttatactttcattcaaattaaatttccacgtttttctattgctttgttttttnattcctactattcaaactgtcctttaattt

SEQ ID NO: 13214 - DNA, 101 bp, rice(Oryza sativa)
  misc_feature (71): n=a or t
cagctaggacaagctccccaaacagggccttcgtgacttcaccgatggaacgaggtggaattatcggcgtnatttaggattaaactgttcgaggaacgtgt

SEQ ID NO: 13215 - DNA, 101 bp, rice(Oryza sativa)
  misc_feature (71): n=c or g
cgcagcatgcatgccaaaggggaaaaccgcaagctgccatatcacatcacctggtgcatagccatcctaangctgtgttcggcaccccttttcctaccccc

SEQ ID NO: 13216 - DNA, 101 bp, rice(Oryza sativa)
  misc_feature (71): n=a or t
cgtgtggcaaggagggcaagcacgtgttctttgctccaacaaaaagttggactccaaccaaaagttggatnaagattaagatttttatggcacgcttttca

SEQ ID NO: 13217 - DNA, 101 bp, rice(Oryza sativa)
  misc_feature (71): n=a or t
tgtggttacatactgcaagggtttggagaatgttagtgctaccacaaattccattcaaaagataaagaagnttaaagagaacatacattagctactagtaa

SEQ ID NO: 13218 - DNA, 101 bp, rice(Oryza sativa)
  misc_feature (71): n=c or g
gtgagatgtccaatttcaacaaaaggtacggcaaaagcaataatgcaccatgatgacacacacacacacanagagagagagagagagagagtacttctgag

SEQ ID NO: 13219 - DNA, 101 bp, rice(Oryza sativa)
  misc_feature (71): n=a or t
caggcaatggatttcaacttactccggagttatatgtttgtaaattaactttccgtttgttaactcgcgcntctactcgcataaaaatactgaaatgcact

SEQ ID NO: 13220 - DNA, 101 bp, rice(Oryza sativa)
  misc_feature (71): n=a or t
gcagagtaaaacctactgaatcaaacagctttgatcagtgatccgtgctgtgtttctagtcttcaggtgcntttttttttctgacaagttgtgtgatcctt

SEQ ID NO: 13221 - DNA, 101 bp, rice(Oryza sativa)
  misc_feature (71): n=c or g
agatggtggtgttcatcgtatcgttcaataaggaaagctttgggttgtggcgttatctagtcccctaaaanttcttcttggcgtttagatacaagctcttt

SEQ ID NO: 13222 - DNA, 101 bp, rice(Oryza sativa)
  misc_feature (71): n=a or t
cgcctacgcgggagcttcgggggttcgcgccgtatagatgaaaacccttctctccccaactcttttttttnaaaaaaaaagttcttcaaacttttgtctgg

SEQ ID NO: 13223 - DNA, 101 bp, rice(Oryza sativa)
  misc_feature (71): n=c or g
aaaaggtccatttcagcaaatagtaagcactctacatatttttccaacactgtctagatagataagtactngaaacacatttccccaacaatctgtagaga

SEQ ID NO: 13224 - DNA, 101 bp, rice(Oryza sativa)
  misc_feature (71): n=a or t
catcacaactctactagcaaaagggtcagtatgcacactgcacactccttacccccccccccccacacacnctctctctctcttgactcttgactcccgct

SEQ ID NO: 13225 - DNA, 101 bp, rice(Oryza sativa)
  misc_feature (71): n=a or t
catgggcggagaaggcctatctcctcaaggaatgcatacaagtacaagggaaagggcaccatgaattccanaatcgagaggcaggcatgcaaatggtgatt

SEQ ID NO: 13226 - DNA, 101 bp, rice(Oryza sativa)
  misc_feature (71): n=c or g
gtctcactctatcaccggatacaactcatatggatgaagaatgaactcgcgcgcgctgccggtggatggancttaggtggacgggtgctgccggtggatgc

SEQ ID NO: 13227 - DNA, 101 bp, rice(Oryza sativa)
  misc_feature (71): n=a or t
gaacaacagggtcttcaaccaacagcaaaagacctgggtcgaagtggcaaagtgatggcggctgaggccgngctttggcgcttagcgaacgcggcaatgct

SEQ ID NO: 13228 - DNA, 101 bp, rice(Oryza sativa)
  misc_feature (71): n=c or g
attattaaattttggatatgacttgctacatatgacagctggacaacatctagcctacaaaatgtaccatntgcgagcatgtgaaatgtttgcatcactta

SEQ ID NO: 13229 - DNA, 101 bp, rice(Oryza sativa)
  misc_feature (71): n=c or g
ccgcccatgttagagccatgcgagggatataaagtacgcaaaagttgcaaatgaagatttatctagctatntattggtgcgataaaatgacaatcaagact

SEQ ID NO: 13230 - DNA, 101 bp, rice(Oryza sativa)
  misc_feature (71): n=a or t
caattggatttccacatctgaggattggcaccattgaattgaggacatagcatggggtgtatagtatcacncagatccacagatgcagtaggctcatgtct

SEQ ID NO: 13231 - DNA, 101 bp, rice(Oryza sativa)
  misc_feature (71): n=a or t
ttattattattgtaatcggattattgagaattccagagcagaggctgcgattttgttttgccatagcccanagctagcactgtgtatttattggaaacaac

SEQ ID NO: 13232 - DNA, 101 bp, rice(Oryza sativa)
  misc_feature (71): n=a or t
gtgaagttcgggcctgaagccctgaatccaggtgttgctaaattatgaacttgttcattctgggaataagnctattttacttctgattgaatcgtctctct

SEQ ID NO: 13233 - DNA, 101 bp, rice(Oryza sativa)
  misc_feature (71): n=c or g
gcgccggcgacgatcttggccgtcttgctctccatatctcggccacgtgacgtcacgccgtcaccggctcnccgtcgccggcgacgccgcccgccatggtc

SEQ ID NO: 13234 - DNA, 101 bp, rice(Oryza sativa)
  misc_feature (71): n=a or t
cacatcttgagtgcttcatgttgggaaagataaggccttcctccattttagcatccctctttctggatctntctttctcatctttgattattctaggggta

SEQ ID NO: 13235 - DNA, 101 bp, rice(Oryza sativa)
  misc_feature (71): n=a or t
acagctagattaccaagttctaccactgttagctagatattccgtgtaacacgggaggttaatttcatctngtttctaagaaatgtcgcaccattggatga

SEQ ID NO: 13236 - DNA, 101 bp, rice(Oryza sativa)
  misc_feature (71): n=a or t
tatatgtctcgtcggccgaacagtgtaaagtacggcgagctctatgtggccatgctaggtacgggtgtaantggtaagccgcaaacccacttatagatcaa

SEQ ID NO: 13237 - DNA, 101 bp, rice(Oryza sativa)
  misc_feature (71): n=c or g
accatactgccgagggcagcaggacttgctgcgtgctccgatctgctcatagcccctaaaatacccacgtncaatccatctgtcggcggtgctatgagaga

SEQ ID NO: 13238 - DNA, 101 bp, rice(Oryza sativa)
  misc_feature (71): n=c or g
actacctaggatctcggttgatccggttttgtaaattgaaagacctgctatacctgtcattttagtttagngatgaatttcagactgagagataaattgag

SEQ ID NO: 13239 - DNA, 101 bp, rice(Oryza sativa)
  misc_feature (71): n=a or t
atatcttatagatggggcgccgcgagtacagtgaacaatatcatcatcgggcaggggcaggggcaggggcnggcgctgccattgtggtggtggtggtcgca

SEQ ID NO: 13240 - DNA, 101 bp, rice(Oryza sativa)
  misc_feature (71): n=c or g
tcatatttagcctgattattagtcacatgatgtttaacagcataggcaaattcaaagcttgccccccaagnagaaattataactaaaccgatgccacaacc

SEQ ID NO: 13241 - DNA, 101 bp, rice(Oryza sativa)
  misc_feature (71): n=c or g
gggatacgaagcgatggaacaccttagcattaatttaagaatgatggatatgttggtgtccttggtcttgntacgctttgcttagaggatggtcaaactgg

SEQ ID NO: 13242 - DNA, 101 bp, rice(Oryza sativa)
  misc_feature (71): n=c or g
atagaatgcgattttgtttttatcaaacaagcatgtcatttggtcattttatatttttatatgtcaactanaattttataaaaagccatataaaagagaat

SEQ ID NO: 13243 - DNA, 101 bp, rice(Oryza sativa)
  misc_feature (71): n=c or g
gcattttcttcttgttcttcagcgattcacgacacactcactcactcctgctagagcccattttgcatctnctggtgttggccccttgtgttgctgcttct

SEQ ID NO: 13244 - DNA, 101 bp, rice(Oryza sativa)
  misc_feature (71): n=a or t
acatttagtggaaaagatcttaggtgcactttcatggcggtggcttacagcatgcatcttcataatttttnaaaaaaatttgtatttgctctcttttaaaa

SEQ ID NO: 13245 - DNA, 101 bp, rice(Oryza sativa)
  misc_feature (71): n=a or t
aaagtatactgctcggtatttgaggtacagaaatagctaggttcagtgtagaggtttaacgaggtcgcacngaggacataatgctgatattgtctcgtact

SEQ ID NO: 13246 - DNA, 101 bp, rice(Oryza sativa)
  misc_feature (71): n=c or g
gcgtccttatcaaatcgtttctccgccttatccatctactacctttctctcgtctctccgccttatccatntactacctttctctcgtctctcagctctcg

SEQ ID NO: 13247 - DNA, 101 bp, rice(Oryza sativa)
  misc_feature (71): n=c or g
ctttacaggcactctctcaaacttcaacattacatagtatctctcattcagttcatgaatcaggtcaggtnaggtcaggtgatgagctcgatgctgtactc

SEQ ID NO: 13248 - DNA, 101 bp, rice(Oryza sativa)
  misc_feature (71): n=c or g
atttccaaaaatgattcgcaaaagaaacatgggcataagtcagatctctgatgaaagcggccacacctttngggagcgaagcggcgggagagtcggagacc

SEQ ID NO: 13249 - DNA, 101 bp, rice(Oryza sativa)
  misc_feature (71): n=a or t
tttatttataaattacttttcatttgtaatattgcacgaaacgatggctccggtctctttccccagatctntttttttttaatatctcttgcctcttgcac

SEQ ID NO: 13250 - DNA, 101 bp, rice(Oryza sativa)
  misc_feature (71): n=c or g
agcaaattaaactgatgtacttaggaatcagcaaagggaatatatagtttagccttgcgaaccataagagnactaaacatcagaggcatgaactcaacaac

SEQ ID NO: 13251 - DNA, 101 bp, rice(Oryza sativa)
  misc_feature (71): n=a or t
aggcgactgtagcggagattcgcaaaagctggagtggccgaggtctctcaaattctcagcagtatcttttnggggctccgaacagtcgcgcatcagaaccc

SEQ ID NO: 13252 - DNA, 101 bp, rice(Oryza sativa)
  misc_feature (71): n=a or t
aggtgagggaagccggttttttcctccacccactcggctaggctcattgcttaataggtgacggttttttnaaaaaatgcacgtttgattatttcaaatgt

SEQ ID NO: 13253 - DNA, 101 bp, rice(Oryza sativa)
  misc_feature (71): n=a or t
ggtaacttaaaaaggaagacaattgttgattgaatcacttatttaagtgacacgaatggctgaactggggngggtcagaagatatccggttagtccacaga

SEQ ID NO: 13254 - DNA, 101 bp, rice(Oryza sativa)
  misc_feature (71): n=c or g
gaatttccacaaaaagttacttctaagtccatgcaaagttacttccttaaaacataaaagttacttcccantaaattttgaaaataacaattattaaactt

SEQ ID NO: 13255 - DNA, 101 bp, rice(Oryza sativa)
  misc_feature (71): n=a or t
aattcaataacatggtccataaagaagaacaccagcccaactgttggtattttgcaagtacaaaggttggnggtagttttgtagaagggctcaaggtacga

SEQ ID NO: 13256 - DNA, 101 bp, rice(Oryza sativa)
  misc_feature (71): n=a or t
acacaacacaacactttcttaacaaaaacaacgctacaccatacgtggcgcacatccgtgccagacactcngccttctcctctgtgtcctacaggaaacca

SEQ ID NO: 13257 - DNA, 101 bp, rice(Oryza sativa)
  misc_feature (71): n=c or g
gttctagttgtggccgtgacgatatttgccatgcggtcagctcaaaagaagtccatgcaaatatatgcgtnattatatagtaaattgtgcacgttgatcga

SEQ ID NO: 13258 - DNA, 101 bp, rice(Oryza sativa)
  misc_feature (71): n=a or t
ctgagtagaatggttgtgaagaacctgatctgtacaacttacctgaattttgtagctgcttcattcctttnccctctacatcatctgatagttatgttccg

SEQ ID NO: 13259 - DNA, 101 bp, rice(Oryza sativa)
  misc_feature (71): n=c or g
aggtgtattccacttacaggggaagacatgccagtgctcgatgaacttcatcgtaatgaagtttttacaanagacaatattccttcctggctagccttctc

SEQ ID NO: 13260 - DNA, 101 bp, rice(Oryza sativa)
  misc_feature (71): n=c or g
gtgaggataaacatcgccggaatacctcgcgtcgtttggatgagggaggagaaaaaccaagcgaacccagnggaattcgttgggcagcgggtgcgggagca

SEQ ID NO: 13261 - DNA, 101 bp, rice(Oryza sativa)
  misc_feature (71): n=a or t
ccaaagtttggccctgattttgatgatctgactttacgtgtgtttaccgaaacattatggcgacattaganatgaactgaatatgctcgataatcaatcaa

SEQ ID NO: 13262 - DNA, 101 bp, rice(Oryza sativa)
  misc_feature (71): n=a or t
aaagaaaatgtgtatccatcaagagacgggcttagtcatataacacatgcaaaaagaggcaacaaaaaatncatgagcaacagtaattgttgattgggatt

SEQ ID NO: 13263 - DNA, 101 bp, rice(Oryza sativa)
  misc_feature (71): n=c or g
agccagatttcgcgagcgagcgccgggctgtgggatctggtcatttttcaaaaaaaacctctattttaccnataatttgttatagatccctagacgtacat

SEQ ID NO: 13264 - DNA, 101 bp, rice(Oryza sativa)
  misc_feature (71): n=a or t
aaccagatggagtgatggagaggggatgaagctgtaggcggtgggggggagaagacactctgctcctgccnctgcggcggcggcggtggctgctgctgttc

SEQ ID NO: 13265 - DNA, 101 bp, rice(Oryza sativa)
  misc_feature (71): n=a or t
ttgatgccgcggccatcgacaagctcctgttctgaaaggcatttcatggtcgccagaaatagaccaagacncagaccgattcattagaattttggcccaac

SEQ ID NO: 13266 - DNA, 101 bp, rice(Oryza sativa)
  misc_feature (71): n=c or g
agtgattcagtccatccaagatgagagggcaagacctacaattagttgcatctttatgtttctgaatctgntttgcttcaaaattttctcactgtcggact

SEQ ID NO: 13267 - DNA, 101 bp, rice(Oryza sativa)
  misc_feature (71): n=c or g
aaatttgttaatagcaattaatgttctctgacaaactatccatattgactcgttttcttccgcgtgattanttgcttctttacaacgtatgccattgtgca

SEQ ID NO: 13268 - DNA, 101 bp, rice(Oryza sativa)
  misc_feature (71): n=c or g
tgcagacgggttagctagggtttgtcggcgttgtcgatctctatggagatctgaaatattttgttttgtcngcgtggagacgaatagtgtaatatatatat

SEQ ID NO: 13269 - DNA, 101 bp, rice(Oryza sativa)
  misc_feature (71): n=c or g
gccccgagaggggacgcagagatcaagaacagtgcaaagatcaatcgatccatccatctctccccctcctnctgctgctgctgttgttgcgagagagagag

SEQ ID NO: 13270 - DNA, 101 bp, rice(Oryza sativa)
  misc_feature (71): n=a or t
catatttgctttctgatgagaaatgaatgtttttgagtctatgcgtttgctttgtttggtcttgatgatgnagttaagaattttgaagtaattgtttggtc

SEQ ID NO: 13271 - DNA, 101 bp, rice(Oryza sativa)
  misc_feature (71): n=c or g
cctcctcctccctccatcccgtcgtccccgtcgtcatctcctcctcgagaaaattgcatatccaccatcgnataaggttggattcgctggaataccatcac

SEQ ID NO: 13272 - DNA, 101 bp, rice(Oryza sativa)
  misc_feature (71): n=a or t
ctgttgatgcatgttgctggactacatcgtgaagggttgtgctataatggggcttttactagccaaaacantatttttcatcatgatgcatttactgtagt

SEQ ID NO: 13273 - DNA, 101 bp, rice(Oryza sativa)
  misc_feature (71): n=c or g
ggaaggttatctgaccggtgcaacacaagttccatcggcggaaatagaagtcaaggaaggagaaaagggtnaaataaccaagaaagtttccaatccggcat

SEQ ID NO: 13274 - DNA, 101 bp, rice(Oryza sativa)
  misc_feature (71): n=a or t
cactaatgcatgcttgatagcctgaaaggcctgatctgtggctgatgtccatagataaagttgtcccttcnttaacaaagaagttaatggtttactcagaa

SEQ ID NO: 13275 - DNA, 101 bp, rice(Oryza sativa)
  misc_feature (71): n=c or g
aaaattttgacttaaaagaagcttatatgcttaaaaatggatgaaccatacgagctaaactaaactgcgcntaacaatgaatgacaagaatggcacaaaag

SEQ ID NO: 13276 - DNA, 101 bp, rice(Oryza sativa)
  misc_feature (71): n=a or t
tgatatctcccaaactgtaaaatcactccttttagattagatcgcccctattttaaaccttcttttttttnaaaaaaaaataaagcatgtgactaagtaag

SEQ ID NO: 13277 - DNA, 101 bp, rice(Oryza sativa)
  misc_feature (71): n=c or g
tcatataggtcggggaggattataggtgctggttatgatgcaaagtataggtgtcaattttttaatatagntgccggtttttaacaagaactggcacctat

SEQ ID NO: 13278 - DNA, 101 bp, rice(Oryza sativa)
  misc_feature (71): n=a or t
ataatgactaggcttgaaatagtcccgagggttgcttcctaagtgtcatattataggttatcatttttttnaaaaaaatatctccaatattttgttgacat

SEQ ID NO: 13279 - DNA, 101 bp, rice(Oryza sativa)
  misc_feature (71): n=c or g
gcggagccaataaggaggattctgatgaagatgagtgaagcaaggattaaagaggagccctcttcctcctnctcctcctgctgctgctactgctactgatg

SEQ ID NO: 13280 - DNA, 101 bp, rice(Oryza sativa)
  misc_feature (71): n=c or g
aattttctgaacaaataaaaaatgatttctaaacttctgagcgagaacagaaacatcaactggttattaanaggaaacaccaagttaaaattctacaggcc

SEQ ID NO: 13281 - DNA, 101 bp, rice(Oryza sativa)
  misc_feature (71): n=c or g
acttaagattgaggatggtatggtatgatgagcctctttggtgatctgatcattttcctttttcatgtcangtttgacacctttggattgcataccagaat

SEQ ID NO: 13282 - DNA, 101 bp, rice(Oryza sativa)
  misc_feature (71): n=a or t
cttctcacatgtaaaaaaggacatccgactctttatccccttctctaaacccataataaccaacaataccnacaaaatctcccaaaaaaacaactgtttgt

SEQ ID NO: 13283 - DNA, 101 bp, rice(Oryza sativa)
  misc_feature (71): n=a or t
ggcatcggttggatggagctttggtgaatgctgtaaacttactatttcttttctatctttgattttttttnaaaaaaaaacaaagcaaagctccttcttcc

SEQ ID NO: 13284 - DNA, 101 bp, rice(Oryza sativa)
  misc_feature (71): n=c or g
tagcataagtatcttgtctatagctgcggagtacacacaaatggttgcgtatgtgattattatgacaatgngtggtgaaaaatttaaagaaccaatagcga

SEQ ID NO: 13285 - DNA, 101 bp, rice(Oryza sativa)
  misc_feature (71): n=a or t
cccgatccgcgaattcttctccccaattccaacccaaaatccccaaaatccagcggtgcaggaggagaatnccacgaggcgagtcggcttctagggtttgg

SEQ ID NO: 13286 - DNA, 101 bp, rice(Oryza sativa)
  misc_feature (71): n=a or t
cagtgcttggactggatgtctggatcacgccgccgccggttttgcccaaatggaaatcgggagccaccgantagatgtagcgcgcgcgtacgtgcgaggac

SEQ ID NO: 13287 - DNA, 101 bp, rice(Oryza sativa)
  misc_feature (71): n=c or g
caaacacgagaagaagtcaagaagcgataagcatcaacctcccggggaaaagagaaaaacggcggcggcgngagccggtggtcgccggagatcaggtcagg

SEQ ID NO: 13288 - DNA, 101 bp, rice(Oryza sativa)
  misc_feature (71): n=a or t
tcttcgacttgcaaatttgaccgttaatttcggtagtaaaatagttgcaaaccccggcaaacaaaaaaaangtttattgtacttgagaaagtacctcaata

SEQ ID NO: 13289 - DNA, 101 bp, rice(Oryza sativa)
  misc_feature (71): n=a or t
gttagactgtttgtgactttctccatacgataggacgctaggactaacttttattctattagggatttggngttctttgtttaactgccaatttgcctgaa

SEQ ID NO: 13290 - DNA, 101 bp, rice(Oryza sativa)
  misc_feature (71): n=a or t
ttcagacttcagaggtgctctggaggagtttggtctcgatcatcatctctctgaagcctgagagagtttcngctccgattaccacttgaccatggtatgca

SEQ ID NO: 13291 - DNA, 101 bp, rice(Oryza sativa)
  misc_feature (71): n=c or g
tagatataattagcacatattaacttcgatagatacgttatatgacacaaacgaaccaactttctgaatcngccactgaacctgattcatgcatgtaaggc

SEQ ID NO: 13292 - DNA, 101 bp, rice(Oryza sativa)
  misc_feature (71): n=a or t
aaagaatataacatgccaaagttagaaccgtcgtgtcacaaaaggaaaaataatggaactaccattcgtgntgctgaacagagtagtccaatttgaagcaa

SEQ ID NO: 13293 - DNA, 101 bp, rice(Oryza sativa)
  misc_feature (71): n=a or t
acaaaaacaccctcacagtataactgtgaaaaacacaaacattccataaagtactctgcagatgttgagancgtgccaactctgcgacgatggcacaccca

SEQ ID NO: 13294 - DNA, 101 bp, rice(Oryza sativa)
  misc_feature (71): n=c or g
aaaaactggagggtggacaaattaagcgaaggtttgtgaagaggctagttgatgcactcaatgcaaatatnaacccaggtgctcattgtcctgggatcagg

SEQ ID NO: 13295 - DNA, 101 bp, rice(Oryza sativa)
  misc_feature (71): n=c or g
ccatactgcagttcaaattgggcccatccaacaaggaaattatgggcacctcaaaagagatgtactccccngtcttataaaaaaaacgaatctagtattaa

SEQ ID NO: 13296 - DNA, 101 bp, rice(Oryza sativa)
  misc_feature (71): n=c or g
agatgtacaagattttccttctgtcacagattggaatagaaatatctgcatcttggtacgaagtaactaantaaaatgtacaaatttttgcagggtctaat

SEQ ID NO: 13297 - DNA, 101 bp, rice(Oryza sativa)
  misc_feature (71): n=c or g
tacgtacatcggctatggaacaaatcttgtccctcttgtcctctgcgaagatgacacttgtatgtgtagtntcgactactgcacactgtaggctgcgcaaa

SEQ ID NO: 13298 - DNA, 101 bp, rice(Oryza sativa)
  misc_feature (71): n=a or t
agatccatctgatcctccttgaggactgggaatagagagaagctagaatgattagtgctgttctttttttnaaaaaaaatactaaagtgctttttgttgat

SEQ ID NO: 13299 - DNA, 101 bp, rice(Oryza sativa)
  misc_feature (71): n=a or t
aaaaaaaaacacaagatagccaacaagaaatcgccaagaaccgctctccagagcctagaaactgacgatgncgatcgacgagaactcatcaagaactcgtc

SEQ ID NO: 13300 - DNA, 101 bp, rice(Oryza sativa)
  misc_feature (71): n=c or g
ttctatcagccatgaaggaaaaaagactttctgatattttagatgatcaaatcatgacgggagataatttngagtttcttgaagagattgcagagttagca

SEQ ID NO: 13301 - DNA, 101 bp, rice(Oryza sativa)
  misc_feature (71): n=a or t
gatgctccatgaatctagagggcatattcattctcttctttccatgtgtccttctgatgacggttggagcncaggaaacggtcacaaccgtcttaggaggt

SEQ ID NO: 13302 - DNA, 101 bp, rice(Oryza sativa)
  misc_feature (71): n=a or t
tattacaaagtgtttttttttaatgcaactattagctgtttgtcctcagcatgttataccaacgtaagatnagcaaaaatgttgcacagccttcaggttga

SEQ ID NO: 13303 - DNA, 101 bp, rice(Oryza sativa)
  misc_feature (71): n=a or t
cccattacttctatggaaagaaaacaagcctgccctcaccctcccctcttgtctcctatgcaaattacaanttctgacccctcactccctccatcatatca

SEQ ID NO: 13304 - DNA, 101 bp, rice(Oryza sativa)
  misc_feature (71): n=c or g
aatacatcacaaacctaacttgtttagagcggtattgtctttcctatgggcgaacctatctttccgatgtntatgtcctatctatctcaggtgttttgtgt

SEQ ID NO: 13305 - DNA, 101 bp, rice(Oryza sativa)
  misc_feature (71): n=a or t
tatcattcactgaacctgtccacaatagtggcttcgcacccatgagatccacgcatctactccagattagnagttaattaacagtctatgttcaatgaacc

SEQ ID NO: 13306 - DNA, 101 bp, rice(Oryza sativa)
  misc_feature (71): n=c or g
cggcgatctccactagctagctaccaagagcaagcaggagatggagacgatgaactcacagggctccaagncgctcgctatatatagagagggagtgggag

SEQ ID NO: 13307 - DNA, 101 bp, rice(Oryza sativa)
  misc_feature (71): n=c or g
aaaataagcgatgaggccatatctcacatagctcaaggctgcaagaacttgagagagctttctatcatctnttgtcctcaggtacatttctagtttgtatt

SEQ ID NO: 13308 - DNA, 101 bp, rice(Oryza sativa)
  misc_feature (71): n=a or t
ggattgctgttcttcagattctgcatttgggaaaaacgatcgtaagctcccttctttgcttgtgtgtgtgngagagagagagagagagagatcctcccaca

SEQ ID NO: 13309 - DNA, 101 bp, rice(Oryza sativa)
  misc_feature (71): n=c or g
gtagatctctatagcaaatcatctagaaaaaaaacagagcaatttagagtaaagcagtcattagaccattnagagaaatcaattaccatatgcttgtttct

SEQ ID NO: 13310 - DNA, 101 bp, rice(Oryza sativa)
  misc_feature (71): n=a or t
aagaggcttgctggactatttcaaatattactgctggtaacaaagatcagatacaggtatgtgtacagacntaaaaaatactgacatgctcatcattctac

SEQ ID NO: 13311 - DNA, 101 bp, rice(Oryza sativa)
  misc_feature (71): n=a or t
atggaattggaaggaaaggtgatttttcctccagtaggacaaggatagggacatggaagggcctttttttnaaaaaaaaaacttcttgaaggatcaaggag

SEQ ID NO: 13312 - DNA, 101 bp, rice(Oryza sativa)
  misc_feature (71): n=c or g
tactcgattttccgtgtttttattcgtttcatgtgtgggtccttgtatgatctgttgattatttcttttgnattatgaataaaataaatttcacactttgt

SEQ ID NO: 13313 - DNA, 101 bp, rice(Oryza sativa)
  misc_feature (71): n=a or t
gactgaattttctaacctgctgcgttagtgatgtcctgcagtcctggcagtttttaaaaattgaatagtgnaatagatcatgctgcagctgcatgtcttct

SEQ ID NO: 13314 - DNA, 101 bp, rice(Oryza sativa)
  misc_feature (71): n=a or t
acgtgaactgttgttttgccacgccaaacgcgttttgaaaataagttttggaatagttcgtttaaaaaaanaataaaaataaaaatgtttaaacagtaaaa

SEQ ID NO: 13315 - DNA, 101 bp, rice(Oryza sativa)
  misc_feature (71): n=a or t
aaaacatttggtttcctgaaatttacgcaatgaaatagtatgaagataacaaaaagattaggaaaaaaagngtaaacaatataaagtttgtaaaaaaatcg

SEQ ID NO: 13316 - DNA, 101 bp, rice(Oryza sativa)
  misc_feature (71): n=a or t
aagtgaacaggccctaaaagtacacttgtcgtgggactaaggaagtattatttaataggtgttgaactctncccgataaatagactcgatgggttcttttc

SEQ ID NO: 13317 - DNA, 101 bp, rice(Oryza sativa)
  misc_feature (71): n=a or t
attatagtagagcacccttgtaacattctttcaaattttcttgctgggccacaagatcgctattttggaanagaatacaaaatttgtcatttttaacatat

SEQ ID NO: 13318 - DNA, 101 bp, rice(Oryza sativa)
  misc_feature (71): n=c or g
aaataaataaatgaagtgaccagggtttaccctttcaatttcgaagtagaaaccactcctcacagctttancgaaatccgaccgaaaacgggtaaaaaccg

SEQ ID NO: 13319 - DNA, 101 bp, rice(Oryza sativa)
  misc_feature (71): n=a or t
cgaggatatgagattgcggcacagttagagcaggcgagcgtacaccaaaagtctctccaaaatattgaagnctttactaagccagacgagtttggtctgtc

SEQ ID NO: 13320 - DNA, 101 bp, rice(Oryza sativa)
  misc_feature (71): n=a or t
atatgcacctgcctatgactcgggcggaggtagagtatgtaagggggttaccaggaatctggtcaaaaaanttttttaagctatacttcacatatcttcac

SEQ ID NO: 13321 - DNA, 101 bp, rice(Oryza sativa)
  misc_feature (71): n=c or g
atttgaattctccgggtagagttcaagggaagctctcattcttgggtaatttgaaggatttaaatggattngtgaagatttgaatgaaggtcaaaggaaag

SEQ ID NO: 13322 - DNA, 101 bp, rice(Oryza sativa)
  misc_feature (71): n=c or g
cttacattatgaaacggagggagtatgtttaaaatacacctagcttatattatcatgacttacgcaataanaataatatacttgaaagaagttctaattag

SEQ ID NO: 13323 - DNA, 101 bp, rice(Oryza sativa)
  misc_feature (71): n=a or t
gtcttggaaaaatgactagccactaattttgaatcagttttgattattagatgtaatgccccgattttcgntcgggattaaaaatcattaaataatgcatt

SEQ ID NO: 13324 - DNA, 101 bp, rice(Oryza sativa)
  misc_feature (71): n=c or g
ggatctcattcctgccgaggtgagtggtcaccggtgagacgtcctctggcgatattttctccatccgcgtnctcggtaggttgttcttcgtacctgcgcgg

SEQ ID NO: 13325 - DNA, 101 bp, rice(Oryza sativa)
  misc_feature (71): n=c or g
gcagatcaacacacatgtggatgccatgcaccacacatacatgcatatgcttcctggaccatgtcgacaancacatgcagtacacatgtgcaacacatacg

SEQ ID NO: 13326 - DNA, 101 bp, rice(Oryza sativa)
  misc_feature (71): n=a or t
tttgtcccccgctctaagcggcgagatagaaggggcaaaaggaaattggcctgctccgatgacgagggccntgtccttgcggctgatgggccctcacgggc

SEQ ID NO: 13327 - DNA, 101 bp, rice(Oryza sativa)
  misc_feature (71): n=a or t
cagacccaaaaaaaatatattttttagggtaagagagctttttttttattaaagagcatgtttatttgttngaggttcaactcctaaatttagcttaaaca

SEQ ID NO: 13328 - DNA, 101 bp, rice(Oryza sativa)
  misc_feature (71): n=a or t
cttggtatctagatcagtctgatacctgtaggtaccagacctggcactgggtatcgggtacctaggtatcnagtacttggtactttgatcagtataataca

SEQ ID NO: 13329 - DNA, 101 bp, rice(Oryza sativa)
  misc_feature (71): n=a or t
tattcgaaaagaaacaaaaagatctgaactaatcacaataatcccctaatcgccgtactaatcgttctaancaccgttgtcagggttatggataccacata

SEQ ID NO: 13330 - DNA, 101 bp, rice(Oryza sativa)
  misc_feature (71): n=a or t
atgtgatcatatatttttacaacttgtagacgttaatctactgatacctacaatgtcttttcatgtacacntctcaactgtgtatggttcaacaccatatt

SEQ ID NO: 13331 - DNA, 101 bp, rice(Oryza sativa)
  misc_feature (71): n=a or t
cacaactcaacaattaccaggatcagtaccattactaggatcatacccctccggatcaaatggcatatganctccctctatttcatattgtaagtcgttgg

SEQ ID NO: 13332 - DNA, 101 bp, rice(Oryza sativa)
  misc_feature (71): n=a or t
ttttgcccgcgtaaagccacatggattgtataacggcaaataaccctgaatattaatgtgttataaagtanaacaaaatcatcctattgatcattttaatt

SEQ ID NO: 13333 - DNA, 101 bp, rice(Oryza sativa)
  misc_feature (71): n=a or t
aactaacaaggacattggccaagcaataaggacagaatcgtttgtgatagctcgaataacgacgatggtgntaaattaccaccacaagctgtagtttaatt

SEQ ID NO: 13334 - DNA, 101 bp, rice(Oryza sativa)
  misc_feature (71): n=c or g
ggatttgatggcagcagcagcaaggggatcagggaagaatcttgatcggagacggcgtggtgcgggaggcngggaccaggagagttttagggatgacaagt

SEQ ID NO: 13335 - DNA, 101 bp, rice(Oryza sativa)
  misc_feature (71): n=a or t
ttgtgtggggaacaatagcagcaacaaccatttgcctctttgtgatcgactccatttggtttcttcctggntatgggtaagtacttcatttccagctttct

SEQ ID NO: 13336 - DNA, 101 bp, rice(Oryza sativa)
  misc_feature (71): n=a or t
agcccaaaaatagaaaaaagtagatttaccatagacgaattctgaaaaatagtccagaatattaaaaaaantcataattttggatagattaaattctacaa

SEQ ID NO: 13337 - DNA, 101 bp, rice(Oryza sativa)
  misc_feature (71): n=c or g
tctcccacgaaaaagaagagatgtttaggcaaagggatggacggtggcgccggcgatggcggctggtccancctgagctacgacgccgacgtgctccacat

SEQ ID NO: 13338 - DNA, 101 bp, rice(Oryza sativa)
  misc_feature (71): n=a or t
cgtacgcgtcttttcaagaaaaaaaagaatcgcgcaacgcaactgcgatcctacccttgtgcgtgagtttntcttgctagcactctctccgtaaaaaaaat

SEQ ID NO: 13339 - DNA, 101 bp, rice(Oryza sativa)
  misc_feature (71): n=a or t
tatgataacatggagagagtatcaattaaagcatttgggcaacggaaaaaaaggtgtcaaattatcaaaantttccttttttctcctctcttctcaccggt

SEQ ID NO: 13340 - DNA, 101 bp, rice(Oryza sativa)
  misc_feature (71): n=a or t
gcatttgcatgggtgtcgcgcgaggcgagggttgcattgctctcaggtttcctttaccgccggggtacgtnaatataaataccgcggtaacctccttaaat

SEQ ID NO: 13341 - DNA, 101 bp, rice(Oryza sativa)
  misc_feature (71): n=a or t
catgcatccaaatgatacatatacacgtgcttggaagttatgtgtaatttacaatttcttaaatgtcactngtgctaaatacctactaagctgcacattat

SEQ ID NO: 13342 - DNA, 101 bp, rice(Oryza sativa)
  misc_feature (71): n=a or t
ggacgagaacggaagaaaaagattcagcagaaggggcagaaagaaagaaccgagggcataactgcgataanaagtataagctccagggacctgggcagaat

SEQ ID NO: 13343 - DNA, 101 bp, rice(Oryza sativa)
  misc_feature (71): n=a or t
aacatggtgctagaggacaacttttgtagcctaactcatcccaatagataaaaatttggaaaactaaaatnatttttatagcatgatttatgctattgaat

SEQ ID NO: 13344 - DNA, 101 bp, rice(Oryza sativa)
  misc_feature (71): n=a or t
caatactttgtcaagcacaaaacttgacaatgaatttattaaagcgcagggaaggcaaataatttatttangtgtctgaccttctatgttgagcaggctgt

SEQ ID NO: 13345 - DNA, 101 bp, rice(Oryza sativa)
  misc_feature (71): n=a or t
aataatcaaatattcatgattgagtatttcctattagttggcatcattcacaagaacactactacagaaanagtcaaaggtgccggtttcccaaccgtcaa

SEQ ID NO: 13346 - DNA, 101 bp, rice(Oryza sativa)
  misc_feature (71): n=a or t
tcaatgtgatttgcacattgttatgtacaatggggagtcatctttatggtttagttagactgattttgctnggactacttcatgtcaacaaattgagtgaa

SEQ ID NO: 13347 - DNA, 101 bp, rice(Oryza sativa)
  misc_feature (71): n=c or g
agaaggaattgggtcaacgacttgggtaaagaaccaacacggccagtccatttgggcagtaatgctgcaangtgcagacaataaacatcacaaggtcgagc

SEQ ID NO: 13348 - DNA, 101 bp, rice(Oryza sativa)
  misc_feature (71): n=c or g
gaggagaaatagttgattcggtaagcctattgcataattgcacaaacgacgacgagcagcagcagcagcancaccaccaccaccgcttcgtccgccccgtg

SEQ ID NO: 13349 - DNA, 101 bp, rice(Oryza sativa)
  misc_feature (71): n=a or t
atgctctaaccaaaaggcacaacaggaagcaacagcggaaaaaaaattaaaacaagagtaagcacacatcngtaaaatggggaacacattgtgaaaattat

SEQ ID NO: 13350 - DNA, 101 bp, rice(Oryza sativa)
  misc_feature (71): n=a or t
ccaggtcatgtagcaagaacaaaatcattcagaggctcaagccacttttcagtatggagtggacataatcncatacttcctccgtcccaaaataaagctat

SEQ ID NO: 13351 - DNA, 101 bp, rice(Oryza sativa)
  misc_feature (71): n=c or g
ggaccaaataatgcctgttattatcctactaaaaatcgtcttcgttgtcaccatcagagaggatcaccacnaccacaagtcattggagtcaaagtaaacac

SEQ ID NO: 13352 - DNA, 101 bp, rice(Oryza sativa)
  misc_feature (71): n=a or t
taaatttattcttttgatctttatataaattcatttactgtgggggattcccctacaatgttttctttttnaaaaaaaaaatctatgtgtcatcccgttga

SEQ ID NO: 13353 - DNA, 101 bp, rice(Oryza sativa)
  misc_feature (71): n=t or c
tcctgaacttatcagttgggtgaagaagttcaatgagggtgccaaagtcagcattaacatctatggtgatnagggcccttttttcagaacttttaggggtt

SEQ ID NO: 13354 - DNA, 101 bp, rice(Oryza sativa)
  misc_feature (71): n=a or c
atgattcaatacatgtttgtccgaataactgtgttttggttagaaaggagttggctaaaatggataattgnccagtatgtggtgcttcaagatggaaggat

SEQ ID NO: 13355 - DNA, 101 bp, rice(Oryza sativa)
  misc_feature (71): n=a or g
actgcctccaaatggtaaagttgtacctttacaggaatttggtcaaattacaaggggaatggtgatggccnatggggggattgatcgctgttcatggcagc

SEQ ID NO: 13356 - DNA, 101 bp, rice(Oryza sativa)
  misc_feature (71): n=t or c
atgagctgcaagcttcttgccaatgagcctgtgctcatgtgcaggtagtagtggtataagagttacagccnatgaagagggaggaaagcagcagccgggaa

SEQ ID NO: 13357 - DNA, 101 bp, rice(Oryza sativa)
  misc_feature (71): n=a or g
gagctgtccttcgcacgaaatgcatagaagattgggaaaaactgtctctgcagctatcttcagggctcaanacaaagtcaagtcttgaagaaatgactaga

SEQ ID NO: 13358 - DNA, 101 bp, rice(Oryza sativa)
  misc_feature (71): n=a or g
taaggctcggactcgattccgattccgattgcgattgaagctcttctcttctatttattgtacatgtgcanatagatagcagataaaccggaggctgctat

SEQ ID NO: 13359 - DNA, 101 bp, rice(Oryza sativa)
  misc_feature (71): n=t or c
gaagaagaggccttgtgaatcttatcttgggaaaaagaggtatatccatccacccatctgtgtgctgttcntgattggcggcaatggcgatggagccgacg

SEQ ID NO: 13360 - DNA, 101 bp, rice(Oryza sativa)
  misc_feature (71): n=t or c
tgagggcgtttacaaaattgtgaagttcttgactacattgaacatagaagttattatgaaaaggatggatngatctacaaaacgtaagctaactattgaca

SEQ ID NO: 13361 - DNA, 101 bp, rice(Oryza sativa)
  misc_feature (71): n=t or c
atttcgctttgtgcaagcttttggagatgtggccaataataagttgagcgaggtcaagaaggcaatcgaanaacttttctctgatcattcaccaaaagtga

SEQ ID NO: 13362 - DNA, 101 bp, rice(Oryza sativa)
  misc_feature (71): n=a or c
atatcctccatgtcgtaggctagctcgtgcatctctatcatccaggccttcagttgcaaatcataattctncatgctcgcgtacttctccagcacaaggtt

SEQ ID NO: 13363 - DNA, 101 bp, rice(Oryza sativa)
  misc_feature (71): n=a or g
acacggtgtcaccctccacgcaaatcaaattcacaccggaggatagcaaaatctgctgattgttcttgtcnaagagcactgtgcagtgaacaagctcgagt

SEQ ID NO: 13364 - DNA, 101 bp, rice(Oryza sativa)
  misc_feature (71): n=t or g
tctacatctggcttctcgccagccacagagaattcatcatctgaatagttcctaacataagtgcccatctngaatcctgacataaaaaaaaatgtttgggc

SEQ ID NO: 13365 - DNA, 101 bp, rice(Oryza sativa)
  misc_feature (71): n=a or c
ttcttgtactctctcttggaagagaacgtcatagaaccgccaaagatatgggtgacatggaggtcgaattntgagaaaatgagttcgttatcgggtgcaag

SEQ ID NO: 13366 - DNA, 101 bp, rice(Oryza sativa)
  misc_feature (71): n=a or g
tttccttttctccctgttttgttctgattctcgacgatttcttggcccacgcatagggatttccccctctngaaccagcgcaggggaaggaaagatgggtc

SEQ ID NO: 13367 - DNA, 101 bp, rice(Oryza sativa)
  misc_feature (71): n=a or g
catgtcaagagagcgacgtgccctctcaagaacactcttcttctacctctccacgatgcaacgtataggcngcaacaagtttcttgaagccggagcactag

SEQ ID NO: 13368 - DNA, 101 bp, rice(Oryza sativa)
  misc_feature (71): n=t or c
cgtacacaaattgttgtcgcacacataattatcatccatcgatccatccatacaaacgtacgtagaatcangaagcttgattcgttcacggcacgccgggg

SEQ ID NO: 13369 - DNA, 101 bp, rice(Oryza sativa)
  misc_feature (71): n=t or c
tcaggaaatattgagcacccatctgtttgtaagcaactacactttaatcacttgcaatagagataagccanagtaaacatgtcagggaaactctgttgttg

SEQ ID NO: 13370 - DNA, 101 bp, rice(Oryza sativa)
  misc_feature (71): n=t or c
tggaatgcttggggccattttataaagcacaggttactgccgactggatcctttctaattcataaatagcnattctagcaataacgaaataaataataata

SEQ ID NO: 13371 - DNA, 101 bp, rice(Oryza sativa)
  misc_feature (71): n=a or g
ttgcaatgtttttcttgctgagctgaccaaaatacccatatggatcccatctcttcatatctgaccagtcnctctacagctgccaccactgccggcccaga

SEQ ID NO: 13372 - DNA, 101 bp, rice(Oryza sativa)
  misc_feature (71): n=a or g
cagcggcagatgatgtcgggcttgggggatggacagtttgtggcagtgttggcaatgctgctgattctgtngagcagggacacgcaagaatgctggctaag

SEQ ID NO: 13373 - DNA, 101 bp, rice(Oryza sativa)
  misc_feature (71): n=t or g
tcttttttttctctctttgacgcctaactctgtcaaactgcccctaacccaataacattcgaaaacaagangaaaattcgtattacatttgaatatttgaa

SEQ ID NO: 13374 - DNA, 101 bp, rice(Oryza sativa)
  misc_feature (71): n=t or c
taaattgggcccaaccactttctcggctggcaaaaggcttggccttctctgcttcttccaaacctcccatncactctgttcccctctcttcccctgcttcc

SEQ ID NO: 13375 - DNA, 101 bp, rice(Oryza sativa)
  misc_feature (71): n=t or g
ttgcaaatctgcaaatctgaacctgaacctgatcaacctgaactcatcagccatcgcctcatttcgtcagnaaatggccattgctcctcctaggatccagc

SEQ ID NO: 13376 - DNA, 101 bp, rice(Oryza sativa)
  misc_feature (71): n=a or c
cttgctcaggccgtcccttgtcacacctgctccatcgatcgatcagcacaaacagaataattagcaggatnaaggtagtatagagagttttgtgagatcca

SEQ ID NO: 13377 - DNA, 101 bp, rice(Oryza sativa)
  misc_feature (71): n=t or c
gttgaatgcagtaggattttagcacagtaataaatgctcaccactggatctgcaagctggagtggtttccnggccatcatcccgcagccatggagcagatt

SEQ ID NO: 13378 - DNA, 101 bp, rice(Oryza sativa)
  misc_feature (71): n=a or g
cggcgcccacaatcaccgggaacaaagtggtggatcgatcgacggcggcatgctcgagaggtagcgaactngcaatcaaagcgatgtgctcggggaggtga

SEQ ID NO: 13379 - DNA, 101 bp, rice(Oryza sativa)
  misc_feature (71): n=a or g
aaactaaagaactggttgcttagccttggatcagaaaccaaccagaactcgcaaatccaacggaagaacangcaaaatcaccgcacgaactgcttccgcac

SEQ ID NO: 13380 - DNA, 101 bp, rice(Oryza sativa)
  misc_feature (71): n=t or c
aaagacaaagcagttcttgccacacagagaacatattcccttctcccccctaatctcatctcatcttcaangtgaagcttcatcttctcacctccataatt

SEQ ID NO: 13381 - DNA, 101 bp, rice(Oryza sativa)
  misc_feature (71): n=a or g
tccgtctccagtagcttgctttgctcgcagattgttccttttttctttttctccggcgactcgagatcgtngctagctagagcctagatggcctcttccat

SEQ ID NO: 13382 - DNA, 101 bp, rice(Oryza sativa)
  misc_feature (71): n=t or g
taggaaaagcaaggttgtggaagatgtgcagtctgcagggttagctgtgtatgtggaggtattccgcaatnagtatgtatcaccaccggtggatttcttcg

SEQ ID NO: 13383 - DNA, 101 bp, rice(Oryza sativa)
  misc_feature (71): n=t or c
gcctgaagcaaaattctcaaaacaccatttgaagtcaatttcagggccatctttttatgcgaacttggagnaagcttctaaagatgcgagacatgaaaata

SEQ ID NO: 13384 - DNA, 101 bp, rice(Oryza sativa)
  misc_feature (71): n=a or g
agaagagcgtgggcatggacaactgacctgagtggccttgtcagggagagccatagcagtggacgtgtctntctccgccattgcttcgtcgacactggacg

SEQ ID NO: 13385 - DNA, 101 bp, rice(Oryza sativa)
  misc_feature (71): n=t or g
tgtctctgatgtgaccatgctgctccccaacaccagctcaaataaacaagatgggatcacattttcctatnaagaccatggaaaaagcggtgttttcttct

SEQ ID NO: 13386 - DNA, 101 bp, rice(Oryza sativa)
  misc_feature (71): n=t or c
ctggtggtcaacgtacagtaaatttggttaagttggctactctggatcgatcggtggtgaggaagatggcnatgagagctaggcgcgtatttatagctagg

SEQ ID NO: 13387 - DNA, 101 bp, rice(Oryza sativa)
  misc_feature (71): n=t or c
aatgaatccattagtatttgaggctggggcaatgcaaaatcttgaaaggtttcgctttaacttaaaagcangagaaacaagaaatccatgcagacaatttt

SEQ ID NO: 13388 - DNA, 101 bp, rice(Oryza sativa)
  misc_feature (71): n=t or c
gccgcggccgcgttgccagctcagcttcgaacccccccccatttctctccgcttctccttctcctcccctngcactcgcctccccaattttaaactccctt

SEQ ID NO: 13389 - DNA, 101 bp, rice(Oryza sativa)
  misc_feature (71): n=t or c
catgcgaagtacctgagggatttcaatggttacttcctgaagtgaacgcacgctctctcttctagatcaanaagatttgagaaaaaaccaatgatttatgc

SEQ ID NO: 13390 - DNA, 101 bp, rice(Oryza sativa)
  misc_feature (71): n=t or c
tggcgtacgacgaatcactgccttgtgatgagctctagcagccgatgcagatggcatgaaccaatgaaacnagcaacagcaccaaaaacctgacaaaaaaa

SEQ ID NO: 13391 - DNA, 101 bp, rice(Oryza sativa)
  misc_feature (71): n=t or c
gcttgttgcagctgctgctccaagtagtgtgtggcgatccttagttttttgcacttagggagggtgcactntgctgatcctcttttacttggttcagtatc

SEQ ID NO: 13392 - DNA, 101 bp, rice(Oryza sativa)
  misc_feature (71): n=a or g
tctttcttgaattgaatagaatggtagaaaaagctgtccaatacatcctcaacacggtacgccagcattcncacctctgcgatccatcccttcaggagctc

SEQ ID NO: 13393 - DNA, 101 bp, rice(Oryza sativa)
  misc_feature (71): n=t or c
aaaactgggtgatggtaaacaaaccttgttctgggaagataactggattggaggcagacctcttgccttgnaattcccaactttgttcaatataacaacca

SEQ ID NO: 13394 - DNA, 101 bp, rice(Oryza sativa)
  misc_feature (71): n=t or c
gatgcgcacataaatctcaatgtatttgagtctgtgcgtaaaaataacaaaatcaattaccgaatcattanatttctacccaaaaaataactgaatcaatt

SEQ ID NO: 13395 - DNA, 101 bp, rice(Oryza sativa)
  misc_feature (71): n=a or g
gcaaacctgcaaattcagtggccatggatgcccagaaaaattgccgggacaaaagtcatcaaattccagcnagttcttggtggctggtgcccactagtact

SEQ ID NO: 13396 - DNA, 101 bp, rice(Oryza sativa)
  misc_feature (71): n=t or g
gctaccttggtaaggatggcaaaggatcattattagactcaagtccagaatcactattgtcccaccaacgncacttcaaaatcatatattatacattagtg

SEQ ID NO: 13397 - DNA, 101 bp, rice(Oryza sativa)
  misc_feature (71): n=a or c
taaagccacgggtgatacactgatactagtctcttctggcactttgaaaaactactgatggccctcctagnaaaaataaaggaataatcgataacatgggt

SEQ ID NO: 13398 - DNA, 101 bp, rice(Oryza sativa)
  misc_feature (71): n=t or c
aaaaaaaagaatcgattttgattcccttcttcccttttcttgcacgattgattggtttgattgattccacnaccacctgttgggtgttgggtgttgcacga

SEQ ID NO: 13399 - DNA, 101 bp, rice(Oryza sativa)
  misc_feature (71): n=t or c
gtatatgtgctgttataaaaaatggaaaaaaaaaacgacttaacgtggcaagacgaagaggccaaaagtcnatatattttgccgagtgagtgaaagagcca

SEQ ID NO: 13400 - DNA, 101 bp, rice(Oryza sativa)
  misc_feature (71): n=t or c
agtctatacatcagtttccttatgtcagccctgttggataaagaaaaagataaggaagtgacctacccagnccatactcaatgtatcactagctgtttact

SEQ ID NO: 13401 - DNA, 101 bp, rice(Oryza sativa)
  misc_feature (71): n=t or c
tcaaccggacccagtcgggagcgtggggggcaatcggggcatttgaaaaaaaatctcatctttttcatccngaaaataataaaataatccgtccagtgtcc

SEQ ID NO: 13402 - DNA, 101 bp, rice(Oryza sativa)
  misc_feature (71): n=a or g
catggcaaaggcactcactgacgtcgctgagctcatcgcgagaactcctcagtggtggagtggagtgatgnagtgagtggagtggcgcgaggaaatcaatg

SEQ ID NO: 13403 - DNA, 101 bp, rice(Oryza sativa)
  misc_feature (71): n=t or c
ccagcacgtccggcgaaggggaaagatagaaaaccccacaaattcgagggggctggacacaaaaatccatngaaccccacacgccagcctcccgatccgac

SEQ ID NO: 13404 - DNA, 101 bp, rice(Oryza sativa)
  misc_feature (71): n=a or c
gtctcctctgcctctccctgtgctccgaacaatctcctgaaaattaatctcagcgctagctgttgctgttnatctcgctgctgctgttgttgttgtttttt

SEQ ID NO: 13405 - DNA, 101 bp, rice(Oryza sativa)
  misc_feature (71): n=a or g
cacaccaaagtgggcttgtggatgcttcctttttaggccaagcagcctatgccatgcgcgtggtctgccangcttgcccggactggcgacgatgaagatga

SEQ ID NO: 13406 - DNA, 101 bp, rice(Oryza sativa)
  misc_feature (71): n=t or c
tacaatgattgaggaaagtcaaatcaagtgtgctcagatactgagagacagagcgctggcttttcagcttnaggaagcagaggctaagtcgaccacagatt

SEQ ID NO: 13407 - DNA, 101 bp, rice(Oryza sativa)
  misc_feature (71): n=t or c
caaattaaacacaccaccctcaatatatatcatcatcatcatcccccaattcccaacaccgcgacgtgctncctataaattaactccccccgatcctcctc

SEQ ID NO: 13408 - DNA, 101 bp, rice(Oryza sativa)
  misc_feature (71): n=t or c
gataacagtatagctgatcaaacagataacgagacatggaaaaatgaccttcgatagagcactcaacagcnaaagagcaggggcaggatttattctaacat

SEQ ID NO: 13409 - DNA, 101 bp, rice(Oryza sativa)
  misc_feature (71): n=t or c
caattctcttattcaactcccaaaatttctcctctcctttctcacgattctcctctctcctctcctcactnatgcctctcggcggcagcagtgccccacgg

SEQ ID NO: 13410 - DNA, 101 bp, rice(Oryza sativa)
  misc_feature (71): n=t or c
tggttactagtatcaacttcactcacctcaggtgcagtatcggtcaagaacatcacctcagccacaatatnagcctcaactcaatcagtttgagacgatac

SEQ ID NO: 13411 - DNA, 101 bp, rice(Oryza sativa)
  misc_feature (71): n=t or c
cctatcctgctactcctcctatcatgccctgatagagagagattcgtgtttgcttctgctgcctactgcantctctctctctctctttctctatattcctc

SEQ ID NO: 13412 - DNA, 101 bp, rice(Oryza sativa)
  misc_feature (71): n=t or c
tgtcattagataacaacgataataataataatgtagttttgcaaaccatgatcattaagtagcatatgttnggatggttaggtgaggtcacggtgagcatt

SEQ ID NO: 13413 - DNA, 101 bp, rice(Oryza sativa)
  misc_feature (71): n=a or c
attaacatattagtagcgctgcagccaaagaaagaagccacatttggggatactagcaacatctggcgttntggattcatacaacctttggcgctcccatc

SEQ ID NO: 13414 - DNA, 101 bp, rice(Oryza sativa)
  misc_feature (71): n=a or g
ctgaacacacaattcgtgcagaaggggaaggcaccatttaagaaatatgggaaaataacgctgaaccaatnggacaaatttgtaaagttcaagacctcgcc

SEQ ID NO: 13415 - DNA, 101 bp, rice(Oryza sativa)
  misc_feature (71): n=t or c
tgaactttgtaggttgaaggtaagcattgttggataattcaaaggggactggtttcttatctgttgagtcnggattattgattatacgctagaaaaagtat

SEQ ID NO: 13416 - DNA, 101 bp, rice(Oryza sativa)
  misc_feature (71): n=a or g
ttgcaggtacttttggcaccttccacaaccttgtcttcttcgaaccacttcaagaacttgcaggtctcctnatcttgcttcccttgtttcttgggaagttt

SEQ ID NO: 13417 - DNA, 101 bp, rice(Oryza sativa)
  misc_feature (71): n=a or c
ttgttgagagtaaagactactaaccacggggaacacgttgtgacgcggtaggttatgcgagaaacttaccntagaaagagatcaacggggtggagctcgac

SEQ ID NO: 13418 - DNA, 101 bp, rice(Oryza sativa)
  misc_feature (71): n=a or g
tgttccaaaactctgtgaattagctcagatagtaaaggcagaggagaaggataacatgctccgtgcatcanccttgcaagccctttcagctatggtatgtc

SEQ ID NO: 13419 - DNA, 101 bp, rice(Oryza sativa)
  misc_feature (71): n=a or c
ggaagaagttcgggtctgtttggttgatatcttcgggtctgtttggttgatatcttcggtatactccctcngtcccaaaatataaacatttttagctatga

SEQ ID NO: 13420 - DNA, 101 bp, rice(Oryza sativa)
  misc_feature (71): n=t or g
agggtaagcccaaaggcaaaagccgaatgcaagaaagttacatgtggaacatctggggaaaacatgataantgctatagatgtggaggcattgagcattgg

SEQ ID NO: 13421 - DNA, 101 bp, rice(Oryza sativa)
  misc_feature (71): n=t or c
tttttccaatgagtgagttatttgtcatggcaaggaatgtcagagaggacatgttgaagagagatggaggnattgaccctgacaaattgttgctattcaag

SEQ ID NO: 13422 - DNA, 101 bp, rice(Oryza sativa)
  misc_feature (71): n=t or c
ttcggcgaaatcttgatttaactctttcaacacaccctggacctacaaaacaatcaaaggattcctatgcnaaggctagctagcaaggcaacgagaatgga

SEQ ID NO: 13423 - DNA, 101 bp, rice(Oryza sativa)
  misc_feature (71): n=t or c
gttttgcttcttcttctttcttctttcttctttcttgtggaaaattcactccaagaagaagactcacttcntgtaacttgtctttggttcggttcacagaa

SEQ ID NO: 13424 - DNA, 101 bp, rice(Oryza sativa)
  misc_feature (71): n=a or g
taatctcgtttatgtcgtttgaatcgggttgctggtgactgagcatctcttggcggggtctgatcatatcnaaagttgtatatgtcctcttgtataatatc

SEQ ID NO: 13425 - DNA, 101 bp, rice(Oryza sativa)
  misc_feature (71): n=a or g
tttgcaggataataagcggcctatgcatgcaatggcaatgggcaagccagcacacttatctacaaacatcnaagctatatcttgtagttcctcagggcatg

SEQ ID NO: 13426 - DNA, 101 bp, rice(Oryza sativa)
  misc_feature (71): n=t or c
ctcccggtgataatgtgcagatactcccagatcaccctgttcttcattggcagaatttcgccattctccgngagcaaatgcggtcggagataagcattaat

SEQ ID NO: 13427 - DNA, 101 bp, rice(Oryza sativa)
  misc_feature (71): n=t or g
taaaaagttggcaaagttactgaccgctttaagtaagcggtctaaaggcctttctgctgcacttgatttgnttagaacttgggttggcatgttagcctgat

SEQ ID NO: 13428 - DNA, 101 bp, rice(Oryza sativa)
  misc_feature (71): n=a or g
gaaaattggtggagagaggtggtggctttgtttctgccgaactagggttcggcttgtcaaaccaaacacgncccctctcatctccaccatccatgtgacgc

SEQ ID NO: 13429 - DNA, 101 bp, rice(Oryza sativa)
  misc_feature (71): n=t or c
cgctctctctgtctcttcggcggcagtgtatatataaagcgcgcgcgcagctagcccccacacatatcttntgtacacgggcgtactacgtgttacggctg

SEQ ID NO: 13430 - DNA, 101 bp, rice(Oryza sativa)
  misc_feature (71): n=t or c
gcaagctgtggctcagcgaacatcaccagccctagcatcacaaagagttcaggaagtaaccttctcagcgntatgcgtcgggctgtcaccgccgccacgcc

SEQ ID NO: 13431 - DNA, 101 bp, rice(Oryza sativa)
  misc_feature (71): n=t or c
ttgtatgaggagcctaacgatgatcaagagctatatatataactaaatcaagcgctcactgctcactgctnactgctctctcctgcacttaagcaacaaag

SEQ ID NO: 13432 - DNA, 101 bp, rice(Oryza sativa)
  misc_feature (71): n=a or g
cacaaccgtcccatgtaatatgaaggttattcattgtgaggaagaattgttggagcacttgcagtgggacnatgctaatatcaagcactccttccagcctt

SEQ ID NO: 13433 - DNA, 101 bp, rice(Oryza sativa)
  misc_feature (71): n=t or c
ggcttcttgtctttcaactttgcatcaccttcaaacattgtacttggtctttctggagaaatcttggggtnccttgatattgattcatagagtgttgaata

SEQ ID NO: 13434 - DNA, 101 bp, rice(Oryza sativa)
  misc_feature (71): n=a or c
tcgtaacacgttgaattttctttgcagattaaatatgttagtggttcctacaatagcggggaaggatttgnatcattaaataacgccatttcagagaatga

SEQ ID NO: 13435 - DNA, 101 bp, rice(Oryza sativa)
  misc_feature (71): n=t or g
tttatatcacgcataaccaggggaattatgcgccaaacgaaacatatataaagatgtgacagatcatacangtctggtcttggtaccgagggcgccattga

SEQ ID NO: 13436 - DNA, 101 bp, rice(Oryza sativa)
  misc_feature (71): n=a or c
ttccttgggaggctcactagttgtagatttgtgtgcctgggttgcttttccttctttgatgacctttggcntgtgccttttcctcttaggtttttgaactg

SEQ ID NO: 13437 - DNA, 101 bp, rice(Oryza sativa)
  misc_feature (71): n=a or g
caaggcaatacttggaactgatgtgaataaggaaatttctgcagaaattcggagcagctgcagcagaagcnatgcatggtgatcagtggtaggcctgaagc

SEQ ID NO: 13438 - DNA, 101 bp, rice(Oryza sativa)
  misc_feature (71): n=a or g
aatagtttttcggtttattttatcaaaatctggcttacttttggcatttcctaccaaaggctcactgtcantgggctgttccatggatggtcctgcaccag

SEQ ID NO: 13439 - DNA, 101 bp, rice(Oryza sativa)
  misc_feature (71): n=t or g
ggcgaccaccgacgggacgacgacgctggtctctaccgcgacgtccttggacacctccttctcctcctccnacgacgacgacgaagacgatgaagatgatt

SEQ ID NO: 13440 - DNA, 101 bp, rice(Oryza sativa)
  misc_feature (71): n=a or g
tgtatttcggcccattctgccggaaagcaagtgtgccgccgtcgtcgagcttcctcctttctctctctctncaccgtcttcaccaccaccgcgccgccctc

SEQ ID NO: 13441 - DNA, 101 bp, rice(Oryza sativa)
  misc_feature (71): n=t or c
gcctgcactagaattttggcaaaaacaaataaataatcccaaaaatctgtaaaatcttaccgtcaagggtngagaagctgaggccaccggtggcggaggtg

SEQ ID NO: 13442 - DNA, 101 bp, rice(Oryza sativa)
  misc_feature (71): n=a or c
tccagaaattcgaaaaagagcaatgccatcgccagaatatgtttcatccttcaagcccttttcttctacanatttctggtatccagagctgattccaccct

SEQ ID NO: 13443 - DNA, 101 bp, rice(Oryza sativa)
  misc_feature (71): n=a or c
ttgctcaagtggcatcaccaaccagcgaccactactactcgaagaccagctcagtaactagagtatcaggnatttgcaaacatggcatgagatagagaata

SEQ ID NO: 13444 - DNA, 101 bp, rice(Oryza sativa)
  misc_feature (71): n=a or c
gaaaatttatggtgacaacggagcttcttgagcttgtggattttcttactcataaaccccttaattccagnagactcatcactatagtgctcaatgcgcac

SEQ ID NO: 13445 - DNA, 101 bp, rice(Oryza sativa)
  misc_feature (71): n=t or c
cgaaagcggccagtggctagatgaccaagccttacccatcaatgatggaatgacaattgagctcctgaacnagcttgtcactctctggacgacaatccaac

SEQ ID NO: 13446 - DNA, 101 bp, rice(Oryza sativa)
  misc_feature (71): n=t or c
cagctgagtgcgctgctcagtcagtacagggtccgcactgaagctgaacttgtgacagggcacataacgtnccttgttaagaacagcagcaagaagcaagg

SEQ ID NO: 13447 - DNA, 101 bp, rice(Oryza sativa)
  misc_feature (71): n=t or c
ggcggttgaacggaataactggaacaaatagcatgagcagctcaattatcgcagttgaactgatgtgaccnggataaccaggtggtttctcatgtgattaa

SEQ ID NO: 13448 - DNA, 101 bp, rice(Oryza sativa)
  misc_feature (71): n=t or c
tgtgggacatgtgacatttttatttggtataacgttctcagagaatgtattgtcttgcatcctcgccctcntgtagaccttttttgttgaagcactagttg

SEQ ID NO: 13449 - DNA, 101 bp, rice(Oryza sativa)
  misc_feature (71): n=t or c
tcaacatgttaatttctttgcatgtgggcagctctggttggcgatgttactaatttaagtgccgaggaatngagaagaaggcagcaacgtgaaataaacaa

SEQ ID NO: 13450 - DNA, 101 bp, rice(Oryza sativa)
  misc_feature (71): n=t or c
taagaaggaagctgaagaaggatccgaagacaaagccactaagtcaactgagaagacaaaggatgatttgnctgaggatggtagcaacaagagtgccagta

SEQ ID NO: 13451 - DNA, 101 bp, rice(Oryza sativa)
  misc_feature (71): n=t or c
tatatcattaaatttgttttcagttattgctaaagagttagtggagaagcgtccagggctggctagagaantcgacgatgaaatggatactccaatgcatc

SEQ ID NO: 13452 - DNA, 101 bp, rice(Oryza sativa)
  misc_feature (71): n=a or g
tcagctctccatcgaccggggctacatcactgtgtatgatgactatggctcggaagtattaccgacagcgncgacgtcgctggcggcgattttagtacgta

SEQ ID NO: 13453 - DNA, 101 bp, rice(Oryza sativa)
  misc_feature (71): n=t or c
gcttgctgcctgagtgctagtacatgcttgcgggttgccactatcatcctgatatactcatatgcaatacnaggatcccccctgcataagtaccgtggaat

SEQ ID NO: 13454 - DNA, 101 bp, rice(Oryza sativa)
  misc_feature (71): n=t or g
acacagagcagcatctatctatatcatcgatgtgtacctagagattaagtggcgtgcaaacggaggacaanaaacagtccatcttggacggagggcgaagc

SEQ ID NO: 13455 - DNA, 101 bp, rice(Oryza sativa)
  misc_feature (71): n=t or c
agaccacccgactggcgctcaagcatcaactgacaatgtaaacccaagcgaccaacccccgactggaaacnagttggcggaagtagaaaccgcagccagcc

SEQ ID NO: 13456 - DNA, 101 bp, rice(Oryza sativa)
  misc_feature (71): n=t or c
gctgttaagcaggcttcgccaagggtcggggaattgaagtccacttcattcaatggcgcagcttgaagaangccgccggctccgccctcatgtaccgggtc

SEQ ID NO: 13457 - DNA, 101 bp, rice(Oryza sativa)
  misc_feature (71): n=t or c
cctagaagactcatttgcccttcccctatcagatgaggcttattcggaattcttgcatcttcaggaggganagtttgactttacaatcagggatgggggat

SEQ ID NO: 13458 - DNA, 101 bp, rice(Oryza sativa)
  misc_feature (71): n=a or g
cagggagacatcctgtccatgtacatgaaatggtccattcatgaaagtgcgcacaagcagaaggatgagcngttcctccgtgacacggcagtgggtttcat

SEQ ID NO: 13459 - DNA, 101 bp, rice(Oryza sativa)
  misc_feature (71): n=a or c
tttggaacattagaactaggagccgaaggaacagtagcatcctcatgcaatttatcacagatctctgcganctcaaaagatccagggttcaatctggcaga

SEQ ID NO: 13460 - DNA, 101 bp, rice(Oryza sativa)
  misc_feature (71): n=t or c
tgtgtgcaggctcggcaacctaatggagcagacttgtttatctgctatgctggtgtgcagatgagggaagnggttgcatcaaaagccgattggttgatctt

SEQ ID NO: 13461 - DNA, 101 bp, rice(Oryza sativa)
  misc_feature (71): n=t or c
aagatcaaaaataacatcatgcaacttaaagcgtccaattgacgttgatggtttcttcaaataagtttcanactgtaacttgtttttcaaatagaacattg

SEQ ID NO: 13462 - DNA, 101 bp, rice(Oryza sativa)
  misc_feature (71): n=a or c
caatgagcctccttatctccctgactaggtgcgcagaggccgacaggtctttttctcttgattgcagcatntgtgtcagcgttaaccaatctgtttccact

SEQ ID NO: 13463 - DNA, 101 bp, rice(Oryza sativa)
  misc_feature (71): n=t or c
cttgttcttgttcccaataagatagctatacaaaaagagcaggatgagctgaacaaaaaggatactgcganagaagacagtgaccaatcagatgaccaacc

SEQ ID NO: 13464 - DNA, 101 bp, rice(Oryza sativa)
  misc_feature (71): n=t or c
tgatcatggcattccattgatgccaggaaccaaacctgtgaacctgaaaccatacagatactctccagganagaaggatgaaatagaaagacaagtaaaac

SEQ ID NO: 13465 - DNA, 101 bp, rice(Oryza sativa)
  misc_feature (71): n=t or c
ggtgccccgtaccagtgcaccattgccacctaccccttgtcatggtcactcatatctctacggctcagctntgtcaagaggcaagaaaggtattcttcaag

SEQ ID NO: 13466 - DNA, 101 bp, rice(Oryza sativa)
  misc_feature (71): n=t or g
tgttaggccggatgggctttacagcccatcaaaatctagcccatggaactacccaattatccatacctttnaactaatttttatcctagtctattttccag

SEQ ID NO: 13467 - DNA, 101 bp, rice(Oryza sativa)
  misc_feature (71): n=t or c
caaatagccagatcattgagagctgtcagattatgcatcccttcgggtaatgttgttaggctgtcattagntcccaggtagagcctggtcagatttgatag

SEQ ID NO: 13468 - DNA, 101 bp, rice(Oryza sativa)
  misc_feature (71): n=t or g
atatatgtagactgtagttatgtaccggcagtcttcagtagttcagttgctatgtgcctatgtatgagcanatccaattgcttccttctcaaaccgcttga

SEQ ID NO: 13469 - DNA, 101 bp, rice(Oryza sativa)
  misc_feature (71): n=t or c
taaccagacctttgcgtcgatgcttgcttggtagcaaccttccctatgatgcagtcatcaagaaccttcgntgctgtcgtccttatctgcatcgggcgagc

SEQ ID NO: 13470 - DNA, 101 bp, rice(Oryza sativa)
  misc_feature (71): n=a or g
ttcttgaagatgttatgggtgtataccttggacagttgctcttccatatagaattttgacacaggtgggcnctgcttatggaatgtctcaaaatctgcttg

SEQ ID NO: 13471 - DNA, 101 bp, rice(Oryza sativa)
  misc_feature (71): n=a or g
catctgctgatttgcgcaagcaagcaaagcatcgaaattcaccatgttgaggttggttgtggcaaaaggcncaaaatcgcaccaactcctattgtcccaag

SEQ ID NO: 13472 - DNA, 101 bp, rice(Oryza sativa)
  misc_feature (71): n=a or g
catacaaacacccaaaaactccggacctcgctttctgtgaatttgtttagtccatatacatcttgcctgcncttaatgctttcctcagctgtacttaaccc

SEQ ID NO: 13473 - DNA, 101 bp, rice(Oryza sativa)
  misc_feature (71): n=a or c
aaggtccagggataactttatactcgtaacattcttgcgtaacattctttttactcgttatacctactgcngctacgaggatgtcgagtggagtagtggtg

SEQ ID NO: 13474 - DNA, 101 bp, rice(Oryza sativa)
  misc_feature (71): n=t or c
caatcaagagtttcctttgctacaaggtcgcccatcccaacaaaagaagcacatgctagttcaaaggcacnaacagtctttcttgaaagttccaggtgttc

SEQ ID NO: 13475 - DNA, 101 bp, rice(Oryza sativa)
  misc_feature (71): n=a or g
tttagagacctaatagctggatgtgctgcaattccagatggcgattttgaattagtaacatgggaatcacnaataccacctcataccatgtatgtgcagtc

SEQ ID NO: 13476 - DNA, 101 bp, rice(Oryza sativa)
  misc_feature (71): n=t or c
taaaaaaaaaaaacaacatataagcaaatacatgttgtctctcctaatacaatgagattgttcagattcantgtataacttctaggttatctctttttttt

SEQ ID NO: 13477 - DNA, 101 bp, rice(Oryza sativa)
  misc_feature (71): n=t or c
tgtctccgctgaatgttggtgtagctccagagcaatgacgtcatcctcatcctcctcggcatccgttcccnaatcaaggggctcggatagcagtggcgagg

SEQ ID NO: 13478 - DNA, 101 bp, rice(Oryza sativa)
  misc_feature (71): n=a or c
cgtatatggtaacccatcagatcatcagacttaccacattagcttcattgcgacgccgattgtttgacaantgaaagtaaaggtaggatgcataagcaacg

SEQ ID NO: 13479 - DNA, 101 bp, rice(Oryza sativa)
  misc_feature (71): n=t or g
cacacaaacgcaacgcagagagcatcgacaagacggcttatcctgtggacaaatggcgttgaaacatgcangtaggagcagcgctggtcaaaggccggtcg

SEQ ID NO: 13480 - DNA, 101 bp, rice(Oryza sativa)
  misc_feature (71): n=a or g
gttatgaactttcttgaggaaagaatgaagagcaaaccttctctatcatctggcacaacaaaaggggtgtntgttactattcttagcaaaccatgaaattg

SEQ ID NO: 13481 - DNA, 101 bp, rice(Oryza sativa)
  misc_feature (71): n=t or g
caaaaataaatatggaaatatgaagtgaaaactactcacaatgagctatgctttggttgaagaagctgcanggggaggaggagcagagcaggtagcaacac

SEQ ID NO: 13482 - DNA, 101 bp, rice(Oryza sativa)
  misc_feature (71): n=t or c
tcctctctctctctcactcttgtctgggcaggacggccagcggatagggaggaagtcggtgatagagcaanggctcactttgtcctcgatctcgccagcgg

SEQ ID NO: 13483 - DNA, 101 bp, rice(Oryza sativa)
  misc_feature (71): n=a or g
tcgtagcgatgcgggggaagttgtcggcgatctgctgatgcggctctgatcactgcatatctgatcagttncgtgtccgatccgttccatccctggttggc

SEQ ID NO: 13484 - DNA, 101 bp, rice(Oryza sativa)
  misc_feature (71): n=a or c
acagtgaccatgattatatgatcgggcttgatcccactatcaatcatctgctcaaaaaggcgaagtgcaantgttcctttaccttgcattccatatcctgc

SEQ ID NO: 13485 - DNA, 101 bp, rice(Oryza sativa)
  misc_feature (71): n=a or g
ctacaacacaaaagctaatttgctccttcgctttgaaaagactctcacactgattacctgattggcactgnatggattccgattactgcaaggttttgctg

SEQ ID NO: 13486 - DNA, 101 bp, rice(Oryza sativa)
  misc_feature (71): n=a or g
caaagagcatatacgcaaacgtattgatacgctcggtcttgatgggcaccaatgtattgctgttggacgtnttgttaactctcggttggacatcattagtc

SEQ ID NO: 13487 - DNA, 101 bp, rice(Oryza sativa)
  misc_feature (71): n=a or g
gagcataacattgctccttaaacataaaggggacaaaataaaggaggcgacaaatgtgaaagtgccagttncagtacatgaccacttcaatcgcatggcaa

SEQ ID NO: 13488 - DNA, 101 bp, rice(Oryza sativa)
  misc_feature (71): n=t or g
aaaactaaagtacattactaaattatttgacggacaccatgttaccacccacttatcttcagagagcaagnatccaagccagcatctcagattgaaggaaa

SEQ ID NO: 13489 - DNA, 101 bp, rice(Oryza sativa)
  misc_feature (71): n=a or g
atggagtgttctattagtgtgatgccctcacttattagctttcgagttctacgtgtgctagcactggaaanatgtaatgtcacaggaggatgttgcctcaa

SEQ ID NO: 13490 - DNA, 101 bp, rice(Oryza sativa)
  misc_feature (71): n=t or c
ggaatacacttgcctgtcggcatgtattggttgccatgcacggacgagattggaggattgtgagccccgtngggaccactaccatatccatctccatgttc

SEQ ID NO: 13491 - DNA, 101 bp, rice(Oryza sativa)
  misc_feature (71): n=t or g
actccaagcgaacaaccagttttcccttggacttcattgccacaatgtgctcgaaagacttgtccttacanaatttcccattgaacagcaaaatctcattg

SEQ ID NO: 13492 - DNA, 101 bp, rice(Oryza sativa)
  misc_feature (71): n=t or g
tgaagatttggagccagacaagaggaagttcaatgttaaggaggatgtggggcataatttctctctagatnatgctagagatgaacgaccaatagggggca

SEQ ID NO: 13493 - DNA, 101 bp, rice(Oryza sativa)
  misc_feature (71): n=a or c
ggataactccttttttgtctgtaattctaagttctccatctccctcaagccaatcatacattccagaccancaatatgcagatcgataaattgagaactag

SEQ ID NO: 13494 - DNA, 101 bp, rice(Oryza sativa)
  misc_feature (71): n=a or g
aagtggttgaaaattctagagttcctctccttccaaagttcccaggaaacaagaatgacaagggatttttnggctttcctcgagctgcttggaatttttag

SEQ ID NO: 13495 - DNA, 101 bp, rice(Oryza sativa)
  misc_feature (71): n=a or g
gactgcacatgcaactgaacaagttcataatgtttcagaagtcgctggggttaatcctctgggacaatccnctggagtgcatttatcagaaactaagaaag

SEQ ID NO: 13496 - DNA, 101 bp, rice(Oryza sativa)
  misc_feature (71): n=t or c
tccgtatcagggtcgaccaagtagacctcaattccgcaaccgacagccaccaaagcataataatccggccngatgctaaggattctccctggggactccca

SEQ ID NO: 13497 - DNA, 101 bp, rice(Oryza sativa)
  misc_feature (71): n=a or g
gaatgatcaggggtgctggacatcagaggagttcagaaaccacatagtgcgcccacgtgataaagttgggnctgtgctgactggagagcttgagcttagcc

SEQ ID NO: 13498 - DNA, 101 bp, rice(Oryza sativa)
  misc_feature (71): n=t or c
tatagatagcatggtttaagatgagatggcaaatggccatagcttagggtcaccaccctccttattgcttngactccagggcttgggttgttctcaagctc

SEQ ID NO: 13499 - DNA, 101 bp, rice(Oryza sativa)
  misc_feature (71): n=a or g
cggtcatgttgctcctcttcttcatgtcgtcggtggaagccaggggtgacaccaacgacatgtacaagctntgcgcggacatggcgatgcagcgtggggat

SEQ ID NO: 13500 - DNA, 101 bp, rice(Oryza sativa)
  misc_feature (71): n=a or g
ttcggcgtcgggaacaagtggcaccatcaccaaaccagtagctgagagcaccgcagttgcagtagaacacntgttcccagccaccccggcctcatctgcac

SEQ ID NO: 13501 - DNA, 101 bp, rice(Oryza sativa)
  misc_feature (71): n=a or c
aataaagatctttcccctttgtgaccacggacacattatctttctcagaaggagaattgttatcaggtatntcaccacaaccattaatactacctgacata

SEQ ID NO: 13502 - DNA, 101 bp, rice(Oryza sativa)
  misc_feature (71): n=a or g
tttcttccttgtccacctggcgcgtactatgcagctgcgtgcgtcgtactccatcactgtcctacgaatantactctctccatcactataaagttcaacag

SEQ ID NO: 13503 - DNA, 101 bp, rice(Oryza sativa)
  misc_feature (71): n=t or g
tgcttctgtagttggcatcaatgaggatgttgcaaggcctgagatcaccatggaccaaagcagtagacttnttcgaatgaaggaaaagcagagcacaacaa

SEQ ID NO: 13504 - DNA, 101 bp, rice(Oryza sativa)
  misc_feature (71): n=a or g
aactttaccacctataacattgggatttgctaattttcaggtgatctgctccccctcgaaaggatgagccncaggagagggagaagattcaccaacggttg

SEQ ID NO: 13505 - DNA, 101 bp, rice(Oryza sativa)
  misc_feature (71): n=a or g
ccacacaatgtctgtcattggtgatatgagttatatggatccagtgtattttcagacaggtcttctaaccnacaagagcgatgtttatagttttggagttg

SEQ ID NO: 13506 - DNA, 101 bp, rice(Oryza sativa)
  misc_feature (71): n=a or c
aattaactactagatcggcgctttctcatagttttgaatccattcttgtcatcgacaaaagatgtaccagntgatacatacttagtataaggtggtattcg

SEQ ID NO: 13507 - DNA, 101 bp, rice(Oryza sativa)
  misc_feature (71): n=t or g
aatcgaataatctgtttgttgccaactctttgtgaggtctctgcaccaattataaccttgttgtattctcngacaccactataaattagaaacaaatatta

SEQ ID NO: 13508 - DNA, 101 bp, rice(Oryza sativa)
  misc_feature (71): n=t or c
tttggtgcttcaggtagagtagtcagctctgggcactcgttgattgttaatttgtcaagctgaggaaatgntacctcctcctttagagttccatcgactgc

SEQ ID NO: 13509 - DNA, 101 bp, rice(Oryza sativa)
  misc_feature (71): n=a or g
gagagcgggactaatgcccttgagatcttgaagagagcagctcatgatagagtgatgtttctctaacacanttacaagacgaatggtttcatcctcagaaa

SEQ ID NO: 13510 - DNA, 101 bp, rice(Oryza sativa)
  misc_feature (71): n=a or g
tcacatgttgctactgactccatgctcttccataccactgacatcctcattgagctctatcgactccagtnccacaacgtccttgtcaagctctagagttt

SEQ ID NO: 13511 - DNA, 101 bp, rice(Oryza sativa)
  misc_feature (71): n=a or g
ctctgccatctccttaggtttggtgttcgttggttcctgtaatgaagaggttgcacagacaatcatatgcntcttaatggagcgtagtgaaccagagcttg

SEQ ID NO: 13512 - DNA, 101 bp, rice(Oryza sativa)
  misc_feature (71): n=t or c
gttaaaaatcttgatggctacttgatcttgtcggaattccagattgcccttgtaaaccgttccaaatgatnctgatccaatcaaattagcggaggaaaacc

SEQ ID NO: 13513 - DNA, 101 bp, rice(Oryza sativa)
  misc_feature (71): n=t or c
gaggatgcccggagggtgtttgatggaatggctgtgagagatgttgtcagctggaatacgatggtgtccgngtatgcgtcgacggggaagtcgaataaggc

SEQ ID NO: 13514 - DNA, 101 bp, rice(Oryza sativa)
  misc_feature (71): n=a or g
cttgctggtctcaaattcttccttggaaaattcttgcaatttctttttcctgattgtgcgtcggaagttcnaaataggtactagtggggcaggtggtcttg

SEQ ID NO: 13515 - DNA, 101 bp, rice(Oryza sativa)
  misc_feature (71): n=a or g
ttcctgcaaatatgctctgatgttccaagactttctgcagtcatcaagcttgcctgtgtggaacagagttnataattgtggattttggcgtcaattcacag

SEQ ID NO: 13516 - DNA, 101 bp, rice(Oryza sativa)
  misc_feature (71): n=a or c
atagtattgataatcattcctgctgccctagattcagaatttccagagaattgtttatccaatgtctgagntagctccttcataagagctctgtaaacatc

SEQ ID NO: 13517 - DNA, 101 bp, rice(Oryza sativa)
  misc_feature (71): n=a or g
tctcaggggcttttgccggtgcttgctagtatctggtttggattcaggattatcactgatccaacgacgcnaagatcccatccaacaatgccgggagatcc

SEQ ID NO: 13518 - DNA, 101 bp, rice(Oryza sativa)
  misc_feature (71): n=t or c
gcttctacgtttttcaccatgaatggaaggttgttcttagcgataatagtaagatcatcgtttctggcatngaccataagggaggatgtctccagtggtct

SEQ ID NO: 13519 - DNA, 101 bp, rice(Oryza sativa)
  misc_feature (71): n=a or g
ccggcgctggccactccgccatcatcttagcgctgccagtggtgaaccatggtccgtggatagagattatngagtggagaggttgtggagagaaggggagg

SEQ ID NO: 13520 - DNA, 101 bp, rice(Oryza sativa)
  misc_feature (71): n=a or g
ttggttaggaatggagttgatatgaagataaagaagctctcagttataacagatgaccaagctacagaccnaatcataagtgaggtttgccagataagtga

SEQ ID NO: 13521 - DNA, 101 bp, rice(Oryza sativa)
  misc_feature (71): n=t or g
aaaaaacaatgaaacgcaggaagagatttacgccgacaagtcacttcttgccaagacccgtttgaagctgnttaagcttgaggtgttgagttgtgatccaa

SEQ ID NO: 13522 - DNA, 101 bp, rice(Oryza sativa)
  misc_feature (71): n=a or g
ctcaggtctccaacactgcatggagttccgaaggttgtcactccacctcaagttgtcctggagatatctantgatcagcacactaaagctgattcctcagt

SEQ ID NO: 13523 - DNA, 101 bp, rice(Oryza sativa)
  misc_feature (71): n=a or g
caaagaagggcatcatgacaagaaccttagtcaatcgtctgtgttgttttctatggtgggagctacaaaanaaatgcctcttgaactctttctgcaagttg

SEQ ID NO: 13524 - DNA, 101 bp, rice(Oryza sativa)
  misc_feature (71): n=a or g
aacacaaactcaccctgccactgagaggtgatgggcattgagctttgcggggggtacctattcagggtgcnctacaaaacaatatattagtttataattga

SEQ ID NO: 13525 - DNA, 101 bp, rice(Oryza sativa)
  misc_feature (71): n=t or c
acattgtcgaagtactttacagagtcattctgagattctttgaatgtgaagatcacttcctctgggctaantttagtgaaattgaatttcacgctatcaaa

SEQ ID NO: 13526 - DNA, 101 bp, rice(Oryza sativa)
  misc_feature (71): n=a or c
aatatagtttccgtattcttttggttaagcaatgcatcaaactatcgagaagctctgttatgttgcaggancttaggcctccaaggtctaagatttctaaa

SEQ ID NO: 13527 - DNA, 101 bp, rice(Oryza sativa)
  misc_feature (71): n=a or g
attgttgctagttgtcagatacatcggtggttctgaaggttggcacaacatttgcaaggttagcgtattcntgatggatgtaagcacaaaccctttcagat

SEQ ID NO: 13528 - DNA, 101 bp, rice(Oryza sativa)
  misc_feature (71): n=a or g
ctaaccacaacaaatggcatgcagcagcaaccccaaagttgacgaagacatccaatcatgccgacgtggtngtccatgtcgtcgtcgccatcgtcttcttc

SEQ ID NO: 13529 - DNA, 101 bp, rice(Oryza sativa)
  misc_feature (71): n=a or g
gctgatctctctgatgctgatcttagaggtgcagatttctcactggcaaatgtatcgaaggtagtactgcntattgctcaaagaaaagcattagcgatagc

SEQ ID NO: 13530 - DNA, 101 bp, rice(Oryza sativa)
  misc_feature (71): n=a or c
ttgagcaaccaagagaaataccgctttccaaaatctggactaagatcccactcagggatgaacccttcgtnttccaatatcgtggcaagatgatccttgtt

SEQ ID NO: 13531 - DNA, 101 bp, rice(Oryza sativa)
  misc_feature (71): n=t or g
atctcagtattgaatttctaaatttcttttgtctaaccctagtagtgacatctgcttgtgtgtaggctttngtggtgaggaaggagaacatgtggatcgtg

SEQ ID NO: 13532 - DNA, 101 bp, rice(Oryza sativa)
  misc_feature (71): n=t or c
gaagtacttgaaaccctccaacctaaccagtgcctgaaaactttggagattgttgcgtatgaaggacatgnatttccatcttggataacaagcactgagcc

SEQ ID NO: 13533 - DNA, 101 bp, rice(Oryza sativa)
  misc_feature (71): n=t or c
gactggatcttggcttgaacaactgcaccatctccttttctgagatgtacttgcagatcttggatgatgancttcaactcggtgaagacctcactcataga

SEQ ID NO: 13534 - DNA, 101 bp, rice(Oryza sativa)
  misc_feature (71): n=t or g
aaacgtggagagatgtcatgtaataaaccttgcagaacttggcaacgaacataagactgagtttgtacctncactgaagagaacagcagcatgtaaagctg

SEQ ID NO: 13535 - DNA, 101 bp, rice(Oryza sativa)
  misc_feature (71): n=a or g
cgcaggaccaccgctctctcttacttgctcctcccttgcatcgcgttcacgtcgcatatgatgcagacctncgccagcacgttgctgcttcgaggtaggcc

SEQ ID NO: 13536 - DNA, 101 bp, rice(Oryza sativa)
  misc_feature (71): n=t or c
tgtgaggcttgttgattggggagctgctggttgtagtttgcaattgcaaatggtggattcctcggaagggntccgacggctcgccgcgttgctgttcaagt

SEQ ID NO: 13537 - DNA, 101 bp, rice(Oryza sativa)
  misc_feature (71): n=t or c
aaaatctgtttctttaatagcaacagtgcggcgattctttaacaacacactggtcaactgattctgcaagnctgtcaaactgaaacacgactattaatatt

SEQ ID NO: 13538 - DNA, 101 bp, rice(Oryza sativa)
  misc_feature (71): n=a or g
aagaattgaagtgattgattattggtctctgaaactattttgattttgggatttctgtgcaggaaacgtgnatgctaatcacgacccgtccaaacaatctg

SEQ ID NO: 13539 - DNA, 101 bp, rice(Oryza sativa)
  misc_feature (71): n=a or g
aatggcaaccatgaccacgggaacaatggaggctacaacggtgcaaaccgcgaccgagatcatggaaacgntgccaccggcgggtgccaaggaggagttga

SEQ ID NO: 13540 - DNA, 101 bp, rice(Oryza sativa)
  misc_feature (71): n=t or c
ataggtgtggaggcactggaatgagggaacagttacagagattgtggatccttctctgggcaaccactacnctagaggagatatcctgaaatgcatcaaca

SEQ ID NO: 13541 - DNA, 101 bp, rice(Oryza sativa)
  misc_feature (71): n=t or c
aattagaaggtcacaaatttctatcctgcgaaacccaccgtccaataagtcaccaatcgtgtctgggtgtngctctcgcggtcaggatcgacctggtgtat

SEQ ID NO: 13542 - DNA, 101 bp, rice(Oryza sativa)
  misc_feature (71): n=a or g
aggattctgtcgtttctcgacattggttgaaggagctatttcatgttgtggtctacttttatgctgtgtgnacggataagctggtagtttggggtgtgttc

SEQ ID NO: 13543 - DNA, 101 bp, rice(Oryza sativa)
  misc_feature (71): n=t or c
atcattccttttccacaaccgtgctggacggttgacaatatcaaaacgggattgcaacacgccaaatgcanactcgacatcctttctggccccttcttgtc

SEQ ID NO: 13544 - DNA, 101 bp, rice(Oryza sativa)
  misc_feature (71): n=t or c
cgtttccctcccttcccttctcctctcctcttctctatccccctgacgcggtgagagggcggtgcagatcntggagaagcaggtgctgtcggtggccaagg

SEQ ID NO: 13545 - DNA, 101 bp, rice(Oryza sativa)
  misc_feature (71): n=a or c
gtgctgctggagccactcctgaatagcagaacgcagtgcgcgattcggaatgagctcctcatgttcaagtngcaagttggtcattggagacgtgtcatggc

SEQ ID NO: 13546 - DNA, 101 bp, rice(Oryza sativa)
  misc_feature (71): n=t or g
ttgcgctcatggccgggtacctccctttccatgaccacaacatcatggttctgtaccggaagatctacaanggggagttcaggtgtccaaggtggttctcc

SEQ ID NO: 13547 - DNA, 101 bp, rice(Oryza sativa)
  misc_feature (71): n=a or c
tactacgagagacatcatgaccggaagttctggagccagatcttcttgaagaatcccaatcattattgtcntctcttctcctcctgctgctatccccatct

SEQ ID NO: 13548 - DNA, 101 bp, rice(Oryza sativa)
  misc_feature (71): n=t or c
gaacacttcatcctgtactatctcttggttgggaacttggaagcttgcagggatttctccatggtgtgacnagtttgtgtagccttcaacaaatccatgtg

SEQ ID NO: 13549 - DNA, 101 bp, rice(Oryza sativa)
  misc_feature (71): n=t or c
cttattgcatttacatctttgagcttcttgaatatttcttggacacgtgtgacatgcttaccaattcttcngaccttgaggtgtctaaatatgagcaactg

SEQ ID NO: 13550 - DNA, 101 bp, rice(Oryza sativa)
  misc_feature (71): n=t or c
ctaatccatgtattaggcgacatgttactcaaccaatcatatgcctcctggtttaaattcctcatttcttncatgttgacattccactcatctatacaact

SEQ ID NO: 13551 - DNA, 101 bp, rice(Oryza sativa)
  misc_feature (71): n=a or c
cctctccatcttttcctccctggcgtgctttgccatcaacatcttgtatcacagcctccagatctctcatnttctcctccatgtcgtccacgtcgtccttg

SEQ ID NO: 13552 - DNA, 101 bp, rice(Oryza sativa)
  misc_feature (71): n=t or g
cctcatcacccttctccctttccctacccaggcggtttctccctttcccttcctaggcggcacaggcaatngcaagccatgccctccacaacgcctctcct

SEQ ID NO: 13553 - DNA, 101 bp, rice(Oryza sativa)
  misc_feature (71): n=a or g
atgagactcaagaacttccatagtacctttattgaatgggtgagaaaaattactaaggggggtagggtttntataaacatcaatggggaggttggaccttt

SEQ ID NO: 13554 - DNA, 101 bp, rice(Oryza sativa)
  misc_feature (71): n=a or g
aaaatctcagatggtgtcatgtcacaaggtgccttaagatgcacacggtctttttctgtgatgatgattgnaggtatggtaacttcttcccgagcctggag

SEQ ID NO: 13555 - DNA, 101 bp, rice(Oryza sativa)
  misc_feature (71): n=t or c
ggtctcgctaccggtttgtccggtggcggtagtggttttctcattgcttggagccggagtgatcgggattncgaccttgtcacgcccctgcaggggcttgc

SEQ ID NO: 13556 - DNA, 101 bp, rice(Oryza sativa)
  misc_feature (71): n=t or g
tactactagtacgcatgaaccacaatcaccattgcaggagagagggacattgctggcgatttactttatgntacttgtagctaccacggtgagaatccggc

SEQ ID NO: 13557 - DNA, 101 bp, rice(Oryza sativa)
  misc_feature (71): n=a or c
aatgccgccaacgaaatatgtctggaatgaaacatacaagcaactacgaagtgatctagcaaacaacaatnatgttcaagcaattctaaatctgagctacc

SEQ ID NO: 13558 - DNA, 101 bp, rice(Oryza sativa)
  misc_feature (71): n=t or c
gagccgaaggtcacctactggaccgtcaaggcgttgtgcgtgcccactgacatcttcttccatcgttaatngatttccatccaggtgacgcacgatgatgc

SEQ ID NO: 13559 - DNA, 101 bp, rice(Oryza sativa)
  misc_feature (71): n=a or g
gcagttagaaggacaaactgatgaaaatgctgcagaggcagatgaaagaatatctagatctcctcctggcnctaaagagaagttatggatgatgcaagacc

SEQ ID NO: 13560 - DNA, 101 bp, rice(Oryza sativa)
  misc_feature (71): n=a or c
agttgagctcatatgcatactttacagatgatgggcacaacaacgttttctactgactgtcagcctgaccnctacgaaacggctgctccaggtcttgcagc

SEQ ID NO: 13561 - DNA, 101 bp, rice(Oryza sativa)
  misc_feature (71): n=a or g
atccacttgggcttccctgcttgtagtctgtgttaaaccttcagcaaccatcaggctaatcatctcgtcantatcaaagatgtgatgatatgggaacaagg

SEQ ID NO: 13562 - DNA, 101 bp, rice(Oryza sativa)
  misc_feature (71): n=t or c
atcgcttcttttgtgaactccttttcctgtgttctccaattatattgtttcactgccactgaacggccatnatcaagttttcccttgtacaccacagaaaa

SEQ ID NO: 13563 - DNA, 101 bp, rice(Oryza sativa)
  misc_feature (71): n=a or g
gctaaggaccacgatttggcctcctctttgattttggccagaaggctacccatcgaaagctccttttgctnaaaggttctgcggttcctttcattccagat

SEQ ID NO: 13564 - DNA, 101 bp, rice(Oryza sativa)
  misc_feature (71): n=t or c
ggatgggagtcatgggagcatcttatcttcccctgctccagggagatgttatgtgtcatgttcatcaattnctcgtcatgggcggcattggcggctgcact

SEQ ID NO: 13565 - DNA, 101 bp, rice(Oryza sativa)
  misc_feature (71): n=t or c
aaaaggatgaggcacagtgaaatcaggacaatcatcgatggtgaggttgctgaggtggggcaaccatgagnaccccaagttacggcagttctcaaacaacg

SEQ ID NO: 13566 - DNA, 101 bp, rice(Oryza sativa)
  misc_feature (71): n=t or c
aagcgcaagctgccagctatcctcgatgtcatcagcgatgctgaggagcaggcatcccacagacaaggagnaaaagcctggcttgaggcactcaagaaggt

SEQ ID NO: 13567 - DNA, 101 bp, rice(Oryza sativa)
  misc_feature (71): n=a or g
tctgatggtattactgagcttccagagcaaattggggacctgaagtatttgcagacactagatatacgccntagtggaattaaaaaattgccaccgaccat

SEQ ID NO: 13568 - DNA, 101 bp, rice(Oryza sativa)
  misc_feature (71): n=t or c
accgggctgggtcgtgatccccttacttcagccattgtcgctaatgattcatggtgggaaagcaagaatgnggtatgtacactacatgaccgctggagcag

SEQ ID NO: 13569 - DNA, 101 bp, rice(Oryza sativa)
  misc_feature (71): n=a or g
tcggtattccggcccaacattatcttgtgaaccagatctaagaggaattataaaggactcatcagccgcgncatatccattcttgtccacctgattaggat

SEQ ID NO: 13570 - DNA, 101 bp, rice(Oryza sativa)
  misc_feature (71): n=a or c
ctggatcatcgcgagggagttagtttagttagttaatcagttgggaacacacacgtcggccgtctcgtctngcgccattttttttgatgggctcgaggggc

SEQ ID NO: 13571 - DNA, 101 bp, rice(Oryza sativa)
  misc_feature (71): n=t or c
atcaccaggttctggagtttacgcaagccgcacagtgattctagcaaagccttcttcatgctctcgtcaanctcgttatctacacaaatgttgaggattct

SEQ ID NO: 13572 - DNA, 101 bp, rice(Oryza sativa)
  misc_feature (71): n=a or g
tctataaagaatgcctttatcttctgccaaactgacagaaaacttgaaatgcaggaattcgctctgatganatctgaccccccgattgctcaacaccgctc

SEQ ID NO: 13573 - DNA, 101 bp, rice(Oryza sativa)
  misc_feature (71): n=t or g
atatgacctaaatatattgctaaaccacatgatccgtatacctcaaggtgagccggaaggcactgtgtagngctgagccacttcctgtgcaccttccgagc

SEQ ID NO: 13574 - DNA, 101 bp, rice(Oryza sativa)
  misc_feature (71): n=a or c
gagcaccattcccgtccaatgtgcgttccattgtctactctctataccctttctaacgccacaaagattgntccatttggtgcagccgatcgccgagaacg

SEQ ID NO: 13575 - DNA, 101 bp, rice(Oryza sativa)
  misc_feature (71): n=a or g
gcttaacctcccggccgatattgaaaacggccaagaagactgtcccctagggaggatcagcaaggtcatcnagtctgggctgacaagctacaccaatagga

SEQ ID NO: 13576 - DNA, 101 bp, rice(Oryza sativa)
  misc_feature (71): n=a or g
ggatatgaccaatccacagccattggtgcagcatacttgaggctctggttagaatcagcaagcatgttggntgaagatgttgaaacaatcgttgaaggtgt

SEQ ID NO: 13577 - DNA, 101 bp, rice(Oryza sativa)
  misc_feature (71): n=t or c
gaatggctatgaactccattgtttcactcacagaattccgtcaatctcccagttatccttttcatcgtcangagccctcctcgcggcctctgaatcagcat

SEQ ID NO: 13578 - DNA, 101 bp, rice(Oryza sativa)
  misc_feature (71): n=t or c
gatcaggttaggatgagcgggctctccgagcggtcagagttggggatcatttccagcttccaaagtccganattttcccctctgcgtttggtcaaaatcat

SEQ ID NO: 13579 - DNA, 101 bp, rice(Oryza sativa)
  misc_feature (71): n=t or c
gatgcatatggttgggttggccggtcgcacggggatgatggattaagagtcttagaagctgacgatggtanattttgaggacttaaaaaaggcttaagaag

SEQ ID NO: 13580 - DNA, 101 bp, rice(Oryza sativa)
  misc_feature (71): n=a or g
attcttgtgcaagaatgaaaaaggtgaaaagtcaaccgtcatctccatgttgttgccacaacctgcaatgnatagattcaaaaaggagatggctgcttggt

SEQ ID NO: 13581 - DNA, 101 bp, rice(Oryza sativa)
  misc_feature (71): n=a or g
cagcaacaacagtgaggagtttgatgcaagagaactgttgtgcactcttgcagcttcttatgataaaatcnatgttggacatggtaactttggatgatcat

SEQ ID NO: 13582 - DNA, 101 bp, rice(Oryza sativa)
  misc_feature (71): n=a or g
aggtgcagattattataatgctgcaaagctggaggagatctttaagcaatttggtggagttgaagatgttnttatcaaaacaaggaaatcaaggagtaggg

SEQ ID NO: 13583 - DNA, 101 bp, rice(Oryza sativa)
  misc_feature (71): n=t or g
cacatctgctaactttcaagaaaagaaaacaaatccagaggttaagcctgggcgaattgtcagtacctgtngcatttgctgttgctggctttgctgctgct

SEQ ID NO: 13584 - DNA, 101 bp, rice(Oryza sativa)
  misc_feature (71): n=a or c
tgtcatgtccttgctgccccgttgccacacctgcgatgccttcatctcctcgccatcgacaaaatcataancaaagccttgcgaaaactacatgccactcc

SEQ ID NO: 13585 - DNA, 101 bp, rice(Oryza sativa)
  misc_feature (71): n=t or g
cgaaagaggaaccgccggccagcgaacccacgggttactactgcttggacacaatggaccgttgctgctgncaccgcaccaagctatcagactctaccaag

SEQ ID NO: 13586 - DNA, 101 bp, rice(Oryza sativa)
  misc_feature (71): n=a or g
tgggatacaagaaaattggaaaaggacattgccttcagatctaggttaacatatagcctcggtagtagccnagctctatgtacgacaatgcttcatggtac

SEQ ID NO: 13587 - DNA, 101 bp, rice(Oryza sativa)
  misc_feature (71): n=a or g
gcacacccaaatttggaaatgatcggcaaggaaattgtccataagttgaaaggcctaccattagctgcaanagctttaggtagcttattatgtgctaagga

SEQ ID NO: 13588 - DNA, 101 bp, rice(Oryza sativa)
  misc_feature (71): n=t or g
acaacatgcaagatatgtggaaggttgctggcatcactagttccgcgttcttgttcgggacagcattcatntccctttttgcagggagcctgcatggagag

SEQ ID NO: 13589 - DNA, 101 bp, rice(Oryza sativa)
  misc_feature (71): n=a or c
aacccacaaactgaagagcgtattgcattccgggatatcaccaacagattggatgtattgcaaacgacacntataacaccttctgatgaggtattacgtaa

SEQ ID NO: 13590 - DNA, 101 bp, rice(Oryza sativa)
  misc_feature (71): n=t or c
cactgagctcgaccaactcaccaagatcacactgagcaatacttacttgggagaagatgcaatccgagtantcggaaaacttagaattctacgctgcctga

SEQ ID NO: 13591 - DNA, 101 bp, rice(Oryza sativa)
  misc_feature (71): n=a or g
tgaggaggagcaaaatctcttgaatatcacggaacaggtcaaccatgtagttgtaaatggtgatggtgaanttaaacagttccaactagaggcacagacaa

SEQ ID NO: 13592 - DNA, 101 bp, rice(Oryza sativa)
  misc_feature (71): n=t or g
gtccctccaaactccagagatttcagaaagtcatcagctcccttagcaaaccactcaaatctttgaacagntgatctacttggctcgtcgatattgccgtg

SEQ ID NO: 13593 - DNA, 101 bp, rice(Oryza sativa)
  misc_feature (71): n=a or g
atatccctattagaaacaatctatcttcaacgcaaccaacttgaaggaagcattcctgatgagcttggccnattttcaaatatttcgttgatggccctagg

SEQ ID NO: 13594 - DNA, 101 bp, rice(Oryza sativa)
  misc_feature (71): n=a or c
tgcctacttaccaacatagttcagcatgaaatcaaaagcctttttggtctcttccaaaccatcagaacccnttttatcgttcactctcctgataaagttga

SEQ ID NO: 13595 - DNA, 101 bp, rice(Oryza sativa)
  misc_feature (71): n=a or c
ccatgggaaagaaacgaatcacggacgtattccagcagagtctctcaatgtattcacaattgcaaatctcnaagaaggatcacgaatgtaagatctcggtt

SEQ ID NO: 13596 - DNA, 101 bp, rice(Oryza sativa)
  misc_feature (71): n=t or c
gagcctcgccggcggtggtgccttccgctcggttgcctgctcaagaaagctcatcgtggaatactaacttnaggtaaatttcttgtccaagttcagttttg

SEQ ID NO: 13597 - DNA, 101 bp, rice(Oryza sativa)
  misc_feature (71): n=a or g
tcatttggattctgctcaaccatgtttaagtgggaaatgactccttttattaaaggaaggaatccaaatgnaagtgtaaaggcaagagtcattcaagcact

SEQ ID NO: 13598 - DNA, 101 bp, rice(Oryza sativa)
  misc_feature (71): n=t or c
gggttcaagaattagaatagctgtagatattgcagctgcattagactatcttcataatcgatgcactcctnctttggttcattgtgatctgaaaccaagca

SEQ ID NO: 13599 - DNA, 101 bp, rice(Oryza sativa)
  misc_feature (71): n=a or c
acacttgcaagtttactacagcgaatgatctgtagcatttcgagctctggaaatgtaaccaaattcttagnctcacctgcagtattttctgcccatttctc

SEQ ID NO: 13600 - DNA, 101 bp, rice(Oryza sativa)
  misc_feature (71): n=t or c
tgactgcgccatggcctccttggccatggtggcccctacgacgaagatgagaagaagtgtgggaggaggcngatcaagcgcaggagctcctcaagcagcgg

SEQ ID NO: 13601 - DNA, 101 bp, rice(Oryza sativa)
  misc_feature (71): n=a or g
acaagcgagcagcaggcatcaacatcaacaacaacgtcgtctgaaactgtgcaatgtactcccagagggcngaaacgtgcctatgatagtgacagtcctaa

SEQ ID NO: 13602 - DNA, 101 bp, rice(Oryza sativa)
  misc_feature (71): n=t or c
cgatgatctctttcatgtgaccaaggaaccccgcgtcatctatctcagtcatgagttccactcgatgacanagggcaacttgtcaattgctgactactgcc

SEQ ID NO: 13603 - DNA, 101 bp, rice(Oryza sativa)
  misc_feature (71): n=t or g
tgctgggtagtaaaagcaatactcaggacagtactacgagccagcgaataaccatctcagaaagtgttgancctaagttatatggacggaacaagatgaag

SEQ ID NO: 13604 - DNA, 101 bp, rice(Oryza sativa)
  misc_feature (71): n=t or c
tggcaatgacatggatgtgtttctggagcctttgttggaggatatgcatgatttgtggaaacatgggatcngagtttgggatgaattcctacaggagtact

SEQ ID NO: 13605 - DNA, 101 bp, rice(Oryza sativa)
  misc_feature (71): n=a or g
tttggaattatgaaagtacatatacaccttgatatgcttgatgtaagtggcaaccatgtgggcgatgaagnccggcgcgtcgctgacggggacgatgccat

SEQ ID NO: 13606 - DNA, 101 bp, rice(Oryza sativa)
  misc_feature (71): n=t or c
ctgtcaaagggtggccgatatgctgaattgtggtcacagcagaataacagtgatgccatcgatgctgccgnggttagcttagaggtttcatagactatata

SEQ ID NO: 13607 - DNA, 101 bp, rice(Oryza sativa)
  misc_feature (71): n=a or g
atggacctggtggtgggatcgtcgtcgagcttgggagatggcgcgagggacacggagacgcagctgctgtnggacgtgatgatgatgggggtggtggggag

SEQ ID NO: 13608 - DNA, 101 bp, rice(Oryza sativa)
  misc_feature (71): n=a or g
gtcgaagataatagcacgcaatgcaatggcaacacgggctgctgccaggcttccatcccaggtaatctcanggctttccagccctcattcttaaaaataag

SEQ ID NO: 13609 - DNA, 101 bp, rice(Oryza sativa)
  misc_feature (71): n=t or c
taacagcagagcttgatctcgatcacctcgaaatttacctcgaaacagaagcccgaaatgcccagcaggcngctcaaaccggagtccatgtccatcgccgc

SEQ ID NO: 13610 - DNA, 101 bp, rice(Oryza sativa)
  misc_feature (71): n=t or c
gtaatccatgagctatatagcttgtgcagccaaaagggctgggttaaattgcccacttattcttctggcantcaggctatcaggtgcttcaagataggtag

SEQ ID NO: 13611 - DNA, 101 bp, rice(Oryza sativa)
  misc_feature (71): n=a or c
ggttccaaattcggtctctttgattcggaaaaccagtgatcgattaaattctgggaccttgttatccaaantgttttgaggatcaaatacaacataagagt

SEQ ID NO: 13612 - DNA, 101 bp, rice(Oryza sativa)
  misc_feature (71): n=a or g
tgcactatctctggttggcccgtagacaaccgtgagaaggaaggatgtttggcaagcttttaagaagactntggccgagagtgagaaggttcgttgcgcga

SEQ ID NO: 13613 - DNA, 101 bp, rice(Oryza sativa)
  misc_feature (71): n=t or c
cgacaggtgaagtgctttcgtttgtgcacatcccacatccttacaccatcctttcgtagtattccaagatnctctatcagtggctcgaagtacacattaat

SEQ ID NO: 13614 - DNA, 101 bp, rice(Oryza sativa)
  misc_feature (71): n=a or g
atcacactatcctgcggtcaacacagcaaaaccatctcgaccatcgacgtgaccagctttggtgttgcgcntggtcagtgcggcgcctatgagggtgggtg

SEQ ID NO: 13615 - DNA, 101 bp, rice(Oryza sativa)
  misc_feature (71): n=t or c
gacagatcattttgccgttttcatttttacttaccatcttgagcatcgatgactttgtcccggacgagttncggaatgctgagtagagacgccacgacggc

SEQ ID NO: 13616 - DNA, 101 bp, rice(Oryza sativa)
  misc_feature (71): n=a or g
catgtgtttaataatgcgccggctaattctgtttctggagaaaatgcagcaacaggaaatgatgcagcaantgatggcgaggattctggtatactcgggag

SEQ ID NO: 13617 - DNA, 101 bp, rice(Oryza sativa)
  misc_feature (71): n=a or g
caacctctcatcgataggttctcggctaggctcccaacatggaaaggaaagttactaaacaagactggctngacggttctgataaagtctaccctctctgc

SEQ ID NO: 13618 - DNA, 101 bp, rice(Oryza sativa)
  misc_feature (71): n=t or c
aggtgctggttttttaaaaactaatgcctatgaaaaaaccgatcgaagccaatcaaccttatctccgattncccacacctcctccaccaccatctcctcct

SEQ ID NO: 13619 - DNA, 101 bp, rice(Oryza sativa)
  misc_feature (71): n=t or c
ttgctttgtttgtgtgcccatgaaaaagaaaagaagaggtaatctcttgtgcgtgcgtcccctgtgctgtngctgtgcctgtgcgtcggaaagaaaagaaa

SEQ ID NO: 13620 - DNA, 101 bp, rice(Oryza sativa)
  misc_feature (71): n=a or g
cccactggttgctgctgtggggatggatatatggacgctagaacggtctctgaactgaaactgccctgtancagggtaagcagcctgctgcttaatcggtt

SEQ ID NO: 13621 - DNA, 101 bp, rice(Oryza sativa)
  misc_feature (71): n=a or g
aacttttaaaagggaaaggggaataagaagagaggggggggggagtgaaaagattcatacttcatactcangtataacatgccttaaagcatgttataagg

SEQ ID NO: 13622 - DNA, 101 bp, rice(Oryza sativa)
  misc_feature (71): n=a or g
tctaggtatcctgtgtatagcaccagatgatattgagatacttggagcaatacccagcttgctttttctcnagctacaaacttacggaggcaccaatggaa

SEQ ID NO: 13623 - DNA, 101 bp, rice(Oryza sativa)
  misc_feature (71): n=t or c
tgatttctgctgcgagagtttgaaggatttgcgtttgagagggattgcaaccgtggaagaaataggacttngttctcttctgggaaaatgcaaatcattac

SEQ ID NO: 13624 - DNA, 101 bp, rice(Oryza sativa)
  misc_feature (71): n=a or g
agggagattcttcagaggatacttaagcattctgagatcccacaaacggataccaaattcatcttctgctnttgtctacaatgcataaaggatcttttatt

SEQ ID NO: 13625 - DNA, 101 bp, rice(Oryza sativa)
  misc_feature (71): n=a or g
ttaataaacctcctatagtaccctgtcatccccaaaaactttctgagttcagtgacatcagtaggaatagnccaccctgtaattttatccaccttcctggg

SEQ ID NO: 13626 - DNA, 101 bp, rice(Oryza sativa)
  misc_feature (71): n=t or c
cctttcccctttcccctccgcctgctagagtaaccttcaattttcttcccttccggcccctcttccccttngattccggcggtttgtcgccggcgaaggtt

SEQ ID NO: 13627 - DNA, 101 bp, rice(Oryza sativa)
  misc_feature (71): n=t or c
gggataaagtcgtaaaactcagtttgaatatcacccgtcaatccgtcatggcgtcatctatcgagaatgcnggctagcaatgacataactccaactagcta

SEQ ID NO: 13628 - DNA, 101 bp, rice(Oryza sativa)
  misc_feature (71): n=t or c
agacataccagctcgtcgcaataaatcaaccgcatactgtcgctgagaaaggaataaaccatctggagatngagtgacagaaatgcccggaaagaaatgca

SEQ ID NO: 13629 - DNA, 101 bp, rice(Oryza sativa)
  misc_feature (71): n=t or c
agtaatttttcctttcctttgaacggctttcggctgcatctgcctgtaccctggcaccctgcagagttgancgtaggccctagttgaccgcaatggattac

SEQ ID NO: 13630 - DNA, 101 bp, rice(Oryza sativa)
  misc_feature (71): n=t or g
actttgctgtttgcgcaatagattgaatgaggaggataagataataaggcctccaaacaagcaacagggtnctcctagttctgtggctcctaccgtcattg

SEQ ID NO: 13631 - DNA, 101 bp, rice(Oryza sativa)
  misc_feature (71): n=t or c
acattaaaatcatgtcaattctgaaccattccatcgtgttgagatttacgcacaataaactcccccgtccnccatattttttttctgaggggactacggat

SEQ ID NO: 13632 - DNA, 101 bp, rice(Oryza sativa)
  misc_feature (71): n=t or g
ggcagtggcagagcatagtatgcgaatgaataagttgccaaggatatctcctactgatcctcgtacaaatngtgaaatattggactattctcaagggagtg

SEQ ID NO: 13633 - DNA, 101 bp, rice(Oryza sativa)
  misc_feature (71): n=t or c
ccctgacaaagccatctaaatggttgatttaggaaaaacatacctccggtcgctccttgttgggtggcgangcaaccctctatgccgttgtcccccactct

SEQ ID NO: 13634 - DNA, 101 bp, rice(Oryza sativa)
  misc_feature (71): n=a or c
atttgatggcctctggacacaagttatcacatggctgactgtcttgatcgtgagcctttttgctatggttngctctgtcccaagcaggatggctaaaagat

SEQ ID NO: 13635 - DNA, 101 bp, rice(Oryza sativa)
  misc_feature (71): n=t or c
catatcttgacttttctcaggttcttcatatggcacatcagttgcacaaaaccatggttactgccagcaanaaatcctgacagaatttgcaggttgctctt

SEQ ID NO: 13636 - DNA, 101 bp, rice(Oryza sativa)
  misc_feature (71): n=t or c
cagagtctctcacccgcctgcaagagcgcatgattcattcctacgtagttacttgcacttgacttcgatgncattgccatgtgagggggctgccgtgcctg

SEQ ID NO: 13637 - DNA, 101 bp, rice(Oryza sativa)
  misc_feature (71): n=a or g
cgcggcggcgatctcctggtaggtcacgaagtcgtcaaattgagcggcgatataggacatattgtcgtttntctgtatgatgtggaagggctggctctcag

SEQ ID NO: 13638 - DNA, 101 bp, rice(Oryza sativa)
  misc_feature (71): n=t or c
cggccagacacggaaagggcaagtcggatctgatgcccctcaaggcagatgcatggacgactgtggagggnggccgcggaagcgaaggtggtggtaatggt

SEQ ID NO: 13639 - DNA, 101 bp, rice(Oryza sativa)
  misc_feature (71): n=a or g
ggcaactttggcagaaagaatctcaatcaccgagaggcttagcagtgaaatccatagttttcttaataccnggaggtcaagtaaacccaaggatgataaat

SEQ ID NO: 13640 - DNA, 101 bp, rice(Oryza sativa)
  misc_feature (71): n=t or c
cacagagctaattttagaccaccaagggaaccaagaacaccaagaagtgatgatgacggtgatggtgccangcctagttcacctggaagatctcagcgtgg

SEQ ID NO: 13641 - DNA, 101 bp, rice(Oryza sativa)
  misc_feature (71): n=t or c
cctcgcttgttgcatcgtcactgtctctacctgctaaccactcactctattttatccctatcatcaatacngacccactataacaccactcgcagtcgact

SEQ ID NO: 13642 - DNA, 101 bp, rice(Oryza sativa)
  misc_feature (71): n=t or g
tagctacagttgatgaattgagccccaaaaaaatcttgctcatggatcgagaagcctatcattgatccccnatcctcctccggcattggacccagacgatc

SEQ ID NO: 13643 - DNA, 101 bp, rice(Oryza sativa)
  misc_feature (71): n=a or g
agaaatcgattcaaagaataagaggaggaaatggattcgggatggagggtgaacccagggtatggaagacntgactcccgcccagcggatccgaacttccc

SEQ ID NO: 13644 - DNA, 101 bp, rice(Oryza sativa)
  misc_feature (71): n=a or g
aatctcttccagctgatttgcattttgtgcaatgaaagagaggaatgcaagttcacactcctctccactanagtcatcaaatatcaccctcttgatgattg

SEQ ID NO: 13645 - DNA, 101 bp, rice(Oryza sativa)
  misc_feature (71): n=t or g
cccaactgaatcaattatgctagtatctagactttctcaatccagtgattttccagaatcgccttccctgntaagattccttatctgtcctttcaaccctc

SEQ ID NO: 13646 - DNA, 101 bp, rice(Oryza sativa)
  misc_feature (71): n=t or c
cacttgtgcagtcatgccttccaataggaagatggtagcatgcatgtttgatgtggtcaatgctttggaantttttaacaaatttttaaaactggcagatt

SEQ ID NO: 13647 - DNA, 101 bp, rice(Oryza sativa)
  misc_feature (71): n=t or g
tagtactacaatcgacaaaccattggggcttcatcattggctccacaatatctttagttcttgaacaacgncccaagcgcatcttattattttctgtgcct

SEQ ID NO: 13648 - DNA, 101 bp, rice(Oryza sativa)
  misc_feature (71): n=t or c
tactgaggaaaaactgtttatggggataaagaaaacacacacatatacttaccgatggatggagtcgtcangttggacctggatgtgcaaacttgctgctt

SEQ ID NO: 13649 - DNA, 101 bp, rice(Oryza sativa)
  misc_feature (71): n=t or c
actattactgtcttgggtttttgagttcagaacaaaggaatcatcgagagaaggacttgttcattctgggnggcaagttactaagcctgtactagaattgt

SEQ ID NO: 13650 - DNA, 101 bp, rice(Oryza sativa)
  misc_feature (71): n=t or c
actacattgttaaaattttgggaactatatataatgttctttgcatctgtggcccggaagtagtgtcctanactgctgacaccccatcttgtttgaccagt

SEQ ID NO: 13651 - DNA, 101 bp, rice(Oryza sativa)
  misc_feature (71): n=a or g
atggcgccctgagccagccgacatagggagccaaaattcaaatgcccgcagcgcgcatgcgacaaccacgncacctcggcgcagctcgccaccaaacacat

SEQ ID NO: 13652 - DNA, 101 bp, rice(Oryza sativa)
  misc_feature (71): n=t or c
tggcccgcctagctcgtggtagtgaaaagatctccggcgtcgagctccctgtggcaaagggcgacaagatnggcggcgcttgagctcaagctctccggcga

SEQ ID NO: 13653 - DNA, 101 bp, rice(Oryza sativa)
  misc_feature (71): n=a or g
ttgtcgtgaatacttctcttttttatgaaggcactttgcgcttgggaggttaacatggccatataaggctnaaggcgcagcgcaaggattttggatatgat

SEQ ID NO: 13654 - DNA, 101 bp, rice(Oryza sativa)
  misc_feature (71): n=t or c
tgtacatccacctcagaatggggagcaagctatccctggaaatgtaactgaagaaatcagaatcactgctnaacagagagaagagttgatgttgagattga

SEQ ID NO: 13655 - DNA, 101 bp, rice(Oryza sativa)
  misc_feature (71): n=a or g
ctactcctacggttctatacctccaccatttctccattttcctcgtacatgtagaccgacgtataatactnctactggcaaaatagaatatggctgaaatt

SEQ ID NO: 13656 - DNA, 101 bp, rice(Oryza sativa)
  misc_feature (71): n=t or c
caccaaccgcttcgttctccgttggtgtatagttgccgcagcagcagcagcactcgccactgttctttctntctctctttctcctcctgctgctgcgttgc

SEQ ID NO: 13657 - DNA, 101 bp, rice(Oryza sativa)
  misc_feature (71): n=t or c
aaattaattagcaccgcatcccacatttattcttgagcggcaaccatattctcaaccataataatgctatnattatagacaacattagaaaaataagactc

SEQ ID NO: 13658 - DNA, 101 bp, rice(Oryza sativa)
  misc_feature (71): n=t or c
gcataagctgatgcgagagcagccattccattgccataccatgcttcatgtgtgcaagcttgttcttcttnctgtctcacaaaagccttcatggacagatt

SEQ ID NO: 13659 - DNA, 101 bp, rice(Oryza sativa)
  misc_feature (71): n=t or c
caatgttggcgggaatgcttcctttgagcttgttctcatatacttggagaacagtcagttttgacagattncatatggagggcgggaattcgccagagagg

SEQ ID NO: 13660 - DNA, 101 bp, rice(Oryza sativa)
  misc_feature (71): n=t or g
ggaactcaaaattggagatgaaataaaagaacaagattcttctggacaagattcaaaagcagaaagattgngaatcaaatttcaagaaaagcgcaaatcgg

SEQ ID NO: 13661 - DNA, 101 bp, rice(Oryza sativa)
  misc_feature (71): n=a or g
ctcctcttttttagatgcagagacaacaagatgggatgggggtaggagagagattgaccagggggagatgntgggggcaaaaggcggccaagtggatggag

SEQ ID NO: 13662 - DNA, 101 bp, rice(Oryza sativa)
  misc_feature (71): n=a or g
tcgatgatgcgccttctggaattgacaagaggacacatgatttggtccggcgatgagaagaaaagcgaacntaaggctatgtcatatattcatcttcatct

SEQ ID NO: 13663 - DNA, 101 bp, rice(Oryza sativa)
  misc_feature (71): n=t or c
tctgaaagtaagttactaccacttgccacctggcctacaggtttgcttccgatattgtagcattttcccanaagatcatgaattcaaaaaagaagaattgg

SEQ ID NO: 13664 - DNA, 101 bp, rice(Oryza sativa)
  misc_feature (71): n=a or g
ccagtgcaaggtgacgggggtgcatggagtaacatttgcaacaccagtgctaagtaacaaaagtgccaccnacagctctctaggaaatcaaggtgacaatt

SEQ ID NO: 13665 - DNA, 101 bp, rice(Oryza sativa)
  misc_feature (71): n=a or g
attcagttccctcagattctttagctgtccaagttctttgacgatgttagaggaatgcttggataggtccnccgcttgtaatgtctctagtgcctgcatct

SEQ ID NO: 13666 - DNA, 101 bp, rice(Oryza sativa)
  misc_feature (71): n=t or c
ccccttctcatgcaccactcctcctgcagaaaccaacaaatcgaattcagtcaaaaactcaaaaccttgcncattgcaaagcaaaaggaaaggggaaaaaa

SEQ ID NO: 13667 - DNA, 101 bp, rice(Oryza sativa)
  misc_feature (71): n=a or g
cctacaacagggacagctagaactctgtttgattttagaaccgagtagagcctatgaccttccaggtcagntgctctcagcattgctttcagacatttgtc

SEQ ID NO: 13668 - DNA, 101 bp, rice(Oryza sativa)
  misc_feature (71): n=a or c
aaactgatccaactagggctgtccaaatccagtttaaccgagttctgtcaacccgcattttacatgtctgnaggtgaatgaatgagatgactaggtgcgac

SEQ ID NO: 13669 - DNA, 101 bp, rice(Oryza sativa)
  misc_feature (71): n=a or g
accaagaaatccggtcgaccaaactcttccctccccccacaatcgaacgaataaaaaggcaaacaaagggnaaaaaataaaaaaaacgaatatgaacaaat

SEQ ID NO: 13670 - DNA, 101 bp, rice(Oryza sativa)
  misc_feature (71): n=t or g
cacaaaatctgccagagccgaggctgatgaggttgagcttggagggcgaccaggatttaggtatgtcgagntcaagccaagtttgcaggacatcgggtggg

SEQ ID NO: 13671 - DNA, 101 bp, rice(Oryza sativa)
  misc_feature (71): n=t or c
ctttcattgtggaggacttggtcatcttcgatctcattgtaacaagcttggaaggaatccaaaagaacctnaagatgatatcaagaacaccaagcagaaca

SEQ ID NO: 13672 - DNA, 101 bp, rice(Oryza sativa)
  misc_feature (71): n=t or g
atgcacatcttcgtcactcagtactgagttctaggattcttgaagtgttgctctccttgcgcttcttcatntatcaatacggacttgtctatcatctcaag

SEQ ID NO: 13673 - DNA, 101 bp, rice(Oryza sativa)
  misc_feature (71): n=a or g
tggagtaatgttcacgatgttgccttcattaacctcgtattggtctaactgctggatcttcactttaacanaacctgggctagccaaggacggtgatgtcg

SEQ ID NO: 13674 - DNA, 101 bp, rice(Oryza sativa)
  misc_feature (71): n=a or g
tactttcatggttaatgttacctgaaattcttgattgcttgtgcacagattccaggatttagtgccatgantaatcgccctcgacaaccatctaggtaaga

SEQ ID NO: 13675 - DNA, 101 bp, rice(Oryza sativa)
  misc_feature (71): n=a or g
aaaggcctgcagtcggccgccgcaaccacctataaaaaggaccaccactaggcaaaaagccatcttgcagnagcaccttctgcttcgactaaggcaggagc

SEQ ID NO: 13676 - DNA, 101 bp, rice(Oryza sativa)
  misc_feature (71): n=a or g
atttcgtgcgttccttttgagtgatgatgattggctcggcgaatcattatctacgctacacgacaagcctntaaaggcgcaccacagagcgttggttgcgt

SEQ ID NO: 13677 - DNA, 101 bp, rice(Oryza sativa)
  misc_feature (71): n=t or g
ttcgtatggatcttacggtcaaggaggtggtggtggcaccggatcaggttctggtatggctaacacgtatntgtttgttccaataactgaggcagaaggaa

SEQ ID NO: 13678 - DNA, 101 bp, rice(Oryza sativa)
  misc_feature (71): n=t or g
tgagtgcttcagttggggtgctgaatccccttctaaccaagctttcctccttgatcgagggagagtacaanctgctcaaaagtgtgaagaaggatatcatc

SEQ ID NO: 13679 - DNA, 101 bp, rice(Oryza sativa)
  misc_feature (71): n=t or c
atacatcattttcatattggaaccattatctatagttaaggtgagtacctgcaggggttacactcaaagcngagatagtgggcccatagtagccttgacca

SEQ ID NO: 13680 - DNA, 101 bp, rice(Oryza sativa)
  misc_feature (71): n=a or g
ctcagatttctttctttttagtaaagaaggaaaagaaaaaaaggggggtttctggtgggttgttttagctncttgctgttgggcaatttggttagccagga

SEQ ID NO: 13681 - DNA, 101 bp, rice(Oryza sativa)
  misc_feature (71): n=a or g
tactatcacactctgcatctcaaacccaacttcttaaagaacaaaaaacgatcagccatgaagagcggcancctgctgacgctcaccctgggagccctcct

SEQ ID NO: 13682 - DNA, 101 bp, rice(Oryza sativa)
  misc_feature (71): n=a or g
ctcagtctgcaatgacagtaacaatccattctgtgactgcttgaagggtttctctataagatcacccaagnattgggatctagaagatcgatcaggaggtt

SEQ ID NO: 13683 - DNA, 101 bp, rice(Oryza sativa)
  misc_feature (71): n=t or c
gaaggaagggcactaaacctcaaacaccggagcaaaatctcagcagaagaagcttcttgcaaggcctcaanggcagcaacctctgcagcatcccggtaact

SEQ ID NO: 13684 - DNA, 101 bp, rice(Oryza sativa)
  misc_feature (71): n=t or c
aatactccttagtagccaacacagaagcacaagtttgcacaagttttgcagcattaccatactttgatggncttgtcaagtgagccagagtaaagccttgt

SEQ ID NO: 13685 - DNA, 101 bp, rice(Oryza sativa)
  misc_feature (71): n=a or g
tgtgtgtagcacaagtgtgacgtatgcacgtgtatttgacttatgctcggggttattaaaaaaaaaacatncgccaaactcaaagtcggtttgcgtcggtt

SEQ ID NO: 13686 - DNA, 101 bp, rice(Oryza sativa)
  misc_feature (71): n=t or c
ctcctctacatcccccctcccatttgtccccggtttgctccttgctgcagctctggtggtgatgccaccgngcgcattgctgaccgcactaaataattgaa

SEQ ID NO: 13687 - DNA, 101 bp, rice(Oryza sativa)
  misc_feature (71): n=a or g
gaggatcacagatatagaagactcttttctgctgttgccaattaattataccaaatgtgtcatgatgcacnatatagtgagagatgtggcagtttttattg

SEQ ID NO: 13688 - DNA, 101 bp, rice(Oryza sativa)
  misc_feature (71): n=a or g
gtatgcacactctgtaaaggtatgactcatcccacaagtatcgtctgttctcgtagatgagcctcctttcnttctccctttgtcatatgaatcctgcaaac

SEQ ID NO: 13689 - DNA, 101 bp, rice(Oryza sativa)
  misc_feature (71): n=a or g
cctgtggtggcaatgctatccaagtcgcacacagccgccatttccgagcttggaactcgacagcttcttcnagggctccattccgctaccgtcgactcgat

SEQ ID NO: 13690 - DNA, 101 bp, rice(Oryza sativa)
  misc_feature (71): n=a or c
attaactagatgccacgcttatattgcgagccaccaaatcacctacgtaactatgggcacatatttcaccnatactcgtctcgtgcggatgtacatgatac

SEQ ID NO: 13691 - DNA, 101 bp, rice(Oryza sativa)
  misc_feature (71): n=t or c
gcgaaaaagagatggcaaaaactgcgttttgtcccgagacaggcagtcagaccggtgctttacccccagtnagaccggcggtaagccttcggtcagaccac

SEQ ID NO: 13692 - DNA, 101 bp, rice(Oryza sativa)
  misc_feature (71): n=t or g
gcagaaaaattaggcagatttccagagatcccaaaattcttactgagatcaatgcctcttaatttcttgtnctggaagacgattggagggaaccatccttc

SEQ ID NO: 13693 - DNA, 101 bp, rice(Oryza sativa)
  misc_feature (71): n=a or c
ttccctgtgcatgcctagcaattactgctagtaacggttcttggagatgatttgcagttttgcacttaggncctgtttagatcctacaaaatagcaaaagt

SEQ ID NO: 13694 - DNA, 101 bp, rice(Oryza sativa)
  misc_feature (71): n=a or g
gtcgtttgttcatcgactgaatttccttgcgtgcagctgagcaagattcccatggagaagcccgcgagctngaagttcaccaacacgtccaccggcagagg

SEQ ID NO: 13695 - DNA, 101 bp, rice(Oryza sativa)
  misc_feature (71): n=a or g
tatagaaatgtttttccgtgtgttagctgtctgtcatactgcaattcctgttgcagatagaacttctggtnggatgtcttatgaggcggaatcacctgatg

SEQ ID NO: 13696 - DNA, 101 bp, rice(Oryza sativa)
  misc_feature (71): n=t or c
tctgtcaagagaaaagttgttcgtcgccgttgtgagctccttaaaagtgaattctttgactccatgggttnctctccaaacaaactgtgtggcaacctagt

SEQ ID NO: 13697 - DNA, 101 bp, rice(Oryza sativa)
  misc_feature (71): n=t or c
gagctagcttagctcaggtgcagtgcatccgattcgatcgtatgcgtctctctcaaggaagtatcaaatancaatcacactatcatatcacgctagctgct

SEQ ID NO: 13698 - DNA, 101 bp, rice(Oryza sativa)
  misc_feature (71): n=t or c
ccattagcgttgcattatgttcagtacgaccaatgtatcttaattggccataacgcaacgctaatggttgnattagtcgtactgaccagactttttgaaaa

SEQ ID NO: 13699 - DNA, 101 bp, rice(Oryza sativa)
  misc_feature (71): n=a or g
ggggacggaggaagattggaggaggatgcaggatgcagcagcatgcagtactggagatggagaggaatcanaggatgaggtggtagtggtaggcctgatgg

SEQ ID NO: 13700 - DNA, 101 bp, rice(Oryza sativa)
  misc_feature (71): n=a or g
atagttagaactacctttaattcatccctaggagcattaaggtcatctctactccatctagagtacactcntaacattgaatagagtttgtagcaactccc

SEQ ID NO: 13701 - DNA, 101 bp, rice(Oryza sativa)
  misc_feature (71): n=a or c
tgagtatacatcaatgtccattagtatacaacacgtctattaatagaagaagtttaccttcctctccagcngcagatccttgtgtagattaagaatctcca

SEQ ID NO: 13702 - DNA, 101 bp, rice(Oryza sativa)
  misc_feature (71): n=a or g
catgcacccctgaagtggcgcaccaagttcacagaatgtttttagcatgataatcgcatgatgctgtgagntctcagaaccactgcctagaagaacaagaa

SEQ ID NO: 13703 - DNA, 101 bp, rice(Oryza sativa)
  misc_feature (71): n=a or g
gttctagcaggaattacaccaatctgctggcgtatatatgtgttaggatttatctagatgagtgaggttgnatggtcagtcatcaagccaaccacaggagc

SEQ ID NO: 13704 - DNA, 101 bp, rice(Oryza sativa)
  misc_feature (71): n=t or c
gtttagacaattatattttactccttatttgaagatgttgcatcgaacaataagtgaaacacatgttacanatcaacatcctactgattttagtaaagtct

SEQ ID NO: 13705 - DNA, 101 bp, rice(Oryza sativa)
  misc_feature (71): n=a or c
atataactggctttttgcacaaccagttcctacgtatgttcctcctcaagtaccagatatcaagacttcgncagaaaggaaaacaaatccttttgatcctc

SEQ ID NO: 13706 - DNA, 101 bp, rice(Oryza sativa)
  misc_feature (71): n=t or c
tgttatgtcaagaaactgcaaattagacagattaccaagctgatgaggtactctgccgtaaaaacccatangtgctaggttgagatgggtcaaactttgaa

SEQ ID NO: 13707 - DNA, 101 bp, rice(Oryza sativa)
  misc_feature (71): n=t or c
gaaaccctggtgagattcttcccccttttttgttgttcatgatttcagttacaggctgtgattagtttcangccaaaattagaagttcaatgaaattagaa

SEQ ID NO: 13708 - DNA, 101 bp, rice(Oryza sativa)
  misc_feature (71): n=a or c
catgcagaggacaccggtggatctggtgagcatgagagaaagggggagagggatcaagaactttgcttcancgttgcaagctccaacctcgacctcaactc

SEQ ID NO: 13709 - DNA, 101 bp, rice(Oryza sativa)
  misc_feature (71): n=a or g
ggagtgagctgagctaacgacttagcgtatttgcgcaggccttgctgcagttgatgtgccagcagaggcgntttctagtgcgagaacaacaacaatgatcc

SEQ ID NO: 13710 - DNA, 101 bp, rice(Oryza sativa)
  misc_feature (71): n=a or g
tctcatctctcaagaaaataaaggaaaaggaagggaggatcatctcaaaagagaggggaaagaaacgaagnaagaaggaaaaggaaaaggtagtaacgcaa

SEQ ID NO: 13711 - DNA, 101 bp, rice(Oryza sativa)
  misc_feature (71): n=t or c
cacgcaaatctgctctaggtgcacttctttggaagaattagagctcgaggatgttcgcctacttgaagggnagattcaatcggcctcgctgaagcgcttgt

SEQ ID NO: 13712 - DNA, 101 bp, rice(Oryza sativa)
  misc_feature (71): n=a or g
acacaaactctaacaggagaaacaggatgaaaggaacgaaagatgcatgaggaacaaattgttgctatctngatcgatcacaaagcaatcgaggcgcaggt

SEQ ID NO: 13713 - DNA, 101 bp, rice(Oryza sativa)
  misc_feature (71): n=a or g
ttatttcaacagtgagtgagcaacactacgaggaagatggtcgaatgattcatacctggaagatttcctgntctttggcattggacgactggatgttttct

SEQ ID NO: 13714 - DNA, 101 bp, rice(Oryza sativa)
  misc_feature (71): n=t or g
cttcttccgattctcctcttcttgattccataggtcaagctatggtcagatcgaatcaggaatattggagnctggtggctagatggagggcccgataacct

SEQ ID NO: 13715 - DNA, 101 bp, rice(Oryza sativa)
  misc_feature (71): n=t or c
tggtttctaccgatgactgacgaagacgcccaagggggcatacagctataccggaggagagcagcggcaantctgcggcgcgaagtcgccactggtggaga

SEQ ID NO: 13716 - DNA, 101 bp, rice(Oryza sativa)
  misc_feature (71): n=a or g
cacccatctcgcgtcgcatcacacaagactgtggtgtgacgtcattttcgtataatgatttagcgataacnatggtatatttgtgctaaaagaattacatc

SEQ ID NO: 13717 - DNA, 101 bp, rice(Oryza sativa)
  misc_feature (71): n=t or c
tggacacctttgcatctagctgtgcaaacacagagaactgatatcgttaagctactcttaataaagggtgntgatagaactttgaaaactcaagtaagtaa

SEQ ID NO: 13718 - DNA, 101 bp, rice(Oryza sativa)
  misc_feature (71): n=a or g
taaaaccaaactagcttctaaacagggcctatgtatccatcatctaaacgccgcggatgctgaattcctcnatacaagaccttttcatgttttaaactaag

SEQ ID NO: 13719 - DNA, 101 bp, rice(Oryza sativa)
  misc_feature (71): n=t or g
tgagacaagtatccaagaggaatgtgagaatttgtttcttgaattggtcctgaacagggtctgtcaagctnccaatttgaatctaaatgatgattccaatg

SEQ ID NO: 13720 - DNA, 101 bp, rice(Oryza sativa)
  misc_feature (71): n=t or c
tccaatatcaataaaaatcttttagacttcaatctttgttcaattagctcttctggtctaccatctttttnaccatccactttagggacatattgtttgat

SEQ ID NO: 13721 - DNA, 101 bp, rice(Oryza sativa)
  misc_feature (71): n=a or g
caccagcatccttggcctctacttcaccaacgccaagtactcctccaagatgatagcaaccttacctgatnatgacgaccatggtggcagtggcaaaccac

SEQ ID NO: 13722 - DNA, 101 bp, rice(Oryza sativa)
  misc_feature (71): n=a or c
tccctgttactcaaaccaatcaattgctattgctgaaatttctgcccgaggtacctctatctaaagtaagnacgtaacaagatacaaatgctgcattttta

SEQ ID NO: 13723 - DNA, 101 bp, rice(Oryza sativa)
  misc_feature (71): n=a or c
ccaatggtttgatctctttggtgaatgatctgttctgggtgaagagataaccgtagtcattgcctccaatntcctccattagaaacaaggattttgacatg

SEQ ID NO: 13724 - DNA, 101 bp, rice(Oryza sativa)
  misc_feature (71): n=t or c
aactacgtttaaaataggacagaggtagtaatggaatgtgtcacattcaattcaggcctggttggtttagntaccaactttttcttcaaacttcaaacttt

SEQ ID NO: 13725 - DNA, 101 bp, rice(Oryza sativa)
  misc_feature (71): n=a or g
cgtcgatggaggcctcctggcggtaaagcgcctcgagcctatagtttccgatgtggaatacttctttgtcntgtagtagctcgtagtgaaaagctgccatg

SEQ ID NO: 13726 - DNA, 101 bp, rice(Oryza sativa)
  misc_feature (71): n=a or g
aaaatttctttttcaggttagaaacgatttagctttactagtgtcgacgtagaaaaacacaattttggtcnttaacaactactccctccgtttcataatgt

SEQ ID NO: 13727 - DNA, 101 bp, rice(Oryza sativa)
  misc_feature (71): n=t or c
tgatttccacgcaaggtgacgtgaagcatggcaagagtgacaccttaagaggtgtcatcctcttcaccggnagtgcagatgtatgaggccgattgagcccc

SEQ ID NO: 13728 - DNA, 101 bp, rice(Oryza sativa)
  misc_feature (71): n=a or g
tccaaccaaacctgtgtctctctccttaacatggggcaccccacgactggagtaggccagtctaagaaggnaaggggctccaatggacaggaggagggaac

SEQ ID NO: 13729 - DNA, 101 bp, rice(Oryza sativa)
  misc_feature (71): n=t or c
aagagtaactaatatagatagcatgtcatagcctcaatcttacgctccattgctcaagtactactacaaantaatcaagaaggtgaaacaatagccaggta

SEQ ID NO: 13730 - DNA, 101 bp, rice(Oryza sativa)
  misc_feature (71): n=a or g
ttgcatgtttacaatgtgtccctcgttgttcaggcatcaaagaagagaaagaaaattgtctcatcctctgnaagagctaatagctcaggaacatcaaacaa

SEQ ID NO: 13731 - DNA, 101 bp, rice(Oryza sativa)
  misc_feature (71): n=t or c
gaccttgcactgacgtgaataatcgcagagcgtgctgctgagtgcgaagagcaaatgattttctcttcttntttttttttgttcggcagagatgcacacgc

SEQ ID NO: 13732 - DNA, 101 bp, rice(Oryza sativa)
  misc_feature (71): n=a or c
tggcaaatggctccagtgatctgttgtacttcctggagctttcttgggatccggtactctgggaggatcanatgtagaaactggtttttgcataaaccagt

SEQ ID NO: 13733 - DNA, 101 bp, rice(Oryza sativa)
  misc_feature (71): n=t or g
acatatctcgatctactccttgaaaatagaaggaattaatggcgactgtgttagcgtgctctacgtattcncgatagacttatataagaattacagtggct

SEQ ID NO: 13734 - DNA, 101 bp, rice(Oryza sativa)
  misc_feature (71): n=t or c
gccaggaggctccatggcacggaggctggactcatcaaccaggctccaagaaccattgctggagtcagtcnatgagtgcaagtgagtggagtgaaaaggag

SEQ ID NO: 13735 - DNA, 101 bp, rice(Oryza sativa)
  misc_feature (71): n=t or c
taatgcgtggtgagatcttcactgcaacatttggaatgaaaatgacgatgctgtagccgtgttcattattncacattctgttccgggcgacagattttagc

SEQ ID NO: 13736 - DNA, 101 bp, rice(Oryza sativa)
  misc_feature (71): n=t or g
tggaaaaacaatcaaaatgaaattataaagccctgccactttcttcgccacgctacctgtagcagtgtttnggctatgctgcgtaccaagaggcgaaccta

SEQ ID NO: 13737 - DNA, 101 bp, rice(Oryza sativa)
  misc_feature (71): n=a or g
aattgaagctctgtaagtgatcagtgaattgaagcaagaagaaacagaaaggagttgagtaattgcgtacngcgtagaggatggtgagtatgtggaacttg

SEQ ID NO: 13738 - DNA, 101 bp, rice(Oryza sativa)
  misc_feature (71): n=a or c
ggcgaagcgtacggcatgcggttttggtggactcggtggctttcaccatcccttgcgtgaaccgttccgcntctttttcagcgctcgcctctgccttgagg

SEQ ID NO: 13739 - DNA, 101 bp, rice(Oryza sativa)
  misc_feature (71): n=t or c
acaccaaagccgccgggcgctagctcttatgagccctccttcccgttgcaagcccagctagatgcgtctcngaccgccggccgtcgttcttcttgggcctc

SEQ ID NO: 13740 - DNA, 101 bp, rice(Oryza sativa)
  misc_feature (71): n=t or c
gccatgggagcggcggtgtcggtcctagaagaggggaggtgatgggtagcggcatgtgaggatggtgctcnaagaagaccgtgcggctggtgctgacgccg

SEQ ID NO: 13741 - DNA, 101 bp, rice(Oryza sativa)
  misc_feature (71): n=a or g
ggtactcaagcgagctgagttcgggagacctgtttatcctaaacacttgttcatgcaagtgctttgaaccngggaagcagaggtgcagcgcaggaacagaa

SEQ ID NO: 13742 - DNA, 101 bp, rice(Oryza sativa)
  misc_feature (71): n=a or g
tgcaaaacgcttcttgtttgattcgtggttcccttccctaaaaaacctccggagattgagcattgtaaacnggttcaagacgacaaccattccaagttgga

SEQ ID NO: 13743 - DNA, 101 bp, rice(Oryza sativa)
  misc_feature (71): n=a or g
gatgatgcctggaccggcgacatcaggggaggtctttcactgtaagcgatgtttgaatacctccaaatctnggaccttgttgccaccgtttccttgaaccc

SEQ ID NO: 13744 - DNA, 101 bp, rice(Oryza sativa)
  misc_feature (71): n=t or c
acatcagtacaatcatagagttccaaagttagatttccctaggtttgatggaactgatccccaggacaggnagatgagatgtgagcactactttgatgtta

SEQ ID NO: 13745 - DNA, 101 bp, rice(Oryza sativa)
  misc_feature (71): n=a or c
gaggaggaggaagaactaccacaggcacaccgccgaacaaatcaggatcatggaagcgtgagaatttcctncatttctgttgcgtgaatatcagcgtcagg

SEQ ID NO: 13746 - DNA, 101 bp, rice(Oryza sativa)
  misc_feature (71): n=t or g
atatttttcgctgatgttggtgcaatatactgatcatatcggacctgaggggtttgaaggacaaagattanatatatatgtctttggtgtgtgtccatgat

SEQ ID NO: 13747 - DNA, 101 bp, rice(Oryza sativa)
  misc_feature (71): n=a or c
aaattttttttcagtgctaccgaaatcacccaaatcgaaagtgtaaaccctggttaacacgtgaatgtgcncctgaaattgtttagatgtatctaatcctt

SEQ ID NO: 13748 - DNA, 101 bp, rice(Oryza sativa)
  misc_feature (71): n=t or g
ctgaacgtacccttgaccgaggtcgggaccacggtggtaaccacacctggtgcccttccccggtgttcatntggatgttggcggccactggcccacttgtc

SEQ ID NO: 13749 - DNA, 101 bp, rice(Oryza sativa)
  misc_feature (71): n=a or g
acaaattcaggagcaaatcttgcaagtctcgaaaattctatttcatattctactacagatttattaccttncttaagctctagaaattccttcttcattct

SEQ ID NO: 13750 - DNA, 101 bp, rice(Oryza sativa)
  misc_feature (71): n=a or g
gccacgcgcatcagaaaaagaatcttctgcatttggtgcagcccatttgatatcaaatttcctgtcagatnttatccacagttagatcaggagtaagaaaa

SEQ ID NO: 13751 - DNA, 101 bp, rice(Oryza sativa)
  misc_feature (71): n=t or c
tatgacattactatacaaattgatggtccaatttatgcacttgataccatatcatgtccgaagtgtcgtanatttttttaacagatggattacttttattg

SEQ ID NO: 13752 - DNA, 101 bp, rice(Oryza sativa)
  misc_feature (71): n=t or g
cgtgctccgcttccgcgaggtgatgcgcgccaccgagatccgcgccatcgacaccgctaagaactccaacnccatgcgcaccctcaccagcgccgtccatg

SEQ ID NO: 13753 - DNA, 101 bp, rice(Oryza sativa)
  misc_feature (71): n=a or g
caattagctcatattatgtaatattgaatgacttttgtccaaaatataacatacaagaacaattatctggncattcccctccacgaactctggaatggctg

SEQ ID NO: 13754 - DNA, 101 bp, rice(Oryza sativa)
  misc_feature (71): n=a or g
caggacgaacacgcagcatcatatccatctttcgattcgatttccaaattccaatcgatcggtccgcggcntcccaatttcagtagctgtggatctgtggt

SEQ ID NO: 13755 - DNA, 101 bp, rice(Oryza sativa)
  misc_feature (71): n=a or g
ctaatatatatcccgcaacaaagcgtgggacatcgtcagtttcttgattaaaaacaagctaggtaaggtangtgggcgttggcctcttggtgcttgaaaca

SEQ ID NO: 13756 - DNA, 101 bp, rice(Oryza sativa)
  misc_feature (71): n=a or g
ctgacatgtaggccctgtcttccatctcttttctcccacggccgattcttctccttctcttctcgcccgcntcgagccccgacgtcgccggccagccatgc

SEQ ID NO: 13757 - DNA, 101 bp, rice(Oryza sativa)
  misc_feature (71): n=a or g
ttgcgaagaagaacactaccccaaattaaactccggaagctcactcgaactggggcggggaatcaagccancccaggattcctcctccttcctccgatccg

SEQ ID NO: 13758 - DNA, 101 bp, rice(Oryza sativa)
  misc_feature (71): n=a or c
gaaccatcctgttcaatttgtacgtaataattacgttccaaaacaacattcctgtacgctttggccaatgncgcccaaaagagccaaaaacgccgcccggt

SEQ ID NO: 13759 - DNA, 101 bp, rice(Oryza sativa)
  misc_feature (71): n=t or g
gaatgtcaatgtttcagctgagctcttatcctgtaatttctctttaaatgccttcctccgttgtccacagntaatcccatttgtgccatttgatcgcaagt

SEQ ID NO: 13760 - DNA, 101 bp, rice(Oryza sativa)
  misc_feature (71): n=t or c
tgtctgtttataaaataatccttgcttgaaacatcaccactcctctatgtttaggaaaattcactgtatanctctgaaactttgtcaaatactaccttata

SEQ ID NO: 13761 - DNA, 101 bp, rice(Oryza sativa)
  misc_feature (71): n=t or c
tccttgaccagatcatcataaggactgcttttagcctcttcaaccacatgttttgcacttccgttggaggnaccctccttgtgtgaggcctcgtgcttctt

SEQ ID NO: 13762 - DNA, 101 bp, rice(Oryza sativa)
  misc_feature (71): n=t or c
gtcatatggtaccagagtttagggtgatggctagtcatcatcatcatcgagagaactccgacaatgacaangccaaaggggggttaagcagggggacccta

SEQ ID NO: 13763 - DNA, 101 bp, rice(Oryza sativa)
  misc_feature (71): n=t or g
gataaaaaagagcacaaattcttctcctgttagtaattctgttcgaattcctctccttccccaaaaaagantggagttcatctccgccacgcggggttacc

SEQ ID NO: 13764 - DNA, 101 bp, rice(Oryza sativa)
  misc_feature (71): n=a or c
aatttaactcgtttgttgacgtgttacagatagatcagtttaattacaaaactttttcaagcccacagagnatttgtatccatttcccagttgatatccaa

SEQ ID NO: 13765 - DNA, 101 bp, rice(Oryza sativa)
  misc_feature (71): n=a or g
gatccatacaggtactgatccagttaattggttgtcgtataaatgcaacttctccaaatttgtgagcttcnatagccagacaggcatttttccatacaacg

SEQ ID NO: 13766 - DNA, 101 bp, rice(Oryza sativa)
  misc_feature (71): n=t or c
tgaatagtattatcctacctaggtggtcaaggtgcaaaaagcccccacacattaagatacatggcttgttnactttgctactattttcaatcttaacaagt

SEQ ID NO: 13767 - DNA, 101 bp, rice(Oryza sativa)
  misc_feature (71): n=t or c
gcttaggctcttcctttttcggaagcgttgcttcgatgtcgtcggttatttctgtacggggaagagcatanattacatcatgttgggcatcgccttgaatt

SEQ ID NO: 13768 - DNA, 101 bp, rice(Oryza sativa)
  misc_feature (71): n=a or g
aatctatataggagaataaatacttatgctgacaccaacaatccaatcaagcaagcagcgcctatactaanaaccgggtattactcaaacgaattaccctc

SEQ ID NO: 13769 - DNA, 101 bp, rice(Oryza sativa)
  misc_feature (71): n=a or g
ggcttcgctatacatgccaatatgccatactagtactgcaccgagctgtatatctcactatgctacgttanttgatctctggaactgaaagagtactgttt

SEQ ID NO: 13770 - DNA, 101 bp, rice(Oryza sativa)
  misc_feature (71): n=a or g
catgtttgtaactgatgtagttattctttttgctacttccagcaaggaagggggttgatctgatgcctcanagtaaggtatatagcacaattcatatatgg

SEQ ID NO: 13771 - DNA, 101 bp, rice(Oryza sativa)
  misc_feature (71): n=t or c
gcaactccacttagtacacgctaatctcacgtttgaaaaatcggccacgtaatcatagccaagaagcaacnactctgcaatctgcatgctggattgctggt

SEQ ID NO: 13772 - DNA, 101 bp, rice(Oryza sativa)
  misc_feature (71): n=a or g
atacaggccagctgtccatattgtagagtgttccaaatttgcctctgcatcagtgtttacacaccaatcanaaaggacgaaggccacaggaggaagtacca

SEQ ID NO: 13773 - DNA, 101 bp, rice(Oryza sativa)
  misc_feature (71): n=a or g
atcgtgcatgcacgcgtgcgtggtagtacagcctagctaagctagcttacttttaggctgtgtttagagcnagtttaatagtatagcccactgctagctcc

SEQ ID NO: 13774 - DNA, 101 bp, rice(Oryza sativa)
  misc_feature (71): n=t or c
atcatttcagtgaaaatcattgcaagtctgcacaaaacgctgaaaacatatagagtagatcgcgattagcnagcctatgcgaagattatttcagtgaaaag

SEQ ID NO: 13775 - DNA, 101 bp, rice(Oryza sativa)
  misc_feature (71): n=t or c
tttcatcaacaaagacaaacacggcttaagaaatgatatggatgcatccaaagcgggagggcttgtgaggngatgtgaggattgtcttcagtacgggcacc

SEQ ID NO: 13776 - DNA, 101 bp, rice(Oryza sativa)
  misc_feature (71): n=t or c
aggccaccaatggcacaccctgctggatccatccagattcatctctgtctcgctctcctctctctcggagncgaggcggtaggtgacagcgcaagagggga

SEQ ID NO: 13777 - DNA, 101 bp, rice(Oryza sativa)
  misc_feature (71): n=a or g
tgtggtgacgttaccggaggaatcgaaactggtagggatggtggatggtgtggtgaccttactagaggcanggaagcttgtggggaaggtgatcctagcgg

SEQ ID NO: 13778 - DNA, 101 bp, rice(Oryza sativa)
  misc_feature (71): n=t or g
gttggagattctgatataaaattacagaaatcaatggtatgcgctaggatgaattcatacccattcagganatttgggagtctaacttttatccgtgttct

SEQ ID NO: 13779 - DNA, 101 bp, rice(Oryza sativa)
  misc_feature (71): n=t or c
agaaaatctctccagggtagcatctgtccttccaatgttgaagctatcgtgccttcggaagaacatgtcangatgagaagctttcactaattctccaggat

SEQ ID NO: 13780 - DNA, 101 bp, rice(Oryza sativa)
  misc_feature (71): n=a or g
acaggcatcgatattgcaccaccaagagctgaggcatatatcaatggaagtgtcaaaaaatctggccaatnaatcgagctcccccttccagtaccataggt

SEQ ID NO: 13781 - DNA, 101 bp, rice(Oryza sativa)
  misc_feature (71): n=t or g
gaaataaagaaaagaggagaaaggaaaaaaaggtgaatcaaacgaaaacggacgtgatagatcgtttagcnagaactagctaaaccgcataccaaaacggt

SEQ ID NO: 13782 - DNA, 101 bp, rice(Oryza sativa)
  misc_feature (71): n=t or c
tattatgccttagatggctctccatcatcgacgataaccttgtcgcccttattcagctccttttccttgtngtgatcgttgaccttgggctcaagccagct

SEQ ID NO: 13783 - DNA, 101 bp, rice(Oryza sativa)
  misc_feature (71): n=a or c
gggcacaactctaatggtggatgctatggcctgtgtcctggggtcttgcatctccttcttctcctcagacnctgccattgctcctcccctctcttcttttc

SEQ ID NO: 13784 - DNA, 101 bp, rice(Oryza sativa)
  misc_feature (71): n=t or c
actctggacaatcaacaagaaaataattgacccagtttgtgcaaggcatactgctgtgttgaaagatcagngtgtgatcttcaggcttactaatggtccag

SEQ ID NO: 13785 - DNA, 101 bp, rice(Oryza sativa)
  misc_feature (71): n=a or c
aagttgtttaacaaaactttatgcaaaagacataactccagatgagaagcaggaactcgatgaagcacttnagagagaggtgatttcctttttgtaggagc

SEQ ID NO: 13786 - DNA, 101 bp, rice(Oryza sativa)
  misc_feature (71): n=a or c
gcccctcgctccatcatgtgtgtgtttttaggatatcccgagaatcacaaagggtaccggtgttttgatcntgtctccaatagggtctatatttcacatca

SEQ ID NO: 13787 - DNA, 101 bp, rice(Oryza sativa)
  misc_feature (71): n=t or c
cccgttgtcgtggcgatggatctggccacccctgtcatcacggtggcagacccggcctccctcatcatcanggcggcatatctggtcgcccccatcgtcgc

SEQ ID NO: 13788 - DNA, 101 bp, rice(Oryza sativa)
  misc_feature (71): n=a or g
cgcgacacagcgagcatatgattcgcgttttcgttcggtgcagatccactgaaccaaatattgaataatgnaattcgaaaccaaactgtaacctcaaagct

SEQ ID NO: 13789 - DNA, 101 bp, rice(Oryza sativa)
  misc_feature (71): n=t or c
gaaaaccatgtcttggttctccttgaggtctcaagggaaggtggcgtcagtgctcattgtcactcttcttnctggagatgtcgtctaggaggcctccttac

SEQ ID NO: 13790 - DNA, 101 bp, rice(Oryza sativa)
  misc_feature (71): n=a or g
gtttcaatttgtatttttttaacccaaagccatgggtgtcatctaacgggtgtcaagagtgagggcaaacngcgtgttcgttttcaaaaagaggtggcaaa

SEQ ID NO: 13791 - DNA, 101 bp, rice(Oryza sativa)
  misc_feature (71): n=t or c
gaaaaattgatcaagtaatgaatcggctgacaatcatccaaaatttaaatgacaaagtttaccttgggtangacatcagggaatagatctgtcatgtacat

SEQ ID NO: 13792 - DNA, 101 bp, rice(Oryza sativa)
  misc_feature (71): n=t or c
atgtcttgctctagctctgtctccataaatgcaagattcgaattttctgcattaggctcaccatcaaaacnacttccatcggtgcgatcgactgttctgat

SEQ ID NO: 13793 - DNA, 101 bp, rice(Oryza sativa)
  misc_feature (71): n=a or g
aaatttttcacgatcgacatcagttcaaattagtaaagtgatgactgacgacgggctagtgttccaaaatntccatttaaaatctaacacggctctaacta

SEQ ID NO: 13794 - DNA, 101 bp, rice(Oryza sativa)
  misc_feature (71): n=t or c
gtcatctcgccacgacgccatttccctgtctcatcctcttactctcaggtctctttcagactttcagtagntccaatgccgctaatcatttgtgttagttt

SEQ ID NO: 13795 - DNA, 101 bp, rice(Oryza sativa)
  misc_feature (71): n=a or c
taggccctgtcaggtcattattggagagtagaagagatgttagaattgacaaattccctattaatgttggnaatatttcctcattgaggttgttagatgac

SEQ ID NO: 13796 - DNA, 101 bp, rice(Oryza sativa)
  misc_feature (71): n=t or g
agtataccgcacaaatgttgcatggtcagcaggcaagtcagcctcgtaatcctcctcaatgtcctcaactnacctccaaactagcagaagaccaccccatg

SEQ ID NO: 13797 - DNA, 101 bp, rice(Oryza sativa)
  misc_feature (71): n=a or g
attaatagtgttttataacgatcgactaaattttacacttattaaccgcgtagttggtaatggagacggcngtgacggagcccgggcaatggctcgactta

SEQ ID NO: 13798 - DNA, 101 bp, rice(Oryza sativa)
  misc_feature (71): n=t or c
ccgttgaacgccattgtccacgtttcgttgttgatctggttgtttgattgattatcaggcatggtccagtnagctacaaaatcggcgagtacttgggactt

SEQ ID NO: 13799 - DNA, 101 bp, rice(Oryza sativa)
  misc_feature (71): n=a or g
gctaatgaattttataataaaatcttactatgttccaacgatcctttttgtattcccttcattatcattcncgctaaatatttttgcaagcccaaaatctg

SEQ ID NO: 13800 - DNA, 101 bp, rice(Oryza sativa)
  misc_feature (71): n=a or c
gcattggtgtattcattggcttatcggtgttactcatattgaatacatggttgctaagctgctgactgttnacatgttaacaaaagaaacttttatatcac

SEQ ID NO: 13801 - DNA, 101 bp, rice(Oryza sativa)
  misc_feature (71): n=a or c
ctcaggacttccaggaactatgtgtggttggcgtaacgttaaggtgccttgtttcaaagtctgaacgatgnatgacaaaacgatgcgtcattcgtcctaaa

SEQ ID NO: 13802 - DNA, 101 bp, rice(Oryza sativa)
  misc_feature (71): n=t or c
cctccatggtcaccaccttggtcgatcgatcgatcagatacgctacggaagagagagcaattaaggtgcancgagatgggagtatgcgtatggcggggagg

SEQ ID NO: 13803 - DNA, 101 bp, rice(Oryza sativa)
  misc_feature (71): n=t or g
tcgcgcgcacaaaaattccccattccccaacatttttattttgggtggctccctcctccggcgagggcganggcggaggaggacggcgaccggttcatcga

SEQ ID NO: 13804 - DNA, 101 bp, rice(Oryza sativa)
  misc_feature (71): n=a or g
cttcgtccttggtgatcaccttccattcagaatgctttcacttccacgagtggtaagatttcaccaaaccncttggcatgatattcaaactgtggaagata

SEQ ID NO: 13805 - DNA, 101 bp, rice(Oryza sativa)
  misc_feature (71): n=a or g
ttcactgtagcgtctagaagaggaacaggtggattattaattagcaaaagataatcagaaaacggaagccnagaagagcagagcccctataaatactcgcg

SEQ ID NO: 13806 - DNA, 101 bp, rice(Oryza sativa)
  misc_feature (71): n=t or g
aggccgcgtggggaagcaatggcctaatgaagctttcgggtccagcatggatgggtccagattggatcgcngctgtccaatttgggctgcctcttcaggcc

SEQ ID NO: 13807 - DNA, 101 bp, rice(Oryza sativa)
  misc_feature (71): n=a or g
agaatacaagtcctgcttgttgtacctagctatcttccccaagggtgagaagattaggcggtcaaccttgnttggacggtgggttgcagaagggttgacat

SEQ ID NO: 13808 - DNA, 101 bp, rice(Oryza sativa)
  misc_feature (71): n=t or g
atgtgacgatttcttgtcgtctgtgcttgcgacgtacaatgttaggcttccccagcttagtccattggcantcccgaagctggcggttttcgcctggatgt

SEQ ID NO: 13809 - DNA, 101 bp, rice(Oryza sativa)
  misc_feature (71): n=a or g
ctctctcgctcgctctcggaaactgattaccttagcgatcgccggaagcagatggggtcgccgatatatanccgccggctcacgtgttctggttaaaggcg

SEQ ID NO: 13810 - DNA, 101 bp, rice(Oryza sativa)
  misc_feature (71): n=t or g
gcatccaaaaactaaaatatatgttcttgtgtgtaatgtaggagtggaggatgtgatcgccgactcgaagncgcacaaggtgttggtgaaagggaagaagg

SEQ ID NO: 13811 - DNA, 101 bp, rice(Oryza sativa)
  misc_feature (71): n=a or c
aatcgccatccaaaacctgtgtaacacactagcacctaaaataataaaggctccagatatccaaaaaacanacatacaagataaatatatgtaaactgaat

SEQ ID NO: 13812 - DNA, 101 bp, rice(Oryza sativa)
  misc_feature (71): n=a or g
atccacgcttaataacatggtggcaaatgtgaaaacttcaaatcatcagggccatgaaagaacaaaacatnttgtcgcatcaaataaagaaaaatcatttt

SEQ ID NO: 13813 - DNA, 101 bp, rice(Oryza sativa)
  misc_feature (71): n=a or g
gctaggcaaagcggatgctgtggaagatccacgtggtcacaccaaagtcactccgtaggtcgattttggcnggcgacggtctccagggtggcggaaaagga

SEQ ID NO: 13814 - DNA, 101 bp, rice(Oryza sativa)
  misc_feature (71): n=t or c
ttcattcatctataggctcttcactgtgctagattttgatccaaatggatcatcatcgtcagatgcagganatccagctcgcgcgctgttcttcgcagcac

SEQ ID NO: 13815 - DNA, 101 bp, rice(Oryza sativa)
  misc_feature (71): n=a or c
aataatggctaaaggcaaaccatcacatttataaagtatatcactgataatcccttccagctgactggggnattttttttcagcaccaaaagtccttgtga

SEQ ID NO: 13816 - DNA, 101 bp, rice(Oryza sativa)
  misc_feature (71): n=t or c
cgagatcgagatgatgagcaatcacttacagtcagaatccgtggtgatccactgacacagcctgctgctgncgccatagtcgtcgtcatccgggctgccac

SEQ ID NO: 13817 - DNA, 101 bp, rice(Oryza sativa)
  misc_feature (71): n=a or g
gaggagggttctggctgtacaaggtgtgcgggtagcatctactcactattccatgcgttctcggccggcangggagcggagggtcggggagccaggcatgc

SEQ ID NO: 13818 - DNA, 101 bp, rice(Oryza sativa)
  misc_feature (71): n=t or c
aagagattactgagcatgtttgtgcatgggagtgagaggttcataactcgaatccttctttgtccatatanagtagtgtagagaagagcgcactgaaaaga

SEQ ID NO: 13819 - DNA, 101 bp, rice(Oryza sativa)
  misc_feature (71): n=t or c
gtaaacgagcctggcttgatgtgaatctgcagctcaacatacctgataagacctttgatgacactaacgtnacgagtatttcttgggcagcctcgcagctt

SEQ ID NO: 13820 - DNA, 101 bp, rice(Oryza sativa)
  misc_feature (71): n=a or g
aaaatggcatcaaagtgaagaggtccaaaatttggtgatatattcacttctccagttgtccgtgtagaccntattggactcttgaaagtttgcacaggagc

SEQ ID NO: 13821 - DNA, 101 bp, rice(Oryza sativa)
  misc_feature (71): n=t or c
ttccagcaaattgcacaaaccaagtctaccgaaataaaaagaagagaaaacagggaatgggggaaaaatcngtggatcttgtcgaccatcgttatccacca

SEQ ID NO: 13822 - DNA, 101 bp, rice(Oryza sativa)
  misc_feature (71): n=t or c
ggaaagggatccggctcctctaactttgcaagcgaacggcagggaattacagtaaagcccttgtttagttncaaactttttttcaaacttccaacttttcc

SEQ ID NO: 13823 - DNA, 101 bp, rice(Oryza sativa)
  misc_feature (71): n=a or g
tatatggcagtcccgtcggccatcatgtacgccgaccagatgaagaacctaagcacgccggagttcacgcnccggcggaactccgccagcacgaggagcga

SEQ ID NO: 13824 - DNA, 101 bp, rice(Oryza sativa)
  misc_feature (71): n=t or c
tcggaattgccagtacttatgcttactcatttggttatagtcccacctgtggtccatgtgcttcctgctcnagttaagagtccaaaaatacggattgacac

SEQ ID NO: 13825 - DNA, 101 bp, rice(Oryza sativa)
  misc_feature (71): n=a or g
atttgaaggtatgaacataaaaggactatgctaaacgacctttagacaacgcgaaatctatttcgagaacnctctcggtttagctctacagcgcgacgcat

SEQ ID NO: 13826 - DNA, 101 bp, rice(Oryza sativa)
  misc_feature (71): n=t or g
tcgcttttgctcgaaatctcccaggtttgttgttgttgtgttgaaggcggagaagaggggaggctttggtngtggtggaggaggaggatggcggcggcggt

SEQ ID NO: 13827 - DNA, 101 bp, rice(Oryza sativa)
  misc_feature (71): n=a or g
agcacagagctagagtgtttggagcggtttgtggaaggggtgatcgacaattttggtgaagaatatttgcnaagccccactagtgaggatatgcaacatat

SEQ ID NO: 13828 - DNA, 101 bp, rice(Oryza sativa)
  misc_feature (71): n=a or g
attttttttagtttttgacatggatagtgtggagtagtagtagtaatattagaagctctgctcgcccaagnaggtagtttgctttactcaactcccctttt

SEQ ID NO: 13829 - DNA, 101 bp, rice(Oryza sativa)
  misc_feature (71): n=a or g
tagggagtcctacctgatggccaagaaatagccgtgaagaggctttgccagagttccagacaaggaatagnagagctgaaaagtgagctgattttggttgc

SEQ ID NO: 13830 - DNA, 101 bp, rice(Oryza sativa)
  misc_feature (71): n=t or g
gttttctgcaggagtatggtgaggttgaaggacgtggaatacgaatggcaaaacgagtagtccgtgctttnggtttgatatttggatgtgtatttgccgcg

SEQ ID NO: 13831 - DNA, 101 bp, rice(Oryza sativa)
  misc_feature (71): n=a or c
tggatgagggattattagagaaatactactcacatattcttgagtacccagctgcgcatggcgtgcctcgnctgatccagcaacgatccgccgcctgcagc

SEQ ID NO: 13832 - DNA, 101 bp, rice(Oryza sativa)
  misc_feature (71): n=a or g
ttcattgcaatagacacttactgacgaggagagtgttgtgcagcacgaatttcaactaaattaatggccgngtctccttcaggttcatctaaccaaaacat

SEQ ID NO: 13833 - DNA, 101 bp, rice(Oryza sativa)
  misc_feature (71): n=t or g
aaattgttgaagggattagtgctgccacaatgcttttcaaattgttctgtcttgcttgcattctttgggantattagtcctttttcctgcaaaaacgaata

SEQ ID NO: 13834 - DNA, 101 bp, rice(Oryza sativa)
  misc_feature (71): n=a or g
aatatcagttctgtaagaaaaagccgaattaaccggaccggtttttcagacctgttttttttttcttcacntcaaaattgaaagtttgattgaaattggaa

SEQ ID NO: 13835 - DNA, 101 bp, rice(Oryza sativa)
  misc_feature (71): n=t or c
cgatttccatctcaaaagaaacaggagcctttgctatttcctcggccccgaccaacaaacaaacaaacagnggatgagcggagagtagtcaagccgcgtcg

SEQ ID NO: 13836 - DNA, 101 bp, rice(Oryza sativa)
  misc_feature (71): n=a or g
caatcctgtatttaactattgtattctcatgacactttatgtgaatcctggattttgttgatagtgccttngtgggtgaattagaaagatatatatagttc

SEQ ID NO: 13837 - DNA, 101 bp, rice(Oryza sativa)
  misc_feature (71): n=a or g
cttgcaattgatgatggtttcaccggatttcttaatctgatggattctctatccactccaaaatacatccncacactcgagctttcaggcgaactacccag

SEQ ID NO: 13838 - DNA, 101 bp, rice(Oryza sativa)
  misc_feature (71): n=a or c
ccatattttcagaccaactatgactgcatcccgtatcttgctcagcgcgcaatagtttgtccagtaaatgnagttgttgatgaggttaatgatatgatgct

SEQ ID NO: 13839 - DNA, 101 bp, rice(Oryza sativa)
  misc_feature (71): n=t or c
gttcacaatctgtttatcccctttcataacccgcataagctccccatccttcttcctccaaataaatacanggccacagtctgatccagtggtaacatagt

SEQ ID NO: 13840 - DNA, 101 bp, rice(Oryza sativa)
  misc_feature (71): n=a or g
tgtacgcgtatttctgtgaaattcctacaggacgaccttacatatgcgcgtttcaaagagaccatgagcantgatactttgtcgtagtactccttctgccc

SEQ ID NO: 13841 - DNA, 101 bp, rice(Oryza sativa)
  misc_feature (71): n=a or c
cctagaaacctaaacctattgttgtcaacatttaagtatttaactcacggcgccgttccaatatcttgtgnaagttgcatcctgacattcaagagtacttg

SEQ ID NO: 13842 - DNA, 101 bp, rice(Oryza sativa)
  misc_feature (71): n=a or g
ttcctcccttcctgcgtggcgatttggagtggatggattagggttttttttagaagacctcggggacgacnccggaggaggaggaagggtataagaagcgg

SEQ ID NO: 13843 - DNA, 101 bp, rice(Oryza sativa)
  misc_feature (71): n=a or c
actgctggcagtagaattcataaataaaagcttgagatcacttctcctcgtgataatattggtaatacttnttctgtcccactgaataaagcgcacacgca

SEQ ID NO: 13844 - DNA, 101 bp, rice(Oryza sativa)
  misc_feature (71): n=a or g
tttagcgtgaactaaacacacacaccctgaatcctcaagatttcttcgtgcggcatgttccccacaaattntccaaaagagactcgaatcgaacagtgatc

SEQ ID NO: 13845 - DNA, 101 bp, rice(Oryza sativa)
  misc_feature (71): n=t or c
gcccgttgcatacattggcacacttgacgggcaagagttaatcaatatctccctttccccataagttagangtccactcttgcaagtgcctaaccttttct

SEQ ID NO: 13846 - DNA, 101 bp, rice(Oryza sativa)
  misc_feature (71): n=t or g
ttggtggttgattttgtgaggttcaattttcgtctcaccactaaattggtggccattgctctttaatcctnccttggtggcactcctcacagttttgaggt

SEQ ID NO: 13847 - DNA, 101 bp, rice(Oryza sativa)
  misc_feature (71): n=t or c
aataaaagtacgggactcatgtatcagtgacggtaaggatagtatcattgggtgtgttcggtagctgtttntgtggtagcgcttggttgtgttacccgctg

SEQ ID NO: 13848 - DNA, 101 bp, rice(Oryza sativa)
  misc_feature (71): n=t or g
ggtaccctcaatgagctcgtggcagggaagtgacgtagtatccatcgtacccctatagaatgaacaacttnattttgtttggtacctgatagtaccagtac

SEQ ID NO: 13849 - DNA, 101 bp, rice(Oryza sativa)
  misc_feature (71): n=t or c
tccgcgagcttcttcgccgccgtacccagtcctcggcaaccttcgtcccccacgccgttgcaccgttggangttcgtgagcttctttgttgtcactgctgc

SEQ ID NO: 13850 - DNA, 101 bp, rice(Oryza sativa)
  misc_feature (71): n=t or c
ttacgaaaactaaggatttaatatgatatgacgtgagcactgaaatagacaggcttgtttacacctctgcntatatgtctatatatgatgctcgagccagc

SEQ ID NO: 13851 - DNA, 101 bp, rice(Oryza sativa)
  misc_feature (71): n=a or c
ctcttcatcaaaatctgcttccaactctgacagatcaactgatggaaggtttatccttgcccaatttagtntgttcaaccttgtacccggcactcccaatc

SEQ ID NO: 13852 - DNA, 101 bp, rice(Oryza sativa)
  misc_feature (71): n=t or c
ggtgaaggatttccaggatttttttgtgcctgtggaaagctgtagagtagtaggccggcggtcagcaccanggcgcctgcaacaaagccaggagggagagt

SEQ ID NO: 13853 - DNA, 101 bp, rice(Oryza sativa)
  misc_feature (71): n=t or g
agtgtagtgtgcttgctcaatcaaggatcttcttgctcttccctgcagggcctcccgtggcgctcaacaanacgctcgccttctgcgcctacgcccggggg

SEQ ID NO: 13854 - DNA, 101 bp, rice(Oryza sativa)
  misc_feature (71): n=t or g
ttgtcactgaccatgcacttggacagatcgagctcagcaagctcagtgcaattctcggagatggcaaagangctagcatcggttatcttgctgcagccctc

SEQ ID NO: 13855 - DNA, 101 bp, rice(Oryza sativa)
  misc_feature (71): n=a or g
tgtttttgggtattggattctatcacttgagaaaatgagaaccgccatcccgcacacaccaaatgatgaanaaatggtatgcatacgtttagtgtgtttgt

SEQ ID NO: 13856 - DNA, 101 bp, rice(Oryza sativa)
  misc_feature (71): n=t or c
gtgggatgttcttctgatgctgagctgcgacagtgtaatcttaccagaaccaaaactaccagcttactacnactaaaacgtactcctacaatgataacaca

SEQ ID NO: 13857 - DNA, 101 bp, rice(Oryza sativa)
  misc_feature (71): n=a or g
tatatttatatttttttaaggcaaagcacatacacagaaaaacgatatcttccactgctcgactattcacntaatcacatgggacccaaaaagcccaatgg

SEQ ID NO: 13858 - DNA, 101 bp, rice(Oryza sativa)
  misc_feature (71): n=a or g
agttggcttcgacttgaatgattttacagggaagctccctgactatgtcggaaacttctcaagtactctgntaaatttctttgcagaaggaaacaagttat

SEQ ID NO: 13859 - DNA, 101 bp, rice(Oryza sativa)
  misc_feature (71): n=a or c
catctagttggcgatgtgggataaaggtgaaatctttggttggatttaaaggggtgcatatggcaagcctntgttggaagtccatgattgagttctcaaca

SEQ ID NO: 13860 - DNA, 101 bp, rice(Oryza sativa)
  misc_feature (71): n=t or c
gatgcggatgaactgggagctttgcagccgtgtcagggttggaaaaaggtgaggagaaagcgcttggatgntgtcaaagatgataataatggagaaaatgc

SEQ ID NO: 13861 - DNA, 101 bp, rice(Oryza sativa)
  misc_feature (71): n=t or c
aataacagtcaacaaactcccccttaattctgctacggcccaaaatcacgaacacctaacaggtgccgtgntgtcgccaatctcgctgctggcaacccttt

SEQ ID NO: 13862 - DNA, 101 bp, rice(Oryza sativa)
  misc_feature (71): n=a or g
atctatctggtgcgcctgcggttcgcttacggcaactacgataacatgaacagcgagtctgttcagttcgntctgttcctcggggtgaacaagtgggacga

SEQ ID NO: 13863 - DNA, 101 bp, rice(Oryza sativa)
  misc_feature (71): n=a or g
attgtctcagtgattttggcatgcaatgctggatgtgaaaatcgatgtaatgttggtcgcatgatcgaacngttcagaacgttgaggccaaaattttggtt

SEQ ID NO: 13864 - DNA, 101 bp, rice(Oryza sativa)
  misc_feature (71): n=a or g
tgatcaggatgagatcagctgctgatcgatcgatcaggtgagtcctcctagctctccctgatctcgcggcncccccatgcccatctgcacctgcacggcgt

SEQ ID NO: 13865 - DNA, 101 bp, rice(Oryza sativa)
  misc_feature (71): n=a or g
acgagacgaagtatggacaaaaagtgcatgatcatgagcactggccgaaaaacctgcagcagtgactacanaagcaaactgttgaaaccaagcacgaggag

SEQ ID NO: 13866 - DNA, 101 bp, rice(Oryza sativa)
  misc_feature (71): n=a or c
atccggtaggcttgcatctcctggtcaccagtgaggtcgaggtcgaagtcactcaacaatcttggtgtganctctgcatcctccattgcgatgtcgacgga

SEQ ID NO: 13867 - DNA, 101 bp, rice(Oryza sativa)
  misc_feature (71): n=t or g
tttcgtgcgccagtgaaaagtgagcatagtagtactatgctgtatctgtgtgcacacgtgtttttgtttcngttaggaaacctatgggcttgggcccatga

SEQ ID NO: 13868 - DNA, 101 bp, rice(Oryza sativa)
  misc_feature (71): n=t or c
taattgtttatacagttaaataacatataacaattagaaatgtacaaggcgagagacgaagaaaggaacantcacaattttgtgctgaacttattgaagaa

SEQ ID NO: 13869 - DNA, 101 bp, rice(Oryza sativa)
  misc_feature (71): n=a or g
gcccaaagcccatgacattactcccctctttttaagcagctcgaggcacaccccgctagactcaaacaaantaccatagcctaaacaaagattcacaagcc

SEQ ID NO: 13870 - DNA, 101 bp, rice(Oryza sativa)
  misc_feature (71): n=t or c
gccatattaggttgtgtttctataatctataatctctctttccaacttatactctcgtttcgtgcgcgtangcttcctgaactaatgaacggtgatttttt

SEQ ID NO: 13871 - DNA, 101 bp, rice(Oryza sativa)
  misc_feature (71): n=a or g
taatagctagatttcaaaaaagccacaaaggactgaaaaaaaagaccatattacatgctttaagaaccgcnaaagtgaataaatcatacagtttatactga

SEQ ID NO: 13872 - DNA, 101 bp, rice(Oryza sativa)
  misc_feature (71): n=t or c
tacaaaatctcaatttggctggacaaataagccctgacataggtaacctctcagccctccaatccatctanctacaaaaaaataggttcattggcaatatc

SEQ ID NO: 13873 - DNA, 101 bp, rice(Oryza sativa)
  misc_feature (71): n=a or g
tgttggcccttttttggcaagaagacaaatataattgggatacctagatgccttgcgatgatatggagtcnccaaccacttcaacctagcaaaagctacat

SEQ ID NO: 13874 - DNA, 101 bp, rice(Oryza sativa)
  misc_feature (71): n=a or g
catcagggtcgccgtgccatgcatctgaaccaaaaagtaaactatgccatgtaaaagaggaagggatctgnaaatcaacgtacgccgtgctccatggcgtt

SEQ ID NO: 13875 - DNA, 101 bp, rice(Oryza sativa)
  misc_feature (71): n=a or g
aaaaccgtgaattggaaatagcccatccggatttcaattctacgctttataatggaactatcccatctggntttaaattctacgctttagtgataggtact

SEQ ID NO: 13876 - DNA, 101 bp, rice(Oryza sativa)
  misc_feature (71): n=a or g
ggacatttttgctagtaatacacatgttactcccgtgtatgatacaatgggtggtgtacttaagaatactnactatcatacttaggggtgaaaacgggcgg

SEQ ID NO: 13877 - DNA, 101 bp, rice(Oryza sativa)
  misc_feature (71): n=a or g
ttgttcctactgtgcagccaaacgaccaaaattgccggtacgcattcataatgtttcgtacattcgatatnttcacgctctactatctagtttacatgtgt

SEQ ID NO: 13878 - DNA, 101 bp, rice(Oryza sativa)
  misc_feature (71): n=a or g
ttgttgaaaagttagcaaaacatataacctttggaaaaaattccctttgagtagtctatctctctcatccnattctttcaattttcatgaggtctaattga

SEQ ID NO: 13879 - DNA, 101 bp, rice(Oryza sativa)
  misc_feature (71): n=a or g
ggtagggacatcatcactatgttgttttctacaactacattgtatattaattgccagctcccctttgtgtntatatatatgtagtgaccttgattaagata

SEQ ID NO: 13880 - DNA, 101 bp, rice(Oryza sativa)
  misc_feature (71): n=a or c
aacacgtacttgctcactaaaccgttttgcttcatggctgactctttccaggtccaccgacagcaagtcgngggacgcctcagccgattccctttgctgcc

SEQ ID NO: 13881 - DNA, 101 bp, rice(Oryza sativa)
  misc_feature (71): n=t or c
tttcgtatgcgctatgttaatgcgtcatcgaatgggttctttgtgttttggtctcactttgtatgtcgagntcttagtaaaattgcttaattttgcaggta

SEQ ID NO: 13882 - DNA, 101 bp, rice(Oryza sativa)
  misc_feature (71): n=t or g
agctaagctgctgcaggcagacgataaaaagcagtttgcaggtttgatagattgccgtcgtccagccatcnctgtaccgtaaaacacgtaggcgacggccg

SEQ ID NO: 13883 - DNA, 101 bp, rice(Oryza sativa)
  misc_feature (71): n=a or g
catccaacccgagcccttccaggatatgccactctattcatagttggggtgattgtcatatcggatatacngagacacatttgaagtattaaacgtagtct

SEQ ID NO: 13884 - DNA, 101 bp, rice(Oryza sativa)
  misc_feature (71): n=t or g
aacaatctcatcttgaataatgtatttccattgattcagaagtgcagggttgacacgacctatgtctaggncagttgcaatctaaaaactgctgttcacca

SEQ ID NO: 13885 - DNA, 101 bp, rice(Oryza sativa)
  misc_feature (71): n=a or c
aacgcaacggcacaagcacaacaccacttcgagtgtgtttgtcgtctcgcctctgctgcttccttctcctncaagccgccgctccgacctcgccgtcgccg

SEQ ID NO: 13886 - DNA, 101 bp, rice(Oryza sativa)
  misc_feature (71): n=t or c
cacccttcttccctcatgtcttgcacgatgtcctcatactcctcatcatccctcagttcatctggtgaaancacttgggtcaggcataccacctttgtagg

SEQ ID NO: 13887 - DNA, 101 bp, rice(Oryza sativa)
  misc_feature (71): n=t or c
gacgacgaagaaagccgaggtttgagtgacagttgaatctactacctccgtctcaggaatgtagctatttntggctatgaatcttggacatgttttgtttt

SEQ ID NO: 13888 - DNA, 101 bp, rice(Oryza sativa)
  misc_feature (71): n=a or g
tccatgttgcttaaaaaaaacaacattttagagagtcagagactacagatcagaacaacaacagggggcanccagatctacaagctgttgtgcaatgaaca

SEQ ID NO: 13889 - DNA, 101 bp, rice(Oryza sativa)
  misc_feature (71): n=t or g
tttcagtacatacacccctggaaaacagctccaaatgcaaaagatgccagttttttttctgaatttccatnatacgaacacaataattcaaacacatattt

SEQ ID NO: 13890 - DNA, 101 bp, rice(Oryza sativa)
  misc_feature (71): n=t or g
ttgggcagattcctctcttgatggtatcgttgaacaagccaactaagcacaaggagttgtctcgggtgatnagataatttggttaaggaaggtaggaagca

SEQ ID NO: 13891 - DNA, 101 bp, rice(Oryza sativa)
  misc_feature (71): n=t or g
caaaaaagaaacccagaattcaaaccaacaaaaagtttgcccaaaaatccccaaactttccaaaggccaanccacactacacagtgccatgtaccggtacc

SEQ ID NO: 13892 - DNA, 101 bp, rice(Oryza sativa)
  misc_feature (71): n=a or g
ataaccaaagtccaaaacgacggttcttaaaaaaaaaagtccaaaacgaccttcctacaaggctacacctnacttagtcacacttctccaaactaactacc

SEQ ID NO: 13893 - DNA, 101 bp, rice(Oryza sativa)
  misc_feature (71): n=a or c
tagcaaatcggtttctacttgaagagagaaagagcacatgaacaagaggaaattgaggataacaatgagcntaaaaaaagagctaatccagtcgaggacac

SEQ ID NO: 13894 - DNA, 101 bp, rice(Oryza sativa)
  misc_feature (71): n=a or g
ctttgggtgaaaacccagtccaacttttgggcgggcgtcaacaatggctttggtcgttgttcacctccttngaggcttcgccttaaaggtcatgctcttcc

SEQ ID NO: 13895 - DNA, 101 bp, rice(Oryza sativa)
  misc_feature (71): n=a or g
cctgcagcaaagtgtgaggaatcacctagtttctaactatgaatcaaaacattggcatgtccaggtttacngataaaagttgattcatttttgaacggagg

SEQ ID NO: 13896 - DNA, 101 bp, rice(Oryza sativa)
  misc_feature (71): n=a or c
gctcaccgcaacagcagatgtggcagttgctataggcacaattatcagcaataccttggaccgacgagaancttttcgatctgtacctctacgaggtaagt

SEQ ID NO: 13897 - DNA, 101 bp, rice(Oryza sativa)
  misc_feature (71): n=a or g
ttgcacctgttgggagttcatgggagggatttgcttctcagctgtggttcaaacgcgactgtggatgctgncggccggagatggatcggcgacatggcccc

SEQ ID NO: 13898 - DNA, 101 bp, rice(Oryza sativa)
  misc_feature (71): n=t or g
ggtaggggagaagcaggtgaatggatacgagagcctgctctacttgacatcctggcgaaacatcgggttcnaggacgtcgatttcggcagcgggaagacgg

SEQ ID NO: 13899 - DNA, 101 bp, rice(Oryza sativa)
  misc_feature (71): n=t or c
cctctgaaagatttcttgtatggcaaatttttctacaagatactgcgatttcgcggtttaagccatagganaccacccgaactcatttttgggggaagaca

SEQ ID NO: 13900 - DNA, 101 bp, rice(Oryza sativa)
  misc_feature (71): n=a or g
tggaaaattaccttcatctattgggaaattgaagcaattgaagttccttagtgctactggcatgcaacatnaaacaattcccaagcatgttatgaaacttt

SEQ ID NO: 13901 - DNA, 101 bp, rice(Oryza sativa)
  misc_feature (71): n=t or c
aagtgcatatgggcactcttaaactttagcatgcatggttgacttgaggtagagatcactttgccgtctgntgatagaaattctgctcttacctaaactca

SEQ ID NO: 13902 - DNA, 101 bp, rice(Oryza sativa)
  misc_feature (71): n=a or g
ggtgcgtgcggctgcctactggtgctactcaccgattttggctgtatttaggggtgtaaagttttaacggntcacatcaaatatacgaacatatatttaaa

SEQ ID NO: 13903 - DNA, 101 bp, rice(Oryza sativa)
  misc_feature (71): n=a or g
gaatgaacccactgtacacattctagcggcgtcgatgtgagcaaaacaagttgagaagttttatgaaggancatctcctatgcgtattcttacgggtagcg

SEQ ID NO: 13904 - DNA, 101 bp, rice(Oryza sativa)
  misc_feature (71): n=a or c
tttagtgctagtatcatcgacgcgacatgagattttggtgtagcgaattcgcattgcccattttaattttnaccacacctgtattactactagcatggcac

SEQ ID NO: 13905 - DNA, 101 bp, rice(Oryza sativa)
  misc_feature (71): n=t or c
tacggtatttggcgaaaatatacagaaaccaatggcatgtgtttggcacagctcaaaaagctcagctaaanggtctctagctccaacaaaaataaaatcag

SEQ ID NO: 13906 - DNA, 101 bp, rice(Oryza sativa)
  misc_feature (71): n=a or g
ttggttatcaacgtcaaatatttaaattggtggtggagctgatgacaacggtttttagagcacctgcaatngtaaagtaaggtgctctctatataaaacat

SEQ ID NO: 13907 - DNA, 101 bp, rice(Oryza sativa)
  misc_feature (71): n=t or c
ggcttgggccgagcccatgtttcttcggctgggcttcttccttgtttgggcctaaatctgagcacttcggntgatgggccatttggatcataagttcacaa

SEQ ID NO: 13908 - DNA, 101 bp, rice(Oryza sativa)
  misc_feature (71): n=t or g
ctttgtatgactgcagatagtctctcccaagcagacaacgaacggtggcaggttattctgatcctcctaangactgttgctaccctgactaagaccctcag

SEQ ID NO: 13909 - DNA, 101 bp, rice(Oryza sativa)
  misc_feature (71): n=t or c
taagaggatgtagttgtcctaatagcagtagccatggttattgtagtaaatagcaaacgcacttccaactnttcaaggtttcattaatgcaaaggtttttt

SEQ ID NO: 13910 - DNA, 101 bp, rice(Oryza sativa)
  misc_feature (71): n=a or g
tttttgagaacttgcaacattgccttcttcagatatgccaataacagaggtgatcttttcagtcaggctgnacaccatttccttcattatgctccagtcat

SEQ ID NO: 13911 - DNA, 101 bp, rice(Oryza sativa)
  misc_feature (71): n=t or c
tacacctccgttggtagcgcagctctatctgaatcagtttgagaaggacttctctcggttcctccagttgngatgcaaagagcttgtgcccggtggcagga

SEQ ID NO: 13912 - DNA, 101 bp, rice(Oryza sativa)
  misc_feature (71): n=t or c
acctctaatgttcttgtggtcatccttaactttgtcttttggatcgacgtagtcttgcttgagtaaacgcnggaacgatatgaagatgcaagcgacgagtg

SEQ ID NO: 13913 - DNA, 101 bp, rice(Oryza sativa)
  misc_feature (71): n=t or g
tccgcgccctgcacagcgggcacgtgctcttgctcttgatccacagcgcgacgcagtcccggtggaacacntggcggcactccggcaactcgctgcacagc

SEQ ID NO: 13914 - DNA, 101 bp, rice(Oryza sativa)
  misc_feature (71): n=t or c
tgctcgtccctgtcatggtttttcttctttcgtcccctacaatgaccatcacttgatacttgatccaccgnctccagcgttctgaagctgttgtttctggg

SEQ ID NO: 13915 - DNA, 101 bp, rice(Oryza sativa)
  misc_feature (71): n=a or c
tactcttttgcataaaattcatatttataatttcttgggtgtgatctgatgcaggtccgagaggaaacggnaaatacatttgtacctggctgaacacacat

SEQ ID NO: 13916 - DNA, 101 bp, rice(Oryza sativa)
  misc_feature (71): n=a or g
accggcgcgctgccgcaggggtttgccaggggcctgtcggcgctggagcacctcgatttgtcccacaaccncttctccggcgccgtcccggaggacatcgg

SEQ ID NO: 13917 - DNA, 101 bp, rice(Oryza sativa)
  misc_feature (71): n=t or c
agcaaataaccaagtcgtgttagccctctcctacaacatgtaacagaggaagaggcagggtttaccttacngccggtaaccgcatggttaccacggttatc

SEQ ID NO: 13918 - DNA, 101 bp, rice(Oryza sativa)
  misc_feature (71): n=t or c
cagaaattaaaattattatatattagtacggaggcagtagctcggtatatacagatatggtcggaaaatanatgtacaaatctaataggatgagaaaaaga

SEQ ID NO: 13919 - DNA, 101 bp, rice(Oryza sativa)
  misc_feature (71): n=a or g
ttgctgttttgggcccgttgagctagagagaagtatgccatgtgccatggagagagattctaatcactcanatggcgtacacttatttattacatgtcaac

SEQ ID NO: 13920 - DNA, 101 bp, rice(Oryza sativa)
  misc_feature (71): n=a or c
caggaacataccccccttgatataaaagtcttgaaaacaagttcacacacaaccagaggtactctgcccantagttatatcacttccatcatctgacatca

SEQ ID NO: 13921 - DNA, 101 bp, rice(Oryza sativa)
  misc_feature (71): n=t or c
gttcgttcgcattttgtttgctccttcacgttcattcacgtttagtctacgttcgggaatgacttttcggnagtggcggcagcggagcggcggcatggcgg

SEQ ID NO: 13922 - DNA, 101 bp, rice(Oryza sativa)
  misc_feature (71): n=a or g
aaaaagctcgaaactcttgcctcggatcagctggatccggatccaagtcgagatagactttaagcttatantgtaaacttttgtctcgttaaagttatcat

SEQ ID NO: 13923 - DNA, 101 bp, rice(Oryza sativa)
  misc_feature (71): n=t or c
ctatcaagcaaatcacttcctttgtagttcgtagaaccaggacgagggttgaacgggtactgactgtttgngatacacaaggatgctgatgatgttctgtt

SEQ ID NO: 13924 - DNA, 101 bp, rice(Oryza sativa)
  misc_feature (71): n=t or c
aacatgtttatcacgttggaatgatggtgacgtgaccttggcaccccaaagtatccaaaccaaccaatttnatttgcttttcttgctcactaaactcaaat

SEQ ID NO: 13925 - DNA, 101 bp, rice(Oryza sativa)
  misc_feature (71): n=t or c
tatagtgaagttaatggggacaatcacacttcaggtccttggggaagtgctagtagtgaaagtagccaaanggtaagtaataactgaatcttaaaatacct

SEQ ID NO: 13926 - DNA, 101 bp, rice(Oryza sativa)
  misc_feature (71): n=t or c
attggattcgcacatctcgtgcaaggtctgcgggaacatgggccactcgggaaatgactgtctcgagaccngtgaggaggccatgttcatggggaacaaca

SEQ ID NO: 13927 - DNA, 101 bp, rice(Oryza sativa)
  misc_feature (71): n=a or g
ggcgggagaaggaaatcggtacggcgggagaagattttggaggatgaatcggagatttcgccagaggaatnggcgtgaggccacgggtgggctaagccacg

SEQ ID NO: 13928 - DNA, 101 bp, rice(Oryza sativa)
  misc_feature (71): n=a or g
agatgggtgtgttggggaggatttgtgaaatgcagttgatgacatgatgtgtgtgtggtcaggtgtcggtngtgccggttccgggcaagaggatcgagcac

SEQ ID NO: 13929 - DNA, 101 bp, rice(Oryza sativa)
  misc_feature (71): n=a or c
gagttctcgatcaaaagaaactggaggtttctgaattcccttccggagatggtgaggttgcctgggatgtntgacctgtgtcggagcctgagatagcgcaa

SEQ ID NO: 13930 - DNA, 101 bp, rice(Oryza sativa)
  misc_feature (71): n=a or g
ctcgccgactctcgtcctgcactcatcccacctgttccgcttctgcagattgacgtcaaacatcacttgancgctcctaagggctttcacagtgtagtgat

SEQ ID NO: 13931 - DNA, 101 bp, rice(Oryza sativa)
  misc_feature (71): n=t or c
cactctccaacatcacagaaacgttgcagcattatgatcatgaatcctcatggaacagcattacctgtagngagaaaggtatcattaatgtcgatggagtc

SEQ ID NO: 13932 - DNA, 101 bp, rice(Oryza sativa)
  misc_feature (71): n=t or c
caattcagggaactcgagccaatcctacaatcgaggaaatcggctgattcagaaaagagtgcctgttcatnagaggttgggtcctatgcaccaagctcgtt

SEQ ID NO: 13933 - DNA, 101 bp, rice(Oryza sativa)
  misc_feature (71): n=a or g
aattaatttattagtagatgagaactcctttgctgtcttgataaatgtagaaattcaacaaatgataaaangaggcatgtttaatttttttaaatgtacat

SEQ ID NO: 13934 - DNA, 101 bp, rice(Oryza sativa)
  misc_feature (71): n=a or g
tttttctagccacaggtgccaaggaggacgagggagttgaacccctttcttgtgtgatcctacagttgctngcaagaagactcccaccaaactggaagcag

SEQ ID NO: 13935 - DNA, 101 bp, rice(Oryza sativa)
  misc_feature (71): n=a or g
gctagcttaattaacaaataaatctaggaaccgatcgatcgaagcctctagctccattattcacacaaaanctcccgcatacacgtacacactcacactac

SEQ ID NO: 13936 - DNA, 101 bp, rice(Oryza sativa)
  misc_feature (71): n=a or g
ggtgttactgcatatgtgcaagcaaagattgttcttttggcagtggataatgctctgatggtctctggccntgatcaagtggttgtttttctctgcaggat

SEQ ID NO: 13937 - DNA, 101 bp, rice(Oryza sativa)
  misc_feature (71): n=a or g
cagtaacgtcataggatctcaatccccaaataggatagctatactatttcagttggaagcatccctactcnatttgaatctgttttttggaattaaggctg

SEQ ID NO: 13938 - DNA, 101 bp, rice(Oryza sativa)
  misc_feature (71): n=t or g
ccgctcctgttgctccaagcagacgccgacgaggctgacaaggttcttgtgcttcagcttcgcaaccaganccagctcgttcttcagttcttccacccctt

SEQ ID NO: 13939 - DNA, 101 bp, rice(Oryza sativa)
  misc_feature (71): n=a or g
cttccttgtctgctccaccgtcatcattgtatcctccttttgcgcctcggtagcgctcgtcaccgccgtcnatgttggcgatggccacttctcgaccatta

SEQ ID NO: 13940 - DNA, 101 bp, rice(Oryza sativa)
  misc_feature (71): n=t or c
ctctaacaacaaattttcaggacccatccctgaattccttgagagcttccagcttctgaagaatctgaacntttcattcaataacctatctggtatggtgc

SEQ ID NO: 13941 - DNA, 101 bp, rice(Oryza sativa)
  misc_feature (71): n=t or c
tgtttccgaccatttccgaccgttttcatccctatccatgggggagtactgggttcgtacccactgaacangtatcttaatactaaatgacaggttttaaa

SEQ ID NO: 13942 - DNA, 101 bp, rice(Oryza sativa)
  misc_feature (71): n=a or c
atcagagtttgacgttacggttgatgggctgcaatgcaaaatctgatgtgcagtataatttaccaactagnggtgaactagcagcgattatagtgggcgat

SEQ ID NO: 13943 - DNA, 101 bp, rice(Oryza sativa)
  misc_feature (71): n=t or c
agtaaaatgaagcgagagcgagatgatgcagttaaagaggcaaggagcatgcgtatagagaaggagctgangaattcttgtgcctatggagcaataagctc

SEQ ID NO: 13944 - DNA, 101 bp, rice(Oryza sativa)
  misc_feature (71): n=t or g
cttgatttatttcccttagacccgggcttccacaataagaactttcaggcttcttgatttgggagggaaanatcgttttatatcagagagttcacctggtg

SEQ ID NO: 13945 - DNA, 101 bp, rice(Oryza sativa)
  misc_feature (71): n=a or g
tggcatacaatttttctaacttgcatgttattatattgctgtgatttttaattaagggggacatgtaacgncggaaattgatatcgccaacatgacggcgc

SEQ ID NO: 13946 - DNA, 101 bp, rice(Oryza sativa)
  misc_feature (71): n=a or c
attggcgttgggaattctcgcagtggcagaaggaggaagcagatatgtggactcttgtttcttatggcaanaataagtcccctattcttccgtctggaaat

SEQ ID NO: 13947 - DNA, 101 bp, rice(Oryza sativa)
  misc_feature (71): n=t or c
gttgaagagatattaacctggctgcttgtagttaattcatcaatagccgatgagggaacatgaccattgcngtaggttgttttctcagaagagaagcaatg

SEQ ID NO: 13948 - DNA, 101 bp, rice(Oryza sativa)
  misc_feature (71): n=t or c
cccataaccagatgaacttcttccatgctgatctccatatgatgcactcacccccacagagccccttggtngggatgggcttgacatcctccgtgatccta

SEQ ID NO: 13949 - DNA, 101 bp, rice(Oryza sativa)
  misc_feature (71): n=a or c
tgatcttaactgaaactctttgaatcttcttatgttttggtttggtttcttgtttctgtcagaacgaggcnctgaatggaggtggcacgctgttcgtgaac

SEQ ID NO: 13950 - DNA, 101 bp, rice(Oryza sativa)
  misc_feature (71): n=a or g
aggagagagaactggctatatcggaaattattaaggactcatgggaaagtgctggagataagagtaccctnggaggcattaagtctgctttgagcaaagta

SEQ ID NO: 13951 - DNA, 101 bp, rice(Oryza sativa)
  misc_feature (71): n=a or g
ccatgactcgggtggtggcgaggagagtgtcagagaagtggcgcgaatggatgagttcgaatttgaatggngtttcccgggagagccctacgcgttcatgg

SEQ ID NO: 13952 - DNA, 101 bp, rice(Oryza sativa)
  misc_feature (71): n=t or c
tgtgtagttttactttgcatgaacatttattactacaaaatgccatcaattgatttgggacagaaggtganagaatattcttgcagggtgaataaccatgt

SEQ ID NO: 13953 - DNA, 101 bp, rice(Oryza sativa)
  misc_feature (71): n=a or g
ggcagatgaactgagccatgtactcctcatcatcgaaatctttgctgcgatcgccatttttctccatgtcnctgtcttcccagtcactcgtagggctaaca

SEQ ID NO: 13954 - DNA, 101 bp, rice(Oryza sativa)
  misc_feature (71): n=t or c
tcctctccactccgggtaagctaaatcaacaaccttgccactgcttttgacctcctttgtctccattcccnacctctccattgtcggatctacatcacttt

SEQ ID NO: 13955 - DNA, 101 bp, rice(Oryza sativa)
  misc_feature (71): n=t or c
caaggaacgcaaccgcgccgtgctttctggatatgtgttgctcaaacacatcccctcatcattgtaagtgntgtatcatattcttgactggatattttata

SEQ ID NO: 13956 - DNA, 101 bp, rice(Oryza sativa)
  misc_feature (71): n=a or g
ctcaagcttgttctcatactggcttgaagcatgaagacaactatgaacaatgagagtggtgagcacggagncaatcagtgacggtgatcggcaacgaatct

SEQ ID NO: 13957 - DNA, 101 bp, rice(Oryza sativa)
  misc_feature (71): n=a or c
agagaagagaagtggccttgttagaaaaaggtccgatgtctagtgtcctgacaggatgcttcatgattacnaaaaacaattgacaagcacatgtttgtgac

SEQ ID NO: 13958 - DNA, 101 bp, rice(Oryza sativa)
  misc_feature (71): n=t or c
gtgcaaaccctggctgatatgtattgatacgtatgtgtgtgcaaaagaactctcagtgtagtcgctttacngcgagttgcatgtgcagttatgggaatatc

SEQ ID NO: 13959 - DNA, 101 bp, rice(Oryza sativa)
  misc_feature (71): n=t or c
ggcgtggtatcaccgccatctcgaaaccactcgcccaagcagagaaatgacctgaaattacgggtgaaaanggtatggaaatttcccgactgtaccgatac

SEQ ID NO: 13960 - DNA, 101 bp, rice(Oryza sativa)
  misc_feature (71): n=t or c
gagcagatgaagagcctggagttgttcgatgtggatgcaagctttgccgctgttctgtcatcgtctatatngaaaatgagccacctgcaacgcttggggct

SEQ ID NO: 13961 - DNA, 101 bp, rice(Oryza sativa)
  misc_feature (71): n=a or g
catagaagatgctttgaagctttagatctaaccttacgtgatttgctttctgaacagacaccttctaacantatagttccattcggtggtaaagttattat

SEQ ID NO: 13962 - DNA, 101 bp, rice(Oryza sativa)
  misc_feature (71): n=a or g
gaagacgaagatgcaggaggaggtagtcgaccgcagcagcaacactggcctataccgggcaagaccttgcngcgggagccagcagggttcaagccgaggtc

SEQ ID NO: 13963 - DNA, 101 bp, rice(Oryza sativa)
  misc_feature (71): n=t or g
cttattttggactgtgtgtgtctcgcagtaagtgttgttgttacggttgggaatggagttgaaggtcatcnctatagtttgcagcgacatgatattcattg

SEQ ID NO: 13964 - DNA, 101 bp, rice(Oryza sativa)
  misc_feature (71): n=a or c
tcttttgtaggaaacaatgaaagttcttctagcattctggtggatggaaatgctgatcatgtcaagaaaanagtttctactaagacgccctgcaaaaatgc

SEQ ID NO: 13965 - DNA, 101 bp, rice(Oryza sativa)
  misc_feature (71): n=t or g
ccactcgcgcaccgggccgtggtgatgggcccgagtccgactcgaacccgatctcctctcctctctctctnctcgtcgtgcgcctcctccccgcggcgacg

SEQ ID NO: 13966 - DNA, 101 bp, rice(Oryza sativa)
  misc_feature (71): n=t or c
tgctggattgtagaggagcacccataatagcacgtctcaagagatataagtttcggttgaatctcgttaanaaatattgtgtcttggtgtcgtcttcagta

SEQ ID NO: 13967 - DNA, 101 bp, rice(Oryza sativa)
  misc_feature (71): n=t or c
gcctggactttttattggcaaaaccatttgcagttggtcgtctaaacatagcattttcgctggtggtccgnttaagagatcctcgtgcaaaaagttggttt

SEQ ID NO: 13968 - DNA, 101 bp, rice(Oryza sativa)
  misc_feature (71): n=t or g
aactaagctggccacacctgcaaatggacagactaagaatggtccagtttggacagtaaattgtccgagtngtaattaaatgagaacccaggggcctaaat

SEQ ID NO: 13969 - DNA, 101 bp, rice(Oryza sativa)
  misc_feature (71): n=t or c
gcatctcccctctattgggtcggatcttacgggccgcttcctctggaccaaacaattcagtaaggttattncaagtcttgtcacatcggatatttggacac

SEQ ID NO: 13970 - DNA, 101 bp, rice(Oryza sativa)
  misc_feature (71): n=t or c
ccgaagaatatcatcaactctgccctcttcatcagattcattgtcagacgacccaggaagaggagctttanggtccaagtcagcccaaccagcgaagcggt

SEQ ID NO: 13971 - DNA, 101 bp, rice(Oryza sativa)
  misc_feature (71): n=t or c
catttgtgaggacaatgtcctattttcttcccttttttcccctgggagaagtatttgtcggttgttaaatntcttcatgtttacatgttttgaattttttt

SEQ ID NO: 13972 - DNA, 101 bp, rice(Oryza sativa)
  misc_feature (71): n=a or g
ctatacgtacggacgtctaagacaccgccacatgtggatacctgacaggtgaatcatttgatcactgaacntcatcaagataatgttaaaccccacttgtc

SEQ ID NO: 13973 - DNA, 101 bp, rice(Oryza sativa)
  misc_feature (71): n=t or c
cctatatcagcagtgtgttactattggtggtgatagagtaatagagttactacctccgtcccatacttgtntttttaagtttttgtttatagttttttgat

SEQ ID NO: 13974 - DNA, 101 bp, rice(Oryza sativa)
  misc_feature (71): n=a or c
tagccagcgtaaattgcgtgcaaaatcccctattttgattgaaagaaatacctgcttcatgacgttccacntcattaatagattgggttactacttcgcct

SEQ ID NO: 13975 - DNA, 101 bp, rice(Oryza sativa)
  misc_feature (71): n=a or c
gtaaacgctaggtcaacattgtacgtcaaggtgcagagtacacacctgcttcctccatcaaagaaaaaaancacttttggttatgcaattggagcaaccgc

SEQ ID NO: 13976 - DNA, 101 bp, rice(Oryza sativa)
  misc_feature (71): n=t or c
gtattaacttcatcaatttcaagatgtgttggcgtagtccggaggtactcatagtgataagatgtgtgcgngtatattcatagagggaagagtgtgtccat

SEQ ID NO: 13977 - DNA, 101 bp, rice(Oryza sativa)
  misc_feature (71): n=t or c
tattcacgtacggactgaaaaaggaaaaactagagataacatgtgtttttgttgtcgacccgatccggacngtctgtatgaaaacataacatattttattc

SEQ ID NO: 13978 - DNA, 101 bp, rice(Oryza sativa)
  misc_feature (71): n=a or g
agtttagcattgactaggctaggctgttactgtagagtgtagaagctaaaattagctttactgaggataanaatctctgcgagaataactttgtgatttgg

SEQ ID NO: 13979 - DNA, 101 bp, rice(Oryza sativa)
  misc_feature (71): n=t or g
ctcgtgcaattgcaaaatatatactccacttcgcaaaagcgcatcagacttgctgaaggaaagcaacctcncgcagtctgcaataatggtcgatgtgtggc

SEQ ID NO: 13980 - DNA, 101 bp, rice(Oryza sativa)
  misc_feature (71): n=t or c
gtattgattactgattttcttgaacaagctcaacattttactgttcgacgtagctttcctcatgcaactgnggttggcctgttcaagtttgcgtctgctgt

SEQ ID NO: 13981 - DNA, 101 bp, rice(Oryza sativa)
  misc_feature (71): n=a or g
aaacaataataagatgaagaaaaaaaaacagatcagaccgggaagcagtacgcatgcatgcagttagatgnaaaaaaaacaataatcaatcaataagatgg

SEQ ID NO: 13982 - DNA, 101 bp, rice(Oryza sativa)
  misc_feature (71): n=t or c
cgggcattgccagatccaccctactgttgccgtcatcgtcgttgttgtagtcatcaaggatccactcatcncacggtcatcagtgatggatccacacactg

SEQ ID NO: 13983 - DNA, 101 bp, rice(Oryza sativa)
  misc_feature (71): n=a or g
ttttaaaaataattttttatttacaaaactaatcgcccatcactctttgatagggcaacttttaaaaatcncccctccaaaggacaatttatccaacatgg

SEQ ID NO: 13984 - DNA, 101 bp, rice(Oryza sativa)
  misc_feature (71): n=a or c
gcgtaaaaaaaattaatgtttcaccacatttccataccttcaaaatgtcgtagtcaacccattaaccacgngtacgtacgccaagaactgattggtaataa

SEQ ID NO: 13985 - DNA, 101 bp, rice(Oryza sativa)
  misc_feature (71): n=t or c
gcagccctcgccatctgtaatcttgaacgcgcttggtcgtaagacttgcaccaccatgtatggtccttccnatttgggcgagagcttattccgccctgctt

SEQ ID NO: 13986 - DNA, 101 bp, rice(Oryza sativa)
  misc_feature (71): n=a or g
accttccaacaggagtgcagacgagaaactgtagattgcagagagcaggctgcaatctcctgttatatggngacacgatccgaccagtgtacgttacttca

SEQ ID NO: 13987 - DNA, 101 bp, rice(Oryza sativa)
  misc_feature (71): n=a or g
tcattcaaaaaccttatcaacctacagtttttagatatcaggtccagctatgtggaagagttgccgttggnaataactttgttaactaatttgcggaactt

SEQ ID NO: 13988 - DNA, 101 bp, rice(Oryza sativa)
  misc_feature (71): n=t or c
aacttttattacttatagactgcttgcaacgaatgaaggctcatacccttaagggataaaaaaagtttccngtgttgagcaccctttcaatataatcgtat

SEQ ID NO: 13989 - DNA, 101 bp, rice(Oryza sativa)
  misc_feature (71): n=a or g
ggtgctgttgaagctggacatcgctcaggcctttgactccatctcatggcagttcattctcgaagtgctgnagcataaaggtttcggcgttcgatggcgct

SEQ ID NO: 13990 - DNA, 101 bp, rice(Oryza sativa)
  misc_feature (71): n=t or c
ttgaatgttttcacaaatgctgcccactcaagatagatgccatcaactaggtagtaacccatgtcatactnattgccattgacggtaaaatgaacctccgg

SEQ ID NO: 13991 - DNA, 101 bp, rice(Oryza sativa)
  misc_feature (71): n=t or c
ccaagaattcagagtcaagagaccaaggagcaggcacttacatgagcaataggaataggccatcttgtggngaactcgtaaggcagctctggaggcttcgc

SEQ ID NO: 13992 - DNA, 101 bp, rice(Oryza sativa)
  misc_feature (71): n=a or g
gctgcatatatatgcaaggggcggtcaagttacagaatgccaaaaaacacaaaaacgacaatgcaactcanccattgatttgtgtgatccttcaatttgca

SEQ ID NO: 13993 - DNA, 101 bp, rice(Oryza sativa)
  misc_feature (71): n=a or g
tatttcagaacagcagaaccttgaagttggtggtacctgcacagtggaatctgtaaaggagttgagcaatngcaagaaaattgaagaccaaagtagagaga

SEQ ID NO: 13994 - DNA, 101 bp, rice(Oryza sativa)
  misc_feature (71): n=t or c
aggtggtgaccaacgagttatacttcgttagcaaccggttgtattcacttaattaaccactagaagatacntcctccgtttcccaatataagtcattctag

SEQ ID NO: 13995 - DNA, 101 bp, rice(Oryza sativa)
  misc_feature (71): n=t or c
atgacctttgttgatctggtagctgctgaggacgcaatcggtgcaacctacatctacaatcctatacagcncatggtaacgcccgccaagtgtttgacaaa

SEQ ID NO: 13996 - DNA, 101 bp, rice(Oryza sativa)
  misc_feature (71): n=t or c
ggaaaagtggatcccttcaaggagggaatgatgccaatattcgacaattcgttgtggtgatctgtgcttgnggtctggccaaaaactttgcatcctggatg

SEQ ID NO: 13997 - DNA, 101 bp, rice(Oryza sativa)
  misc_feature (71): n=t or c
tgtaagcctccttcagctgtgtaaattcagttacctctgtttctgaactctgaagggcgttcaatctcgangatttggtcccggaactgtggattgggaag

SEQ ID NO: 13998 - DNA, 101 bp, rice(Oryza sativa)
  misc_feature (71): n=a or g
gaggacacattgtcccaaagggcccgaagagagagtgaacttctaaaggttattgaagatgcaaaatgccntgagcatgatttggaaaatgaactggcaaa

SEQ ID NO: 13999 - DNA, 101 bp, rice(Oryza sativa)
  misc_feature (71): n=t or g
ataccctaaacaggagcacatcacatgcatgtcgacctgagaccaccaattaactgattaagttggcattncagatgcatccgtcagttacatgatcaggt

SEQ ID NO: 14000 - DNA, 101 bp, rice(Oryza sativa)
  misc_feature (71): n=t or c
tctgacgggacaccgtggcaagctgccagcggttcataatcaattttgtttaatgctgttcatggtgacanacctagtgtgctttctttttttcccagaca

SEQ ID NO: 14001 - DNA, 101 bp, rice(Oryza sativa)
  misc_feature (71): n=t or c
tctcacttctcagtgtggcaaaatggcgagtcttacaaccactccacatcattgtatataggaaaaagtangaattacccgcctgaagtattgcggtcgtc

SEQ ID NO: 14002 - DNA, 101 bp, rice(Oryza sativa)
  misc_feature (71): n=t or c
atctttggtgcaaaccaaagattgcacgatttcaggatctagacgattgtgaaatggatcaataacacgtncgcctgcactaaatgctgattctgaagcta

SEQ ID NO: 14003 - DNA, 101 bp, rice(Oryza sativa)
  misc_feature (71): n=t or c
aaactaacacagcctaaggtcagttcatattaagctgctagacagtccggcattataacaccggtttatcnagttgtagtcatctccaaaggattttgcaa

SEQ ID NO: 14004 - DNA, 101 bp, rice(Oryza sativa)
  misc_feature (71): n=a or g
agtctaatttctattattatggcagaatgtaaattgggatacttttgattgggctgtgcaagggatacttnaacattttgttaaaaatcagagggacacaa

SEQ ID NO: 14005 - DNA, 101 bp, rice(Oryza sativa)
  misc_feature (71): n=a or g
aagaaacccaatgtgacattctgatgctgaccttccctttgtcttaattttagaaaaaaaaaaggcatctnaatttgcgtggatttatcttatatattttt

SEQ ID NO: 14006 - DNA, 101 bp, rice(Oryza sativa)
  misc_feature (71): n=t or c
cactgcttttttcccctaaaattatcttcttgcagtgggatccccttgatctcgagtaagtatcagcaganatagtcgattcttaatcgctcccctgggtg

SEQ ID NO: 14007 - DNA, 101 bp, rice(Oryza sativa)
  misc_feature (71): n=t or c
gcttaggaccgattttaccatggtaatgcgacctatcggttccatttgctcagccttccacgtcggtagcnggttagtgactttgtcgatgagtgttgcag

SEQ ID NO: 14008 - DNA, 101 bp, rice(Oryza sativa)
  misc_feature (71): n=t or c
attatatggggccttttatgcaaaattacacctcgatgacatgtggggtcaccggcctagtgggtcccacntgtaagtctctctttccgtcacaagggcat

SEQ ID NO: 14009 - DNA, 101 bp, rice(Oryza sativa)
  misc_feature (71): n=t or c
tccccactgctgcttccgtccgcttccgattccaagtttccaactccctccattgctcgcctcgccgcgcngcgcgctacctaaaccccgcggcgaggctt

SEQ ID NO: 14010 - DNA, 101 bp, rice(Oryza sativa)
  misc_feature (71): n=t or c
tttctcgcatacggccaggccaaccgcatgcggaaaccctttttgcagcagtgtcacttttctcattctcnattaatgcatgcatatatagaaaatgcaca

SEQ ID NO: 14011 - DNA, 101 bp, rice(Oryza sativa)
  misc_feature (71): n=a or g
gatcgagggagctgattaatcaactagctagcttgcaaaaatggcgtccaacaaggctttcgttgtgttcnctctcctgatgctggtggctgcatctgcca

SEQ ID NO: 14012 - DNA, 101 bp, rice(Oryza sativa)
  misc_feature (71): n=a or c
gtatggaactagagttagacgcctcgagttcaaatccttgctagtgggcaattaaataaaaaaactacagngcacttctattctacgctagatacttgagg

SEQ ID NO: 14013 - DNA, 101 bp, rice(Oryza sativa)
  misc_feature (71): n=a or g
gccccgcggccgatgaggaagacatcctggcctatcacactgcgcgggcatgcatgaacaagaagccgtcncaatgcagcggggtcaggggcaacagcagc

SEQ ID NO: 14014 - DNA, 101 bp, rice(Oryza sativa)
  misc_feature (71): n=t or g
acaaaggaaaagcgagaaaggttgggccaagcttgttagttaggaaggcatttgttacgatgggttgtggnccggcccgcaacaatattgtggcccgttgt

SEQ ID NO: 14015 - DNA, 101 bp, rice(Oryza sativa)
  misc_feature (71): n=a or g
gcctccaatttgaggcccccatggaacagtgtgggtagtgagatggtgagatggtgagaggagaggagacnaggaggaggcagcggcggtagactagtgga

SEQ ID NO: 14016 - DNA, 101 bp, rice(Oryza sativa)
  misc_feature (71): n=t or c
ttaattcatagcataatgcccgtgcttcgctacgggtaaacaaaatttcatactaaggccctgtttagtgnccacgcaaaaattttacaccccgtcacatc

SEQ ID NO: 14017 - DNA, 101 bp, rice(Oryza sativa)
  misc_feature (71): n=t or c
tcggcctgtgccctggcacattcctcgactccccgaagaccttgaagcagctcctgaatcagttctttttncttcagtaaagacgagtaaaggctttgaag

SEQ ID NO: 14018 - DNA, 101 bp, rice(Oryza sativa)
  misc_feature (71): n=a or g
tcgcaggatgaagagcatccttcctgaggttataagtgatcagtgcttttgttccaggtagattaattacngataatattctgattgcgtatgaatgtatt

SEQ ID NO: 14019 - DNA, 101 bp, rice(Oryza sativa)
  misc_feature (71): n=t or c
actgatggatcggcttcactgatgcaacatcttactgaacaagtagacaaaattgatcagtggcaatcacntgaacctgataagcaagtaaagaggcaatt

SEQ ID NO: 14020 - DNA, 101 bp, rice(Oryza sativa)
  misc_feature (71): n=t or c
ttccggagcttgtcaaattttaccgttacaagtaaatcagaggatactcttccgagcatcagcatagccanggcgttaaagcccggacctgttgtcgcgta

SEQ ID NO: 14021 - DNA, 101 bp, rice(Oryza sativa)
  misc_feature (71): n=t or c
gagtttctgtttcatccttgtaacgttagctcagtgtgtctaatgtatcctgctgtgataatggttccatngaaatagttactgggtccaatttgttggat

SEQ ID NO: 14022 - DNA, 101 bp, rice(Oryza sativa)
  misc_feature (71): n=a or g
gagaaaaatttaatcttcatatgatcaaatcaacatgcaacgcacggttatgctacaacagggagttaaanattgtagtttttgttagtaaaaaatatata

SEQ ID NO: 14023 - DNA, 101 bp, rice(Oryza sativa)
  misc_feature (71): n=t or c
aagatgagcacggttttatatctgaaactgaaaatgggtctgttggtcataaaacttactacctccgtttngaaatatatcaaactagcttgtattagatt

SEQ ID NO: 14024 - DNA, 101 bp, rice(Oryza sativa)
  misc_feature (71): n=t or g
attgacatccacattcaagactactagttgtcatctgcaacttcgaaagcagttgtgaattcaaccttcangccctgtttagattggactaaaacttttaa

SEQ ID NO: 14025 - DNA, 101 bp, rice(Oryza sativa)
  misc_feature (71): n=t or c
acatctcatcaaatgtaattatctgcgtctggggatggaagatcgaaatattttagctgaactgtttgcangcatgatgctttagcacaccttactgtaat

SEQ ID NO: 14026 - DNA, 101 bp, rice(Oryza sativa)
  misc_feature (71): n=t or c
ctgaaaaacattgacgagggtgcccttcgtttgaaagacatcaagcaatctgcagccttcaacttaccaanagtctcagatactaaaagtgtgcgaacctt

SEQ ID NO: 14027 - DNA, 101 bp, rice(Oryza sativa)
  misc_feature (71): n=a or g
atcggcagacacatcaaaatgtgactcaagtcatccctgagcatatggtacacacggtacaaccagatcantcggttgcagcccaaattatccctgagcac

SEQ ID NO: 14028 - DNA, 101 bp, rice(Oryza sativa)
  misc_feature (71): n=t or c
acggaaaaacaggaaacgaggctccattgccatctctaataccactggccatggcatgggatgtttctttntagaggggtaagcatatgaacaatcaaata

SEQ ID NO: 14029 - DNA, 101 bp, rice(Oryza sativa)
  misc_feature (71): n=t or g
aaacgatatcataggataggattagagttcagggtgctgcatcgacgttttcaaatcatagggggtatttngacttaaaaaaaaatgaaaacgcgaatata

SEQ ID NO: 14030 - DNA, 101 bp, rice(Oryza sativa)
  misc_feature (71): n=t or c
atgtccagtgcccaggctgaaaacacttctggcactgggtatatgcgccaccagaagaagaagaagtttgngcagcttttggtttcactcccagtatcaca

SEQ ID NO: 14031 - DNA, 101 bp, rice(Oryza sativa)
  misc_feature (71): n=t or c
cagctatcgattgttacgatctagaacaaatggggaccgttatgcaaaagagcccataaaacgggcctcanaatttaccgaccataggcccataatggtaa

SEQ ID NO: 14032 - DNA, 101 bp, rice(Oryza sativa)
  misc_feature (71): n=t or c
ggcgaactccgtggagaattcctgctgagcctggtgaagcccacaagaaaatttgtagttcatcaacaaancttcaattgtgctttttatggaggccaaca

SEQ ID NO: 14033 - DNA, 101 bp, rice(Oryza sativa)
  misc_feature (71): n=t or g
gtgtaggaaagttgaagaagtgctaagtaacgaagttgagttgcagatccagggggttgaaaaaccttccntatggagactctatggtgttcagtttatac

SEQ ID NO: 14034 - DNA, 101 bp, rice(Oryza sativa)
  misc_feature (71): n=a or g
ctcatgataccaaattatttctaattattagatctggctggatgggacggacattgttagatccgaaaatnatttggtaccatcgtgaggtaccgatattt

SEQ ID NO: 14035 - DNA, 101 bp, rice(Oryza sativa)
  misc_feature (71): n=a or g
atatggcttataagaatgaaattttgcttaatctaattgctgacatggacacgattacattacctgagacntcatcaaaagtattttggtgggttgtaaag

SEQ ID NO: 14036 - DNA, 101 bp, rice(Oryza sativa)
  misc_feature (71): n=a or g
gctctttaaaaattatatatataatcagttaccaatagatgcgacgaaaaagagagttgatgggaagtacnggctgtttttgattaaagccaaaacatgac

SEQ ID NO: 14037 - DNA, 101 bp, rice(Oryza sativa)
  misc_feature (71): n=t or c
ttagtgcgaaggattatatacgacgtgttaaatttttgttccaaaccaaccgggctagatagtaaggggcnagacgcttttttaatcgggactaaaaatga

SEQ ID NO: 14038 - DNA, 101 bp, rice(Oryza sativa)
  misc_feature (71): n=a or g
tggcggtttgcgttctcgggatattcatgatacccgtctggaagaacttgcgtactgcaccgacaacatcntctttcaaggtctcccaattcctcttataa

SEQ ID NO: 14039 - DNA, 101 bp, rice(Oryza sativa)
  misc_feature (71): n=t or g
gggagtaggtgacaccaaaactggagagtgctgcttttttagttcttcaccaaataaaagtcttgcgtatncaaaatcataatatgaacataccaagcaat

SEQ ID NO: 14040 - DNA, 101 bp, rice(Oryza sativa)
  misc_feature (71): n=a or g
agcaaaacgagagagagatagtcgggagagatttgttttctttcattttcaacttgtcagatacactacancagctgtagctttatatagccagcactcat

SEQ ID NO: 14041 - DNA, 101 bp, rice(Oryza sativa)
  misc_feature (71): n=t or c
attggccttgttggttaagagagctaatgcagatgaagccgaacaagcgaggtctatcactacaataattnagatggatgaacctcttgaaggctaaataa

SEQ ID NO: 14042 - DNA, 101 bp, rice(Oryza sativa)
  misc_feature (71): n=a or g
tcttcacaccgaattcatcaaagcgaaggaagccaccatctccagaggcgattcgcaggcgcgattgctcnccgagatctgcgcgaaactcgacgcgatct

SEQ ID NO: 14043 - DNA, 101 bp, rice(Oryza sativa)
  misc_feature (71): n=a or c
ctttgacagaacaaacctgaattatgaggtgattggcaagacaaaaactccacagaagcagctgggtgatntcctaaaagagcgtttcatgaacatgtctg

SEQ ID NO: 14044 - DNA, 101 bp, rice(Oryza sativa)
  misc_feature (71): n=t or c
atagtgaaaatatgaaataatcatcctgcatttcttcagttgtcgccatacttctgtgaaaatttcccttntaatctcaatcccgtggagatatgttttgt

SEQ ID NO: 14045 - DNA, 101 bp, rice(Oryza sativa)
  misc_feature (71): n=a or g
gcgggagctcataaagttatactgccctaatgagtttgaccaccatagccttttctctggatggatactcngcaacatagatgaacatgatgacctacagg

SEQ ID NO: 14046 - DNA, 101 bp, rice(Oryza sativa)
  misc_feature (71): n=t or c
cctgtctgctcctatttcagtgttcttttgtccttttttcccacctgtctgctctgcttctcttttttttntgactatttgttacactctttttctatagg

SEQ ID NO: 14047 - DNA, 101 bp, rice(Oryza sativa)
  misc_feature (71): n=t or c
atcgggcggagaggaggcccaactcgggaaaaaggagaaacagaaaagaggccgaaaaggcgaaagggatngatgaggtggggaccaccggaccagcgaga

SEQ ID NO: 14048 - DNA, 101 bp, rice(Oryza sativa)
  misc_feature (71): n=t or c
catgggtctctgctgttcacatcaagacccgatccagcgaccgtctatcgtgcaagctatggatgttctgngatctgcagacgcagagttgccggtacctc

SEQ ID NO: 14049 - DNA, 101 bp, rice(Oryza sativa)
  misc_feature (71): n=t or g
tagggcaccggcggtttgggatttgtgaaggaggaaattacgatatcggccctgtctattttatgcccacnagtaaaaggctgggccgggacgccgagcgg

SEQ ID NO: 14050 - DNA, 101 bp, rice(Oryza sativa)
  misc_feature (71): n=t or c
tggaccggtgacccagggacttgagcggttcgatcaccgattcggttttttcaactatgcatatatactcnctctatcctaaaatgtttgacgccgttgac

SEQ ID NO: 14051 - DNA, 101 bp, rice(Oryza sativa)
  misc_feature (71): n=a or g
tgtcatagaagttagactttgaaaaaaaaaataagaacctccatggcaaaaattacaagttactccctccntcctaaaatataagcatttttaatacagtg

SEQ ID NO: 14052 - DNA, 101 bp, rice(Oryza sativa)
  misc_feature (71): n=a or c
acttgttatgtcacttcaccactctgttttgtcctctcttttttttttctgcctacgaaggaaagtgaccnaatcagattagaacaaaggagttaaaaggt

SEQ ID NO: 14053 - DNA, 101 bp, rice(Oryza sativa)
  misc_feature (71): n=a or g
ggcagcgtacgtatagctgcaacaggcgcaacacccctacgacgccaaggagatacaatcagcggatgcancgatggtcgccgagctcaccaagctctccg

SEQ ID NO: 14054 - DNA, 101 bp, rice(Oryza sativa)
  misc_feature (71): n=t or c
cagcaagagcacttcttttttttcaattcctgtagacgactataagaatcagaaaacagagggaggtaatnatatataagctcaaaaattccaaagaaaaa

SEQ ID NO: 14055 - DNA, 101 bp, rice(Oryza sativa)
  misc_feature (71): n=t or c
tgatacaattcgtaatcaagcaacagtctacaaataaagtcgctgtagccatgtaggtgtggactttcgancaaaaaattattttatgcaaacatgtaact

SEQ ID NO: 14056 - DNA, 101 bp, rice(Oryza sativa)
  misc_feature (71): n=a or c
gttatactcatcttctttgaattcctttcttctgtatatataactgcattagcgttttcaggcgaaagcangaagatttgaaactgttgtgcatgatattt

SEQ ID NO: 14057 - DNA, 101 bp, rice(Oryza sativa)
  misc_feature (71): n=a or g
attcacctggagatggaggcataccgctcgatctggtggattgattgttcaagcctccccattgtatttcntgaggcgaccgccatcggctttcactggca

SEQ ID NO: 14058 - DNA, 101 bp, rice(Oryza sativa)
  misc_feature (71): n=a or c
tggcagcaagttaatacggtgaacatgccatgctttgatcatatgtgtcctggctttgtacaagtcagtangagtgttggtattggtgggagaattgaacc

SEQ ID NO: 14059 - DNA, 101 bp, rice(Oryza sativa)
  misc_feature (71): n=a or g
acactgtgccacatgcatatatatcggtttcagcccggttacaagtttatgacacaccatacttcgactcnatactagtacgttgtaagtacgtacttgta

SEQ ID NO: 14060 - DNA, 101 bp, rice(Oryza sativa)
  misc_feature (71): n=a or g
tgattccttggtgatcggtgttggtggtttcggcaaggtctacaagggagagatggaagatggcaagctgntggcaatcaagagggggcatccagagtctc

SEQ ID NO: 14061 - DNA, 101 bp, rice(Oryza sativa)
  misc_feature (71): n=t or c
tttattcttgtcattggtagggtacaaagtatggtacctgtacgtaccatggatgatgggaacgagcgagngagaaaagagaagttcatgtagtaatagta

SEQ ID NO: 14062 - DNA, 101 bp, rice(Oryza sativa)
  misc_feature (71): n=t or c
attgaattgcaaaaacgaattccttgcattcttctcgttccgtttttgcggttttcgatggattccgtcancgccgacttggagtcgccggcggacgccga

SEQ ID NO: 14063 - DNA, 101 bp, rice(Oryza sativa)
  misc_feature (71): n=t or c
gggctgctcatgttgaccaacaacacaaacaagcaaaggccatgccttgtactagtgcctgccacttcagntccacaagatgcccaatagcacggggaatg

SEQ ID NO: 14064 - DNA, 101 bp, rice(Oryza sativa)
  misc_feature (71): n=a or g
aacgtgacgtactgacgtactgactagattttagatttctgtcccacgtaacatttatgcggcacatacantaagaatataccacctccgttttttaatag

SEQ ID NO: 14065 - DNA, 101 bp, rice(Oryza sativa)
  misc_feature (71): n=a or g
tcctgcgccagctgcaccaatagaaaactgagactgcacaggaccatgcataaaatcatgtgtttcctccngtgaaacgctttcttctctgctggcgctac

SEQ ID NO: 14066 - DNA, 101 bp, rice(Oryza sativa)
  misc_feature (71): n=t or g
aatggtaagccgcagctcatcggcagaaaaagctctatcattcattccattagaagaaaggtctagatganaggctgatgcagaatagtccaattcgaaga

SEQ ID NO: 14067 - DNA, 101 bp, rice(Oryza sativa)
  misc_feature (71): n=a or g
catcgacttcctcctcctgagtatcaatccactgatcaggttcctccactgcgtattgtgattcgactccnctggctgctcaacggaggagctctcatcgg

SEQ ID NO: 14068 - DNA, 101 bp, rice(Oryza sativa)
  misc_feature (71): n=a or g
attagtgtaaccggaggcatagaaaatgtgttacctccaggaaaccgttaagaagcactataaaattagcntttttttgttataatataatttattatcaa

SEQ ID NO: 14069 - DNA, 101 bp, rice(Oryza sativa)
  misc_feature (71): n=a or g
gttttcgagccctttcgcttagctttcgcccttcttgctctgcttatacccttcgacccaatggcgccctncaaacccgctccggctgcgataactggccc

SEQ ID NO: 14070 - DNA, 101 bp, rice(Oryza sativa)
  misc_feature (71): n=t or c
tataggtgagtgagtagagaagtaaactatagtgtggagcaagtgggtgtgaaagctataagtgtcccatnccccatggtgtgattttggtgggtttttcc

SEQ ID NO: 14071 - DNA, 101 bp, rice(Oryza sativa)
  misc_feature (71): n=a or g
agagattaaagtgaacttatttccaatatataatggatgaacatattacgtccgggcaggggtggaaactntcacggaaattcccaatcgaccgagcgccg

SEQ ID NO: 14072 - DNA, 101 bp, rice(Oryza sativa)
  misc_feature (71): n=t or g
tactagtaacacgctgccttgccacaattcaccgaacaaaccggaacttcattgtggtaacattttttttntgtgtgtgtatggagtagtatgggtgtaaa

SEQ ID NO: 14073 - DNA, 101 bp, rice(Oryza sativa)
  misc_feature (71): n=a or g
gagcagggaggcagcttccgatcgaccacctttccgctttcgcttcttttgaaactgtccaattttctganaaatcttggaactagttgaaactccaaata

SEQ ID NO: 14074 - DNA, 101 bp, rice(Oryza sativa)
  misc_feature (71): n=a or g
caccccattctctaccatttgtgtagttttcccaaatcgaagttcaattatgcaaacatgcatttgctctncttatatttataagccaaaatttaaataga

SEQ ID NO: 14075 - DNA, 101 bp, rice(Oryza sativa)
  misc_feature (71): n=a or g
tgtactgaagaacaaggacctggagcatggacaaggagccaatcgcagtgggtattagccctgacagactnttgttgccaatgttgagataggctaacaaa

SEQ ID NO: 14076 - DNA, 101 bp, rice(Oryza sativa)
  misc_feature (71): n=a or c
gataggcccctcacggataaccaacattcatatggggtgtgatttgcccgttaaggtcattagtgacggcncccgttacctatgagggtcatccgtgacga

SEQ ID NO: 14077 - DNA, 101 bp, rice(Oryza sativa)
  misc_feature (71): n=t or g
cacaatattcgcgtaacatccacgagcgaatcaaaggcgtacttgtagtgtaaatgctatgtttatctganataacatattttatgattttgagtacttgc

SEQ ID NO: 14078 - DNA, 101 bp, rice(Oryza sativa)
  misc_feature (71): n=a or c
tagattgcccaaagcagctggaatctcacccgataggctgttgaaattcagtaccagttgctggagcctgntgagacggctgagctcctggggtatcttgc

SEQ ID NO: 14079 - DNA, 101 bp, rice(Oryza sativa)
  misc_feature (71): n=t or c
attgcttatgcttttattctttgcagattttactggggtcatagctaatgtggggccaaaggactttagtncggattggcctatgggcgtgagagatgtag

SEQ ID NO: 14080 - DNA, 101 bp, rice(Oryza sativa)
  misc_feature (71): n=a or c
tggaggtctcagtaaaatagcatcaatagcatcccagttacccggtggatccattcggattgacaaggacngaagacctctatggagtttgtcaacctgaa

SEQ ID NO: 14081 - DNA, 101 bp, rice(Oryza sativa)
  misc_feature (71): n=a or g
atcctcatccgatcgagagcagataactaactaattaagcgttggccggaggaaccgggcagttgctattncactcgtcgatggttcggaagggcgagttg

SEQ ID NO: 14082 - DNA, 101 bp, rice(Oryza sativa)
  misc_feature (71): n=t or g
ttgtagcctttgttttttcgttttttcttctcaccctttggcataggcttatatggcggattgtgttgtgnaaaaaaaaacccttttccttctaatatatt

SEQ ID NO: 14083 - DNA, 101 bp, rice(Oryza sativa)
  misc_feature (71): n=a or g
gacagagataaatccatagaacgatctcacaagcatcacgtccaaactacacctttaagcctacccttgcnccaacactcactcctagttcgcctcttcac

SEQ ID NO: 14084 - DNA, 101 bp, rice(Oryza sativa)
  misc_feature (71): n=t or c
ggtcgtgcatgtgaagacatatctgctgcacggcataagagatgcctggcctggtgaaactcaagtactgnagggcgccaacaagactccggtagtcggta

SEQ ID NO: 14085 - DNA, 101 bp, rice(Oryza sativa)
  misc_feature (71): n=a or g
aaccatctggttccgtggacatgcagctgtcaatggtttcgaggctcaagaacgagtatttcatccggctnatgggctactacctggatgcaaaccgaaga

SEQ ID NO: 14086 - DNA, 101 bp, rice(Oryza sativa)
  misc_feature (71): n=t or g
ttagcccgtttcgagtacggcctactttgtttacatatttgggccgtggcacttgcatacatacaagttcncaacggaaactgtacggacaaaaggagcat

SEQ ID NO: 14087 - DNA, 101 bp, rice(Oryza sativa)
  misc_feature (71): n=a or g
tattgtgaaattgatgagttccagcctagaaactgaggaagcaatagtgccatatcatcgttttagtaacnttggtttataaagatgtagacattgattta

SEQ ID NO: 14088 - DNA, 101 bp, rice(Oryza sativa)
  misc_feature (71): n=t or c
atgcagacctttacatgacatgctcaagaaagaggggttccaatggggtgaaaagcaaactgaggcattcnaggaactgaaacaaaaaatgtgtagcagtc

SEQ ID NO: 14089 - DNA, 101 bp, rice(Oryza sativa)
  misc_feature (71): n=a or g
ctgctgtacagtacagttgaatactacagtacgtcagtaccgttcttgcgctgtgttgtggatcggagtantaagttttgcccaacaaggcgccaagtcat

SEQ ID NO: 14090 - DNA, 101 bp, rice(Oryza sativa)
  misc_feature (71): n=t or c
atttacggttagcatgctattgcactgaggaagactcaccaaaatttccagggctgacgacaaactgcatngccgccttgaagtagtcaccatacatgatt

SEQ ID NO: 14091 - DNA, 101 bp, rice(Oryza sativa)
  misc_feature (71): n=t or c
gtcgtgattgtatctgtagtttctgtacagagtagctgaattcctgaatgaatgtctgaattttcccaaanatatttagaggagatttgctccggtccaac

SEQ ID NO: 14092 - DNA, 101 bp, rice(Oryza sativa)
  misc_feature (71): n=a or g
aactttgatttttttcaaaggattgtaacactcattagaatgacaagaaaaataacgaggactcagagacncttgcataactctaatttctgcaaataaaa

SEQ ID NO: 14093 - DNA, 101 bp, rice(Oryza sativa)
  misc_feature (71): n=a or g
cttcagagttcagagttatcagaaactaaagtcaccagccaaaccagcaaccacaaccagaccaccgtgcngtgcaggacaggaggggagagtggcatgac

SEQ ID NO: 14094 - DNA, 101 bp, rice(Oryza sativa)
  misc_feature (71): n=t or c
aaagttaaatagcaaaacccaaaaaaataataatgccctcgtgatcgtacacatcccatccatctacccanggcctgtttagttggagggagtttttagaa

SEQ ID NO: 14095 - DNA, 101 bp, rice(Oryza sativa)
  misc_feature (71): n=a or g
gcttgctgccgctgctagcgttcatcgctgctactgctgcttgctgattgtgtactgcctgcttgttgctncaccagggaagaagagaagaacaggaagga

SEQ ID NO: 14096 - DNA, 101 bp, rice(Oryza sativa)
  misc_feature (71): n=a or g
tctccccgtggtgattattttatctgcatgtcttggcgtctgcacatcgtatgcctctctttagaggaaanatttcattttgtgatgattcactcttggaa

SEQ ID NO: 14097 - DNA, 101 bp, rice(Oryza sativa)
  misc_feature (71): n=t or c
tcgagctacccagaaggtttactgcgctgatctgtgcagggcgagaaacacaacagttaacagttaatgantggtaatcaatttttagctgcatctaaagc

SEQ ID NO: 14098 - DNA, 101 bp, rice(Oryza sativa)
  misc_feature (71): n=a or g
tcacctcagagtaacacactcgaaatagccggtcaaagagacaaagtgggtatgtgatttaaatttgaganaattcaacttgaccttcactcaccctaccc

SEQ ID NO: 14099 - DNA, 101 bp, rice(Oryza sativa)
  misc_feature (71): n=t or c
tttactagttagtggcttcgcaagtctcaaacaatttaagaaacccgagggcggcatccttggccttctcnggtggcggggaagtgggggtgatgggctca

SEQ ID NO: 14100 - DNA, 101 bp, rice(Oryza sativa)
  misc_feature (71): n=t or c
agaccttgttgtggagtactgcatgcttcggatttacctcttgttatgagactcgggtgttacgcttattncggacgaggaggtcctcggccttctgcgct

SEQ ID NO: 14101 - DNA, 101 bp, rice(Oryza sativa)
  misc_feature (71): n=t or c
ataaaaaacgagggaggggttaggaaaaggggatgcaaacagctgcaactacttcaaaaattagaaaatcnaataaacaaattttaggaagctgtagttat

SEQ ID NO: 14102 - DNA, 101 bp, rice(Oryza sativa)
  misc_feature (71): n=a or g
caagcaattcccaaccaaccatgcaaagctagagacataaaagaggcatggaaagggccatggggataggngtgataggtggaaaaagattattccatccg

SEQ ID NO: 14103 - DNA, 101 bp, rice(Oryza sativa)
  misc_feature (71): n=t or c
attacaacttgcttaaaggccattgccaaaacactctctgcatcaggttcgttttcagagaaaaattcagngccaaggtctttctttagcttactggcctt

SEQ ID NO: 14104 - DNA, 101 bp, rice(Oryza sativa)
  misc_feature (71): n=a or g
gcaacttgactgcgaaatggcaagccacattaacccaaaccaaataaccaactagccgtccaaattccatnaagaacccattcagcatagctccagcttca

SEQ ID NO: 14105 - DNA, 101 bp, rice(Oryza sativa)
  misc_feature (71): n=a or c
attgaaaaaaatgttctgacatatcctaatccagttatacttccttatttatgactgacctatatactccnttcgtactaaaatataggacacaattatta

SEQ ID NO: 14106 - DNA, 101 bp, rice(Oryza sativa)
  misc_feature (71): n=a or c
cacgccgcaaaaaaggaaaagaaaagaggatgaaatcttagctacccttgataatgaaacacctgtagtgnatggcaacatttttttaccaccaaatcatg

SEQ ID NO: 14107 - DNA, 101 bp, rice(Oryza sativa)
  misc_feature (71): n=t or g
acaagttaagggaactacggtgtactttttcctacctccttaagctgaaagttagcgaagagagtccaacncagcctctaaatagcgaaatcgctttcgcg

SEQ ID NO: 14108 - DNA, 101 bp, rice(Oryza sativa)
  misc_feature (71): n=t or c
ctttcattcaagcagcatgaatgaatgcactgcatgcagcaggcagcaacaacatcaaagaaaaagaccgngcgcgatgacgtcgaaacgcacaggagatg

SEQ ID NO: 14109 - DNA, 101 bp, rice(Oryza sativa)
  misc_feature (71): n=a or g
ctgtcgatctgcaccgtggcacgtacgtcgatcgatctctccatcatatcacatgcaagcacgtatacacnttactgtacttgctactataccatatagta

SEQ ID NO: 14110 - DNA, 101 bp, rice(Oryza sativa)
  misc_feature (71): n=t or c
tcaaattccaggtcctcagagttactcctgaactccaggcacttgccttctttcttcttcttcgctgtcgngagggtcacaacgtcacagggtcgcgtctc

SEQ ID NO: 14111 - DNA, 101 bp, rice(Oryza sativa)
  misc_feature (71): n=a or g
agccttctcaacaatgaactttgcacgctgagcttcttgttcatcgacctgcttggtttcaattgcatgantgaactcttttctaaagctcttaaaatagc

SEQ ID NO: 14112 - DNA, 101 bp, rice(Oryza sativa)
  misc_feature (71): n=t or g
attttggaaaaagatgtgtaatccttggcaaatcttgagcaaattgatgggggtgctaaagcaaactaganatatatatatatatcaactagataatttct

SEQ ID NO: 14113 - DNA, 101 bp, rice(Oryza sativa)
  misc_feature (71): n=t or c
ccacaaacaaatgatgcaccacaaagaatttttgcagcagctgatttttcctcctctgaaccatttaatgntatgtgatataacctatccaattctgtggt

SEQ ID NO: 14114 - DNA, 101 bp, rice(Oryza sativa)
  misc_feature (71): n=a or g
cagagacgggtagcttcctagctagtaggtgtgttacacactagctagctagtgcagaactcaaggagcanagacactggccttgagttgaaagagatgtg

SEQ ID NO: 14115 - DNA, 101 bp, rice(Oryza sativa)
  misc_feature (71): n=t or c
tactatctttagatgcattgtaattaattaagcagccttgagctttgcaacaaactccagcatgctcgtgnggctcgtgccgccctccgcgacggccttgg

SEQ ID NO: 14116 - DNA, 101 bp, rice(Oryza sativa)
  misc_feature (71): n=a or c
aacaccaaaacggctcaatcggcctggtattcatagtaccctggacgctattcttcgatgggtccgtctgnactcacggatgtggcatcggcttagtgatc

SEQ ID NO: 14117 - DNA, 101 bp, rice(Oryza sativa)
  misc_feature (71): n=t or c
ggggagtcgaatttacgcctttgccctccggccccacacgccaatttcccatttgcatcaaacttttttcnaagtacaggagggctcgtttggtttagtac

SEQ ID NO: 14118 - DNA, 101 bp, rice(Oryza sativa)
  misc_feature (71): n=t or c
cttccttctcgagccgtgggccaaaccgcatcgcggctgagatcctcaagccggatatgatagcacccggngtcgacatcctcgcggcatggtcgggagaa

SEQ ID NO: 14119 - DNA, 101 bp, rice(Oryza sativa)
  misc_feature (71): n=t or c
acgacatatccatcttagcatcacgataaattgttacaggtatcgttagctatatcaccttacattcgacnaagggttcattgggtctctctatgacgata

SEQ ID NO: 14120 - DNA, 101 bp, rice(Oryza sativa)
  misc_feature (71): n=a or g
ttctaaccttggtcgcttgctaccgtctggagaccccggggcaatgcttaaatagacagtgccaacttgcngggctaattaattaatatacttcctctgaa

SEQ ID NO: 14121 - DNA, 101 bp, rice(Oryza sativa)
  misc_feature (71): n=a or c
cagccaccttttgatttgtcttatcacatactaaggtactaactgtgacgagttcttatgtcaggcctgcngttgtttgcaatgtttatgctatagaaccg

SEQ ID NO: 14122 - DNA, 101 bp, rice(Oryza sativa)
  misc_feature (71): n=t or g
atgaatttacgcctttgcctgcactctagtttcagcagttaactctattttttttgtacattaaaagggtnctcccgagaggtggagattagtgaaggctc

SEQ ID NO: 14123 - DNA, 101 bp, rice(Oryza sativa)
  misc_feature (71): n=t or c
gctttcttggatccacatcaacaaaataggatgtctacggtctacctaccaagatcagcgctagtatctanttcctccgtttcacaatgtaagttatttta

SEQ ID NO: 14124 - DNA, 101 bp, rice(Oryza sativa)
  misc_feature (71): n=t or c
tttccaggctctgtcgcagtacctttatcctttggcagcggtgaagtgccctgagacatatttacaatgtntgcacctttctttggcagctcacgcgatgt

SEQ ID NO: 14125 - DNA, 101 bp, rice(Oryza sativa)
  misc_feature (71): n=t or c
tcatctactctgcctgacttacaaagtccatctatcaatgttccgtaggtcactacatccggagttaatcnttgctgcctcattttgctgaatacaaacat

SEQ ID NO: 14126 - DNA, 101 bp, rice(Oryza sativa)
  misc_feature (71): n=a or g
gagatcgatactcgcacgattgcaaaatcatggagcttaattaggaatgccccctcacgtgtctagcggcngaagatcgctaagtagtcacacacctagga

SEQ ID NO: 14127 - DNA, 101 bp, rice(Oryza sativa)
  misc_feature (71): n=t or c
cgccatcggtggatgaaccagtttccttccaagaatcatctgtatcaagaaatgggggaaaaatcgagganggcacaaccaaggagacagtgtcactgacc

SEQ ID NO: 14128 - DNA, 101 bp, rice(Oryza sativa)
  misc_feature (71): n=t or g
aatggagctgcgcctaccaatctattaccagactcagctggcaacctaaaactcttacgctttttgaggtngagatgcagcatagattgccagatcatgca

SEQ ID NO: 14129 - DNA, 101 bp, rice(Oryza sativa)
  misc_feature (71): n=t or c
catgtcgaactgccgaaattcgacaggtgcctatcaaacggcgagtcttcaacaggtggaagcaatcgaanaaaaggagttggactggacctgtcgaacta

SEQ ID NO: 14130 - DNA, 101 bp, rice(Oryza sativa)
  misc_feature (71): n=a or c
atatgccaacgccaactgcataattatccttgccagtaacatcgccgacaaccgataccccattcttgcgngcaacttccatgcaagagcaagggtttgca

SEQ ID NO: 14131 - DNA, 101 bp, rice(Oryza sativa)
  misc_feature (71): n=t or c
gacgtcatctattatataatataagccatttttttcataaaccgtcacttataaactgctataggtgcccnttttttagccacagggtgttcgagtgagaa

SEQ ID NO: 14132 - DNA, 101 bp, rice(Oryza sativa)
  misc_feature (71): n=t or c
tcaaggagctcgaggaggccaagaaggcgtaccctgatgcattcgtccgtatcatcggcttcgacaacgtnaggcaggtgcagctcatcagcttcatcgcc

SEQ ID NO: 14133 - DNA, 101 bp, rice(Oryza sativa)
  misc_feature (71): n=a or g
cagcgtgaggcctggtgacgatgaaccgatattaaccaagctagacaagcctaagtttgtgcttgatcagnaacgacgtgacatcattgatagaattaaga

SEQ ID NO: 14134 - DNA, 101 bp, rice(Oryza sativa)
  misc_feature (71): n=a or g
atggacgcaggagtaggtgggtggatggcatgattcatgtggctggctattgtattagcccaactacattntttcagttagcttttatgaaactgataaat

SEQ ID NO: 14135 - DNA, 101 bp, rice(Oryza sativa)
  misc_feature (71): n=a or g
gctgcacacaatcttaaataccaccataggtctcagaagcagagtaactctcctactgctctgcacatcanttcatctcaaatcccccccccccccccccc

SEQ ID NO: 14136 - DNA, 101 bp, rice(Oryza sativa)
  misc_feature (71): n=a or c
atcatttcagccatggaagtggaattcattccctgtgtctcaggagcagtctggattcatcagtaacagtnattaatgctctggttaatatgtactctgct

SEQ ID NO: 14137 - DNA, 101 bp, rice(Oryza sativa)
  misc_feature (71): n=t or c
gagctcgtcaaaaattcttacctctacaattatcaattgcaagcttggacaggccttgttggtgtgatgcntttcttctcttcctcgtcgtgcggtaggac

SEQ ID NO: 14138 - DNA, 101 bp, rice(Oryza sativa)
  misc_feature (71): n=t or c
ggtgcaagcaattgcaaatattttgctcctcaacattttagtactcctgctctagagagagaaagatagangaacaagaagaagagggtgaggaggagtgg

SEQ ID NO: 14139 - DNA, 101 bp, rice(Oryza sativa)
  misc_feature (71): n=a or g
tttcctaataaattaatttcactacgatgattgtagctagccgatgccgaaaagttgtagtgaaactttcncttgaaaagaaaacacaaagatgaatacta

SEQ ID NO: 14140 - DNA, 101 bp, rice(Oryza sativa)
  misc_feature (71): n=a or g
atgaatagaattattaataatctaacagaaagtatccatagtagtagtcgtccctccgttccaatatacangaaattttgggtggctatgacatattttag

SEQ ID NO: 14141 - DNA, 101 bp, rice(Oryza sativa)
  misc_feature (71): n=t or c
aacaacaatgtcacattgtcacttgaagagtacaatgtattgtgcaagaaagtgcaagatgccgaggactntgctaagaagcaagttattagagctataga

SEQ ID NO: 14142 - DNA, 101 bp, rice(Oryza sativa)
  misc_feature (71): n=t or c
gtggcgccataacgatgcggtgcatgactcacgctcaataatggcataggcgacatgttgcaatgtgaggnatgctgccgtcgctaggcctgccggccccg

SEQ ID NO: 14143 - DNA, 101 bp, rice(Oryza sativa)
  misc_feature (71): n=t or g
tcttcctaccagaacatactgccacgatgtacagaagattattatttgtaaatactgctcacttgttccangttgtaagacgtttttaattttagtcaaag

SEQ ID NO: 14144 - DNA, 101 bp, rice(Oryza sativa)
  misc_feature (71): n=t or c
gccaatgacgacgcaccgaccgtcatttctgacgttaccggttacactcatcaatcgccactaaagatacngttctgattgtggcagtcttcggatcgtgc

SEQ ID NO: 14145 - DNA, 101 bp, rice(Oryza sativa)
  misc_feature (71): n=t or c
gcaacatcatacaccacatgaatttatttgagctttgcctcttggatgccacaatcagcacaacactgctnagtccattgagaaaaggagtggttcaaaac

SEQ ID NO: 14146 - DNA, 101 bp, rice(Oryza sativa)
  misc_feature (71): n=a or g
gaagatgacatatgccgaactgccgccatccacaaggattcgacgtactttaaatctagctatctctgccnaaatgatcagcgggtcttggtgtaggaaca

SEQ ID NO: 14147 - DNA, 101 bp, rice(Oryza sativa)
  misc_feature (71): n=t or g
ctaggacaagaagtcttggaaaagccagcgctggttccttaagtgctatcaagttcagtaatacccaagtnctaacaacttcacggttctagcttatgaaa

SEQ ID NO: 14148 - DNA, 101 bp, rice(Oryza sativa)
  misc_feature (71): n=t or c
ggcgtggtggtggagttgtggctgcatgactccacctagcagaattcaaatctggtgcctataaatattangcatatttaagcttttgaaccaaactttag

SEQ ID NO: 14149 - DNA, 101 bp, rice(Oryza sativa)
  misc_feature (71): n=t or g
tggattcgaggtttgacgaaatggtgatcacgagagcgtgcctgattgcatgagagggataacaggtactnctaatatatagattacgatcgttgcgtgag

SEQ ID NO: 14150 - DNA, 101 bp, rice(Oryza sativa)
  misc_feature (71): n=a or g
tttgaaacggagggagtcccttaaaagcgtagtcattcttccgtcatcttatcaccatgcgtaagaggtcntgcctaggtgttaatagtgaaagttggtaa

SEQ ID NO: 14151 - DNA, 101 bp, rice(Oryza sativa)
  misc_feature (71): n=t or c
acctaccctcgtcagaaaattcaatccttgtacagcgtttcatccttttcaggcaaccaagtaattaaggncaccttgattagtaagaaaaacataggaga

SEQ ID NO: 14152 - DNA, 101 bp, rice(Oryza sativa)
  misc_feature (71): n=t or c
gctggcttgggtttgattggaaacgtggcaatccaaccaattcttaacagatgcgacggcagcactcgggngcaccggcgtggcacggtcagaggccggtg

SEQ ID NO: 14153 - DNA, 101 bp, rice(Oryza sativa)
  misc_feature (71): n=a or g
gatgctttcaatctaggggctatcgggcgccagtgaggagtagagagagacaaagatggaaggaatatagnagaaaagggcgagctaaccacggtcccctt

SEQ ID NO: 14154 - DNA, 101 bp, rice(Oryza sativa)
  misc_feature (71): n=t or g
agcagtcagggcacggggatcagtggcacgccaatgtgggcagcttcttcttcttcttcgatgcagcatcngttcctgctctgccgcctcctggggttctg

SEQ ID NO: 14155 - DNA, 101 bp, rice(Oryza sativa)
  misc_feature (71): n=a or g
gctacacaccgagttgcacggcgagcggaggtgtgaatgcaaagcaactaaggttatgttcgggaggaggngccctcctctccggcacacaaaacgaaaca

SEQ ID NO: 14156 - DNA, 101 bp, rice(Oryza sativa)
  misc_feature (71): n=a or g
cacacacacctctttaaaatccgctaaaactgggactcatttttctttatgaaactgcctgtgtgttttgncagcatcaaaattaacaaaagtctcaggct

SEQ ID NO: 14157 - DNA, 101 bp, rice(Oryza sativa)
  misc_feature (71): n=t or c
acacacaacacttctgacttgcttatctttcaatgcttcaaccaatgtaggagtattcttatcatcagtancaccatgacctaaccgaccatttgcacctt

SEQ ID NO: 14158 - DNA, 101 bp, rice(Oryza sativa)
  misc_feature (71): n=t or g
atagccttgtcattgagttccaaaaggcgtatgatcgagaaaatagtgggagagcattgtttgataagganattgcaattgaagaagatgtcttgatctta

SEQ ID NO: 14159 - DNA, 101 bp, rice(Oryza sativa)
  misc_feature (71): n=t or c
ccggtcgaggatcttaagagcagtggaatgaagcttgcaactgaggaagcaccatctccatccagtaatgntgccatgccaggctctgagcctagtgcgcc

SEQ ID NO: 14160 - DNA, 101 bp, rice(Oryza sativa)
  misc_feature (71): n=t or c
tcaaatttcatctttcaactcaccattcggttgcaggctttcagctcctttatcctgcccaacttagtttngactttcgaaccacttgtcctacacctcgc

SEQ ID NO: 14161 - DNA, 101 bp, rice(Oryza sativa)
  misc_feature (71): n=t or c
atatctgatctggagtctgaactctcaaagttgcaggctcaactggagaaaattgaagggaaagtacagangctggagcaggaactcaaacataagaaaga

SEQ ID NO: 14162 - DNA, 101 bp, rice(Oryza sativa)
  misc_feature (71): n=t or c
ccaagcggtcaaatcccagagttcataggctctatgaagagcttgagatatctaaagctctctggcattcngttctctggtacggtgccttctcaacttgg

SEQ ID NO: 14163 - DNA, 101 bp, rice(Oryza sativa)
  misc_feature (71): n=t or c
ttttttatcttaccaaccgggactaaagatagatctttattagcactggtgaagagctttcagcatgcacnattttcgtagcttacatttatcgatttgtt

SEQ ID NO: 14164 - DNA, 101 bp, rice(Oryza sativa)
  misc_feature (71): n=t or g
ttgatagattcaaagctagaatacccagtgacctgtgtcgtgcactgtcgagacagttttgtcgctattgnctccctcggagagatctccatgtttagtgg

SEQ ID NO: 14165 - DNA, 101 bp, rice(Oryza sativa)
  misc_feature (71): n=t or c
attgtgacctcaaaatttgtgattttggacttgctcgtaccacctcagaaaccgattttatgactgagtangttgtcacaagatggtatagggcaccggaa

SEQ ID NO: 14166 - DNA, 101 bp, rice(Oryza sativa)
  misc_feature (71): n=a or g
gtatttggcactgtgctggccagggatgagtatgatttcaggtgtgtctatctgttcaggcgtgacaggancaatccccagatcatcacctcgccggtatg

SEQ ID NO: 14167 - DNA, 101 bp, rice(Oryza sativa)
  misc_feature (71): n=a or g
ggtgcaccagtgaatcacattgcactatccaatatagagagttctaagcataacttccattctctgagccncttatttgctaaaagaaatttgttctctga

SEQ ID NO: 14168 - DNA, 101 bp, rice(Oryza sativa)
  misc_feature (71): n=t or c
tctttgccttcttgctttgatatctcaattatataaggctctagctgcatgcaacaagaagttcagcatancaagaatatatgtctatcttggttcatcag

SEQ ID NO: 14169 - DNA, 101 bp, rice(Oryza sativa)
  misc_feature (71): n=a or g
tgagtagtgacttcatgaatcttaaaatttatcggaccaatatttgaaagcgctcacagggatagggcgtncgtgttgtgtgctcatatgagtggtgagcg

SEQ ID NO: 14170 - DNA, 101 bp, rice(Oryza sativa)
  misc_feature (71): n=t or c
gctccatctcacccttcttaatctcagcctcaaccctcatcctctctgtttccctgtacaggtccattctngcgcgctcaatcttcaagaatgagcttgcc

SEQ ID NO: 14171 - DNA, 101 bp, rice(Oryza sativa)
  misc_feature (71): n=t or c
tttgggatgtggtgccgactgattggatatcaggaatagtttttctcccctcttgctacagtcctgtaaanagataatcagattacttataccgacttaga

SEQ ID NO: 14172 - DNA, 101 bp, rice(Oryza sativa)
  misc_feature (71): n=a or g
gaggcaacaacaacaatgccttatctggatccaaagcgttctccgagcatgttgttctattcactttagtnttgaatatgttagtagatgatgctattcct

SEQ ID NO: 14173 - DNA, 101 bp, rice(Oryza sativa)
  misc_feature (71): n=a or g
attatttctctttttagtttgagagctataaaaatatcaaggagaggtagcggggaaagtgcgagccgagnggtgaggggatgggtagtgttgtgtttgtg

SEQ ID NO: 14174 - DNA, 101 bp, rice(Oryza sativa)
  misc_feature (71): n=t or c
ttagctttttttttaaaaaaaaattcaaataagaccgagggagtactcgatggctacgcttaaaatggganggagggagtacttgatgctccaaagtaagc

SEQ ID NO: 14175 - DNA, 101 bp, rice(Oryza sativa)
  misc_feature (71): n=a or g
tccagttgattggtctcctttgtcaaattagctagcataggcgactcttaacccacgatactatcaaggcncacttgcattgggaaggaattgaaggaaaa

SEQ ID NO: 14176 - DNA, 101 bp, rice(Oryza sativa)
  misc_feature (71): n=a or c
tcaacagtatcatataattaaaacgggagatcaattctctactttagattaaaccacaagaaaagaaaatntatatatagaatactaactctagtttctaa

SEQ ID NO: 14177 - DNA, 101 bp, rice(Oryza sativa)
  misc_feature (71): n=t or c
tcacgggagaggaacgaaattaatttactcacctacccttccagcgacttctcctcgcgctcccctccatngcccttcgccgccttgtagtccgccgcacc

SEQ ID NO: 14178 - DNA, 101 bp, rice(Oryza sativa)
  misc_feature (71): n=t or c
catttaatagtttgaaaagcgcgtgaaaaacgatggtggtgagttaaaaagtgaacaaaaagaactcagcngtaggagccttgccgagataggtcatggcc

SEQ ID NO: 14179 - DNA, 101 bp, rice(Oryza sativa)
  misc_feature (71): n=t or c
caatttcttcaaacctactctttcgcaccacttttcacaaacgaaaacaacaagaatccaatcatatcgangcttaatatgatgaagtctctctcattcgt

SEQ ID NO: 14180 - DNA, 101 bp, rice(Oryza sativa)
  misc_feature (71): n=a or g
atgagttttctccagagcttccacatgagccctcaactcctccatctccacttgcaaatccttgacagccncatcgacttgaggacgccaactcgccatgg

SEQ ID NO: 14181 - DNA, 101 bp, rice(Oryza sativa)
  misc_feature (71): n=t or c
ctgatgcgagtgagataacgagatgcttatgtatttttaggctcttctcgtgaagctgtgtccaaataggngtaggcttctgcttctccttctccttctcc

SEQ ID NO: 14182 - DNA, 101 bp, rice(Oryza sativa)
  misc_feature (71): n=t or c
gacacaaataaaaatactatgagtgttgggttttttatttacccgctccaaatttagagccccacaagcangcaaaaaaatcagcatggagaaaaaaaaaa

SEQ ID NO: 14183 - DNA, 101 bp, rice(Oryza sativa)
  misc_feature (71): n=a or g
cgcggccggccggagggatggcttccgacgaggtggcaaagaagtttgggatgcacaggttgtgggttttntggggccatgcggagcgccgacgttgtgct

SEQ ID NO: 14184 - DNA, 101 bp, rice(Oryza sativa)
  misc_feature (71): n=a or g
ttaactggtaatgttcagttgctacaatgttactttgcctttaccttgctgcagaaagatagacatgattnaagaattagaggctatggctaaactcaata

SEQ ID NO: 14185 - DNA, 101 bp, rice(Oryza sativa)
  misc_feature (71): n=a or g
tcatcgtcatcgtcgtcatcatcatcatcgtcttcgtcaacggatagacatccgcggagaacatatgatcnccgacaacccactgcccccggcggcgagtg

SEQ ID NO: 14186 - DNA, 101 bp, rice(Oryza sativa)
  misc_feature (71): n=a or g
caaatatcttgcaccaacgctcttcactcattccaaaggaaagcaccgaacagtacacaaggctttgagcnataatcaatggatcagggacattaggcatg

SEQ ID NO: 14187 - DNA, 101 bp, rice(Oryza sativa)
  misc_feature (71): n=a or g
cgatgaagctaggtttgatgtgatttcactcttgcatcggatcagcgacacacgacgagaatctgacactncctgtacaactccagaagtatcatcatgaa

SEQ ID NO: 14188 - DNA, 101 bp, rice(Oryza sativa)
  misc_feature (71): n=a or c
taagatagtacttgaaagttgaaagcatgatcatgcaaagagaatactaagttggcctccaacatcagggnttttttagttttcctctctctgtcagcctt

SEQ ID NO: 14189 - DNA, 101 bp, rice(Oryza sativa)
  misc_feature (71): n=a or c
tccacacactccccaaaaactccacacctcccctctctagtttacttctccccaccaccaccccctctctntctctctaatttacctcccgtttcccaacg

SEQ ID NO: 14190 - DNA, 101 bp, rice(Oryza sativa)
  misc_feature (71): n=t or c
cgtcaatctgtacaagaagatggttattcactttgtcgatgaacattaccagcttttgcagccaattgttngctcccgctcgctgcagccactctcttggc

SEQ ID NO: 14191 - DNA, 101 bp, rice(Oryza sativa)
  misc_feature (71): n=a or g
acatctttcaaaatagaagggtaacttttgctcaaattctcgactccctctgcctgcacaatcaatctcantttcaccgggtcatcaagaaaacgcaggca

SEQ ID NO: 14192 - DNA, 101 bp, rice(Oryza sativa)
  misc_feature (71): n=a or c
attttctgcgaaaaccctcgcactatttctaattttattattacccttgttgccttcctccccctcctatncctcccctcggcggcgaggcggcggagctc

SEQ ID NO: 14193 - DNA, 101 bp, rice(Oryza sativa)
  misc_feature (71): n=a or g
tgcatggagtacatgtacatcacttcctttttcatttctgaactttgtccctctctttctctgtgcttggnttggaaggtgatcagattcagtctccttaa

SEQ ID NO: 14194 - DNA, 101 bp, rice(Oryza sativa)
  misc_feature (71): n=t or c
gtgttccttgcttcaaacctattgccctgaattgaagatatatatggaccccccccttggtgagtgagttngtgtcatatgtctttctttgacatggtagg

SEQ ID NO: 14195 - DNA, 101 bp, rice(Oryza sativa)
  misc_feature (71): n=a or c
gctgatcgctcgctggtttgatataggatgccatatttcagaggctggctgaagatcgcatatatagtcancttccgtgtatcctgattactgcaaaagga

SEQ ID NO: 14196 - DNA, 101 bp, rice(Oryza sativa)
  misc_feature (71): n=a or g
tttcttaagacttgtgttgtcagatattgacaatggggatttgttctcactcttgtgcagcctgacatcangatcatcaagaggaggatcgaggatcttat

SEQ ID NO: 14197 - DNA, 101 bp, rice(Oryza sativa)
  misc_feature (71): n=a or g
gtactacgtacgcgcagtatctcgattcttaatttgaattcgtacctgtggtgatcagccgcgggagggtngcacctctgctgtacgcagacgacgcagac

SEQ ID NO: 14198 - DNA, 101 bp, rice(Oryza sativa)
  misc_feature (71): n=a or g
ctctgcttggtccgtctctctttgacccaacccacaaatatagatgtaggtccaactcgctgtttggtccntctctttttgacccaactgacgagtgtagc

SEQ ID NO: 14199 - DNA, 101 bp, rice(Oryza sativa)
  misc_feature (71): n=t or g
atggcctcgcgatgtcgcctccatgagtccatccaaatctgattaggcttttttccttaaaaaaaaatctnattaggttagctaattactccattacatcc

SEQ ID NO: 14200 - DNA, 101 bp, rice(Oryza sativa)
  misc_feature (71): n=t or g
taatttgtccattcacgacgagcttatttgcaaaattggaagtgtcccaattctccatgctgttagctctncaacaacttatctactccatccgtttcaaa

SEQ ID NO: 14201 - DNA, 101 bp, rice(Oryza sativa)
  misc_feature (71): n=a or g
ttgttttcattttggtcaacggtgcaggttgggaagacatattttgaactcgtcaattatttagaagccgntcatttttttgagttagcgcatcgactatc

SEQ ID NO: 14202 - DNA, 101 bp, rice(Oryza sativa)
  misc_feature (71): n=a or g
taccctcctaggttggtcctctgagggttgagcattctcacattgttcaccaatgttcttccttctcagangactcctcttcctctcggctataacactag

SEQ ID NO: 14203 - DNA, 101 bp, rice(Oryza sativa)
  misc_feature (71): n=t or c
tttggcttttgcaaaagcaaaagcaggtttaaaagcccaaacaaagacaacctaaatgggctcaacttgtntctctcaccttttttccttaaaaaaggcac

SEQ ID NO: 14204 - DNA, 101 bp, rice(Oryza sativa)
  misc_feature (71): n=t or c
ctgctttagttagcaccattcctccacttaaaactctagtccgatccatagtaccttagcaatgtattcangaaatataatgtgaagcttcatctcatatt

SEQ ID NO: 14205 - DNA, 101 bp, rice(Oryza sativa)
  misc_feature (71): n=a or g
aagttgagggaatcaaaatggatattttcttaatccatcggctacatagatctagagtggatcaatgggtngagtgtccatggaagatatctaaatatagt

SEQ ID NO: 14206 - DNA, 101 bp, rice(Oryza sativa)
  misc_feature (71): n=t or g
aatttgccaaatttattgtcaaatacactgttgcaaacagtttctggctatgaatagtaaggtgagtaggnatgagtatgatggatcccttgaacattttt

SEQ ID NO: 14207 - DNA, 101 bp, rice(Oryza sativa)
  misc_feature (71): n=t or c
catgtcttctactcgtcattttcccttcttttggaggtcactatgtttttcattttaacactcctatgtantgaaagatcaaggacagaatccacaaacta

SEQ ID NO: 14208 - DNA, 101 bp, rice(Oryza sativa)
  misc_feature (71): n=a or g
gacttggtattccttctacgtgacgcttatgtgccgttggaatttaaaaagatatgtgtggaacccatttntcattaaaaaaaataaatatatgacccact

SEQ ID NO: 14209 - DNA, 101 bp, rice(Oryza sativa)
  misc_feature (71): n=t or c
gtctgtacagagagggcaataagtatatagaactgtcacctgaaaccctactgggagttgccattattatnatgtacaatatttaaaggtgaatgcatact

SEQ ID NO: 14210 - DNA, 101 bp, rice(Oryza sativa)
  misc_feature (71): n=t or c
aataaaacacatgacttctttcaagcttcttccactcctccactaataagttcttatgcccatgagagatncccttccctccaaaggctcatatgctttct

SEQ ID NO: 14211 - DNA, 101 bp, rice(Oryza sativa)
  misc_feature (71): n=t or c
aacagaaaatatatctctatcttcacaaccgcacacgctaatcatgcctagtcaaacacaaacactagtanagatccttccatctgtgacggcccataaca

SEQ ID NO: 14212 - DNA, 101 bp, rice(Oryza sativa)
  misc_feature (71): n=t or c
tctcccgacgacgacgagtttattttccacctcttctttcctctatctccatctgccaccatggtcgatcntgtgcccgtggcccactcatcgagtactcg

SEQ ID NO: 14213 - DNA, 101 bp, rice(Oryza sativa)
  misc_feature (71): n=a or g
ggcgttgggacgccattgttgtgttctggtgtagtatggttgatggttggattgtgttgttgttgggtgtnatcagtgatgagattaggtcgcatatatat

SEQ ID NO: 14214 - DNA, 101 bp, rice(Oryza sativa)
  misc_feature (71): n=t or c
gctaagcttgtgctctggatctcaacgagctcgtagtggtgctagagtcgacgagactcgacaaggacaanggcgatgtggaagagcaagaaatcggtagc

SEQ ID NO: 14215 - DNA, 101 bp, rice(Oryza sativa)
  misc_feature (71): n=a or g
catttccccaaagagaacaagttaacaaggtgtgacagcatggaacgaataattgccttagcaatatttcnaacaaaattacattcctcatcattccttga

SEQ ID NO: 14216 - DNA, 101 bp, rice(Oryza sativa)
  misc_feature (71): n=a or g
ttgtcgtttcaagaattaatcatggatttgtttttgttggttggcttggcttcaattatttctgcagtttntgtacttcttttattattctctctcactgc

SEQ ID NO: 14217 - DNA, 101 bp, rice(Oryza sativa)
  misc_feature (71): n=a or g
tcgtggcgtcgccgttgctgatgtcgttgaagaggccgatgtactggctggcgacgaagaagacgatgccntggccgcaggcgtcggcgtcggggcataga

SEQ ID NO: 14218 - DNA, 101 bp, rice(Oryza sativa)
  misc_feature (71): n=t or c
tctatgcttctcgtagctgctttgcctatccttgcagctgtcaaccgctagccactatctctgctatcttncacattagttgttttacggggtgtttagat

SEQ ID NO: 14219 - DNA, 101 bp, rice(Oryza sativa)
  misc_feature (71): n=a or c
tagagatgatgctcaaggatggctgcttcttgcttgagatggcgagggtgtttgagctacgtgggaaagtngaagactatgaacccgatgaccctgtctca

SEQ ID NO: 14220 - DNA, 101 bp, rice(Oryza sativa)
  misc_feature (71): n=t or c
ggccgcttcggttggcgaagccagcgaaggagtagtcgtgtttgtgcacggccaggtgcacggtgcaccangtcgccgtcggcgcctttcatgctgacacc

SEQ ID NO: 14221 - DNA, 101 bp, rice(Oryza sativa)
  misc_feature (71): n=t or c
caaagattccgtgcatctggagattttgatgaacatgtcatgtgtgatggatcacatcatcaatctgcggnttgtactacttcatccattatttctccaga

SEQ ID NO: 14222 - DNA, 101 bp, rice(Oryza sativa)
  misc_feature (71): n=a or g
caatgagtctgtcaactcttactgttagctccttgagacttttttggaggcaatacgtcaagtgcatccanaatcattaattaccgatggcgacctagcaa

SEQ ID NO: 14223 - DNA, 101 bp, rice(Oryza sativa)
  misc_feature (71): n=t or c
cggagggagtattatttggtcacgagtgagcatgatttgattcgcacaagcacacctgaagtactgtactncattttgcaaaatttcttcaaaatccgtgt

SEQ ID NO: 14224 - DNA, 101 bp, rice(Oryza sativa)
  misc_feature (71): n=t or c
ttagtgaggactgaggagtttggttggagattgttgaggagatgggcatcgtcgacgttgtctccgagttntgctccgtgccgaggactcgccgacacctc

SEQ ID NO: 14225 - DNA, 101 bp, rice(Oryza sativa)
  misc_feature (71): n=a or g
cgtccctaaccttccaaagatcccacgggtttaagtaatctaatatatgcgttgcttgatctgcctgctcncagttataaattgcgtaatattagaagtag

SEQ ID NO: 14226 - DNA, 101 bp, rice(Oryza sativa)
  misc_feature (71): n=t or c
acgaaatcaaaaacgaaaaaaagatgcaactattttaccggcgcgtgcagctgcagcaccatcgtctccangcgagtccctcacccgcagctccaccaccg

SEQ ID NO: 14227 - DNA, 101 bp, rice(Oryza sativa)
  misc_feature (71): n=t or c
tctagggtgtaagaactctccatcacatcacaggttgctgacaagaccctatcagattttgtacctactantatttccgtcccagaatataagaagtttta

SEQ ID NO: 14228 - DNA, 101 bp, rice(Oryza sativa)
  misc_feature (71): n=a or g
tccaccattcatggacgatatatggggcactaatacggacatgccgacaagatatggccacaataatggcnaaacaccggaggagacatgagtagatcgtc

SEQ ID NO: 14229 - DNA, 101 bp, rice(Oryza sativa)
  misc_feature (71): n=a or g
caaaatgggtcacgttgcctctgaatgctggcattgtttcgatgactcctacgtgcctgatgaaaggcatnttgctgctgctacccatgctgcctatggag

SEQ ID NO: 14230 - DNA, 101 bp, rice(Oryza sativa)
  misc_feature (71): n=a or g
cgaagaagaagcgacggccagccggcacgccaggtaattaagctaagcgccgagacgcgccgccccagatntcatcatgcgagtacatccaattattattg

SEQ ID NO: 14231 - DNA, 101 bp, rice(Oryza sativa)
  misc_feature (71): n=t or c
agaaagtcaatccatgagaaaaatacaggggtgctagaatgctgtgaagcccaaacgtgaaaagaactcanaacattgtttatacattttgggcattgacc

SEQ ID NO: 14232 - DNA, 101 bp, rice(Oryza sativa)
  misc_feature (71): n=a or g
ttgatgcgtgcaagggcaatatgggcataacacacaaggaatgaaggagacagtgatctactagtagtccngtacccatggccgtgcgtgcggtgcgggct

SEQ ID NO: 14233 - DNA, 101 bp, rice(Oryza sativa)
  misc_feature (71): n=t or c
catgattattctagctagcactttaatatgatccattggttgcaacacctatagctagctacttgcctttntttttccagaagaactttgattaattaatt

SEQ ID NO: 14234 - DNA, 101 bp, rice(Oryza sativa)
  misc_feature (71): n=a or g
taccatggtgacaccattgcccaagtctttcttagctgcagtaacgacgataaagtcctccacggccggtntggcgacttcccaagtcctctacgacaaca

SEQ ID NO: 14235 - DNA, 101 bp, rice(Oryza sativa)
  misc_feature (71): n=a or c
cacgcacgtacacgggtagtactacagaacgcgccaacgtcatgggcgattggtgagaaaacacgcacacntactagtactagctttatccttttttagtg

SEQ ID NO: 14236 - DNA, 101 bp, rice(Oryza sativa)
  misc_feature (71): n=a or c
tttggtttggtttgctcggttttgcgcggaatttgaccgaattttggtgaattttttgtaggtcaggtggnggtggtagccagcgacgacgacagggaggt

SEQ ID NO: 14237 - DNA, 101 bp, rice(Oryza sativa)
  misc_feature (71): n=a or g
agaaagaaagagagaagcagaggacgggtagtatttttcctctctttttcgatagatgtcacgtgcctacnggctggcgatttatacaccacacacccgac

SEQ ID NO: 14238 - DNA, 101 bp, rice(Oryza sativa)
  misc_feature (71): n=t or c
tcacatccgccacaaggattgctactctcatttccattgccctcaattgcagcactctctaattcatcccnctcctccgactttatctgcgcgaggccaaa

SEQ ID NO: 14239 - DNA, 101 bp, rice(Oryza sativa)
  misc_feature (71): n=t or g
gcatgagactggttatgttccatttcgatctaggctaaaaatgaatcaggaaaccgcttttaatttcacgntttaggctaaagaacatccaaacataagcc

SEQ ID NO: 14240 - DNA, 101 bp, rice(Oryza sativa)
  misc_feature (71): n=a or g
tcgacgtgtgttcaccataacgggtttttttttcgagtgttcgttcgatgatatctatcttttttgcggcnatgggttttcagatgccgctgtgggttgca

SEQ ID NO: 14241 - DNA, 101 bp, rice(Oryza sativa)
  misc_feature (71): n=a or g
agtgttttggatttgttaactttgaaagtccagatgatgctgctcaggctgtccaagagctgaatggcaanaagtttgatgataaggaatggtatgttgga

SEQ ID NO: 14242 - DNA, 101 bp, rice(Oryza sativa)
  misc_feature (71): n=t or g
ttttcttttttttttctcttgaagtatattgaaaaaacttcaacttggtaactaaaccggcggcggccaanaggataatagaactcatcttgaagaattaa

SEQ ID NO: 14243 - DNA, 101 bp, rice(Oryza sativa)
  misc_feature (71): n=t or c
caaacaccaaaagcgaagatcgatcgatctaatcgtgccattttttctagcgagcgatttgtcagtttctnctcctcttcatctgcagaatctccaatttc

SEQ ID NO: 14244 - DNA, 101 bp, rice(Oryza sativa)
  misc_feature (71): n=a or c
gcgtgggagcttgcaggccaaaaactcaagaacgtgtacgttgtcggtgtcatgattattttggtgcgcgnagccttggaaatcgtctaccacctgctctt

SEQ ID NO: 14245 - DNA, 101 bp, rice(Oryza sativa)
  misc_feature (71): n=a or g
atatataatccactacttttggcttattccattcgtattatatctctttaaccaagcaaaaaaattgatcnttctatctatacaaaccaaacagaaaatta

SEQ ID NO: 14246 - DNA, 101 bp, rice(Oryza sativa)
  misc_feature (71): n=t or g
tgtttcacccttttttgtagttcaacatcttctgcagttttgcttcatcatgtaatatgctgattccctgntgtatggcatcattttttgcagatgattgt

SEQ ID NO: 14247 - DNA, 101 bp, rice(Oryza sativa)
  misc_feature (71): n=t or c
atgttcactgactgcaatcggtatcgggaaagacaatatggcttaatggtatcatcattaatgctgtcacnagtagtctgatcagcactttggtcaaatgg

SEQ ID NO: 14248 - DNA, 101 bp, rice(Oryza sativa)
  misc_feature (71): n=t or c
ctgaaggttttattagtgacggttcttgccctatcagagaacacatggctgagcaagtgggagaccacatngtgtcggattttgtctaaccgacacttgat

SEQ ID NO: 14249 - DNA, 101 bp, rice(Oryza sativa)
  misc_feature (71): n=t or g
ggtcccgaaatttttacgctattgaatcccagaaccctgacctcggaagcttttacaacaagatcaatacnccattaatatggaggaggaccgagcagcat

SEQ ID NO: 14250 - DNA, 101 bp, rice(Oryza sativa)
  misc_feature (71): n=a or c
gacccgctggaggctgtccatagtactgctggtttggtgctggagcattgtatctaggatcaccataaccnggcccatagttctgtggaggtgcagactgc

SEQ ID NO: 14251 - DNA, 101 bp, rice(Oryza sativa)
  misc_feature (71): n=a or c
gttgctttcctatggctttggatgttgggggcacatttcgttttcagattatgcccagatgcaagtagagnacatgtcgtttcaaattattccgaaatatt

SEQ ID NO: 14252 - DNA, 101 bp, rice(Oryza sativa)
  misc_feature (71): n=t or c
ttttggaaatgctgaatgcgcaacttcaagttgtagtgcacgtagaccagcttatggatcttctcgtatcncagccgatttctcactttggtatgcaccaa

SEQ ID NO: 14253 - DNA, 101 bp, rice(Oryza sativa)
  misc_feature (71): n=t or c
actaagaaaactatttctacgtacggtcggtaacctctgcaacataatgccttagaaatcaataattctgnagagtactgttggaattaatagatgggcta

SEQ ID NO: 14254 - DNA, 101 bp, rice(Oryza sativa)
  misc_feature (71): n=a or g
catgcttgcgtgtatgataaaagttgcttgctttctgacttctttgtgcttgctactacagcatgtgaatngggtggcagtagatctactcattcacttgc

SEQ ID NO: 14255 - DNA, 101 bp, rice(Oryza sativa)
  misc_feature (71): n=t or c
agagttctagaaaatatgcactgtgtgcagtttcatgatatgatcgagcatatatatctgtaattcagctnaagtaagactaggtgtgaatataatttgga

SEQ ID NO: 14256 - DNA, 101 bp, rice(Oryza sativa)
  misc_feature (71): n=a or c
tgggtggagaagacggagagtttgtagtcagtttctatctctactgaggtgagtcatgactggggagagcntgggagtcagtttgctgtgcatatagtttt

SEQ ID NO: 14257 - DNA, 101 bp, rice(Oryza sativa)
  misc_feature (71): n=a or c
ctgctcctccccacccaccgtgagagctagtgctcgggtataaatagcccaactcgtggatgtcacctctnctcctctcatcgcctcgctcgtctcgtttc

SEQ ID NO: 14258 - DNA, 101 bp, rice(Oryza sativa)
  misc_feature (71): n=t or c
ctcacctaaattttttttcgttcgtaacatctgagttcaagaaacaaaatcatctagagtctgcgtcaaanaacacaaaaaaattaaatcaattcgtgtta

SEQ ID NO: 14259 - DNA, 101 bp, rice(Oryza sativa)
  misc_feature (71): n=t or c
aaaaatataatatttaattaattcgtctgtactctcaaattttatcatagatcgttcagctattcattcantcaactatttagaatggaaaaaagaacaca

SEQ ID NO: 14260 - DNA, 101 bp, rice(Oryza sativa)
  misc_feature (71): n=t or c
aagaagtaattagcaatgatagccagcgagaatctagcattgttaatctagagagaattggaactaaaagntctcctaaatagtgtcttagtaaccaagcc

SEQ ID NO: 14261 - DNA, 101 bp, rice(Oryza sativa)
  misc_feature (71): n=a or g
atcatcggttgcacgaagctcatgataggagagcaattgatggctgataaggtcaggcttaccagcagaantattttgatggttagctttctttctaatca

SEQ ID NO: 14262 - DNA, 101 bp, rice(Oryza sativa)
  misc_feature (71): n=t or c
ttttttactccccaatcccccttcttcctccttgatccctttcttctccccatccctctttgccatggttnccgcatcttgagctgagcagagcacagctt

SEQ ID NO: 14263 - DNA, 101 bp, rice(Oryza sativa)
  misc_feature (71): n=a or g
cacgtcaaactaatgaagatataagtctttagatttaatttatagtagtaaggatgacaggaagcacactnttcttttagtaaaatacacttcttgtaatt

SEQ ID NO: 14264 - DNA, 101 bp, rice(Oryza sativa)
  misc_feature (71): n=t or c
ctcagacatccttctggcagtagaagggcttcctttgttggaatatccggtacaatctagtagaaccttcntcttcatgtgcaccttgatcatccacgttg

SEQ ID NO: 14265 - DNA, 101 bp, rice(Oryza sativa)
  misc_feature (71): n=t or c
gagcaacccgtacgtactaaaattgtcgcccaaaactcattcagacttcgttttcgatgccatacatatanatacatacatacatacatacatacatacat

SEQ ID NO: 14266 - DNA, 101 bp, rice(Oryza sativa)
  misc_feature (71): n=a or g
tggcagtttctagcagaagcagtttatgagaaaaactgcagctgacacaaagctccccaaacagagccttngtatctagtctctactgcacaagcagagca

SEQ ID NO: 14267 - DNA, 101 bp, rice(Oryza sativa)
  misc_feature (71): n=a or g
ccagaagggacagacgaagaagtagcgaaggatttcgcgctgaagactatgggcaagttatggcgaaactngaaaacggatctgaacacgaaatatgttca

SEQ ID NO: 14268 - DNA, 101 bp, rice(Oryza sativa)
  misc_feature (71): n=t or c
tagagtggacctgtttgtaagtgactcccctcttctctcatctatcctctccaatccgcattcttctcgangtcctgtaggtcctacgctggcgtcagcca

SEQ ID NO: 14269 - DNA, 101 bp, rice(Oryza sativa)
  misc_feature (71): n=a or c
accgtgtaacttagggccacatcccactagcccactagacatgaaccttacccaacaaaaatattaggggnaatttcattcttgctcctgctcctgttttg

SEQ ID NO: 14270 - DNA, 101 bp, rice(Oryza sativa)
  misc_feature (71): n=a or c
gcaagaacgaagcaaaaaaattaacatggctcaagaatcgaagcctctcgtcgttgctctcctcctctgcntcatgatcgccaaaggtaaatcaatcatca

SEQ ID NO: 14271 - DNA, 101 bp, rice(Oryza sativa)
  misc_feature (71): n=a or g
ttgaaggcaatgagtgacacggctcctaatgatgctactgttcatgttcaggatgcagcggcgacaacttntggtgtagcttctgttggtgctcaaactgg

SEQ ID NO: 14272 - DNA, 101 bp, rice(Oryza sativa)
  misc_feature (71): n=a or g
ccaaacattcttgataaatatagtgatggcattttgtcagaggagatagagtcttatggcatcttgagtgntgaagctgaactagacggtgatacacagga

SEQ ID NO: 14273 - DNA, 101 bp, rice(Oryza sativa)
  misc_feature (71): n=a or c
ttaggaaagctgcatcacatgcttttgagaagaacaagagatcaactgtcaccactgacatcattgagttnctgggcaaaaggtccgcgtgcgctctcact

SEQ ID NO: 14274 - DNA, 101 bp, rice(Oryza sativa)
  misc_feature (71): n=a or g
ctacgatcgttacctgctgaactatattctccctctcagcgagacattggcctgcacgttcacctccggcngcggcggcggcggctggcgcctaccgcaca

SEQ ID NO: 14275 - DNA, 101 bp, rice(Oryza sativa)
  misc_feature (71): n=a or g
tttgtgaaattgacacaaagagggaggaaaaagagagaggagtagggctcaccatgaagaatgcatctgcngaaatattttatctgaaactgatggatgga

SEQ ID NO: 14276 - DNA, 101 bp, rice(Oryza sativa)
  misc_feature (71): n=t or c
cacctgtgtttatactgtatttataaaagatagtgtcatagtgataagcatctgagaacagaatgagtatntctttatgttcaactgaagaacaagatttt

SEQ ID NO: 14277 - DNA, 101 bp, rice(Oryza sativa)
  misc_feature (71): n=a or g
tgaaaaattaatctcccttcgttgtatgcgtgcggaagtagatcctctcacctaattatatactagaaaanatgtccgtacgttacaacgggtaaacattt

SEQ ID NO: 14278 - DNA, 101 bp, rice(Oryza sativa)
  misc_feature (71): n=a or c
taacaaatggatgctgcaaggttggaaggggcgtatcatctttgctctttcagcatgggaaccaaactagnaaactgtaaatatgactaactcagctgatt

SEQ ID NO: 14279 - DNA, 101 bp, rice(Oryza sativa)
  misc_feature (71): n=a or g
attccgagatcagagatcaccaccacaccaaccacgaaactccggcgaccggcgccattgacgacaacaanaagcggtgcgaggaggttgatgtgcgtgcc

SEQ ID NO: 14280 - DNA, 101 bp, rice(Oryza sativa)
  misc_feature (71): n=t or c
ttcttcttatgagacacctcttgaaagctctattcatcatctctattttcttcctccctcaacctttctangtcagaatcagtgggaatttgacacctctc

SEQ ID NO: 14281 - DNA, 101 bp, rice(Oryza sativa)
  misc_feature (71): n=t or g
gggtcattgattgcagccgtagggaagttaccttaaccacatcttggggatcggtaatgaaagccacagtngatcaagatccacaattatttaagcgagct

SEQ ID NO: 14282 - DNA, 101 bp, rice(Oryza sativa)
  misc_feature (71): n=t or c
ttccccggccccacctgtcattcacgtggggtgattctacgacccgcctcgtccgcttacttattattatnattattattacagacaggccgtaattccaa

SEQ ID NO: 14283 - DNA, 101 bp, rice(Oryza sativa)
  misc_feature (71): n=a or g
tgggtgaagaggtggtgctgttggcatcatggatgaagctggaggcaccattgatgtagaagaggatgacngaggcgtaaaaaatgctggtgttacaagat

SEQ ID NO: 14284 - DNA, 101 bp, rice(Oryza sativa)
  misc_feature (71): n=a or g
acctttcaccacatagatgataccgtcaaatcggagaatacagggtattgcgaggggatgatcggatgctngaatacatggacataaatagactaggtgga

SEQ ID NO: 14285 - DNA, 101 bp, rice(Oryza sativa)
  misc_feature (71): n=t or c
ttgaatctcagacaccttgtacttatcatcggtacaagtacaacagcttgcaacttcagcttgctgtgtgnacactaggactcggctcccgttatgattgt

SEQ ID NO: 14286 - DNA, 101 bp, rice(Oryza sativa)
  misc_feature (71): n=a or c
agcgataagaaacctcagctgcttcaatttgccaatagagcttgggaggatccttatggagcagtcagttnaatctagaacacgcaagaactttgtgaatg

SEQ ID NO: 14287 - DNA, 101 bp, rice(Oryza sativa)
  misc_feature (71): n=a or g
caaattcaacaaatccacacataatcacacaaatcacattcatgaggaacaattaggatcggtcgactagnggaggtaggaaaatcgatcgctcccctccc

SEQ ID NO: 14288 - DNA, 101 bp, rice(Oryza sativa)
  misc_feature (71): n=a or c
cttgcttttgatagcgcacacacaaaacacttgagggtgcaggcttcactcttcttaattgaagccgcttntactactgatcaccctgtgctctgttcttc

SEQ ID NO: 14289 - DNA, 101 bp, rice(Oryza sativa)
  misc_feature (71): n=t or c
taaccaaggcgagttgaggctcgcgagggtcatgcataaaaagacacttgttgaacggcataggcgatctnaggacgggtgagggtgagatactggagggc

SEQ ID NO: 14290 - DNA, 101 bp, rice(Oryza sativa)
  misc_feature (71): n=t or c
cattctttttattcatcgctcaacggtccagatcatctcgctcacatccaacgcatgcatcagaatcaacnagccggaaaatcgcgcacgcgggatccacc

SEQ ID NO: 14291 - DNA, 101 bp, rice(Oryza sativa)
  misc_feature (71): n=a or c
tctttcatccaacggctgattgtaatgtcaacgcacagctagaaccgatagtcatatcggtagggtggagnaacctagctcaatttctaatgattaggact

SEQ ID NO: 14292 - DNA, 101 bp, rice(Oryza sativa)
  misc_feature (71): n=a or g
cttcgttgctagatgagaatccttcttgttgcaaatgtagcaatcaaggtccgctttgcatacctgcgccntatggccacttgttttgcacctgtgacaaa

SEQ ID NO: 14293 - DNA, 101 bp, rice(Oryza sativa)
  misc_feature (71): n=a or c
gctggtggaattccacagcgacacgttccaccagccggcgttctacgagggcgcgaggtacctggccaagnaggcggacggcggcggggggctactggtgg

SEQ ID NO: 14294 - DNA, 101 bp, rice(Oryza sativa)
  misc_feature (71): n=t or c
taaatgatcaaacagctaatatttgttgatgacatggtcaccatcaggctttgtagagaatcaggatgtgntaagcagaatcaacattctattttaatttg

SEQ ID NO: 14295 - DNA, 101 bp, rice(Oryza sativa)
  misc_feature (71): n=a or g
atatgtacatgttttgtatgttgagagagcacaagagagcttatgaattttgttccgcatatttagtgcantcaacttgtatttttaattcataattgtat

SEQ ID NO: 14296 - DNA, 101 bp, rice(Oryza sativa)
  misc_feature (71): n=a or c
gagccactatcatttgctttgacaaccagttttcaaatatttctgcactatttccatcatgttgaccttcncttactgattcctgaaataaacaaatactt

SEQ ID NO: 14297 - DNA, 101 bp, rice(Oryza sativa)
  misc_feature (71): n=a or g
gcactgactagttgcttcaacttctacagagcttctacagcgatgaagaattttggtatcagccaatatgngataacgatcaggcggagattgaagagcct

SEQ ID NO: 14298 - DNA, 101 bp, rice(Oryza sativa)
  misc_feature (71): n=a or g
gatagacaaattgagggagggagaggtggtggtgtggaggcgaggatggcttgttggaggggagactgtgntggctagagtcgctgaggtcggagtcgggg

SEQ ID NO: 14299 - DNA, 101 bp, rice(Oryza sativa)
  misc_feature (71): n=t or c
aatcacaatgaagaaagcgaccgtgccaggaagaacaattgctaccctgttgtcgtgccaccaacaaatgntggtgcgtctctcattcgcttatcggtgat

SEQ ID NO: 14300 - DNA, 101 bp, rice(Oryza sativa)
  misc_feature (71): n=a or g
cattatttgtgcatggaagtaatggacatgtgatgtcttgtttgttattgggtagaacatagtgaggatgnctcatatgagtttgttacctcagtaaacgt

SEQ ID NO: 14301 - DNA, 101 bp, rice(Oryza sativa)
  misc_feature (71): n=t or c
caggaaagataaatctagtatgtgcctcttctcccttatgctttcccccggcttttgtttctactcttgangatgaatgctcaatttgacctattatcttt

SEQ ID NO: 14302 - DNA, 101 bp, rice(Oryza sativa)
  misc_feature (71): n=a or c
atatttattattttattttaatggtgacagagaggatacacgtggacacattactatacacgtaaaccacnaagatttaccatttccatcctataaaaaac

SEQ ID NO: 14303 - DNA, 101 bp, rice(Oryza sativa)
  misc_feature (71): n=t or c
accaactccactagttcaggttcttgaagacccatgtcctatcaattatgtcagaataccagagtgaatanggaatagaacaggatttcaaattgtttgat

SEQ ID NO: 14304 - DNA, 101 bp, rice(Oryza sativa)
  misc_feature (71): n=t or c
actatcattaggaagaccaatgttcttcggcagggaaggtggaaagatgcaataagatctgagcttgtctnagatagcaccacagggcaaactgggagtgc

SEQ ID NO: 14305 - DNA, 101 bp, rice(Oryza sativa)
  misc_feature (71): n=a or g
gcgccggagccggagcggcagtagcgtcaccggcatcgatgcaagcccagatggcaatgcaaaaggagctngcgacggtgggtcgtcttcctcattgtcgg

SEQ ID NO: 14306 - DNA, 101 bp, rice(Oryza sativa)
  misc_feature (71): n=t or c
gagaagagctcagatctctgaaaaaaatctggatctccccagtctaatgttgcattgcacatccaaaattntaaaaatttataaattcacaatcagaaacc

SEQ ID NO: 14307 - DNA, 101 bp, rice(Oryza sativa)
  misc_feature (71): n=t or c
ggaagaaccaaaacgatcacactacgccagatcagccctgattggttaaactggaggctgttaattctacnaatcaaagaaaaaaaaataggaccagtaat

SEQ ID NO: 14308 - DNA, 101 bp, rice(Oryza sativa)
  misc_feature (71): n=a or g
tgggcctgggcctgagcttggggcacaccaaataagctagcatctaattgcacctgttgcatgatcgcctncaccatggtgaaaatagcctggcagcgata

SEQ ID NO: 14309 - DNA, 101 bp, rice(Oryza sativa)
  misc_feature (71): n=a or g
agacataaaaactgtgttgttcacataattgagttagaggaaacaaggcctcaccttcgctgacccttgcnatgacaggacggcgcactgccaccgtagga

SEQ ID NO: 14310 - DNA, 101 bp, rice(Oryza sativa)
  misc_feature (71): n=t or c
acttggaagagctgcagtgtctagttccaggaacccttctgcaacacctaccctttcatttccgttcgttntatagaaggggatactgtgagaaaaatgaa

SEQ ID NO: 14311 - DNA, 101 bp, rice(Oryza sativa)
  misc_feature (71): n=a or g
agctgctgcaatgaatgatcatgtacgtgagctagagagtgaattgcatgctgagaagatgggatcagccngaatgcaattgcagatagctgatctacata

SEQ ID NO: 14312 - DNA, 101 bp, rice(Oryza sativa)
  misc_feature (71): n=t or c
aaaggagctgatgccattgtcattaacttcggaacttgcagccaactcgttcaataatttctcatgactcntcttcatgtcatcttcctttgcaggggcag

SEQ ID NO: 14313 - DNA, 101 bp, rice(Oryza sativa)
  misc_feature (71): n=a or g
gagctggactatggccttaacatactgatcccagtgctatgatgccaatggatcagagaacagaacaggcntattcatcgatgactacggcctgatggttg

SEQ ID NO: 14314 - DNA, 101 bp, rice(Oryza sativa)
  misc_feature (71): n=t or c
ttcatgatactctgtccatatatcccggcatgatgtatttgagtgggcaatattattgcctttgacagcancctgaaacaagcatagcgttaaggttttgc

SEQ ID NO: 14315 - DNA, 101 bp, rice(Oryza sativa)
  misc_feature (71): n=t or c
agtaccggttattgccacacaccggtgctaaagatcccaggaggcctgatatgctctgacaaagtgtgaantggtactaaagatagcaatatgtcgttagg

SEQ ID NO: 14316 - DNA, 101 bp, rice(Oryza sativa)
  misc_feature (71): n=t or c
ttaagacagtggaacctgttcctaggcgcacatgaagcattattgcatctgattttggtttgtttattagntactcttttctttttatttgcggggtgttt

SEQ ID NO: 14317 - DNA, 101 bp, rice(Oryza sativa)
  misc_feature (71): n=t or c
tcttttacgaattccaggtaacaagtcagtggtttgcagtcacgatgttgtttgaatcaggtccctatcanatcacaaaagatatcggagctggaatcata

SEQ ID NO: 14318 - DNA, 101 bp, rice(Oryza sativa)
  misc_feature (71): n=a or g
tatttgtgatggtcataattaggatccgtcacagacagtaaaatgagtaaaataaagatgtcgtctgcttngctagtcacggacctttatatgggcattca

SEQ ID NO: 14319 - DNA, 101 bp, rice(Oryza sativa)
  misc_feature (71): n=a or g
aaccaaaatcggcgaccttggcaatcaaattgtcacctagcagaatgttggcagatttcacatccccatgnaggataggacgtgccaacgaatgcaagtgt

SEQ ID NO: 14320 - DNA, 101 bp, rice(Oryza sativa)
  misc_feature (71): n=t or g
atagttcataatgtgattttaacaagtgcattgtgcgctatcgctatcgttcataatattgtagccacagngcacctctacagcatatttatatagcgttg

SEQ ID NO: 14321 - DNA, 101 bp, rice(Oryza sativa)
  misc_feature (71): n=a or g
ttcctgccatggaatggacggggctcaaactcaaaactggctcagcgagcgaggtttacgtgtgttaattnaaagtttggttgaaattgaaacgatacgat

SEQ ID NO: 14322 - DNA, 101 bp, rice(Oryza sativa)
  misc_feature (71): n=t or c
ataggataattaagccagtgaacattcccaacatgggtgaatgttttgatttgggcaggcaaaagaggttnagcagaactgttgataatttgtcggaactt

SEQ ID NO: 14323 - DNA, 101 bp, rice(Oryza sativa)
  misc_feature (71): n=a or c
tgtctcatgtgtcaaaatggttatgttttttgcaagtcgaacaatattactatgttagtagatctgggttntatgaaatgtactcttttaattaagaagta

SEQ ID NO: 14324 - DNA, 101 bp, rice(Oryza sativa)
  misc_feature (71): n=a or g
gaaaataatgtgggccccacatctctttttttattctctcttaggcgctcggcctctcaccctcctcgccngtggcagatgggggagaggcggccgacaag

SEQ ID NO: 14325 - DNA, 101 bp, rice(Oryza sativa)
  misc_feature (71): n=a or g
cggaatctagtgcaggggctggcaagtcttcatctgaacctgtcaagactactgctattgctgacagaatncgagctctcaaggctcatcggcgagcccaa

SEQ ID NO: 14326 - DNA, 101 bp, rice(Oryza sativa)
  misc_feature (71): n=t or c
aaaaaacagaaatccagtgcagccaatacctttgcacttgaagaacaggaaggttgaactccattgccgcnggaagaggagcattgggcagcaatgttcta

SEQ ID NO: 14327 - DNA, 101 bp, rice(Oryza sativa)
  misc_feature (71): n=a or c
cgttgaactaaacaaatatctctcgcgcgggatcgagctcgccaagaaattgctccacctagaggtgtcangtaaagacatcgacaaggttctgcaggtga

SEQ ID NO: 14328 - DNA, 101 bp, rice(Oryza sativa)
  misc_feature (71): n=a or g
gaaaatcatggaatttagttgttttattagacattgagaatgaaggtgatatgcgggcaataccgcacaanccatgcaactatgaatctgtataattaatt

SEQ ID NO: 14329 - DNA, 101 bp, rice(Oryza sativa)
  misc_feature (71): n=a or g
acagcaagctcaatagccggcatcactgctctaccgataaccgaatcaaatgtgaataatgcaccgatgcncagctcagctggccttgaaccatcacctcc

SEQ ID NO: 14330 - DNA, 101 bp, rice(Oryza sativa)
  misc_feature (71): n=a or c
cttcgatcgtcctcacccccaccttgcccgctaccatcacctctgtctgccgcctccccataactgttccnatatgtgctttcgtatccacttggaccccc

SEQ ID NO: 14331 - DNA, 101 bp, rice(Oryza sativa)
  misc_feature (71): n=a or g
ccgggtctacgaaaatcgctatttttccatacgggtgacccacacgccacgaaaatcccattttttccgtncaggtgcttctgtcgtccacacgcaaaaat

SEQ ID NO: 14332 - DNA, 101 bp, rice(Oryza sativa)
  misc_feature (71): n=t or c
caatcggcaagccaaaaaacaaaaaaagatttcttttcttttcttttcctcctgttgctcgtcgacgcgcngccgccgccgccgccgccgcctcctccatc

SEQ ID NO: 14333 - DNA, 101 bp, rice(Oryza sativa)
  misc_feature (71): n=t or g
tacaaacagcactgacgttcctgatctgagcacatttgcatacaggcctacaactgcttctgctcattctnatcaggggaagatcacaagcaaagctacag

SEQ ID NO: 14334 - DNA, 101 bp, rice(Oryza sativa)
  misc_feature (71): n=a or g
attggataacttggtggtcgactgtgggtcaatcaggactaggcttcaagaaattcaatctttgatcccanatgaactagccgatgcccttactccagcgg

SEQ ID NO: 14335 - DNA, 101 bp, rice(Oryza sativa)
  misc_feature (71): n=a or g
gtggttctcaggagcattaatcgatatatatggtttaggagtgcggtcgtgatgtacatagcagagacccntccttgttgctcgagtgacgttgtctgctg

SEQ ID NO: 14336 - DNA, 101 bp, rice(Oryza sativa)
  misc_feature (71): n=a or g
tcaccagaagttgcattgggcatctgtgagttgcgaccaaaccttactgtgctcaaattgaatagtgtcantaaggagctcgaggagttcatagagaaaat

SEQ ID NO: 14337 - DNA, 101 bp, rice(Oryza sativa)
  misc_feature (71): n=t or c
gcggctgcaggttcatcgccggctgatgatgatgatactgctgaaaccccggcgagtcattaggcttcgcngccgccgccggctccgtgaggcttctgagc

SEQ ID NO: 14338 - DNA, 101 bp, rice(Oryza sativa)
  misc_feature (71): n=a or g
tagaaggaaaaatacagaaaacttatgattgtacggtgatttgatggagagaaaagggagagagaaagagncaacttgtagtgcaaccctaaaaggaattt

SEQ ID NO: 14339 - DNA, 101 bp, rice(Oryza sativa)
  misc_feature (71): n=a or g
ctcgagaaatcgatatcatggttgcattctctgaatcttccggcatccttgcaggccagatgtggaagggngatttgcaattatgacactataaatattaa

SEQ ID NO: 14340 - DNA, 101 bp, rice(Oryza sativa)
  misc_feature (71): n=t or g
tgttagttgttgaacaatttgttgtaagatattggtagcggataggtaaggtgcaaaacactccatggctngaatgtcgaactgcttctgcttacctattt

SEQ ID NO: 14341 - DNA, 101 bp, rice(Oryza sativa)
  misc_feature (71): n=t or c
atgcccaccacctgttcgatgaaatgtcgagctgtccaagagctgactcagctgctgtccttcgcgtcacngtgagccagatcatatatccagtgacatct

SEQ ID NO: 14342 - DNA, 101 bp, rice(Oryza sativa)
  misc_feature (71): n=t or c
cctaatcgtgggtcctcaggtaggcttctgagcattatatccttgcttatctcttcttccgctccacctcngccgccgcagggcttgccatcagttgttgc

SEQ ID NO: 14343 - DNA, 101 bp, rice(Oryza sativa)
  misc_feature (71): n=t or c
atggttgcttttgcctatactgtgcaaaaggctaaaagccactgtactgtgtagtactgctcgtctcatgnttctagaccaataataatataaaggcggac

SEQ ID NO: 14344 - DNA, 101 bp, rice(Oryza sativa)
  misc_feature (71): n=t or c
tattactactaagatctctaatgtatcagaaaataaattgtatgtcttattatagatgctctgcatccacnatgtggtaaatgatgataatgtataaggtt

SEQ ID NO: 14345 - DNA, 101 bp, rice(Oryza sativa)
  misc_feature (71): n=t or c
caactaatacaagcaagaagtcgatcagcacacagtattccaccacgacttagatatcatacttggggccngtttagttccccaaatttttttttcaaaaa

SEQ ID NO: 14346 - DNA, 101 bp, rice(Oryza sativa)
  misc_feature (71): n=a or g
ggctggaggagaatgcagctcttggagcaattggtgcagccagctggtttcagcgacgacatttgcaacanctcgatactcggcttcagcacttgacctgg

SEQ ID NO: 14347 - DNA, 101 bp, rice(Oryza sativa)
  misc_feature (71): n=t or c
aagagtagaccaagctggaccaggccaacaacctgatggagatgaacagcaagaatctgatggagatgaanaacaagaacctgatggagatgaacagcagg

SEQ ID NO: 14348 - DNA, 101 bp, rice(Oryza sativa)
  misc_feature (71): n=t or c
gaggtagatgatgtcgtgttctaggtgctggggtggcacgtgttgtcgttgccagcttcctcgtgcaatgncgattgttggaactacgaacttggatagga

SEQ ID NO: 14349 - DNA, 101 bp, rice(Oryza sativa)
  misc_feature (71): n=a or g
gggcagtcgagaaggatgtggtcgatggtttctttttgttagtcacagaagacgtaggaggtagggtgtgncagccctcttgtgctcagcatgttcgccat

SEQ ID NO: 14350 - DNA, 101 bp, rice(Oryza sativa)
  misc_feature (71): n=t or c
cccagcatcagtgagcatattttgcaacctaggctctaggtttagatctctcaaattacccaagcatgtcntgagtattgacttgcctaacttcttacagc

SEQ ID NO: 14351 - DNA, 101 bp, rice(Oryza sativa)
  misc_feature (71): n=t or c
ctacgctgcatgggattctctactgtcatgttaaggcattagcagtgcggcaagtaattttaccggacttngtatgccacctagaccaagaataatgttag

SEQ ID NO: 14352 - DNA, 101 bp, rice(Oryza sativa)
  misc_feature (71): n=t or c
agcccttcaatgaaatcaagcgacacaatttgccaagcatgatccggaacaggcagaggttgtaacatacnaggataacggacatgttcagacttagctcg

SEQ ID NO: 14353 - DNA, 101 bp, rice(Oryza sativa)
  misc_feature (71): n=a or g
gggctaccaagacgatatcgcctaattctagactctccttggctagatctggcaaggtggctagtagacancgggtggggcggaggagacctaagctagtg

SEQ ID NO: 14354 - DNA, 101 bp, rice(Oryza sativa)
  misc_feature (71): n=t or c
cttactagcgtagtcgtaggagtgtgttggttttctgggcacgctcgtattttcttcttaaatactccctncatctacttttaatagttatatttttaaat

SEQ ID NO: 14355 - DNA, 101 bp, rice(Oryza sativa)
  misc_feature (71): n=a or c
atcctacaatacaaatatcattgtgttagaaaaataacccatgttatcgtagaatatgtatttccttgtanttaacacggtataaccataaacataaacat

SEQ ID NO: 14356 - DNA, 101 bp, rice(Oryza sativa)
  misc_feature (71): n=t or c
gacggacgtacggcacaccattaataaacgcataagcgtttcatagtacgaatatcgtaaacacccagatngtacgtatagcagcgttgatttgtgaaaca

SEQ ID NO: 14357 - DNA, 101 bp, rice(Oryza sativa)
  misc_feature (71): n=t or g
ccctaccatatttccatataatcacatgcatggagactagaggtagatagagccacacacaaggctccaantacaatcatcattactttgttaattgttat

SEQ ID NO: 14358 - DNA, 101 bp, rice(Oryza sativa)
  misc_feature (71): n=t or g
actccgccattgatcttgattgagttcatatatgaaaaaaaaagcatgaataattatccccggagcgaccnccgcccccacccgccattgtgcttggctcc

SEQ ID NO: 14359 - DNA, 101 bp, rice(Oryza sativa)
  misc_feature (71): n=t or c
tgtaaatactagcagcgatccctgatatggcaaatctagtaagcttgcagtagggcgggcggcggcgacgnttttagcgtcgtttcttccttgaaggcgtc

SEQ ID NO: 14360 - DNA, 101 bp, rice(Oryza sativa)
  misc_feature (71): n=a or g
cccttcgatctggagggtttgtcgtagtcgtgattttcgctcagttttgatctcgtttcttctttaaaatnggatatcttctttatataaaacgtcggtaa

SEQ ID NO: 14361 - DNA, 101 bp, rice(Oryza sativa)
  misc_feature (71): n=t or c
gtgtcgccgctcgccatccagaaggggaagaaaacggctgctgaaacgtcggcttcggagtattctcttgnggcaccccactttgcccctggtgatttcga

SEQ ID NO: 14362 - DNA, 101 bp, rice(Oryza sativa)
  misc_feature (71): n=t or g
cgccgcaaccttcttggagacgttggtgtggagtcttcttccttcctaggggattattcgggtgaaaattnccctgctcctgggacaggcgatggcgacac

SEQ ID NO: 14363 - DNA, 101 bp, rice(Oryza sativa)
  misc_feature (71): n=t or c
tgaatatcattgggttttatgctcatgtttagttgtgccttttagcattcaacgttcttttcactcgtagngaagcacacgcattttgctagttatatcat

SEQ ID NO: 14364 - DNA, 101 bp, rice(Oryza sativa)
  misc_feature (71): n=t or c
aggaagaaaaagatggcagttaagatggccaagattagaaagggactaatttacaagctcgaaggagctgngatcctagctgatggtaatatgatccacta

SEQ ID NO: 14365 - DNA, 101 bp, rice(Oryza sativa)
  misc_feature (71): n=t or c
gctcattttcgctcaatctgctactgacttggtcacaaattacactctgtaatggaaactttcttttaagntaacggtccagagcaatctgcattctacag

SEQ ID NO: 14366 - DNA, 101 bp, rice(Oryza sativa)
  misc_feature (71): n=a or g
gtccttgttggtaacaccaatccagactaaagatccatggtcccctaacaaatccagactacttcattaantatgattaaatattttaatgatttaactta

SEQ ID NO: 14367 - DNA, 101 bp, rice(Oryza sativa)
  misc_feature (71): n=a or g
aaaaaatacttctaaggtgatacttttcgatcttgtaaaattcaacagagggagtacatagttctcctgcntttttgagaaaaaaaaaacttctttggtga

SEQ ID NO: 14368 - DNA, 101 bp, rice(Oryza sativa)
  misc_feature (71): n=t or g
atccaaaaaaaaaggaaaaaaggggaagaaaaatcgaaatccaactctatcgacacggtaaaaaaagggcnaaaaagataaaaaaatatccgattccaaag

SEQ ID NO: 14369 - DNA, 101 bp, rice(Oryza sativa)
  misc_feature (71): n=t or g
tgtcctcttacttggcatttacgtgctattcatttacaacaggatgaggagagcaatttgatagtgcaacngtattcacttgatgctgaattctcaaagcc

SEQ ID NO: 14370 - DNA, 101 bp, rice(Oryza sativa)
  misc_feature (71): n=t or c
tgtgctataatactattgcatgagctaggtagctaatgattcaattcaattcactgcacatctcgatctanattatgcacacactgacctatagaacatgg

SEQ ID NO: 14371 - DNA, 101 bp, rice(Oryza sativa)
  misc_feature (71): n=t or g
atctcggtcacctcccttaacaccagcacagacctggctcctgcttatgcttttttctagattaacaccanaaggctttgacagcaatgaaaaatacaaga

SEQ ID NO: 14372 - DNA, 101 bp, rice(Oryza sativa)
  misc_feature (71): n=a or g
gaaaagacgcattgtacgtgtatgcctgcacgcgaagccgttaattgtattactccatccgtttcgaaatntttgacaccgttgactttttagcacatgtt

SEQ ID NO: 14373 - DNA, 101 bp, rice(Oryza sativa)
  misc_feature (71): n=t or c
tacacattttctgtttaagaaacttgaaagcctcagtttgtttctctccccattgaaagccttcttttttnagcatgtcatgtaatggtctgcaaattaac

SEQ ID NO: 14374 - DNA, 101 bp, rice(Oryza sativa)
  misc_feature (71): n=t or c
ttcacctttgagcctcgcagacccaaatggtgcagattgaaaagattaccaatagcattgggaactgtctngatgggtactccacttagctcaagcacgga

SEQ ID NO: 14375 - DNA, 101 bp, rice(Oryza sativa)
  misc_feature (71): n=a or g
agcaagagttcctgttcatcaaaggttgggcccggtgaaccaaggttgtaaccaagaagacaatgaagatnggaagactcaatggtgtccttctggtatat

SEQ ID NO: 14376 - DNA, 101 bp, rice(Oryza sativa)
  misc_feature (71): n=t or c
ttcttgtttgatgtgtctgtgtgtagcaactgatttttatggagtgttattagttgtagggatctgtagtntgatctgatttggtaggagctccaaaaaaa

SEQ ID NO: 14377 - DNA, 101 bp, rice(Oryza sativa)
  misc_feature (71): n=a or g
tctctgtaattcggatttatgggttcccccgaaatattttgcttctccaaagatttttaacccttgatagncaatatccaatggttctaaattatcgtaaa

SEQ ID NO: 14378 - DNA, 101 bp, rice(Oryza sativa)
  misc_feature (71): n=a or g
aaatgatggactccaagatccttcatggcaaactctgactgaagctgtgtgatggtccactgaagtatcgncgccgaggaggccgtcaggactatatcatc

SEQ ID NO: 14379 - DNA, 101 bp, rice(Oryza sativa)
  misc_feature (71): n=a or g
ctgtgtcaattcacaaaattctttgtttcttttttctggtttaccatgcggtaagaattgtatgtcagacnattaactgagtgctaaacacatccctcctt

SEQ ID NO: 14380 - DNA, 101 bp, rice(Oryza sativa)
  misc_feature (71): n=t or c
caaaaggagtataggagtatgattggatcattactctatctcactgcttcaagaccggacatacaatttgntgtatgtttgtgtgcttgttttcaagcttc

SEQ ID NO: 14381 - DNA, 101 bp, rice(Oryza sativa)
  misc_feature (71): n=t or c
aggttgccaaagacgaactgcgcgctaattacaagtcaggaacttttccaaaatgtaactacaagttcccngtcaaatgccaaaaaaaaagctgatttcta

SEQ ID NO: 14382 - DNA, 101 bp, rice(Oryza sativa)
  misc_feature (71): n=t or c
tatataaacactattgaaccgctttagaccgagggtagaaccaagggcttcgtcggttcaattaccggtcnggtctcaataactatgcatcagatcatctc

SEQ ID NO: 14383 - DNA, 101 bp, rice(Oryza sativa)
  misc_feature (71): n=t or c
gtaagacaaattaagggagaccgattatattaccaacctccacgatttctcccaatcccctggtacacagngggggtcaacagaagaagcgaacctggcga

SEQ ID NO: 14384 - DNA, 101 bp, rice(Oryza sativa)
  misc_feature (71): n=t or c
tgaacacaattaactctcatcttcaaaaggcaatcatgtgcttagaataacatgttcaacggtatggacgnagcatttgatattgatgcactaaaacctac

SEQ ID NO: 14385 - DNA, 101 bp, rice(Oryza sativa)
  misc_feature (71): n=t or g
gtaatcaaaactcgtattacttggtaagagagattagagcctggtaactttgcataagagagatgagagangagagagagagagagagtagatgattattc

SEQ ID NO: 14386 - DNA, 101 bp, rice(Oryza sativa)
  misc_feature (71): n=a or c
actgctgcaatgaaaaaactcccgcttttcttgataccatgggcgtagaccaaaagcaaaggggggagaanaaaaattggctcaaaattttcctgaaaaag

SEQ ID NO: 14387 - DNA, 101 bp, rice(Oryza sativa)
  misc_feature (71): n=t or c
attctgaagtgggctagatcagaagtaggattgtcatacgagagcgatggtgatgaacctgtggttacacngccagagaataaccgcaacatccagtccta

SEQ ID NO: 14388 - DNA, 101 bp, rice(Oryza sativa)
  misc_feature (71): n=t or c
ctctgcttcgggcgactgccttatgcttcgccttacggccttcgctcttggtggatccttggacgattgangggcttggtggcgaacccttcggtctttat

SEQ ID NO: 14389 - DNA, 101 bp, rice(Oryza sativa)
  misc_feature (71): n=t or c
gttcaaggggccaatttactgctgagttagatcaggacaataagatgccagctaaagagaaccagaacctnggcttgaaggaacaacctaacagagacatg

SEQ ID NO: 14390 - DNA, 101 bp, rice(Oryza sativa)
  misc_feature (71): n=t or c
ggatgcatactgttagctcattagtactctgctcagagatctcacttgcagcctaaccacgttgtcactcnagcatggagagccttctgtaccacgggatt

SEQ ID NO: 14391 - DNA, 101 bp, rice(Oryza sativa)
  misc_feature (71): n=t or c
cttggaggatgttggacagagctatttcaatgagcttgtcaataggggtttgatacaacctgagcagaacnatgatcgggaggtgacgggttgcagggtgc

SEQ ID NO: 14392 - DNA, 101 bp, rice(Oryza sativa)
  misc_feature (71): n=a or g
ccctcgtgcccgtcctcatgtgtagcctcgatgatctcccgagctaagggcgatgccgggggaatgtatanccagctgttgtactgcagcaggtcgtcgac

SEQ ID NO: 14393 - DNA, 101 bp, rice(Oryza sativa)
  misc_feature (71): n=a or g
ttagaaatcatccagctagagtcttgttagacaaaagattacatatactagatggtacaccggacactacnacaatacccattattccgggcggttggata

SEQ ID NO: 14394 - DNA, 101 bp, rice(Oryza sativa)
  misc_feature (71): n=t or g
ccaaatttagaaccgaaattgcaatcaccggatgcaattgtgactattccacgaactcttcgtggctaagncctggtttagttgaggaaatttttttaagt

SEQ ID NO: 14395 - DNA, 101 bp, rice(Oryza sativa)
  misc_feature (71): n=t or c
cttgtatcgctggcttatcatactctattatacctgctctaaggaggggtttcctcctaaaataatgaatntggataaaagttttttttttttttgaggga

SEQ ID NO: 14396 - DNA, 101 bp, rice(Oryza sativa)
  misc_feature (71): n=t or c
tggtggagcagggcagaggcagatctaacgttgtatcttgaagaataacagaaaatacctgatgaggcggngagcgacgaagcaggaggacgccgggcgcc

SEQ ID NO: 14397 - DNA, 101 bp, rice(Oryza sativa)
  misc_feature (71): n=t or c
aacccaactccaaaataaacctaggctgagttcgtttgggatttttgacgacacgcgaaatgagataaacnattaacgcatgattgacgagtattgtttta

SEQ ID NO: 14398 - DNA, 101 bp, rice(Oryza sativa)
  misc_feature (71): n=a or g
tattcatctggaatatacacaaccattgcatattgccgtcacgccgaagaaaaaggaacaaaaggttactntcgaacaaataagaaagaacactatgtttg

SEQ ID NO: 14399 - DNA, 101 bp, rice(Oryza sativa)
  misc_feature (71): n=a or g
aaatgtcgagcaattcaacaagagacgaaatcatgttttgaggaaggttggaacgtttgaatacataccgntggaggaggattgaatgcattgaacggtat

SEQ ID NO: 14400 - DNA, 101 bp, rice(Oryza sativa)
  misc_feature (71): n=t or c
acgcacgaacgcttgcagttgccattacaaattaaacacctatccgtttgtgcaaacagctacacgttcgnaccattttgacgtgatgatatatgcagatg

SEQ ID NO: 14401 - DNA, 101 bp, rice(Oryza sativa)
  misc_feature (71): n=t or c
gagtaatcgaactcatcaagccaggaagatgagcaccgtaacattctattctgccatgtccttccgtttcntgttctttgcttcttgtttatgcatggaga

SEQ ID NO: 14402 - DNA, 101 bp, rice(Oryza sativa)
  misc_feature (71): n=a or g
gcgtgataccgaggttcgcaacgggaaagtgcgatatcgccactgtatcgcattaccaatgcgcgagagcntgatggtctcgcgcgtcgaatgggcgagga

SEQ ID NO: 14403 - DNA, 101 bp, rice(Oryza sativa)
  misc_feature (71): n=a or c
tctcatgctgcatgtgactccatgccagttgcaatgctccaaggatgcgttgctccatgaggctagaactncagttggacctgagagctgcgacttgaagc

SEQ ID NO: 14404 - DNA, 101 bp, rice(Oryza sativa)
  misc_feature (71): n=t or c
ccctcctctaaaaaaaggggaaaaagccaccaaaaccctaaccctaagcatcccaatccccaaatcccccngaaaaccctaaccggatcccccttcccctc

SEQ ID NO: 14405 - DNA, 101 bp, rice(Oryza sativa)
  misc_feature (71): n=t or g
agggcaagcatatttgcttcttcagctttaaattcaggtacaagagttactgcattggaagaaagaatctnaaatcaaaatgaagcctccaaagcagaagc

SEQ ID NO: 14406 - DNA, 101 bp, rice(Oryza sativa)
  misc_feature (71): n=t or c
caacgtgttcctcctcaagtcgatctcaacaaaaaaatcggtcacattctggcctcttgtgtgcccctttntctactgtaccaactaatccatccggccca

SEQ ID NO: 14407 - DNA, 101 bp, rice(Oryza sativa)
  misc_feature (71): n=t or g
atatcttcatacttcatcctcactatgtccatgaagggctcaataggacaggcaagagctgccgcctccgntgggtgaactacctccaccctggcctcaag

SEQ ID NO: 14408 - DNA, 101 bp, rice(Oryza sativa)
  misc_feature (71): n=t or c
gacaccagcatcagatgctatctgttacagtatcaggagtgtgttgtgaaaccgacgacattttaattggnaatttgtgttaataacgcccgtgctaaatg

SEQ ID NO: 14409 - DNA, 101 bp, rice(Oryza sativa)
  misc_feature (71): n=a or g
catcacaagagaagagttctacaatcgcagttggtggattcaatcacaaataacctctgtttaggtggacnggtatggcaattcttgtatgtattttgaaa

SEQ ID NO: 14410 - DNA, 101 bp, rice(Oryza sativa)
  misc_feature (71): n=t or c
atactctttgaaatagggcagatcactagagcctcgccaattgtgcccggaacccctcgaggtgttcgtcngttacgcacgacgccaccacgttgacgcca

SEQ ID NO: 14411 - DNA, 101 bp, rice(Oryza sativa)
  misc_feature (71): n=t or c
gtgcttgctctggcatttgcattcgcaggaaatactctcaactcttggagctgtatacaggatgaggctanaattttcaatccttcatcaccaatgtgatc

SEQ ID NO: 14412 - DNA, 101 bp, rice(Oryza sativa)
  misc_feature (71): n=t or c
cctcagcgcagtttctctcttcttttttttttgttctaataccagaatgattaaccaggatgtgcacatanatatatggctacaaatatgcatgtttaaat

SEQ ID NO: 14413 - DNA, 101 bp, rice(Oryza sativa)
  misc_feature (71): n=t or c
cgattaaattttctatactaaaatatgatcgaactaaaagaccactttggtcctgtttggggagcttgtcncagctgcagcttttcccaaaagctgcttct

SEQ ID NO: 14414 - DNA, 101 bp, rice(Oryza sativa)
  misc_feature (71): n=t or c
tggagctggaacgaaatggagagatgtgctatccgtttattttgctctactaatttagagagtgcgagttngtatggattgagggatatatacatagtgaa

SEQ ID NO: 14415 - DNA, 101 bp, rice(Oryza sativa)
  misc_feature (71): n=t or c
acagtgaaaagaacaaacaattcaggcagcaacatacagtttcgaaaaatttgatgccatactcatcagcnagtgcttggcctttcgcagtagggacagcc

SEQ ID NO: 14416 - DNA, 101 bp, rice(Oryza sativa)
  misc_feature (71): n=a or g
gttgtattgcatttgaaagtcaatgtgtaacaagacattccacctggccttgatggattagaatcgcaacncatcaatgtttcatactccctccgtttcat

SEQ ID NO: 14417 - DNA, 101 bp, rice(Oryza sativa)
  misc_feature (71): n=a or g
tagccttggacatattgatccaattctcagccatgaattcatcatggcaaacgtgtattcccatgtagagntaactaggagctgacaaattgaccatcgat

SEQ ID NO: 14418 - DNA, 101 bp, rice(Oryza sativa)
  misc_feature (71): n=a or g
gcagaataggtgactgaatttgtggttgttcagaactcagaatatccaatgactggatgtctgcttgtaangaattaagagtataaacactagtgacatag

SEQ ID NO: 14419 - DNA, 101 bp, rice(Oryza sativa)
  misc_feature (71): n=a or c
cataatctgatccaacccccttctcgtctcttacttccccattatctttggcacccatttctgaatatttntaatctctgctagaattgtggtacctggaa

SEQ ID NO: 14420 - DNA, 101 bp, rice(Oryza sativa)
  misc_feature (71): n=a or g
tcaaactccactattaattccactgtcactagctcgatcggtaattaaaggcaaggagctttaatttggtntcaagcaaaaatttatccaaccaacttatg

SEQ ID NO: 14421 - DNA, 101 bp, rice(Oryza sativa)
  misc_feature (71): n=t or c
tcttaccacttgaaagtggtactgatgattgatgatgtgaacaacctgatggattaggtcctggatgctcncttctggaggctgtggttccaccagcaccg

SEQ ID NO: 14422 - DNA, 101 bp, rice(Oryza sativa)
  misc_feature (71): n=a or g
gcgtggagtggagtggagtccgtataggttatgcacaacttatccagtttgattacacgttgtggagatcntgcaggcatcttgatcacgtatcctgttat

SEQ ID NO: 14423 - DNA, 101 bp, rice(Oryza sativa)
  misc_feature (71): n=a or g
tgtcatgttcatgaataacaacaacggtatcgtccacaaagagatgaaggatggtacattgctccataggnaatattacgtacgaaccaaaaccaacagaa

SEQ ID NO: 14424 - DNA, 101 bp, rice(Oryza sativa)
  misc_feature (71): n=a or g
acttccagttcggattcactggtgcgtgggtctatggattgcattgtagatgcattccattcaatttcctngcattcttctagatgcctatctccccctaa

SEQ ID NO: 14425 - DNA, 101 bp, rice(Oryza sativa)
  misc_feature (71): n=a or c
acggttcctagagcgtcatcctcattgtcgattccgcctggaatctggggaacgggaaccacatcgtcacntgttgtcgtcggtctgttggtgacttcgac

SEQ ID NO: 14426 - DNA, 101 bp, rice(Oryza sativa)
  misc_feature (71): n=t or c
accacaccaatgtccttgggcttcacacccgtcttctcaagaagctggtcaatggcgccgaacatgacggngcgggcctccttgcgggcctcgtccatgca

SEQ ID NO: 14427 - DNA, 101 bp, rice(Oryza sativa)
  misc_feature (71): n=t or c
tataattgggctttcttaggcattcgggaaaaccctcagacggttgcgggttaaaaagtaggaataagttnaccttaggttcctcaatttatcgccgagtc

SEQ ID NO: 14428 - DNA, 101 bp, rice(Oryza sativa)
  misc_feature (71): n=a or c
ttagatagcaatggtactattcctccctgcataatatccacatagctccaacgctcccacatattcaccanccatatactattcatctcatgtctaaggcg

SEQ ID NO: 14429 - DNA, 101 bp, rice(Oryza sativa)
  misc_feature (71): n=t or c
tgcgtggccctcgcacctgtgtgcgcatggccacgactacacacgccatcactactaggaaaagcattttngccggcaggggaaacacatcttcccagccg

SEQ ID NO: 14430 - DNA, 101 bp, rice(Oryza sativa)
  misc_feature (71): n=t or c
ggtggtgtccgaaatttcaaaactaaattgcaatggctgaccaaaagacacatagcaaagcactaacatantccctccgtttcaaaatgttcgacaccgtt

SEQ ID NO: 14431 - DNA, 101 bp, rice(Oryza sativa)
  misc_feature (71): n=a or g
ctgtttcttgtctgaaatttgcggggattcaaaatgcttggcttgtgaattagcataaggagcgcgttccnaaacacacctaacgcctcgaagtggcatcc

SEQ ID NO: 14432 - DNA, 101 bp, rice(Oryza sativa)
  misc_feature (71): n=t or c
cccctgtgataatgaagttgtcgcagacctacctccaatattggcccagtgagttcgttggggacggtgcnggtgatggcgacgttggggagggacagtga

SEQ ID NO: 14433 - DNA, 101 bp, rice(Oryza sativa)
  misc_feature (71): n=a or g
tcaggagtaaccttgagttgctgaggacatgtatccaggacgaataaagtaagaattctcatagtatctgncaggatcactttatcatgcctagatacttc

SEQ ID NO: 14434 - DNA, 101 bp, rice(Oryza sativa)
  misc_feature (71): n=a or c
gacgtgtcgcggagtcggccacaaactcgcaaaccaaacccggcgacggcacacaggttttagcaccggangggagctctccgccgtcgccgacgacgccg

SEQ ID NO: 14435 - DNA, 101 bp, rice(Oryza sativa)
  misc_feature (71): n=t or c
aattagcttaggttaattaggattcgatccatcgatacgatggcgttgagaagaatgggcatcattcttgngctcttggccattgctactctgctctcgcc

SEQ ID NO: 14436 - DNA, 101 bp, rice(Oryza sativa)
  misc_feature (71): n=a or c
gataccaatgagggcacaagttcagaaggttgggggtaatagctgccaaaatgtggtggattatgtgttgntcccggagccccagtagaactagacgatac

SEQ ID NO: 14437 - DNA, 101 bp, rice(Oryza sativa)
  misc_feature (71): n=a or g
gcggtgaagtcgacgcagcacaggccaaagcggttgccgtagccggagaggaactcgaacccgtcgagcantgaccacacgaagtatccccgcgtgttcga

SEQ ID NO: 14438 - DNA, 101 bp, rice(Oryza sativa)
  misc_feature (71): n=t or c
acctgaggcgccgtattgcataatcgatgcacaggcatgaccagcaatatatagacttcatccagattacncgtaactgccaaggatttggagtcctggcc

SEQ ID NO: 14439 - DNA, 101 bp, rice(Oryza sativa)
  misc_feature (71): n=a or g
tcgaacaggaccaaacttcatgtccatactccgtactgtacataccaactatactaaatatcgctaaaacnttttaaaaatattatacatatactttcaat

SEQ ID NO: 14440 - DNA, 101 bp, rice(Oryza sativa)
  misc_feature (71): n=t or c
agcaatttcaacccaagataaagaaggggaattgttccgtttcctcaaggagagacttggaacatgttttnaaagaaggtcaggaatcaattggaatatga

SEQ ID NO: 14441 - DNA, 101 bp, rice(Oryza sativa)
  misc_feature (71): n=t or c
ggaacatccatactccatcacgtccatccttgccttggtacattggctaggttaagctacactccaagttnagcctagagcccatgcaggtatgtggtaag

SEQ ID NO: 14442 - DNA, 101 bp, rice(Oryza sativa)
  misc_feature (71): n=a or g
tttacagatctacatcataaaagctgttgatgaggatgcaaatgagtctgagcctgctgatgaggaagctnttggggacaaggacaccagtacagaggatg

SEQ ID NO: 14443 - DNA, 101 bp, rice(Oryza sativa)
  misc_feature (71): n=t or c
aagaaacttacaaaagagaacatatgttatcaggtggtggtaaagccttatccacatgacgggagatagangatacagttgctatttctgaaccaaccatc

SEQ ID NO: 14444 - DNA, 101 bp, rice(Oryza sativa)
  misc_feature (71): n=t or c
cctttgaaaacatttctcgtccaaccgtgccgtgtcgtgtcttattctggatatgttcaaattcgtagtantatgatcgtatttcgtactagttaatttaa

SEQ ID NO: 14445 - DNA, 101 bp, rice(Oryza sativa)
  misc_feature (71): n=a or g
tttaggaccacttttaccttgtcccttttgggaacccttccaactcagacattgtcattctagtacgtcantacaatgaatggtccatgtttcacaggatc

SEQ ID NO: 14446 - DNA, 101 bp, rice(Oryza sativa)
  misc_feature (71): n=a or c
ctgggaggtagctcattcttggattggtaaccaatgattggctttgtcatgaaatgtggcatggttttggnatgcttaatccctaagtatgctgatagcag

SEQ ID NO: 14447 - DNA, 101 bp, rice(Oryza sativa)
  misc_feature (71): n=t or c
aataagtctactttacctcgctcaagattaaatcaccgtagcatgaaataagtctactttacctccatccnaaaatgtttgacgccgttaacttttttaaa

SEQ ID NO: 14448 - DNA, 101 bp, rice(Oryza sativa)
  misc_feature (71): n=t or c
caaggtttatttcataccagaagaactgctgctgcaaaagaactctatgtcagtattaccaaaagtggaanacagcttgaacttagcacgtacaacataat

SEQ ID NO: 14449 - DNA, 101 bp, rice(Oryza sativa)
  misc_feature (71): n=a or g
tcaggcatttcaagagggagatgatgaaacacttcaggatgagcgatttgggattgctcacctattacctngggatggaggtacgccaaggtggtcatggc

SEQ ID NO: 14450 - DNA, 101 bp, rice(Oryza sativa)
  misc_feature (71): n=t or c
ctgatcttccttcacctgggtagtagagcttcgtgagttaaggccttgtgtagtcacatctgcatcacgtntgggaaccagggatctagacggaggctgcg

SEQ ID NO: 14451 - DNA, 101 bp, rice(Oryza sativa)
  misc_feature (71): n=t or c
aatagcgacggcagcagcagcagtgacagaagcagcggaagccacaaagctagtactactagcctactacnagtagggggatgggtcttggtgggggaata

SEQ ID NO: 14452 - DNA, 101 bp, rice(Oryza sativa)
  misc_feature (71): n=a or c
accatggtcaccatggctatcttattctacctgtcacttatttgtaagccttgtgtagcgacgacgacggnaaggtgagcaaggaggcgaggtggttcagg

SEQ ID NO: 14453 - DNA, 101 bp, rice(Oryza sativa)
  misc_feature (71): n=t or c
gcttaatgtataggcttctttgttagtgggctataggaagtttcggcatgtttggttcgcatattcacacngtaaaaacttgctatacttttagggagtgt

SEQ ID NO: 14454 - DNA, 101 bp, rice(Oryza sativa)
  misc_feature (71): n=a or g
gatcacaagataggcaagattagaaagggaaatcatctgctccgaaagttttgatattccaacgccagaantagaaagctctctgagaccgggagcactac

SEQ ID NO: 14455 - DNA, 101 bp, rice(Oryza sativa)
  misc_feature (71): n=t or c
tctgatttgcatgcccagcgtacccacaattgtagggcgctggaggatgtgatgaaactacacaaggatcnatgttgcttctattgtttgcaacagaatga

SEQ ID NO: 14456 - DNA, 101 bp, rice(Oryza sativa)
  misc_feature (71): n=a or g
actgtcacaaccgccatagggacccacctgtcaaccacatagggaagtttggaggcctgctgcgaaccctngtgacgctggctctggctggccttacacct

SEQ ID NO: 14457 - DNA, 101 bp, rice(Oryza sativa)
  misc_feature (71): n=t or c
gacccattctctccatttggaccagatgatttactctggctcactttgttatgcgccttgtccctcttatncatcattgccttatgttcttcctcacgctt

SEQ ID NO: 14458 - DNA, 101 bp, rice(Oryza sativa)
  misc_feature (71): n=t or g
ttatttgtgcatttttgcaaacgaaaaggtggttatatcaaggttgaaagcccagctcagtttttgctgcngacaaggtccctgaaccagtaggccgacat

SEQ ID NO: 14459 - DNA, 101 bp, rice(Oryza sativa)
  misc_feature (71): n=a or g
gagggagtatccttttagaaacgagcattttatgtgctgatagtctgatacaccatgttaccatccggccnattaaaaaaaaattaaatgacttacaatat

SEQ ID NO: 14460 - DNA, 101 bp, rice(Oryza sativa)
  misc_feature (71): n=a or g
ttggaaatgaaattatgattaagatgcatctgcacttctgcagcatgttcttctgcctgattaacgttgcntaagtgaagaagatacttgtgctacacttt

SEQ ID NO: 14461 - DNA, 101 bp, rice(Oryza sativa)
  misc_feature (71): n=t or c
ttcctggaccttatctcctcatgttagtggctgtggttgttgctatcctgttggaagcttttctcatgtgnctccactgggtgtcatattctcggtactta

SEQ ID NO: 14462 - DNA, 101 bp, rice(Oryza sativa)
  misc_feature (71): n=a or g
aagataatctgacagagataacttttcttgcagaggacatatggtacatgaatttttcagatgatccacantcccctaagaatggagaaaatgctattata

SEQ ID NO: 14463 - DNA, 101 bp, rice(Oryza sativa)
  misc_feature (71): n=a or c
tcccttttaccggcgcttctctctcccactttcctcgcattctctctcacacttcccccatttaccggcgnccagcggagaggaggcgacatcctcgggct

SEQ ID NO: 14464 - DNA, 101 bp, rice(Oryza sativa)
  misc_feature (71): n=a or c
agcaacggttgtatccattatagctatggtcacatcagatttccagctgagttctggaatgtaattaaatnagacctggttaatttattaaaagattttca

SEQ ID NO: 14465 - DNA, 101 bp, rice(Oryza sativa)
  misc_feature (71): n=t or c
atttttttctaattatttgatagccaagttttttcttggttatctttaatattacactttgatggttaacntgttataatgtattacaaaaatattaacat

SEQ ID NO: 14466 - DNA, 101 bp, rice(Oryza sativa)
  misc_feature (71): n=a or g
gggccatgggctttgcagaaaagaacaagatgggccaagggaacccaaaaacaaaaggaataagttcaccngagatccctcaacttaatagcgagattttt

SEQ ID NO: 14467 - DNA, 101 bp, rice(Oryza sativa)
  misc_feature (71): n=a or g
tatattggtaaccctgtcagagaggatgatgacggtaaattccatatacttcctcagaaaccgcaaagacngagagaatcgaagtggaccagcacagaccc

SEQ ID NO: 14468 - DNA, 101 bp, rice(Oryza sativa)
  misc_feature (71): n=a or g
ctctcccaagaagaaagtcggagaggaaggggcaaatggtcaccacacgcagggaagtggatcctctgacntgaactacacactgacgtggtcactgacag

SEQ ID NO: 14469 - DNA, 101 bp, rice(Oryza sativa)
  misc_feature (71): n=a or c
gctcttacggcaatgtaatgcatggctcggttcagcatttggcatatgtagatatctagttgtgtgatganacaaatgaatcacagctatgattatgaaat

SEQ ID NO: 14470 - DNA, 101 bp, rice(Oryza sativa)
  misc_feature (71): n=a or g
taactacattggataattgttacggtatatggatatcattttatgtatcgacggttgcttgagtacaattnaattgggtgtcctttttctcattggtttaa

SEQ ID NO: 14471 - DNA, 101 bp, rice(Oryza sativa)
  misc_feature (71): n=a or c
ccctaatcaagtggacgttttcagggtactctatctgcaggatatgttttcaatggctcagaaataacttnatgacaatagtgttgtggcaatcaatgtat

SEQ ID NO: 14472 - DNA, 101 bp, rice(Oryza sativa)
  misc_feature (71): n=t or g
atgcacaaattctttactggtgtgttactactagtgctgtagaaattgtggagcccttggtgttcatgctnccccgcttgtagaagctgtaagcagctaag

SEQ ID NO: 14473 - DNA, 101 bp, rice(Oryza sativa)
  misc_feature (71): n=a or g
ataattttgatcataaaacatggggattttgaaatttactctatcaaagcatattatatatactccctccntcccaaaatataagcatttttagactctga

SEQ ID NO: 14474 - DNA, 101 bp, rice(Oryza sativa)
  misc_feature (71): n=t or g
ttcaattcaaacgaatcggattaaaccaaacagagaaatgcatgggttacctggagatcgtgaagggattntgctgtgttcttgcgcccctcgtataccaa

SEQ ID NO: 14475 - DNA, 101 bp, rice(Oryza sativa)
  misc_feature (71): n=a or g
aaacgatgtgcagaaagaagatttttcttggccttagggacatgcaaaacattcttaagatataaattgcncgtaggggtatgaataatggaatggccaat

SEQ ID NO: 14476 - DNA, 101 bp, rice(Oryza sativa)
  misc_feature (71): n=t or c
cttacacatacaatatcttcccactggagcatcttatctggatccattaattctatttcatagcttccagnatccaacacaacaaacttaaaatttgcttg

SEQ ID NO: 14477 - DNA, 101 bp, rice(Oryza sativa)
  misc_feature (71): n=t or c
gtagatgcataagtccaaaattaagcttgtgtggaccatgaatttattagttgtacctgttactcatcccnatacattatattacataaacaaggcattac

SEQ ID NO: 14478 - DNA, 101 bp, rice(Oryza sativa)
  misc_feature (71): n=t or c
ggggcaacgctgaatcgcgaccgttcgtttcctgatcggacgggcggacggctgggtagctatcaaacagngtgaaacttgacccatcccaagggccagat

SEQ ID NO: 14479 - DNA, 101 bp, rice(Oryza sativa)
  misc_feature (71): n=t or c
ttcacatcaaatggtgtatgctcctgttcatatattcctatgtcctcgtttactggtcactgttgacccgntagtgttttaactttgatcattaatagttt

SEQ ID NO: 14480 - DNA, 101 bp, rice(Oryza sativa)
  misc_feature (71): n=a or g
aaaactggtgcaatttgactctctcgatggttttagatgacagtttcgctaacgtgacgtctacgtaacantgttgatctgatcttcttgtgtgcttgcac

SEQ ID NO: 14481 - DNA, 101 bp, rice(Oryza sativa)
  misc_feature (71): n=t or c
agagccatcgctgtggctcttggcaaagcagggtgcaaggtaattatttctagtctgatatgttcaacagncgagaaaccaacaaccttgattactgttgt

SEQ ID NO: 14482 - DNA, 101 bp, rice(Oryza sativa)
  misc_feature (71): n=a or g
tggcccaccccacaaagctcgatttgtcgtactcacacacctcaccacacgccacgttgatgcctcgatanaacatcacttttttgttgtttttttcgctc

SEQ ID NO: 14483 - DNA, 101 bp, rice(Oryza sativa)
  misc_feature (71): n=t or c
gccctgaaaaaaatagaccaacgtatgtcaggctgaataagttagtattcgagccccaaaaaatagccggngatctgaagagtaagcgggcgtttattaca

SEQ ID NO: 14484 - DNA, 101 bp, rice(Oryza sativa)
  misc_feature (71): n=t or c
acaacaaccaaatccttttacttgatggttccaataatccacatgtccctacactcacaaaagactctccnggttcttctaccgttctacgccaccaaatg

SEQ ID NO: 14485 - DNA, 101 bp, rice(Oryza sativa)
  misc_feature (71): n=t or c
aacactgaatataaatgatttccatgtgttgaaaatatgagctttccaacagtgtcagagacagaaattgnaatgagcttttcctgaactttttttacatg

SEQ ID NO: 14486 - DNA, 101 bp, rice(Oryza sativa)
  misc_feature (71): n=a or g
ccaccttgtaggtaccaatattcctcctcaccatcataatcgtatccgtcgtcatattcgtcaccgtcatnatctccatggtcaccttggcccaaacccaa

SEQ ID NO: 14487 - DNA, 101 bp, rice(Oryza sativa)
  misc_feature (71): n=a or g
tgcattaatagataatgagcatcgactacgtgtttcgttcctcaacaagtcatgtggtcagatgacatggnaacttaagcatgacaaggatctatcttagt

SEQ ID NO: 14488 - DNA, 101 bp, rice(Oryza sativa)
  misc_feature (71): n=a or g
actaggcattcatgggccacaatgtcttcggtcggttttgcaagttaacgatgcctttaaatgggtcaacnagaggggggccatgtctcggtcgcgaaact

SEQ ID NO: 14489 - DNA, 101 bp, rice(Oryza sativa)
  misc_feature (71): n=a or g
aatttactagaacttcgtaggaaatatagtttgattcggcccagcatgaatcgggcaatgatctatgttcnaacttcaacctcactgcaactttttcatgt

SEQ ID NO: 14490 - DNA, 101 bp, rice(Oryza sativa)
  misc_feature (71): n=t or c
gccatggcagcggcgatggagtaggggatgatgaggtggcgaggtggaaggcctcgatgggttgggttctngttggcatctccttgctgggccaggttctc

SEQ ID NO: 14491 - DNA, 101 bp, rice(Oryza sativa)
  misc_feature (71): n=t or c
atatagtgctaccttttgcatacaccaccccttccataagaaaacgaatttctgactatgaatttgaacanatataccctatgttcagattcgtaaccaga

SEQ ID NO: 14492 - DNA, 101 bp, rice(Oryza sativa)
  misc_feature (71): n=a or g
cgtggcatgccacattggctgtcaaatatggtcaaaggataattggtctggggatggtacattaaaccaanttcacggatctaaacgtgtaatttttaaat

SEQ ID NO: 14493 - DNA, 101 bp, rice(Oryza sativa)
  misc_feature (71): n=a or g
aatgacaacttcgtttatgaaatcatcgatctccttacgaaccgtaatattcgatttcttgatggcaacgncacgtctgtctggcaaggtgcctttgtaga

SEQ ID NO: 14494 - DNA, 101 bp, rice(Oryza sativa)
  misc_feature (71): n=t or c
taaatttcagattatcaaggtcaacgagtatggtgtgtattcaatctcagacagcatgctgataaaacctngaacctgttttgtatgtcatatggtttaat

SEQ ID NO: 14495 - DNA, 101 bp, rice(Oryza sativa)
  misc_feature (71): n=a or g
gcagtcaaaactcatggtggcatcatggccagaatgatataagtagttggctggcaatcagggacagtganttgtggaatgtcaaggaaagggtgctctaa

SEQ ID NO: 14496 - DNA, 101 bp, rice(Oryza sativa)
  misc_feature (71): n=t or c
ggtgtacatctctaacaggctaactgctctatcctgtccgtggcagaaacaatctagctcaaatgtactangtatgctccattctctatctatatagcctg

SEQ ID NO: 14497 - DNA, 101 bp, rice(Oryza sativa)
  misc_feature (71): n=a or g
gtttgaactggtctcttgtgggaaatgtcaaaatgaatcatgctcctactctatggctcttgagtgcaacnttgaacgccatggtccatgtctcgttattc

SEQ ID NO: 14498 - DNA, 101 bp, rice(Oryza sativa)
  misc_feature (71): n=a or g
ccagcaactgtgatgcacacaaaagtgctcgctaattatgggagcaatctagcaagtgtaaaccagggcantacctggttttgctaactcgcatgctgtgc

SEQ ID NO: 14499 - DNA, 101 bp, rice(Oryza sativa)
  misc_feature (71): n=t or g
ggtcctgtgcacgcagctgccgtcgtctgatatgatgtttcgttttgccttttggccgcagctgatattcnatttccgtttcctggctctcctcgccgtcg

SEQ ID NO: 14500 - DNA, 101 bp, rice(Oryza sativa)
  misc_feature (71): n=t or c
aaaacggcataaagggttgttaggtgttatcgtgatggcggatatatgggcaaaacacaggatttgagaangccagaaatcctccgagtagtggtatatat

SEQ ID NO: 14501 - DNA, 101 bp, rice(Oryza sativa)
  misc_feature (71): n=a or g
cttataccacattttgattttcttttctatctcgctttgcatcacaaatagcaatccaacctaaaaatccntgagaaaatatagagaacactattccgtgg

SEQ ID NO: 14502 - DNA, 101 bp, rice(Oryza sativa)
  misc_feature (71): n=a or g
atcttatactgcctcagttaggtccgatctattaaattgctgtcaataaggttaaatctaataagtgatanatttttatacaacgttcatcggagtactgg

SEQ ID NO: 14503 - DNA, 101 bp, rice(Oryza sativa)
  misc_feature (71): n=a or g
cctcaaggtgctcgcctgtaggctgtcgccaggcgccatctccttcttattgaagttgtaacgcatcgtcnggaagggcccaaacaacgctattgagttgg

SEQ ID NO: 14504 - DNA, 101 bp, rice(Oryza sativa)
  misc_feature (71): n=t or c
tctcccaagcttaggacaatgcgaacgtatgtgaccaaccactccacactcgaagcaatgatttggtccanctcttttcctgtacataacattattcatag

SEQ ID NO: 14505 - DNA, 101 bp, rice(Oryza sativa)
  misc_feature (71): n=a or g
tcggtttaacaaccaataaaccaatgggaaacaatcaaggggctctaacatactcttcatcaagatcagcngatggaccttcttcagataggctgtccttc

SEQ ID NO: 14506 - DNA, 101 bp, rice(Oryza sativa)
  misc_feature (71): n=a or g
cgaatgcagcaaactcaagtcaggcatactatccatcccgggtgtacaagcagttgactcgacgagaaacntgtgagatctctgacattgtcgacatgcat

SEQ ID NO: 14507 - DNA, 101 bp, rice(Oryza sativa)
  misc_feature (71): n=a or g
gacacgagatgggccggcacagtgcacggggctacagctcactttgcaggaaacttagttagtgggttatncggtggcccatgtaggataagaagatggtc

SEQ ID NO: 14508 - DNA, 101 bp, rice(Oryza sativa)
  misc_feature (71): n=a or g
tttcattctgtttgatagtgtctcggtgtccggtgcaacatacttgcacaacagcacctcttttgtctatnaaacagtcgtgaacactaaggatgagtttt

SEQ ID NO: 14509 - DNA, 101 bp, rice(Oryza sativa)
  misc_feature (71): n=a or g
ttttttttttggcggagagaatatggtggaatacaccagtgaccaatcccttcccatgacaatcattgcancttaccttttccataagaagaaacctctca

SEQ ID NO: 14510 - DNA, 101 bp, rice(Oryza sativa)
  misc_feature (71): n=t or c
tcaactgcagagacagtaatgtataaactaccagagccaatgctgctaagtaacttgctactgtacgtgcnagagaaattgtcagaagaattatgacgcca

SEQ ID NO: 14511 - DNA, 101 bp, rice(Oryza sativa)
  misc_feature (71): n=a or g
cattaatctggtataaactgagtcaccttttgatcccaaagcaatattgctctccgattttggtgacatantggctgagttagtacggccccacatgtcag

SEQ ID NO: 14512 - DNA, 101 bp, rice(Oryza sativa)
  misc_feature (71): n=t or c
actagtccaaaagcctgtcacatgcatggttacgtattgatggcattatagaaagcctttactttgggtgngtttagtttacgtcaaaattggtagtttgg

SEQ ID NO: 14513 - DNA, 101 bp, rice(Oryza sativa)
  misc_feature (71): n=t or g
ccaatagaccgttgagcgacggggagaggagcccagcagccggtgctcgttagagcaagataataatacanccagctgcttagttatagtctatctatcag

SEQ ID NO: 14514 - DNA, 101 bp, rice(Oryza sativa)
  misc_feature (71): n=a or g
aaagaatttccaggaacaccattaagcagaacagaggtatgtgctgaagtaaaaatcatgtgaacccactncaaccatttgtcactaaaacccatgctttg

SEQ ID NO: 14515 - DNA, 101 bp, rice(Oryza sativa)
  misc_feature (71): n=a or g
ttatggctcaattcgaatgggtaaacaagctgccgactgaccccagcatagaaaccattatgaaccttttnctccaaatctttggtggccacatcatccag

SEQ ID NO: 14516 - DNA, 101 bp, rice(Oryza sativa)
  misc_feature (71): n=t or c
cgttttgcataacgagccgagtccgagtcagtttccggttccgttttcattctttcccaaaacggcaccgngtccttttattttcttttcctttttccggt

SEQ ID NO: 14517 - DNA, 101 bp, rice(Oryza sativa)
  misc_feature (71): n=t or c
gcggtaggagggccgctcgccgcctcgcggcgtcgctagcttcttttaattacataccttagagcaaatanaatagcaggctataagccaattataaacat

SEQ ID NO: 14518 - DNA, 101 bp, rice(Oryza sativa)
  misc_feature (71): n=t or c
gtcgtctaggaaaatagtttttccaagcggtgtacctaaccgagccatctgcaaaaaaaaaaacttttatngcacatggccatgttagaccggccatctag

SEQ ID NO: 14519 - DNA, 101 bp, rice(Oryza sativa)
  misc_feature (71): n=t or c
aaaaacaatgcaagtgccgtggaggagaaaataaatcaaaccatggatttaacaccggaggaacgtcgatnacacactagcatgggataggtcatctcaat

SEQ ID NO: 14520 - DNA, 101 bp, rice(Oryza sativa)
  misc_feature (71): n=t or c
ggctcggcgttgttggagagacgcatgaattgtttgccctagtgatagttaattaatttaccagtaggcanttactgtgttcctacccactgtaaacacag

SEQ ID NO: 14521 - DNA, 101 bp, rice(Oryza sativa)
  misc_feature (71): n=a or g
aactgaattgtccctatgatctggtcttttctttctatgggcaattcctaagtggacctccagaaagggcnggcaaatcgagctccaatttgatcaagaaa

SEQ ID NO: 14522 - DNA, 101 bp, rice(Oryza sativa)
  misc_feature (71): n=a or g
gttccgtatcaacttctgcacccttccctcattcggtctcaccttctagctttggcctccaccctcctccncctgctctcggcctccctccaccctcctcg

SEQ ID NO: 14523 - DNA, 101 bp, rice(Oryza sativa)
  misc_feature (71): n=t or g
gagcaggccgaacagcccaactctgtgcgcagctattactcccgtcaacctgagatccctcaacttaaaantaagattttctaaggtggcttaaccataaa

SEQ ID NO: 14524 - DNA, 101 bp, rice(Oryza sativa)
  misc_feature (71): n=t or c
atctaatcacatcgataccgcgtgatgtgttttgattctttaaaaacgaaaggcgacatgtgaaagaaatnatagcatcatatgttatctatatttcctaa

SEQ ID NO: 14525 - DNA, 101 bp, rice(Oryza sativa)
  misc_feature (71): n=t or g
cgctcctcctcctcggagagatcaacaaccgcgtgcttgccttcctccatgaggatcgagttcttggcgcnggcgatcggatgaagccgcggcggaacccg

SEQ ID NO: 14526 - DNA, 101 bp, rice(Oryza sativa)
  misc_feature (71): n=a or g
ttgattccctacagattaataatccactaaagtgtcaggaaacaaatgtatgatacacgaggatgcattanctctctaatcctttaatcttggcaaagcag

SEQ ID NO: 14527 - DNA, 101 bp, rice(Oryza sativa)
  misc_feature (71): n=a or g
tgaatccgtcacttcatagcgcataagttcatattctgtgcaaacgtgagtacctcagttttggtgctcgnaaacctgcagaagatgaagcgccaattaat

SEQ ID NO: 14528 - DNA, 101 bp, rice(Oryza sativa)
  misc_feature (71): n=t or c
atcatgaataagtatgatggccgtcatgcttcagatccaaatctgacaatataaaggtcatgcctatgtgnatctgtgtcttattcagaaatactgaaact

SEQ ID NO: 14529 - DNA, 101 bp, rice(Oryza sativa)
  misc_feature (71): n=a or g
ttaattttctagggaacggtttacgaactggtcctcggttcccctatgttccttatgtcttactcccttcntcctaaaatataaagaattttaggtaaata

SEQ ID NO: 14530 - DNA, 101 bp, rice(Oryza sativa)
  misc_feature (71): n=t or c
tgaattagcgggtctgcagccgccgccaaatctcccccgaaaacacttccaaattttttatctcctttgtntttggggtctttggaactaccgttatgatg

SEQ ID NO: 14531 - DNA, 101 bp, rice(Oryza sativa)
  misc_feature (71): n=a or g
atatattttctttctgtcagcccatacttttctgaatatttactctccatctctctctcacaaaaggagcnataagctagcacaactaaacctgcaatctg

SEQ ID NO: 14532 - DNA, 101 bp, rice(Oryza sativa)
  misc_feature (71): n=a or c
ctgacggtgataacctcggacacgtaacgatctctcaatgtcttcacaatctgaactagcttacgctctcntgtgggagatgctacctggccaaatgcaaa

SEQ ID NO: 14533 - DNA, 101 bp, rice(Oryza sativa)
  misc_feature (71): n=a or g
cctgtgtcatacactcatacatacacaactaagatcgagagcctacagaggaggaagaggaagatggcaantacgagcagctagctaagctagtttgtgcg

SEQ ID NO: 14534 - DNA, 101 bp, rice(Oryza sativa)
  misc_feature (71): n=t or c
tatcagcataactcttctgccgagacagggcgattctcaatctgatgtttgccagagagtgaaagtagaanagcagaggcccgtaggactactactacctc

SEQ ID NO: 14535 - DNA, 101 bp, rice(Oryza sativa)
  misc_feature (71): n=a or g
tagctaaaaaactgataaggaaaacagctaacaaactttatctaatttgcaagcggatagaactgttggcntccggcacggccgatcagacacgacgtgct

SEQ ID NO: 14536 - DNA, 101 bp, rice(Oryza sativa)
  misc_feature (71): n=t or c
cgcattctatcatgaccccaatttcctgttcaaccaattaaaagcctaacgatgaagaactgaccgccaanaatcctggaaacgagggacaaacttcatct

SEQ ID NO: 14537 - DNA, 101 bp, rice(Oryza sativa)
  misc_feature (71): n=t or g
atggtatatgactcctttgtgtgtgtagtgcagcgtagatttaagaatttgaggtgtttcttgtctagtantgatgaagtaccacaaggcatggcattttc

SEQ ID NO: 14538 - DNA, 101 bp, rice(Oryza sativa)
  misc_feature (71): n=a or g
gctcaaacaaactgtacatgcaacacaccccttaggcccattgcaaaactgacatagaagtacagaaagtncaaagcaaatatcacagtattaataaatat

SEQ ID NO: 14539 - DNA, 101 bp, rice(Oryza sativa)
  misc_feature (71): n=t or c
ccaaccaaccaagccagagaagttccagaggtgacctcacagtcacagagctaagaacatagtacaacganatctggagcaaccaaccacataagagagtg

SEQ ID NO: 14540 - DNA, 101 bp, rice(Oryza sativa)
  misc_feature (71): n=a or g
gaggatagctttggtgtacttcgtggttgctctgatagaggcattcaccacaaaagttcggcctacgacantgcggtccggtccatatgcaatcttccacg

SEQ ID NO: 14541 - DNA, 101 bp, rice(Oryza sativa)
  misc_feature (71): n=t or c
gtgagatccaagtgtcaaaatatttttgagaatagctctgcccaggacagatctgctcggccggaagttcnggtcctttggacccggaagttccggatcga

SEQ ID NO: 14542 - DNA, 101 bp, rice(Oryza sativa)
  misc_feature (71): n=t or c
ctcttcttccttctcaactacgataacatcaaccttgccactgtaaccgcatcccttcttgctgacttttnggactccgatgaccccatgacctcatcaac

SEQ ID NO: 14543 - DNA, 101 bp, rice(Oryza sativa)
  misc_feature (71): n=a or c
ttgtatgcttccttgccatactgaagaaagaaacacaggcagatttcggaaggtgcctaatctaaatcggnttgctgcctctgaagcagagctagcggcag

SEQ ID NO: 14544 - DNA, 101 bp, rice(Oryza sativa)
  misc_feature (71): n=t or c
gtgcccacaaggatcagcaggtgagtgagcccgtctcttcaccgatcaagcgtgacatgctttttttaatnctcttgccaagtgttacccttgacaaaaga

SEQ ID NO: 14545 - DNA, 101 bp, rice(Oryza sativa)
  misc_feature (71): n=t or c
taataaaccttcaagccacctgtaacatatcgtactccagaacgattcccatatgcatgcgtcatgacaancacctgggaatcaaacaaaaaagttgtcta

SEQ ID NO: 14546 - DNA, 101 bp, rice(Oryza sativa)
  misc_feature (71): n=t or c
tgcctatcttttggggtagttgtgttccagtctccttaggctgcgtttgtttgtatgggttcctaactcanattaatccatttttcaagttagttttagct

SEQ ID NO: 14547 - DNA, 101 bp, rice(Oryza sativa)
  misc_feature (71): n=a or g
gatgacgagcctccgtttgagtgggagtgtggtacagcttatggtcagcaagatcgtctgataatggatancggagtgctgggaaacctgcgtccgcaaat

SEQ ID NO: 14548 - DNA, 101 bp, rice(Oryza sativa)
  misc_feature (71): n=t or g
aaactaataggattttaacaatttaggggctatttgattgatggccataagttgccacactttgccacacntgaggttaggcaagtttgaccatgttagat

SEQ ID NO: 14549 - DNA, 101 bp, rice(Oryza sativa)
  misc_feature (71): n=a or g
gtcctgattggtaacatcaaacaggagtaaagatagttgggtttgacacggcctgacgactttttgaaccnggaataaaaataatatttatcaaccgggat

SEQ ID NO: 14550 - DNA, 101 bp, rice(Oryza sativa)
  misc_feature (71): n=a or g
agaccatagtgcaatttacttttttttttgtcttggatttctgcccatttatacatttgctagtccacatnaatattgaatcttgctctaagtgaatcttg

SEQ ID NO: 14551 - DNA, 101 bp, rice(Oryza sativa)
  misc_feature (71): n=a or g
gtcgaagtttgcataaatatctatattgtcgtttctttacaaaggaaaccgtgtattggttcgtatagtcntatcccctacaagagattttgtaaccattt

SEQ ID NO: 14552 - DNA, 101 bp, rice(Oryza sativa)
  misc_feature (71): n=t or c
tcatatcccgcaaattgagggttcagacttcataagttcgagctctgtccacaagaaaggaacaagagatngttcttggcagttggaagaagctaagaact

SEQ ID NO: 14553 - DNA, 101 bp, rice(Oryza sativa)
  misc_feature (71): n=a or g
taaacctcgtgactgtagcttggtccagtcctactcttctctttgctgccgcttggagccggagaaggtgntggggagtgagtgtgttgagtgaagccatc

SEQ ID NO: 14554 - DNA, 101 bp, rice(Oryza sativa)
  misc_feature (71): n=t or c
tcgatcccgaggtcatccaccttcttctccaccgcgggcaacctgatctccagagacttcttaagttctgngaaatcagctcgcatgcgggcctcagcctc

SEQ ID NO: 14555 - DNA, 101 bp, rice(Oryza sativa)
  misc_feature (71): n=a or g
aatgattatgaggaggaggtggagttttttactgcttgggaagctatgatcagtaaatataaccttcacancaacgtgtggttgcagaaggtatttgaaga

SEQ ID NO: 14556 - DNA, 101 bp, rice(Oryza sativa)
  misc_feature (71): n=a or g
gatttagaggccgaacatcaggtccataactttggacaatactgattttgtgggtgaagcaatggcccccnaagcaccacggccactcccgttgccgattc

SEQ ID NO: 14557 - DNA, 101 bp, rice(Oryza sativa)
  misc_feature (71): n=t or c
gcaaggtaatagtcttagattctgataatgaatagatctatcctgtggagtattcaggctctgcgtagccntttttaccctgactctatagggctgtaaag

SEQ ID NO: 14558 - DNA, 101 bp, rice(Oryza sativa)
  misc_feature (71): n=t or c
aatattactacttttgctttagcacataaacactactacgtactgcagctattacatacaataacaaccanggataaatactagtaatactataacaatgt

SEQ ID NO: 14559 - DNA, 101 bp, rice(Oryza sativa)
  misc_feature (71): n=a or g
tccaaaatggcttcccagattagtacatgttctctctgaaaacagttgaacgtttttcacagcgaatgcanacgaatctgtctaatgacatattgtaaagc

SEQ ID NO: 14560 - DNA, 101 bp, rice(Oryza sativa)
  misc_feature (71): n=t or c
tactaatactagctctctgctctgaagtcttgatcatgtgtttgttgctgaggttaagctgagttgcgggnttgcaaccatatcagaagaaggaacaactt

SEQ ID NO: 14561 - DNA, 101 bp, rice(Oryza sativa)
  misc_feature (71): n=t or c
ttgatccacgagaaaggaaggtcaatcatggattactcaagagaaaggtttctgatgttgcgctgctgatntgcaattcctttggctaatcgtgacggcag

SEQ ID NO: 14562 - DNA, 101 bp, rice(Oryza sativa)
  misc_feature (71): n=a or g
atcaacatcgtctaatacagtgatatcaacgactctgaatttctacctcttgttatacgttggcgagtccnatcaactgtttaaaacagtcgggcgttaac

SEQ ID NO: 14563 - DNA, 101 bp, rice(Oryza sativa)
  misc_feature (71): n=a or g
tgcctcccttcttacgcacaacctgcaccaggctaacccactctctatacggcataaaatatattatcccngcgtgtaggagtttcaagacctattttttc

SEQ ID NO: 14564 - DNA, 101 bp, rice(Oryza sativa)
  misc_feature (71): n=a or g
cttaatctgctgcatcaccctattgtccacttgagcattgcctccagtcagtgtagtaggaaaagcaccangtggtgccactgcctgtatgggaacagcat

SEQ ID NO: 14565 - DNA, 101 bp, rice(Oryza sativa)
  misc_feature (71): n=t or c
ggcatctgcagagtccagtttagaagatcatacaatttttttattggaggggggatctacagggacggatnacggtgaaaccattcctccaacactaacat

SEQ ID NO: 14566 - DNA, 101 bp, rice(Oryza sativa)
  misc_feature (71): n=a or g
tataaatataaaccgtaagcaggcttttgcgcatatttgtgaccttgtagtttacaatgttttgatgcttngatactcacattgttatagtcaaatatttt

SEQ ID NO: 14567 - DNA, 101 bp, rice(Oryza sativa)
  misc_feature (71): n=t or c
aagcctctactaagagtgtgcactccgcttaatagaccggtgaccccttcagctgcctccacaagaacggnacaattcgagattgattgttgagtcaaaga

SEQ ID NO: 14568 - DNA, 101 bp, rice(Oryza sativa)
  misc_feature (71): n=a or c
gctaacttaaatatatgcattaattcctcctttctgtgctgctttagatgtcgccccatccgccggaaagnttgatcgatgtggtaggattcgtcaggggg

SEQ ID NO: 14569 - DNA, 101 bp, rice(Oryza sativa)
  misc_feature (71): n=a or g
gggtctagttcgacctagaccaagtcgtcttacaagccaatggataaaagggcaaatttatactttccgcnttgtttctctctctatttgcaccggatata

SEQ ID NO: 14570 - DNA, 101 bp, rice(Oryza sativa)
  misc_feature (71): n=t or c
ccattggccattacatgttgtgagaccatcaacaatttgcatcaaatggttgcctgatttttcttataaantaggttaattctcttattctaaatataaaa

SEQ ID NO: 14571 - DNA, 101 bp, rice(Oryza sativa)
  misc_feature (71): n=a or g
agttgagatcctgcaaaaaatcgtgtgtgcattaaggagctataaataagagaagaattaattaacaactnatcgatggttaaccacaactaggctgtgtt

SEQ ID NO: 14572 - DNA, 101 bp, rice(Oryza sativa)
  misc_feature (71): n=t or g
atgcttaccccatcctggatgtgaatggagagttgttcgattctttcacactttgaaagaaatctggctanggttggacttatggaatgcccacccatcca

SEQ ID NO: 14573 - DNA, 101 bp, rice(Oryza sativa)
  misc_feature (71): n=a or g
gagaagagagtccttgatcctgatgagattagggcaaaagaagctccatcgaagagacaaaggccattccntgagacattgaatgcaaataactaataagg

SEQ ID NO: 14574 - DNA, 101 bp, rice(Oryza sativa)
  misc_feature (71): n=a or c
tatctttatggacaaagaaaaggccatgatttttttttaccttgaagaaaagagcacaattgaacctccanatattaggtctagccagctatccctatgcc

SEQ ID NO: 14575 - DNA, 101 bp, rice(Oryza sativa)
  misc_feature (71): n=a or g
caaaaagaatatttaaaactgtacatgaagagctataatccgaaattaatctgaataattgatctcacctngattgtctgctcggaagcggattgcggccc

SEQ ID NO: 14576 - DNA, 101 bp, rice(Oryza sativa)
  misc_feature (71): n=a or g
ctccacggccaagaagaggctgggtgagcatcgatccgatccccttcttctcgatctcatctactctaccncctcctccccctcgtcgtccttcgccgagc

SEQ ID NO: 14577 - DNA, 101 bp, rice(Oryza sativa)
  misc_feature (71): n=a or g
gcggagaaacgatgggatccaaatgaggaggagtgaagccggccacaggatccgtggagaggaagaggtcnttggatccgcccctcccgtcgccggcgacg

SEQ ID NO: 14578 - DNA, 101 bp, rice(Oryza sativa)
  misc_feature (71): n=t or c
tttgtatttttgaaatgggtcacaatggcttaatttgggatgagttgtacgaactctcggtcactgtatanataggatcggaatgagcttatctgacagaa

SEQ ID NO: 14579 - DNA, 101 bp, rice(Oryza sativa)
  misc_feature (71): n=t or c
ttgctctggtctagtaagcttccacttgctttctcgagatcaccgcccgtcatctcattctcagtattggntgggtgcatggccacacatacacatgtcag

SEQ ID NO: 14580 - DNA, 101 bp, rice(Oryza sativa)
  misc_feature (71): n=a or g
ccgccatcgccaggtacactagctaaggtcagagaaccccggagttgaggaaccagtactcaatgagcacnacctagtcgaagtcccccggtgctaccata

SEQ ID NO: 14581 - DNA, 101 bp, rice(Oryza sativa)
  misc_feature (71): n=t or c
agaaaatcccttgtgtgcccatgaaaactcatccaatcccttacatgcgccctcgaattttactcgatctnctctgtacccctcaaatttcgctttgatcc

SEQ ID NO: 14582 - DNA, 101 bp, rice(Oryza sativa)
  misc_feature (71): n=a or c
tcggcttcctgctacagccgaccacaaaacgattctcgccatcgctagtagagccacgcctccgtgccagncttccactaccgacgcctgtagccatctcc

SEQ ID NO: 14583 - DNA, 101 bp, rice(Oryza sativa)
  misc_feature (71): n=t or c
gaggattggatactggtgatgatcaagcggcgctgctaaatccaggatttaaagcattgacccaaattgtncaggatgatgtgttcagagaatttgagttt

SEQ ID NO: 14584 - DNA, 101 bp, rice(Oryza sativa)
  misc_feature (71): n=a or g
gggcagctgttgtgatggatccgatgacggggagacaccagcttgagtaggagagggaggaaagggagggnggtaagggggagaagccagccggtggggct

SEQ ID NO: 14585 - DNA, 101 bp, rice(Oryza sativa)
  misc_feature (71): n=t or g
ctctgtcaagaggcctagaaccagtcaaagttttgtggagtcaattttaccacatgataaaaccaaacagnttagattcaaagaattctggtcatatactt

SEQ ID NO: 14586 - DNA, 101 bp, rice(Oryza sativa)
  misc_feature (71): n=a or g
gtagatgtacttggctagctttaaaggacatacaaaagcgtgtttcatcataacttgcatggtttaaaacngacacgaatattatggaaggacataatatc

SEQ ID NO: 14587 - DNA, 101 bp, rice(Oryza sativa)
  misc_feature (71): n=t or c
tcatatcagctgtaaaagagtcacgaaagacaatagcccactttttcttcaacctatatagatttgacatncatacgttatcctcaagcttgtattcactc

SEQ ID NO: 14588 - DNA, 101 bp, rice(Oryza sativa)
  misc_feature (71): n=t or c
gtaactctgtaacagttaaacagtggctaagaaaatctcaaatctgagatctcatctgagtgatatttagntcatgagttattacaagcatgtctagtact

SEQ ID NO: 14589 - DNA, 101 bp, rice(Oryza sativa)
  misc_feature (71): n=t or c
atgcaagtactgcagccccttagcaacgcccaaggctatgctaagccttgttttccatggaagtgttgggnatgctttattgaacaagtgatattctaggg

SEQ ID NO: 14590 - DNA, 101 bp, rice(Oryza sativa)
  misc_feature (71): n=t or c
aacaaaattgcagttgtgctgaaaagacatgaagctggttctcttaaacatgggtttgcaaaacatccccnacccgctccctccccccacccaaacctttc

SEQ ID NO: 14591 - DNA, 101 bp, rice(Oryza sativa)
  misc_feature (71): n=a or g
cattgatgtcatctatcatcacatattgtgtcttctcccttcacgacaccgcatatagcgaggtagtaacngttattaatgtgatatgaaattgttattat

SEQ ID NO: 14592 - DNA, 101 bp, rice(Oryza sativa)
  misc_feature (71): n=t or c
ctaagaaaggcgcataacagtgaacaggtgtagccaatgcagctgtggatcactctgaagccattttcttnctctattagaactggaatatgttgacaaga

SEQ ID NO: 14593 - DNA, 101 bp, rice(Oryza sativa)
  misc_feature (71): n=a or g
atctttaccgttgcccactattcagttaaatatgtcctgaacttccatgataggtttccaccctgccatcntccgacatccccttctgttcagtccgattg

SEQ ID NO: 14594 - DNA, 101 bp, rice(Oryza sativa)
  misc_feature (71): n=t or c
tgcatcagaagtggattcctctcgtttagtttgatatgattttctcgattatactttagaagggttggacngattagggttttttttgttttgtatgatgg

SEQ ID NO: 14595 - DNA, 101 bp, rice(Oryza sativa)
  misc_feature (71): n=a or g
cacgttgaaattgatctcaacgtttctttttgaagttaattccatcgccttatataggattggggggcagnattacaagatagaaaccttaaccaatacga

SEQ ID NO: 14596 - DNA, 101 bp, rice(Oryza sativa)
  misc_feature (71): n=t or c
aaatgtcttcgatagcaccattgggactatactgggcataccaactaagaccaaggataggctaaaatcangtaaggacctcgtggatatgcaaataagga

SEQ ID NO: 14597 - DNA, 101 bp, rice(Oryza sativa)
  misc_feature (71): n=t or c
agccgcgcgccccggcacgcgcacggtcagttcgccccccccctctagtctcttctctgtatctactatanttatgcatatactacatatgcatacgtata

SEQ ID NO: 14598 - DNA, 101 bp, rice(Oryza sativa)
  misc_feature (71): n=a or g
caagtgtacattcctagttaaaacacaattaatcgaatctatagacacacctcaggaatgcacctacagcnagagggattgcatccaggatgaacgtccgt

SEQ ID NO: 14599 - DNA, 101 bp, rice(Oryza sativa)
  misc_feature (71): n=t or c
aatcagccgcacttcttctttgcatccttatcatttttcaaggtctatataaatactccctccggttttantttaattgacgttttggacaatgacacggt

SEQ ID NO: 14600 - DNA, 101 bp, rice(Oryza sativa)
  misc_feature (71): n=a or g
gtaattatggaaaaaaaatctaaacatcgtcaatcattattttctttgtcattttttgcctaacggtgatntgacttagaatcttctatatgccgaagttt

SEQ ID NO: 14601 - DNA, 101 bp, rice(Oryza sativa)
  misc_feature (71): n=t or c
cgctaaccctgctgatgattctgctggagaaaatggaaattgtggtgcagatgattgtgtggacatagcanagcaggaggatgcgtcggaatccacagaat

SEQ ID NO: 14602 - DNA, 101 bp, rice(Oryza sativa)
  misc_feature (71): n=a or g
tgctgcttctccatgaccatggcaactgtaagcatcaatcatactggaccaggaaaccacgttcctgcaanccatttggtcaaacacaatgcgagcagcca

SEQ ID NO: 14603 - DNA, 101 bp, rice(Oryza sativa)
  misc_feature (71): n=a or c
ttacaatcttatatgaattggagatatgccactacgtacctctttaatggatcttctgaattctttggatnaaactaacattatcttattcctccatcccc

SEQ ID NO: 14604 - DNA, 101 bp, rice(Oryza sativa)
  misc_feature (71): n=t or c
gaattcaaggagctcttgcacatccgtttcaacaatggcgatgatcttcatgacaagcacactcacaaccncttccctattaatcactatgcttagtttaa

SEQ ID NO: 14605 - DNA, 101 bp, rice(Oryza sativa)
  misc_feature (71): n=t or c
tgggaagcgcaagtcctcgggagaagtccttgccacagagcaagtggaatcgtccagacgctccaaccccnagaacgaagactcgtgcaaggcatggttcc

SEQ ID NO: 14606 - DNA, 101 bp, rice(Oryza sativa)
  misc_feature (71): n=t or c
aggcaacaataccagccaaatccaatgtcaaaatgtctgcgtccgcggtggtgtcaatggcaaaagcgtgngacccaaagatagcccagaggcaccaaccc

SEQ ID NO: 14607 - DNA, 101 bp, rice(Oryza sativa)
  misc_feature (71): n=a or g
tgtgcacgcatgggtttgcgtatctgagcagtttgatatcaacaacataacacagagcatcattgtcgcgnttacaaaggagaagtgtgatctatcagaac

SEQ ID NO: 14608 - DNA, 101 bp, rice(Oryza sativa)
  misc_feature (71): n=t or c
acatgatgccacagcttcgtgtagccatgaagagacaccaggaaagaacctcttaaaactttggattttcngtgcagcatcttctgggctgcattcaagtt

SEQ ID NO: 14609 - DNA, 101 bp, rice(Oryza sativa)
  misc_feature (71): n=t or c
gtattattaaggttccaaaatttgttggccatttggccttacctgaagccccccaagttgatataacttcntttgcatggtcaatagtattgttggcacac

SEQ ID NO: 14610 - DNA, 101 bp, rice(Oryza sativa)
  misc_feature (71): n=t or c
aagtacaagtcatgtgcctatcagtaagtacagtacagtatattataccgcatgcatatgcatgcacatantcccagtaatcacgccgataatcttcagag

SEQ ID NO: 14611 - DNA, 101 bp, rice(Oryza sativa)
  misc_feature (71): n=a or g
gagcacgaaatttttttgcgcgtccgttttcccgcccgcgggatggttgttcttttttggggaaaaaagcngcgccacacaggcggacggtgaggtggatg

SEQ ID NO: 14612 - DNA, 101 bp, rice(Oryza sativa)
  misc_feature (71): n=a or g
gccgtcaagtcattggtgaacaaccccgaagaatctgtcttgagaaaagaacaccatcaaatgcatactcnttgctttataactgaatcgttcaaatctgc

SEQ ID NO: 14613 - DNA, 101 bp, rice(Oryza sativa)
  misc_feature (71): n=t or c
gtttgctgctgatgtgccagacgttgttgaagcatatgagggtaagatcaaattcaaaggattcaagggtnagggtcagggtgtttaagtccacggaagcc

SEQ ID NO: 14614 - DNA, 101 bp, rice(Oryza sativa)
  misc_feature (71): n=t or c
ggaagtgaaatacaattcacagaataatttggtccatggacgatattgtgtggtaaaggttagtgagggtnaagagtctattgcagcgagtacaatagcag

SEQ ID NO: 14615 - DNA, 101 bp, rice(Oryza sativa)
  misc_feature (71): n=a or g
agtgcttagctagcgaagagttaacctttgtgaagcgcctaccggaagattggaagttgtcagacgagtgnttcatgcccactttgaagattggaacactc

SEQ ID NO: 14616 - DNA, 101 bp, rice(Oryza sativa)
  misc_feature (71): n=a or g
gattaccatttgtataagccctacacgatagtgccttggaatatcccccatcataccaaaatcaaaatacncgagtgatccaccttcagttgcaaccagat

SEQ ID NO: 14617 - DNA, 101 bp, rice(Oryza sativa)
  misc_feature (71): n=a or g
ccttccatttttgtattgtgtttggcatgattttcaggtggaagcagatgcatctctcgtacacaagtcangcggctacttgggctctgctgcatctatac

SEQ ID NO: 14618 - DNA, 101 bp, rice(Oryza sativa)
  misc_feature (71): n=a or g
agtagaatggtacggaaacaagatatctttcccactgtctcctcatgtgagctagatagagatagaagganggatcgatccaaacccgcaaatagtcaagg

SEQ ID NO: 14619 - DNA, 101 bp, rice(Oryza sativa)
  misc_feature (71): n=a or g
ctgcttcgtcttcatccatgggcatttctacctctccatcaaaacagcagcgcctctttcaattcctcacngatctcttcctctccttcatcaattttctc

SEQ ID NO: 14620 - DNA, 101 bp, rice(Oryza sativa)
  misc_feature (71): n=t or c
aaaaatgctcatgattagacttgatgtgaataatttaatcaggatttgttcatcgctgggagccacacgangacgaccacggtggagtgggcgatggccga

SEQ ID NO: 14621 - DNA, 101 bp, rice(Oryza sativa)
  misc_feature (71): n=a or g
gacctcctcctcgagacacagtgttgggtgcagtgcctttacttgagctggtagtagtgtagtagtagganccaaatctaaccattgatcctgatgggtac

SEQ ID NO: 14622 - DNA, 101 bp, rice(Oryza sativa)
  misc_feature (71): n=t or g
catcatcagctcccatcgaagctgaatcatcatctccaattctgtgaggatctgaagaacattttgtgaanggccttatcatcgtcaacatctccaaaaat

SEQ ID NO: 14623 - DNA, 101 bp, rice(Oryza sativa)
  misc_feature (71): n=t or g
gccaacgcaagcaacaattcttacccctgcagaacacaatgaagattgtgatgtccgacaatcttcaatgngtgacaaagataagaaaagattagagagga

SEQ ID NO: 14624 - DNA, 101 bp, rice(Oryza sativa)
  misc_feature (71): n=t or g
ggtttcttacggtggtatatgttcatgagagttcgagtacttgactcatcatatgcacttgtatttacatntaattgtttgggtgaatagcaaatttagtt

SEQ ID NO: 14625 - DNA, 101 bp, rice(Oryza sativa)
  misc_feature (71): n=a or g
ctggtggccgttgtagtaggagtagtagccgccactgctcgccatgctcatgtgcaagaatcaatcaatcnatcgatcacttctttttctgaaatctaaac

SEQ ID NO: 14626 - DNA, 101 bp, rice(Oryza sativa)
  misc_feature (71): n=a or g
gcaggaaggggcggatctgacagcacatgtgaatgttttcaatcaactagtcactgatcttatgaagatgnatgtggaagttgacgatgaagacaatgcca

SEQ ID NO: 14627 - DNA, 101 bp, rice(Oryza sativa)
  misc_feature (71): n=t or c
acattattagatctataatagaagagaaatatcaaaacccatattaactcacatattttcgatattaaccntacaaacatgcctagctataatacaatcta

SEQ ID NO: 14628 - DNA, 101 bp, rice(Oryza sativa)
  misc_feature (71): n=t or c
ttctgtaaatattaaaaaaatctaaaatgaaaaaaattcgttcgccttccgcatatgcactctgtttggcnaggcccgagggacaccggggggagggggtg

SEQ ID NO: 14629 - DNA, 101 bp, rice(Oryza sativa)
  misc_feature (71): n=t or c
cccattccttggtggcatggcaagtgggtgcccaagaaggaagggtcgagctcaacacgtttgcagatgangtcccctcagccttcaacatcagaagagct

SEQ ID NO: 14630 - DNA, 101 bp, rice(Oryza sativa)
  misc_feature (71): n=a or g
ttctagtagtgaatgccatcgctcaagtgggcttcgataaaataccatgcccaacaaggatggttttgctngaataccatcctggacaatattgcccttgc

SEQ ID NO: 14631 - DNA, 101 bp, rice(Oryza sativa)
  misc_feature (71): n=a or g
cagaatatcttagccgatcacaaaaattttcctaaatcctattacatgaatgttcactgagacaaatgtcnctggatagccgatatggccctttgcctgat

SEQ ID NO: 14632 - DNA, 101 bp, rice(Oryza sativa)
  misc_feature (71): n=a or g
gctcctctttcttttcttctctttactaggagtatttgctagtcaattagttgtctcattgtgtgtgtaancaccttttttaaaaaaaaatggcagcagct

SEQ ID NO: 14633 - DNA, 101 bp, rice(Oryza sativa)
  misc_feature (71): n=a or g
atgtttccataacttcgagtttgtgatcgatgcggcaataattgctttccgtggacctttgggcacaacangtagaatttgcctaaagtcgccacccagga

SEQ ID NO: 14634 - DNA, 101 bp, rice(Oryza sativa)
  misc_feature (71): n=t or c
gataacgggatgccacatcaacacacgtggaccagttgaccaaccacgtgagcagaaaccgtttcaaaacnactaaaggtgttaatttacatcggttttta

SEQ ID NO: 14635 - DNA, 101 bp, rice(Oryza sativa)
  misc_feature (71): n=t or c
aggagccaatattataaacgtttatcaaatagagaaatggcagtgactgatcagtaggctactcatgaatnacggctagggatgaaaatggtacggaaaca

SEQ ID NO: 14636 - DNA, 101 bp, rice(Oryza sativa)
  misc_feature (71): n=t or c
cgtccgagaccggtaattagctcacttcgttttatagcttcgtttcatgctataagtcgtccgatcttttncttaaatttgattagattcatagaaaaata

SEQ ID NO: 14637 - DNA, 101 bp, rice(Oryza sativa)
  misc_feature (71): n=a or g
tccttttcatacgtggacagtccttgatgtcgtggacccaaagcacggctcaagaaagcaataggatgttncttctgcatcagaactgcaccaatgccctt

SEQ ID NO: 14638 - DNA, 101 bp, rice(Oryza sativa)
  misc_feature (71): n=a or g
aggagtcggagaaacctcctctgccttgcatgccagtgagtgagtgcgagagataggttcacttcagggtngttattggggtgagcacctgagctgatcag

SEQ ID NO: 14639 - DNA, 101 bp, rice(Oryza sativa)
  misc_feature (71): n=t or c
tgaggtgaggcaaggtccccttcgtcttcaaggcaagctcagctcagagctcagatcgatcgatctgccantggagatggtgtgccaccggatgctgccgt

SEQ ID NO: 14640 - DNA, 101 bp, rice(Oryza sativa)
  misc_feature (71): n=a or g
taggcgtcatccctggaaccatgctgattcccagaagcttatcttagctccatcgcctattgtcaagatcnttgttgccacaaagaggagtttgttggtgt

SEQ ID NO: 14641 - DNA, 101 bp, rice(Oryza sativa)
  misc_feature (71): n=t or c
ttctaccattctaggggcgacgatggggatacgagatttgcttcaatcagcgcacaatctgttactccatnatggactccgcgacgaggatctcatccagc

SEQ ID NO: 14642 - DNA, 101 bp, rice(Oryza sativa)
  misc_feature (71): n=a or g
tctctctctcgagatggatatatgtacgtagagagaggagtatatatattacagtggagtcgagaacgccngctcctccggaagcaaagctgacgcctccg

SEQ ID NO: 14643 - DNA, 101 bp, rice(Oryza sativa)
  misc_feature (71): n=a or g
gaggatctcgatccttttaggctagctacaaagcaatgagaggctgctgggccatcatactagtagtatcngatacttcctccgtcaaaaaaaagaaaaaa

SEQ ID NO: 14644 - DNA, 101 bp, rice(Oryza sativa)
  misc_feature (71): n=a or c
ctgcatgccatcatcatcaaatgaggtatgagtgaaatctatccctgtgtcaaggacacctatgatcacancctcacccatgctagtttttttccaggatc

SEQ ID NO: 14645 - DNA, 101 bp, rice(Oryza sativa)
  misc_feature (71): n=a or g
ctagacaagccattaaactaatgacgtcgtgattacaggtgttaaattggacatacacctcgatcgattcnccatacggaatgattacttgttttgaattc

SEQ ID NO: 14646 - DNA, 101 bp, rice(Oryza sativa)
  misc_feature (71): n=t or c
aattatgaaggtttcttctaccgatagactcttcaacctgctcttgaacattagaaggtgatactgctaangcctggcgcaaaacattgaattcatttgct

SEQ ID NO: 14647 - DNA, 101 bp, rice(Oryza sativa)
  misc_feature (71): n=t or c
taaatctaacctatataattaaattggtttttttcccgctcctgaatgcataatggtcagcatatgtctcnatccaaaactatttctctcattctctccga

SEQ ID NO: 14648 - DNA, 101 bp, rice(Oryza sativa)
  misc_feature (71): n=t or g
aacccccgcgacgtcgcctccaacttcgagataaccaaacctcaccgtcgatctgttgatataaaaacacnagatatgagagatctgcttaactccagtgt

SEQ ID NO: 14649 - DNA, 101 bp, rice(Oryza sativa)
  misc_feature (71): n=t or c
cttgctgatgcaaatcagaagtacagtgctgctgctattgacaatagggtactaatggcagacattgaagncctaagagcaaaggtatgcaactgtttaag

SEQ ID NO: 14650 - DNA, 101 bp, rice(Oryza sativa)
  misc_feature (71): n=t or c
cagacccattagtctgatccactctgtggcaaaggttatatccaaacctttggcaatgagactagcagcangacttggtgatttggtctcgcatacccaaa

SEQ ID NO: 14651 - DNA, 101 bp, rice(Oryza sativa)
  misc_feature (71): n=t or g
catcagtataaactgtatggagtataaaataatggaagtaatcgtcagacgtccatatccagcacaagagnggtgtcccccttctccacggtgaacgtctt

SEQ ID NO: 14652 - DNA, 101 bp, rice(Oryza sativa)
  misc_feature (71): n=t or c
tggtcgtcgcatcaatggcgatcgaattgccaaggtgaattaagaatcttggaagtggatttttgtccctnagagggggcatcatctcgttttgtacatgg

SEQ ID NO: 14653 - DNA, 101 bp, rice(Oryza sativa)
  misc_feature (71): n=t or c
attctgaatcactccttgtaatatatgggtctgcatggccatgagttggtgaaggtccactggtgggggtnggttacctcttgagacatcattaactgatc

SEQ ID NO: 14654 - DNA, 101 bp, rice(Oryza sativa)
  misc_feature (71): n=t or g
tgcacgccagtgtcgccgatccagtaggaccaacaagcaatttgcatcaacggatggtcaacctccgcttntcctcccctttccatgcggttacagctgcc

SEQ ID NO: 14655 - DNA, 101 bp, rice(Oryza sativa)
  misc_feature (71): n=a or c
agaaagagggactgactgactgagaaataatggatgatatttatggagttggagatagtttttggatggangtaactacacagctctggtttgtctaaacc

SEQ ID NO: 14656 - DNA, 101 bp, rice(Oryza sativa)
  misc_feature (71): n=t or c
attatgtaataagtagcttctcttgctgaagcactgccaaaacaagcagccaaaatgagcatcttcgatanctgcgtcatgaattgttcataaaaaacagg

SEQ ID NO: 14657 - DNA, 101 bp, rice(Oryza sativa)
  misc_feature (71): n=a or c
gatggagatggagtatctcgacctgtcccagaattcattcaccggaagcatacctcctgggatttggaacnttccaaagctgcagtacttgttcctgtaca

SEQ ID NO: 14658 - DNA, 101 bp, rice(Oryza sativa)
  misc_feature (71): n=t or c
ccagtgcgctggcatctctgatccattcaataaagatttcacttccttccccacatccagccccactttcncccaaaaattcttgtaaaacaaggccggca

SEQ ID NO: 14659 - DNA, 101 bp, rice(Oryza sativa)
  misc_feature (71): n=t or c
ctctccactcttctttgaagttttcatggtcggggcccctgaagacgagcaggcccgtattgcgagggagnaggaggagcaacgtgcaaaagccgagaaga

SEQ ID NO: 14660 - DNA, 101 bp, rice(Oryza sativa)
  misc_feature (71): n=t or c
aggcaccgaaactgcagggggaggcgtttaacgagatgactcgctaacgagagttgttatctctcttttcngcatgacgttgttgatgaaaattgatgtat

SEQ ID NO: 14661 - DNA, 101 bp, rice(Oryza sativa)
  misc_feature (71): n=t or c
aaattcttcttctagaattctcctgaatggcaacccaggggaacacattttccatgcaagagggctacggnagggagatcccctctcaccgatgctattta

SEQ ID NO: 14662 - DNA, 101 bp, rice(Oryza sativa)
  misc_feature (71): n=a or g
acccaagttctgtcttctaatctcttttggtgtaattttgcataaatcgatccaccaatcttcaatcgtgngcgccgaatttgggggagatgtcgttaagt

SEQ ID NO: 14663 - DNA, 101 bp, rice(Oryza sativa)
  misc_feature (71): n=t or c
cagaccgtaattttgtaggtaggggtgataattagttagaccaggttctttcacaactctagcccttaacnatttttagataaaaaaaattaacaaaaatt

SEQ ID NO: 14664 - DNA, 101 bp, rice(Oryza sativa)
  misc_feature (71): n=a or g
cgccgccgccatggatgatggggatgaagtggcagcgagctaattaattaaggtggtagtagctgatctgntgtcgcgtgttcttcagaggtttcagcaat

SEQ ID NO: 14665 - DNA, 101 bp, rice(Oryza sativa)
  misc_feature (71): n=a or g
acgtactttttctcagaatctacgcgagcatctgaattgttagaaagagccagagattacaaaggaagctncatttgaccaaaagcttccaaaacatatac

SEQ ID NO: 14666 - DNA, 101 bp, rice(Oryza sativa)
  misc_feature (71): n=t or g
ggttcagaagaatcaattgctcacctggttgaccgtttcttttagcctgacattagtctttctgaggtctncattagatttatccacctgcaaaatttgtg

SEQ ID NO: 14667 - DNA, 101 bp, rice(Oryza sativa)
  misc_feature (71): n=t or c
atacatatcagttcgcgtgaacgactccacggcggtagataggtgtccattttctttaattggtgggatcnagtggggctcactttaacacctcccactca

SEQ ID NO: 14668 - DNA, 101 bp, rice(Oryza sativa)
  misc_feature (71): n=a or g
gtaataaacgataataatcgcaggtacccattggatataatagatttagaatggataactacagcggatcntgactctgtggagtatttcaggggagtaac

SEQ ID NO: 14669 - DNA, 101 bp, rice(Oryza sativa)
  misc_feature (71): n=a or c
cagctcctttgtcttgtcaactttacctcccaaaaagcaacgtcactaattaactgatcagttaccaaccntgtacttttatcatagacaaaaaccagcca

SEQ ID NO: 14670 - DNA, 101 bp, rice(Oryza sativa)
  misc_feature (71): n=a or g
aggattttatgccactattttagctgacatgggacagtctcaatgggatgtgaacatggaggaggatatanctgctagcaaccatgagatacaataaatgg

SEQ ID NO: 14671 - DNA, 101 bp, rice(Oryza sativa)
  misc_feature (71): n=a or c
aataataaatatagttgggaaaggatggagagatgttgggttttggactgcacaagatggattttcacagngattaaccagaccaagatcaaatgggacat

SEQ ID NO: 14672 - DNA, 101 bp, rice(Oryza sativa)
  misc_feature (71): n=t or g
tggttttgcaacatttgccactggagttgttcatggtctccaaccagatgctctactgatggtgttgcctncattggcccttccctcacgcttcgctggtg

SEQ ID NO: 14673 - DNA, 101 bp, rice(Oryza sativa)
  misc_feature (71): n=a or g
ctcccggtcacctttggcactcgggaaaactttcacacagagaacgtctacttcaaagtcgctgatttcgngacagcgtatcacgccatactcggacgccc

SEQ ID NO: 14674 - DNA, 101 bp, rice(Oryza sativa)
  misc_feature (71): n=a or g
gccgaaaacgctttgaggtgttctagttttggaagttgagggatgcgaccaggggcggagctacattgaanagagggggtgcccagaaacccggtcaagaa

SEQ ID NO: 14675 - DNA, 101 bp, rice(Oryza sativa)
  misc_feature (71): n=a or g
ggacatgttctgccatgagttccaccttgttgaccttagggtcatggacaactgcctcaaggtcaccaacngcgtcgaccatgtgttcaaccttgccgctg

SEQ ID NO: 14676 - DNA, 101 bp, rice(Oryza sativa)
  misc_feature (71): n=t or c
accaagcccatttcagcctcatttttcacagaaaggaagggcacaagccaacgtatcataaagtgggtgtnacgaattcgcgtcgctcatcgcccaatacg

SEQ ID NO: 14677 - DNA, 101 bp, rice(Oryza sativa)
  misc_feature (71): n=t or g
ctaccatcccacgctcttcgttccacgctccgacgaccagatccccgtggaggaggaggagcgagcttacntgcccggcggctccgcccagacaagggact

SEQ ID NO: 14678 - DNA, 101 bp, rice(Oryza sativa)
  misc_feature (71): n=a or g
tatcctatgcacacaagacttttagttcgaaagcatccaatatatggtgctacattcatctactccctccntcactaaatatttcacgccgttgacttttt

SEQ ID NO: 14679 - DNA, 101 bp, rice(Oryza sativa)
  misc_feature (71): n=t or c
gtttagattacacgtgatgatgtggttcttgcagtacccgcagcagaaattgatggtttcttccatctcancagaagggaaaactgcagatatcttaatca

SEQ ID NO: 14680 - DNA, 101 bp, rice(Oryza sativa)
  misc_feature (71): n=t or c
cattcttgtataaactgtgatctcctgatgtctcccaagtcgaaaacaacaactacatgtatataagtatngcagagctgtaattcttgagataaatcttt

SEQ ID NO: 14681 - DNA, 101 bp, rice(Oryza sativa)
  misc_feature (71): n=a or g
caatcaggtttgtatttctttttcgaaactaagccttgcttactactcactccgctcttgaaagcaagtcnttttggatatcgagatggtctttgaaatac

SEQ ID NO: 14682 - DNA, 101 bp, rice(Oryza sativa)
  misc_feature (71): n=a or g
aaattagactgtcagttttgctaatgaaagtaacttacaaaagtgataagaaagaaagaactgaaagagcncattttcagggtactagtgtgtacctgaca

SEQ ID NO: 14683 - DNA, 101 bp, rice(Oryza sativa)
  misc_feature (71): n=a or g
gctgtccgttatgcataatttacttatattatccactgcatcagtatatgaccacattagacctaaagccnttccttcacgcagccctagtggatggtgct

SEQ ID NO: 14684 - DNA, 101 bp, rice(Oryza sativa)
  misc_feature (71): n=t or g
gggctagagacgtggacgggatatcctgaccgtcggatgggatcgaacggccaagagtgtatgtcttcttnttttttctttcgtcgacctatgaactctaa

SEQ ID NO: 14685 - DNA, 101 bp, rice(Oryza sativa)
  misc_feature (71): n=t or c
gccgcctcccgcctcccccccatttatatccacacttgcaaacgggctcgcgaattatcacgatgaactcngctaagtggtaagctcagcatgtgagagtt

SEQ ID NO: 14686 - DNA, 101 bp, rice(Oryza sativa)
  misc_feature (71): n=t or c
ccaatcaatttaagcttcctgagttttgaaagaggccctaactcttccaaactacatctgtattctccagngttttcaataataatgtggacaggaaaccc

SEQ ID NO: 14687 - DNA, 101 bp, rice(Oryza sativa)
  misc_feature (71): n=t or c
atcggcctcccaagtcccaacgaatccagagcaagcaatcagagcaaagcaaaaatcgtcagggaacacgngcgcgtttacccttgctcgcgctgatgagg

SEQ ID NO: 14688 - DNA, 101 bp, rice(Oryza sativa)
  misc_feature (71): n=a or g
tccatagagaacagatcaaagaaaccagaaaacgctaacgtatcaaccatgaatctagccgatgcaaacgnttccgacagaaccggagaagaagccatcca

SEQ ID NO: 14689 - DNA, 101 bp, rice(Oryza sativa)
  misc_feature (71): n=a or c
ggcatggttcgaacaaaccctataaagtaatacaccttcatctaaaatatagtgactattggttaccaatntgaacatacttttatctaaattcgttgcta

SEQ ID NO: 14690 - DNA, 101 bp, rice(Oryza sativa)
  misc_feature (71): n=a or g
acacaataatagtgaggtacccttctttcagagttaaaatagcagtatgaatggcatcgtcaagctccatntcttctgtgtatctgcaatgaaacaataaa

SEQ ID NO: 14691 - DNA, 101 bp, rice(Oryza sativa)
  misc_feature (71): n=t or g
actggtcaacatagagctgaatgaaggtagaaagataaccattttttgcagcacagtgaagaggaacagancatgcattgcacttcttatttggatcagcc

SEQ ID NO: 14692 - DNA, 101 bp, rice(Oryza sativa)
  misc_feature (71): n=a or g
tctttttattcaatttctttgctctacgttgtatttgcactgaacgatgttttctttatatttatctcgcntacttattcttaacatatcaagttctgaga

SEQ ID NO: 14693 - DNA, 101 bp, rice(Oryza sativa)
  misc_feature (71): n=t or c
cttttgctggagtatatatattgtcctgtttgtactagtactatctgcccaacaaattcagaaaatgacangcttttattgatgtcctaaaactgattgca

SEQ ID NO: 14694 - DNA, 101 bp, rice(Oryza sativa)
  misc_feature (71): n=t or g
tagccacacccatcatcgatgactacttatctttgatgggctgtatttgtggtctggcataggacatctgngacgagccacaaccaaactcgtcaccaatg

SEQ ID NO: 14695 - DNA, 101 bp, rice(Oryza sativa)
  misc_feature (71): n=a or g
gcaatggccatcttatcgtcagaagggtcactgacatagaaaacttgagcaacacgctcagcaagaacccncggatcatccttttgtcctagcttgctacg

SEQ ID NO: 14696 - DNA, 101 bp, rice(Oryza sativa)
  misc_feature (71): n=a or g
tgagatggccatatgctcgaatactctacctactttgggcatggcataggtatgactggtgccatcccttnccacgagagaacgccgttgtgttgtgtgtg

SEQ ID NO: 14697 - DNA, 101 bp, rice(Oryza sativa)
  misc_feature (71): n=a or c
gtgtagtggaaaaaaaacatgtggttttaacatgtcaacatgtattatattctcggatagtattcacctcnttattatctgacatcttatacactctatat

SEQ ID NO: 14698 - DNA, 101 bp, rice(Oryza sativa)
  misc_feature (71): n=t or g
cattttggaaaaagtaaagtaagtggccaacctttttatattgaaaggttttgatgaggcgaatttggatnacatgaatccaaaagcataatctaggaaaa

SEQ ID NO: 14699 - DNA, 101 bp, rice(Oryza sativa)
  misc_feature (71): n=a or g
aatactagacaccgtggagaccgccggggtaaactagacttcttaaacgaaaagggacatgaactagcgcncgagaagagcaatacaggacatagtcgagt

SEQ ID NO: 14700 - DNA, 101 bp, rice(Oryza sativa)
  misc_feature (71): n=a or g
gttgattgacccatcgagagacacgtgtaccatgcgagagctgcattgatcgatcaaccaagcaaaaaatngacgactggtgtagatacttcgtatcgtaa

SEQ ID NO: 14701 - DNA, 101 bp, rice(Oryza sativa)
  misc_feature (71): n=a or g
atcaccagaacaaaagaaggaattcgaactgatgatgcagagcactcaggaacaattcatgaagtcgttcncagaaacccgcgggaaagtttaccaaaaat

SEQ ID NO: 14702 - DNA, 101 bp, rice(Oryza sativa)
  misc_feature (71): n=t or c
agcgacatcgacatctcaaattctactgaatggagttcctgggccgtcaattgcgcatgtgaggggtcttngacaaggtgacccgctcttgccaatgttgt

SEQ ID NO: 14703 - DNA, 101 bp, rice(Oryza sativa)
  misc_feature (71): n=a or g
aaaaatgagtgtcttctgatttcggcaggtaagggctgagttcgaaccttatgttctcctcatggaaaatnaggtgacctattagcgcattaataattagg

SEQ ID NO: 14704 - DNA, 101 bp, rice(Oryza sativa)
  misc_feature (71): n=t or c
ggagtctccaaacacccccccgcaagcctcttaggactttgattattctaatcttatgggaaatctggtgngaacgcaatgcaagaattttccgaaactct

SEQ ID NO: 14705 - DNA, 101 bp, rice(Oryza sativa)
  misc_feature (71): n=a or g
ttcatgaattttaaaaattttggcagccacataaattttggtgactaccgaaattgcaaacactctctgtnattgaaacagacaaaaaaagtagctatcgc

SEQ ID NO: 14706 - DNA, 101 bp, rice(Oryza sativa)
  misc_feature (71): n=t or c
ttatttaatacataatatttgatcccacatgtgtatgccagagccttgacatggcagagaaattgggaccngagaagcggcacgccttcgtccacaacggt

SEQ ID NO: 14707 - DNA, 101 bp, rice(Oryza sativa)
  misc_feature (71): n=a or c
gagtattgctgcttgttaatcctgaataccacatggtaaatcatcaagttccaaaaccaagcttgctatcnacatggccatatgaaatatcaactaaaaat

SEQ ID NO: 14708 - DNA, 101 bp, rice(Oryza sativa)
  misc_feature (71): n=t or c
ttactttgccttgcatcttttgtgaactacagaaggtggcagaggaaggggccgtggtcgaggccgaggcngtggacgtggtcgtggtggaggccgtggcc

SEQ ID NO: 14709 - DNA, 101 bp, rice(Oryza sativa)
  misc_feature (71): n=t or c
ttaaccgggttctgtacgacattgatcgaaaatcgtcgatttttattggttcttcgttgttgatgaggagnggtttttacttcgaaaatgaaaaggggatt

SEQ ID NO: 14710 - DNA, 101 bp, rice(Oryza sativa)
  misc_feature (71): n=t or c
gtatcctatacgccggggttcatcaggtcttcgtctcctggggaaaaaaatatttactacggtatggattnttttttttacaaccaaagggattagaatag

SEQ ID NO: 14711 - DNA, 101 bp, rice(Oryza sativa)
  misc_feature (71): n=t or c
gcaccgtccgtcaccgagatcgacccggcggcgtgcatggccggtgctcgatcgtgtccttgtttagtttnaaactttttctttaaacttttaattttttc

SEQ ID NO: 14712 - DNA, 101 bp, rice(Oryza sativa)
  misc_feature (71): n=t or c
tggtatgagaggagaaatatgactatgtttttacagtattagagaaactttgctaccactagcggagagcngataataattgctgatttaaaaaccgatat

SEQ ID NO: 14713 - DNA, 101 bp, rice(Oryza sativa)
  misc_feature (71): n=t or c
tccggccgtcccctccaccaccgcctagtctatctccggtcgccccttccactgtacccatcccttctgtngatgcagacgagtaggactccgaccgtccc

SEQ ID NO: 14714 - DNA, 101 bp, rice(Oryza sativa)
  misc_feature (71): n=t or c
ctctatcgctgtgcctgattgaatgaggttaaaattttgagaagctagctggtgagactgatttctagttnattttttaaattttacaactatagattctc

SEQ ID NO: 14715 - DNA, 101 bp, rice(Oryza sativa)
  misc_feature (71): n=t or c
ccatatcataaacgagtagtgaaaaacctaggtttgccagctggcagctatgttgatctcaaaaggcgcangacagcgaggacatgggaaggtgccactag

SEQ ID NO: 14716 - DNA, 101 bp, rice(Oryza sativa)
  misc_feature (71): n=t or c
aaccactgggggccatactataggacgatcagtgttttctcgcaatcctttccagattccaaagaactcgncagatgatgccattgaaattcccgtacgat

SEQ ID NO: 14717 - DNA, 101 bp, rice(Oryza sativa)
  misc_feature (71): n=t or c
ataggagagatgctcttcagtaagttctcgtagtccaccttgcatgcagcaggtaaagagaacctttatcngttgaagaagtgttcccttcgggtgaaact

SEQ ID NO: 14718 - DNA, 101 bp, rice(Oryza sativa)
  misc_feature (71): n=a or c
tagctagttgagatgattaattaccttccaagagtgatatcttctctgagaattgtggagtccaagacggnggtgatgatcatgcaaagcggctggaacgc

SEQ ID NO: 14719 - DNA, 101 bp, rice(Oryza sativa)
  misc_feature (71): n=a or g
tgtgatctggcaattagataggcatgttgacccacatgggcactatcagttatcacatatgccaaaagacnggcccagctgagtcggcaattaattgaata

SEQ ID NO: 14720 - DNA, 101 bp, rice(Oryza sativa)
  misc_feature (71): n=a or g
ttcataaaaagctcttgtttctaattaatccacgattttgttctttgtagttttccaactataatcttgtnctcgtttcttccctttccccgaaaaaaaaa

SEQ ID NO: 14721 - DNA, 101 bp, rice(Oryza sativa)
  misc_feature (71): n=t or c
gattgaaattatttttataattgcaattgttgtttcttagtaactgggatttgataggttctgacaagaanactgcgttgcaggatcgcctcacatgttca

SEQ ID NO: 14722 - DNA, 101 bp, rice(Oryza sativa)
  misc_feature (71): n=a or g
taacataaaaatccatattgttccataaacgattggctgcgttctagaaaatattcctcgtttttcatatncacgaaacggttaaacggtgtgtttttatt

SEQ ID NO: 14723 - DNA, 101 bp, rice(Oryza sativa)
  misc_feature (71): n=a or g
ggtggaggaggaatgtgggtagaactgtctggcaaaatgcatgtcttagctagattactggggcacctccntctgaaaactgatgatcgtattgttcttgt

SEQ ID NO: 14724 - DNA, 101 bp, rice(Oryza sativa)
  misc_feature (71): n=t or g
tcactccatgctaactcccatgcaaacatgtcaggaaaaaactattgtctgaacaattcagcagccgacancttcctcaagtacgagccccagccaacgtc

SEQ ID NO: 14725 - DNA, 101 bp, rice(Oryza sativa)
  misc_feature (71): n=a or g
acaaacagagagcatcaattcaattcaacaatgcaaaggatggaacagcaatagagcgctcttcttaccantctccgtgctgctagtaacagcagcagctt

SEQ ID NO: 14726 - DNA, 101 bp, rice(Oryza sativa)
  misc_feature (71): n=t or c
tttctgaacattgtgttatgcagaagagatcaaagcattttgttttaccgcgatgatgcagtcttccaggngttcacccaagccccagatcggagcgtcca

SEQ ID NO: 14727 - DNA, 101 bp, rice(Oryza sativa)
  misc_feature (71): n=t or c
catgcttgcgccaccagaataggttccattattggtttgagccacactggcctgtaagttagggtcttgcnccttagttagactctttggttcatagtgtt

SEQ ID NO: 14728 - DNA, 101 bp, rice(Oryza sativa)
  misc_feature (71): n=a or g
tgccagcaaatctgccacaaaatcacctgtcgctgaagtaatctccaaggaacctattgctgatgattgtnaagtagaagaagaaatacctgtgccccatg

SEQ ID NO: 14729 - DNA, 101 bp, rice(Oryza sativa)
  misc_feature (71): n=a or g
gagtagtcatgcctactcgagcaggggtaggaccgggatttcgtctccttggggtttaaattatggcgggngaggagaccggggcggcagcggccggcagc

SEQ ID NO: 14730 - DNA, 101 bp, rice(Oryza sativa)
  misc_feature (71): n=a or g
atgtaagaatctgaaacaaatcttattttcaacatgcagcaaggaatcaccctcctgttgatcaacctgancaataccaccggatacaacgtcaccctcca

SEQ ID NO: 14731 - DNA, 101 bp, rice(Oryza sativa)
  misc_feature (71): n=a or g
caaagaacagtggccaagtgcccaagtctgaaatttctgacgtttgtctatggacctacatacatggtacncgaccgcagctgtagatcaccgaaaacgcg

SEQ ID NO: 14732 - DNA, 101 bp, rice(Oryza sativa)
  misc_feature (71): n=a or g
caaaatgctaaaaatagtaaattattcctcttggtttcataatttcatgggcatagtacgatcccgcagcntcagcaaggcgaagaattccttcaatgtgt

SEQ ID NO: 14733 - DNA, 101 bp, rice(Oryza sativa)
  misc_feature (71): n=a or g
ggctacacaggataagcccaagaacaaccaatcccaaccaaatcaagaaacgcaaccaagcagagcagcanatcaagaaacgctagaaacttgagccaaaa

SEQ ID NO: 14734 - DNA, 101 bp, rice(Oryza sativa)
  misc_feature (71): n=a or g
taaaatttttaaataaaacgaatggtaaaacattgaacaaggaaacctaccactgcgttttaagtggaacngagggagcaaaggattttagttgaatagga

SEQ ID NO: 14735 - DNA, 101 bp, rice(Oryza sativa)
  misc_feature (71): n=t or c
ataaccagtgatcatcgaagtgtaagcaacaacgtccttgtcaatgatctctttaaacactccctgtgaancgtccatcctatgaagcttggagtacaaca

SEQ ID NO: 14736 - DNA, 101 bp, rice(Oryza sativa)
  misc_feature (71): n=t or c
agtggccaaagcgaaggaggtgacaacgatgacactgatcggaggtgatggagtggcatggcaagcagctngaaaggaggggacgatggcagggagactct

SEQ ID NO: 14737 - DNA, 101 bp, rice(Oryza sativa)
  misc_feature (71): n=t or g
gaccacaaccttgtctatatctctactattttcctcaaaaggtttctgtcccgctaatccaaaaggcaaangcaaattcaaacaaaatcagtttcaaacca

SEQ ID NO: 14738 - DNA, 101 bp, rice(Oryza sativa)
  misc_feature (71): n=a or g
cagcgatactattaaacatgttcttaggctgtgttcggtttaggaggatgggaattaatccctcccacacngaaaatggagcggttcattcgcgtatgatt

SEQ ID NO: 14739 - DNA, 101 bp, rice(Oryza sativa)
  misc_feature (71): n=a or g
atcaactgaccatgcaaatggtgcctaatctctggaggattttccttctcggctctgtcaagatataacgncagatggcggctgcattactcgtccgatgg

SEQ ID NO: 14740 - DNA, 101 bp, rice(Oryza sativa)
  misc_feature (71): n=t or c
tctcggtaaggtcagctgggcaacacatggttgataagcagagaaatcgtagtactgtgattgccgggttnagatcttgttgatctgaagctggatcatgt

SEQ ID NO: 14741 - DNA, 101 bp, rice(Oryza sativa)
  misc_feature (71): n=t or c
aggcactgttatggtacattctgctactacaccagtagtagctactacttgagaaagggaccaaacactantacagattctttcatctgtgacggcccata

SEQ ID NO: 14742 - DNA, 101 bp, rice(Oryza sativa)
  misc_feature (71): n=t or c
cttgttgctttagcaacatgcatgctagaaaattattctcaaacgctattgaacctgcgttgatcgaaacnatattttcctaccctgctgcatcagttagt

SEQ ID NO: 14743 - DNA, 101 bp, rice(Oryza sativa)
  misc_feature (71): n=t or c
cctatcaaacgagctgagccaatcgagagagagcgctagggccacgaccgattgagtggataaagtcacgngagtagatggataaacgcgtccttatccac

SEQ ID NO: 14744 - DNA, 101 bp, rice(Oryza sativa)
  misc_feature (71): n=t or c
gccctagatgagaagacaagttgatgacggcatgagcgcaatgctgtttggaggtaccaaaaataagagcnaggccgacaatggcggaagaggaaaaaaat

SEQ ID NO: 14745 - DNA, 101 bp, rice(Oryza sativa)
  misc_feature (71): n=t or g
tggcgggcccaatcagccggagcagcggctgccaaccatctacagagtccctggtgagatgaaaaggaggnacgaggagggtaacagctatagctacctcc

SEQ ID NO: 14746 - DNA, 101 bp, rice(Oryza sativa)
  misc_feature (71): n=a or g
aaatgtcctctcctcccctccacacccacactcacgcaacaccttcatcattcctcccttccttactgtangtagtaggcgaagaaggacagcatggaggc

SEQ ID NO: 14747 - DNA, 101 bp, rice(Oryza sativa)
  misc_feature (71): n=a or g
acaagcttatgcatgattggacggggaggatcgcactcaccaagaatttcgtccagcttgcgaaaccgctntgggcagtcattgtggtcgttgtcgatgtt

SEQ ID NO: 14748 - DNA, 101 bp, rice(Oryza sativa)
  misc_feature (71): n=a or g
acagtagtaatttttttaagaacattctcattcaaaattttggccaactgctgacatttcccatgccatcncatattctcagcaaattcattgctttttat

SEQ ID NO: 14749 - DNA, 101 bp, rice(Oryza sativa)
  misc_feature (71): n=t or g
aacagcttcaggagataacgacccatttgcagataatgacactttgcagacctcatagagcttttgtattntagccatggaattgggaaaggatatataaa

SEQ ID NO: 14750 - DNA, 101 bp, rice(Oryza sativa)
  misc_feature (71): n=t or c
gacgaggaacgcccgttcccagaggtatgcgcgccaatggcggatggcttggacaaggctgatcaactccngctcgtaggcggcgagcccggcatggcgtg

SEQ ID NO: 14751 - DNA, 101 bp, rice(Oryza sativa)
  misc_feature (71): n=a or g
gtttccggaactagatcgttctctactgtattgtcgaataatctagccttcgcatgccacctatgcctctnaggtaagaaccgacgacaacgcatgtacac

SEQ ID NO: 14752 - DNA, 101 bp, rice(Oryza sativa)
  misc_feature (71): n=t or c
ttggtaagctcaggtggctgtatagatgaagtttttatgacttcgaaaaagatacccgggggcatgggggnccgggacgacgcccatctggacaattcatc

SEQ ID NO: 14753 - DNA, 101 bp, rice(Oryza sativa)
  misc_feature (71): n=t or c
agtcccatttagaaaattcagtgaatcaagtccatccaacgcttcatctccgcaactgcgagtctcgatancggcgtggcgctacgtctctcaacactcaa

SEQ ID NO: 14754 - DNA, 101 bp, rice(Oryza sativa)
  misc_feature (71): n=a or g
aagatctgcactgttactacatcctcaccatcaaatgtgcatgtgattgcaccctccacccaaaatctttngccatcaatgataaggccaacttgataatt

SEQ ID NO: 14755 - DNA, 101 bp, rice(Oryza sativa)
  misc_feature (71): n=t or c
tgggaatgacttcatcgcagttggaggtgatcgatgatgagcgcaattgctgaacaggagattcaactctnaagtctccttcatagcagccatgaaaacca

SEQ ID NO: 14756 - DNA, 101 bp, rice(Oryza sativa)
  misc_feature (71): n=a or g
agctctatggtatgcttcgtccgcaattctcaagttcagtttctcagcattctgtgcaaagttcattttcngtgggtgcaatggaagacccattctctaaa

SEQ ID NO: 14757 - DNA, 101 bp, rice(Oryza sativa)
  misc_feature (71): n=t or g
aactgttcagccccaaccgatttacgcaccccagcactttttcatgtagttaaccccttttgttttgcagnagagcgatgctggctgaaagcgacttgggg

SEQ ID NO: 14758 - DNA, 101 bp, rice(Oryza sativa)
  misc_feature (71): n=a or g
ctcctaggtagagttattttgggatagagggagggaggccactagatcctaaagcttaacatataaagatnttacatcatcatccgttagcatttgttata

SEQ ID NO: 14759 - DNA, 101 bp, rice(Oryza sativa)
  misc_feature (71): n=t or c
aaaaccttttagattttcgatcgtcggatgtgctaggagtttcgtgcatgtgaggcactactagaaaaaanattttcgcaggcggctaaaactcatttttt

SEQ ID NO: 14760 - DNA, 101 bp, rice(Oryza sativa)
  misc_feature (71): n=a or g
ttccggttgccaccgcacccgtcatgcttcttccatggacaatattcacctgacattgttattagtcaaangtaatggatgaacttgcaatgcactataac

SEQ ID NO: 14761 - DNA, 101 bp, rice(Oryza sativa)
  misc_feature (71): n=t or g
tttgacgtcaaagtttaatacgctaatacttctgattcctcaacgctgtgctccgcaccgaaaacgaagcngtccactactgcgtgattaattaagtatta

SEQ ID NO: 14762 - DNA, 101 bp, rice(Oryza sativa)
  misc_feature (71): n=t or c
gataagataaatagacaacttcaagaagatcaaaccgaagatgaccatatggaccacttagttgacgtagnggttgcagatgaagtcacactagacaatga

SEQ ID NO: 14763 - DNA, 101 bp, rice(Oryza sativa)
  misc_feature (71): n=a or g
caagttggagcagaagattttgatgagaggattcctgatgactttgtaaggcattcgccaaaatatcggcnttatgaggttcattcaccacagcatgtgga

SEQ ID NO: 14764 - DNA, 101 bp, rice(Oryza sativa)
  misc_feature (71): n=t or c
tcgcaatcctgccctaatccccaatcccaatccaatccccccgcattaatcctaatcctaatcctaatccnaatcccaatcccatggacgagtaccaccac

SEQ ID NO: 14765 - DNA, 101 bp, rice(Oryza sativa)
  misc_feature (71): n=t or c
gcagcaatcttgtcagcgaccttctgggcatcattgatgaggttaagggcatcctcttcacttgttccgtntgcgaagccgtcaatggcatcaatatcgat

SEQ ID NO: 14766 - DNA, 101 bp, rice(Oryza sativa)
  misc_feature (71): n=t or g
tatcgtgtcttggggtgcgactagatcttacttacagtcttacacctcatctgagtaggtaccttgagcancggcgacatccttgctcgcattggaggtcg

SEQ ID NO: 14767 - DNA, 101 bp, rice(Oryza sativa)
  misc_feature (71): n=t or c
caagcggtttcatgaaaaccgatcggtttcgtgaaccctacgagcatgtatatatcatggtgtgtatgttngtgtttttttttgtgtaatgaaaaatggaa

SEQ ID NO: 14768 - DNA, 101 bp, rice(Oryza sativa)
  misc_feature (71): n=a or g
gatctatggatagatgcattcctgcagtagaacatagtgctttacgctagagatgaaaatggccagaaatnaatattacttatatgaaagcagctgtcggg

SEQ ID NO: 14769 - DNA, 101 bp, rice(Oryza sativa)
  misc_feature (71): n=t or c
gcattttgtggcattggctcatcctttcacagctttggacattgctgaggcatacatgcagcatattcatngattacacgggttgccagaggctctcattt

SEQ ID NO: 14770 - DNA, 101 bp, rice(Oryza sativa)
  misc_feature (71): n=a or g
aacctgtgttgagctctagtttgtgccttggtaaagaaattagctaactgcaactcggaaggcacgtactnaagagcaaccacctgatcctgtacctgtgt

SEQ ID NO: 14771 - DNA, 101 bp, rice(Oryza sativa)
  misc_feature (71): n=a or g
gtataccgcccaaataaatctgatggtaggagttctatctcagacctaagacgagcgccggcattggcatnaagctcagaaaaaggaaatattgtttcatc

SEQ ID NO: 14772 - DNA, 101 bp, rice(Oryza sativa)
  misc_feature (71): n=a or g
aggtttttcaacttggctattcgaaattgtaaaagatagaaaaatttttccaacccaagatctaatagttntataatatgtaacggtataaacatgatttc

SEQ ID NO: 14773 - DNA, 101 bp, rice(Oryza sativa)
  misc_feature (71): n=t or g
aatataagacaaaagaaccttgaattacagagtatttgaaacaaatatttgatcaaaatcgacagctactntttcaactaccaaaactttgatgatacaat

SEQ ID NO: 14774 - DNA, 101 bp, rice(Oryza sativa)
  misc_feature (71): n=t or g
ttttctccaactaatcgaggtgtatatgaaacagaacagaacctcaaccgccgacttctacgcagtaccantccaattttcaccaccgcaggggggcaact

SEQ ID NO: 14775 - DNA, 101 bp, rice(Oryza sativa)
  misc_feature (71): n=t or c
caagctttctcaagacttgcttcaatggtgtcaatgccctctcaggttttatttcttccatcctgcctctngtgatcttaatcaagctaagacatcaagta

SEQ ID NO: 14776 - DNA, 101 bp, rice(Oryza sativa)
  misc_feature (71): n=a or g
tagcaacaatcccccgcaaccctctcaaccaatctcacggaaatggcagaggagagagaattggctcaaanccagtgggctttgtctgacgtcaaggaatc

SEQ ID NO: 14777 - DNA, 101 bp, rice(Oryza sativa)
  misc_feature (71): n=a or c
acattgttctctgcaccaagcaatctgataaacacaaaagcactaacaatgggagagcaaggaggcagggnaagcagcaacaagatcagggacattgtgag

SEQ ID NO: 14778 - DNA, 101 bp, rice(Oryza sativa)
  misc_feature (71): n=t or c
ctcctagatcttcacggtcgcagaaaactgatgatcctgacttgtgtgtggacaatgagctaggatttgcnaaggatcgaacaattagtaggtaatgtcaa

SEQ ID NO: 14779 - DNA, 101 bp, rice(Oryza sativa)
  misc_feature (71): n=a or g
aataacacgcttaggagctgtttggaagagtttaatttggagaagccggaaaacctctaattcatttgctnaatttcacatctacatattctcagaatcta

SEQ ID NO: 14780 - DNA, 101 bp, rice(Oryza sativa)
  misc_feature (71): n=t or c
ggtgaatcctattttgaaaagggcgatgtaaaataccacgataaaataagtgtttaggaatcagcaccaangttgaagcattcctgatggatacaatcttg

SEQ ID NO: 14781 - DNA, 101 bp, rice(Oryza sativa)
  misc_feature (71): n=a or g
agaataaaaataattctatgttattttatctcactagataatagtactggatacaacatacttaggggctntttggatgggactaaaagtttttagtctat

SEQ ID NO: 14782 - DNA, 101 bp, rice(Oryza sativa)
  misc_feature (71): n=a or g
cattttaggcatcccatgaaggcatttgtttctacttttagccttctactgattcagtttgaaggagctgnatgactctggatcagcaacaattacttaag

SEQ ID NO: 14783 - DNA, 101 bp, rice(Oryza sativa)
  misc_feature (71): n=t or c
cttttggtaaccgatcatacccatgcaatctcgaaatgagcgtgattgtcaccgtacatatctggatcaanctgggattgaagtaagcagagttgtacatt

SEQ ID NO: 14784 - DNA, 101 bp, rice(Oryza sativa)
  misc_feature (71): n=t or c
ttattctttgtttatatatatacaaggattccattggttactaaaaattacgtacagacgtatccggggcngccatgatctgagtaatagacgaagatatg

SEQ ID NO: 14785 - DNA, 101 bp, rice(Oryza sativa)
  misc_feature (71): n=a or g
aatggatgaatcaatcagaagcttaattaatttgatttgtgaataatcttgcacgcaggcaccttcgacancgcgtgcttcaacatcaccttcaacttccc

SEQ ID NO: 14786 - DNA, 101 bp, rice(Oryza sativa)
  misc_feature (71): n=t or c
ccttatccactcgtgagaaccctctccttctccctctcattctcccttatccactcgcgaaggagagttgnggcggcgcctagcttctccccaagagcaag

SEQ ID NO: 14787 - DNA, 101 bp, rice(Oryza sativa)
  misc_feature (71): n=a or g
atacgattattgaaccatgtcgatattagctagagagataacaactgagtagagcataataaagcaattanatcgccatatccaacaaaatatggatggcc

SEQ ID NO: 14788 - DNA, 101 bp, rice(Oryza sativa)
  misc_feature (71): n=t or c
catatgtaagagcatcagccaatccttgtatacggtcaatgcgcacacttttcccgaacagcctggagaangtaggatcaccatggcgggattccagagcc

SEQ ID NO: 14789 - DNA, 101 bp, rice(Oryza sativa)
  misc_feature (71): n=t or c
cgctacactacatataatagcagcaacgaaaatgcttcatttgaccaagaacgtagttgcttacgattggngaagatgatcattctgaatgactatccact

SEQ ID NO: 14790 - DNA, 101 bp, rice(Oryza sativa)
  misc_feature (71): n=t or c
tcattccacggcttatcagcacaccgtagattaagtgatgaagtttagctcaaagttatatgtagtacttnctccgtttcataatgcaagacattctagca

SEQ ID NO: 14791 - DNA, 101 bp, rice(Oryza sativa)
  misc_feature (71): n=a or c
aagtccatagccaattgaattatacaccttgtaccactcttctgccatgtttctagttctagccaacacantagctatagttatgatagctaatggtacat

SEQ ID NO: 14792 - DNA, 101 bp, rice(Oryza sativa)
  misc_feature (71): n=t or c
tcacttttagaaacaacagataaattctatgagtataccactagagccaactattggctctatttgttgtnatataatctataaaaaattagtagttcact

SEQ ID NO: 14793 - DNA, 101 bp, rice(Oryza sativa)
  misc_feature (71): n=a or g
agaaggcgaaccctgtggcagtcgggaaattggagtctaagtgggaaggaccatatttgatcaagcataantctcggacgggttccttttggctggcaaca

SEQ ID NO: 14794 - DNA, 101 bp, rice(Oryza sativa)
  misc_feature (71): n=t or c
tgtccaaagtttgacttacaccctgagtactatctactggtcttatttcaaaatttagtgctctctccgtncctagatatttgacgctgttgattttttta

SEQ ID NO: 14795 - DNA, 101 bp, rice(Oryza sativa)
  misc_feature (71): n=a or c
aaactttctcatcctaacaggtgctgaaactttcaaggggtcaccctaggtgttttccattggagatttgntccggtccaacaaaaagtaccttgaggtac

SEQ ID NO: 14796 - DNA, 101 bp, rice(Oryza sativa)
  misc_feature (71): n=a or g
cacttttaagggaatcaatgtggacttattcccatccttttccacaagacagcccaccctccttcccactntcccttgggccgcctcggcccagctcctcc

SEQ ID NO: 14797 - DNA, 101 bp, rice(Oryza sativa)
  misc_feature (71): n=t or c
gtagaaagacggcacgtagttaggaaattaacgggggaaggacggaacatgcgacggggtggtatggatcnaatttaccaaaattttagtggcacctagcc

SEQ ID NO: 14798 - DNA, 101 bp, rice(Oryza sativa)
  misc_feature (71): n=t or c
aacaagacagcacaccatgtatctgagaaagaagaggttagaagctgacgataaaggccgagtttagttcnaaattttttctttaaacttctaacttttgc

SEQ ID NO: 14799 - DNA, 101 bp, rice(Oryza sativa)
  misc_feature (71): n=a or g
catatctacatcagtgtgcttcgtaaacgagaggtcagtaaagcaactccatgtttccatctgtggctctncaactttccacaaagaaccatggtatgttc

SEQ ID NO: 14800 - DNA, 101 bp, rice(Oryza sativa)
  misc_feature (71): n=t or c
aggcatggatacagcatctataggataacttccatcttgagtgttctttctgacttcaatgtgatatccgngatctctcttgatccgtaactcaatacgga

SEQ ID NO: 14801 - DNA, 101 bp, rice(Oryza sativa)
  misc_feature (71): n=t or c
cttccttgtccaccctaaaagccaaccaccaaaaaccgttttccatagtatagaggtctcaaaaaccattngaaattttgttcgaatctactttttgtcat

SEQ ID NO: 14802 - DNA, 101 bp, rice(Oryza sativa)
  misc_feature (71): n=a or g
gtaactagaggacagatcaaaggagatggtagtaacatgcacgcatcaccaaccagtctacactacacgcntctaccttcactcacagagtaacagtgcca

SEQ ID NO: 14803 - DNA, 101 bp, rice(Oryza sativa)
  misc_feature (71): n=t or c
taaatatggaggggacaaaggcaagccgtaacgcaaaatagaaccacttgtaagagtagactaaagatcanctatctatagtaccggttcaagccgtgtca

SEQ ID NO: 14804 - DNA, 101 bp, rice(Oryza sativa)
  misc_feature (71): n=a or c
ttgcagctgaagaaggacttggacgccatggagcgtagctgtatcagctcaagattgctcaaggacaggcntgccgccccaagcgccgccgtgtctgccgc

SEQ ID NO: 14805 - DNA, 101 bp, rice(Oryza sativa)
  misc_feature (71): n=a or g
gaggcaaagagcggccggccgacgccgaaaaggaggtgggaaaaagcgtgtgcgtgcgtgactagctgctntagtgtgcggtgcccggtgacgcgaacagt

SEQ ID NO: 14806 - DNA, 101 bp, rice(Oryza sativa)
  misc_feature (71): n=t or c
ttggggactggtgctgtacaaaaccggcccgggggttcatctgcacttctgcaatcctgtcaaatggcaanggcgcatgcgaaagctctcttcccgaatgc

SEQ ID NO: 14807 - DNA, 101 bp, rice(Oryza sativa)
  misc_feature (71): n=t or c
cagcaacatatcaggtggagcaactgcagcaggtgacatggatgcataatcatcagaatagaaggtacacnatgatgtttggtacagcacaccacattaca

SEQ ID NO: 14808 - DNA, 101 bp, rice(Oryza sativa)
  misc_feature (71): n=t or c
ttttagttcaaactaacataccagttcaaaccaaaatacgtaccagcgaggccaagccactgcgcaccacngtaggggcccacatggcagcccatggtgaa

SEQ ID NO: 14809 - DNA, 101 bp, rice(Oryza sativa)
  misc_feature (71): n=a or g
aagaaacaacttcaattctgatgctacaataattttcaatggtaatttccctcttcttatcaagagaacanaatcgaggcagcaataaatttgatactgaa

SEQ ID NO: 14810 - DNA, 101 bp, rice(Oryza sativa)
  misc_feature (71): n=t or c
acagcaaattgacagtttggcaaaatttcagacagcaaactggcatacatccatggcaacatatcctatgnacacaggccctcacgtgtacacacgtgtac

SEQ ID NO: 14811 - DNA, 101 bp, rice(Oryza sativa)
  misc_feature (71): n=t or g
ttgttctgtgcaacaccaatccttattattgccgcagagaaagaattagagacgaaacgagatgaattcgncgtccacccaaaggaataagttcactttag

SEQ ID NO: 14812 - DNA, 101 bp, rice(Oryza sativa)
  misc_feature (71): n=t or c
aagtgggccggcacaacctttacttgagcaaaaccagtagcactcttgccggtggctagggaagggaaccngccgtcgtcatagctcgccgttcgaaggtg

SEQ ID NO: 14813 - DNA, 101 bp, rice(Oryza sativa)
  misc_feature (71): n=t or c
ttacttaagataagctatcccttaactatatgttgactactcagtattgcactactgaaggatccagcagngctgaggagagctcaagcagaggttgaccg

SEQ ID NO: 14814 - DNA, 101 bp, rice(Oryza sativa)
  misc_feature (71): n=t or c
cgaaatattgtatcgattgaaactgtcagtattttaatacgtactctatctagctgttatgcaggattagncgctcttaattactctctccctactcataa

SEQ ID NO: 14815 - DNA, 101 bp, rice(Oryza sativa)
  misc_feature (71): n=t or c
aagctaaaaatgggctattctattaaactaccaacagaatttccattagcacgctacctcttgcgctcccnctgaagccacgccaatctcccaagcacggt

SEQ ID NO: 14816 - DNA, 101 bp, rice(Oryza sativa)
  misc_feature (71): n=t or c
aacgcgggggccttttttatctatccagccactcactcgttaactcacttagctaaaatatgttcctgctnatgtggtactccctcagtcccattttaagt

SEQ ID NO: 14817 - DNA, 101 bp, rice(Oryza sativa)
  misc_feature (71): n=a or c
atgaccccatatgaagtagaagcaacctggctctagctaatgtttttttaagggaacgacggcagaagacntgtcggaatttaattaaagggagtaaaaaa

SEQ ID NO: 14818 - DNA, 101 bp, rice(Oryza sativa)
  misc_feature (71): n=a or g
tggaagaagcatcttgctaccaagtcatagaagtaaccggcgccgacatcttcaggccggcattctcctcnggttttgatgaagccctgcgcggtccagag

SEQ ID NO: 14819 - DNA, 101 bp, rice(Oryza sativa)
  misc_feature (71): n=t or g
caggagctgcgtggtggacgccaaggctacgtgcataatgtgcgcctacactggcatcaatggcgtcccgncctgcgcgaacgccgacctcctgaccaaga

SEQ ID NO: 14820 - DNA, 101 bp, rice(Oryza sativa)
  misc_feature (71): n=a or g
cacgcatttattgtcaacatcagtagataataactgatccttttgtcggacaggtttcttgggcatctctnttggttttttaccaggtatgctttttatgg

SEQ ID NO: 14821 - DNA, 101 bp, rice(Oryza sativa)
  misc_feature (71): n=a or c
tactgagaatttgagattatttgtaccatgcttgtaatcttctaacgcaggtagatttgcaggttgtccanattgttgacttgtcctgctcagctgctcat

SEQ ID NO: 14822 - DNA, 101 bp, rice(Oryza sativa)
  misc_feature (71): n=t or c
atcttccttattcttcatccctgtggccaggagcttgtttaacttgtgtgcgcgcgtgtagctcttcattncctgcatatatttgactcgtgtagttgtat

SEQ ID NO: 14823 - DNA, 101 bp, rice(Oryza sativa)
  misc_feature (71): n=a or g
aaaacaaacagcgccttaacttatacaaaaatggtcattcttcaatgcggttgggtaagtgttgacggtcnttatcgatcagtttcgaccgtcaatattac

SEQ ID NO: 14824 - DNA, 101 bp, rice(Oryza sativa)
  misc_feature (71): n=a or g
acggatcatcttgtcaaaattctactcactctgtcctaaacaaacaaatctaacaaatctactactagatntgacacattttagtacaacgaatgatgtgt

SEQ ID NO: 14825 - DNA, 101 bp, rice(Oryza sativa)
  misc_feature (71): n=a or c
ggaagcagagcaactaattttgggtccgtactgcgatgggttcaacgagaaagacaaggctgaatttctgnatgattttggccattttaacggggttcacg

SEQ ID NO: 14826 - DNA, 101 bp, rice(Oryza sativa)
  misc_feature (71): n=a or g
tatatccactgctttgcacaccaattgcaattggtcattgtttctgttacaaaatgttgctcgtcttttgntgatttcttcaactatgtgaatttgattgt

SEQ ID NO: 14827 - DNA, 101 bp, rice(Oryza sativa)
  misc_feature (71): n=a or c
gctatggtatagtagctagtgcacagtgcagccaatagtgatatcccacggaatccaatcctcgatccatngattctagctagctttatatgcaatacaat

SEQ ID NO: 14828 - DNA, 101 bp, rice(Oryza sativa)
  misc_feature (71): n=a or g
ttccaaataaaactccagatgtctcccttcccttgttgtaattgaaggtgagcaagttcattctcttactnaaggtattcactgtaagcttggtctgaaag

SEQ ID NO: 14829 - DNA, 101 bp, rice(Oryza sativa)
  misc_feature (71): n=a or c
taaaagcaagagttgctaaaacgagccgtaggtgtaacacaggtgtcattggagtaaatgatgcattgatnccttgtccgtttgctaagctaagctagagc

SEQ ID NO: 14830 - DNA, 101 bp, rice(Oryza sativa)
  misc_feature (71): n=a or g
gcaatggggggaggaggggataaggggagaggaatggatgaacagtagcgctcgatccctcctttactttngtagatccggggagattcccgcccaaatct

SEQ ID NO: 14831 - DNA, 101 bp, rice(Oryza sativa)
  misc_feature (71): n=a or g
tctggttttccagcagcaatccactggcaacggcaacgtggaaattagcttcaacagcaatgcttcgcctntggccatgtaggcgccagccgataattcta

SEQ ID NO: 14832 - DNA, 101 bp, rice(Oryza sativa)
  misc_feature (71): n=t or c
ctccctcctcaatcctgcagaagtttctgaagagatcaattaccaagaaactgagaggaaacacacagatnatctgcacacagatcatcaccatacttgca

SEQ ID NO: 14833 - DNA, 101 bp, rice(Oryza sativa)
  misc_feature (71): n=t or c
tgctccacccgcatgaaaaattagtgattttcgcagacactttcggacatacaggtaactcaaccgcacgnaaaaattggatctaaccgtttgtaaaaatg

SEQ ID NO: 14834 - DNA, 101 bp, rice(Oryza sativa)
  misc_feature (71): n=t or c
agatatcatctcaggagcaatataacctattgttcctcgtgcagcactaacaggcacaaaactattatccngtgggtacagtttggcaaggccaaaatcag

SEQ ID NO: 14835 - DNA, 101 bp, rice(Oryza sativa)
  misc_feature (71): n=t or g
agttgtccaagccaattattaactgcttcatgatccaacctcgttgtctcagcgtcattaagagaacatcntatgtaatctgtttttctcaccagttcact

SEQ ID NO: 14836 - DNA, 101 bp, rice(Oryza sativa)
  misc_feature (71): n=a or g
tggacggatggatcgagattttgatttccttttaagataaatctaacgataaggtccatcaaaattaatgngtccaccaatttaaaggaaaatcgacagtc

SEQ ID NO: 14837 - DNA, 101 bp, rice(Oryza sativa)
  misc_feature (71): n=a or c
atagttaactatgatcaggagatacaaggaggccacatcaatatgaggggaaagcttgtgaactggatggnggaactggtttatgggttcaatctttggga

SEQ ID NO: 14838 - DNA, 101 bp, rice(Oryza sativa)
  misc_feature (71): n=t or c
tgcaccaaggtgagcatgtgcacaggatacgctaccggatatatatatctatagaaacccctctgttattncttttagtgtaattgcattgattccattca

SEQ ID NO: 14839 - DNA, 101 bp, rice(Oryza sativa)
  misc_feature (71): n=t or c
aactagtactacaaatttagaacggtactaggttttaggtcctttttaagttcccaaataaaaattttcantctgtcacaaaatgtttggacacatgcttg

SEQ ID NO: 14840 - DNA, 101 bp, rice(Oryza sativa)
  misc_feature (71): n=a or g
atggcgttatgtggatgtggagctgctcgatgtatcagccagcctttttttttgtgtgtgcgtgtttctgnaacctcaaaggtgctggctgagtatgggtt

SEQ ID NO: 14841 - DNA, 101 bp, rice(Oryza sativa)
  misc_feature (71): n=a or g
gagctcaagttttacgtgcaaattggggccagaagaacactcaagtatcatccttctcacttgttcctcgnaaacatgagcttttctcttcatattcagaa

SEQ ID NO: 14842 - DNA, 101 bp, rice(Oryza sativa)
  misc_feature (71): n=t or c
ccccctaggtatagtcaatgttttgagcttgtacccattccgctccgaggacgacaaccgataccacctcngcttcaccggaccagcccaagaaagtcggt

SEQ ID NO: 14843 - DNA, 101 bp, rice(Oryza sativa)
  misc_feature (71): n=a or g
aagtgacacgtaaaaatttctctgataccaaataatatagagatggctcgaccttctcgacgtaggatttnaaataccaagtagctaacaaagtggatgaa

SEQ ID NO: 14844 - DNA, 101 bp, rice(Oryza sativa)
  misc_feature (71): n=a or g
accgaagtgccaggcgcgacgcagactccgtctccaccaccaacacaaacccgcacacgagcagggtgtcngcaaccactgccagaagctcctcctccacc

SEQ ID NO: 14845 - DNA, 101 bp, rice(Oryza sativa)
  misc_feature (71): n=t or c
agccacaacaagctcttgttgccattgcccacgcgagcctcacatcactatcactgacgagagtcccccgntgtcatcgtccacgcgggcctccctccgct

SEQ ID NO: 14846 - DNA, 101 bp, rice(Oryza sativa)
  misc_feature (71): n=a or c
ggcttgttggagctaaaaaattccacgaaacgtggaaactcgcctctgttttcttggcgtacttagacacngcatgtattcttccgcttcatggaattctt

SEQ ID NO: 14847 - DNA, 101 bp, rice(Oryza sativa)
  misc_feature (71): n=t or c
tctattatgtgcgtctttctcctatccagcagacaagggaaagcatacgagaaatccagagtagtgcagtngatcctagaggatctaaatcaaatgacagc

SEQ ID NO: 14848 - DNA, 101 bp, rice(Oryza sativa)
  misc_feature (71): n=a or g
cgaacgcctggctaggccggcctgcaccagctttgcactaagggccctgttcaaatctccaacaaaaattnaataatcttttggatagaagtgacatgctt

SEQ ID NO: 14849 - DNA, 101 bp, rice(Oryza sativa)
  misc_feature (71): n=t or c
ctgatgcaagggggacatcctctagctttcatgtgcaaggctcttagcccaagatcacaagccatgtcaanttatcagaaggaatgtatggctatgttact

SEQ ID NO: 14850 - DNA, 101 bp, rice(Oryza sativa)
  misc_feature (71): n=a or g
agagacaattcttatattttagagttttggaataaaaaacaaagcagtctgagacgattcctggtaggatngggcaaaaacaatcgctctaaaaagctgag

SEQ ID NO: 14851 - DNA, 101 bp, rice(Oryza sativa)
  misc_feature (71): n=a or c
gcatttattctccacttagcaactccttttcttttctgccctaagcacctaaagtgtataagtaggtactntatagaataaacgtatgtccttgtaaaagc

SEQ ID NO: 14852 - DNA, 101 bp, rice(Oryza sativa)
  misc_feature (71): n=t or c
gatctttatgaagactatggaaacaccctgaataattccagcaccaaagaggctcatcccaagcatgaggngtacaaggaggtgatgtttgtatcttcgtt

SEQ ID NO: 14853 - DNA, 101 bp, rice(Oryza sativa)
  misc_feature (71): n=t or g
acgtagggagcacgccatgcttgctgggtaaggcggtggattgcagctacgtgcatggagcgggatacctngaggtggatgtggacgttgctggtcgtcgg

SEQ ID NO: 14854 - DNA, 101 bp, rice(Oryza sativa)
  misc_feature (71): n=t or c
tgtgctatctactttcagcgcacatgtcactttgtggtccaccccattttcatctttatcgactgcagagntatgaaagcgaccatgcgagagctcgacta

SEQ ID NO: 14855 - DNA, 101 bp, rice(Oryza sativa)
  misc_feature (71): n=a or g
ttaacgcacacgtaccatcaaaacaactagataggaaccccgccgtattgctccggaagaattgcatagcnaaataggagatgtaagatgtaaaatcggtt

SEQ ID NO: 14856 - DNA, 101 bp, rice(Oryza sativa)
  misc_feature (71): n=a or g
ccgcagcgatagccgccgataccaaggaggtacgtgcggtgacaaggagaacgacaacaacgaccgcgacngtggtccacctcccctgtctttcagtcttg

SEQ ID NO: 14857 - DNA, 101 bp, rice(Oryza sativa)
  misc_feature (71): n=t or c
ttcagatttggactcttttcatgattgactaggacttctactaggattctcttacattcatatcttccggnctgttcttcaaacttttgaaatttcgactc

SEQ ID NO: 14858 - DNA, 101 bp, rice(Oryza sativa)
  misc_feature (71): n=a or g
aaatactctctctccatctaaaacgtataaaaatttctactattctgcacaatggttatttaaaaagtacntgaaattaaatgagatatgattgcgattag

SEQ ID NO: 14859 - DNA, 101 bp, rice(Oryza sativa)
  misc_feature (71): n=t or g
tctcatcagcagaagtttggcaacggtatattgattgtgagcaatgaagccacaccgcgcaacaatggagnagttgacagctctactgcaacacagtttca

SEQ ID NO: 14860 - DNA, 101 bp, rice(Oryza sativa)
  misc_feature (71): n=t or c
caccttgaggaattgttccgctgttgatcttgccttctctccgatttcggtcactgtgttctcatctttcnccgttgagaggaactgacaatattacaaga

SEQ ID NO: 14861 - DNA, 101 bp, rice(Oryza sativa)
  misc_feature (71): n=a or g
cgtcggtgataggtgaggggagaggttgtgcaaagaagggagaaaaaaaggagatagggctgatgtgtgtntcccattgctagaatggagagaatgttgga

SEQ ID NO: 14862 - DNA, 101 bp, rice(Oryza sativa)
  misc_feature (71): n=t or c
tttgcctcctatcaacagctacaatagaaatcacgaccgtcgcacttcatcatctccgatatcggtctgcnggtcgccggcgaagagaagaagagccacca

SEQ ID NO: 14863 - DNA, 101 bp, rice(Oryza sativa)
  misc_feature (71): n=t or c
ccctatagcatcctcggtaacggtcacgcgtgtgtacaaactatccggcactagttgaaatgaatgtaganatttttttattattttcaagttaaattggt

SEQ ID NO: 14864 - DNA, 101 bp, rice(Oryza sativa)
  misc_feature (71): n=t or c
ttgaatatgagtataaaactccccgatcaagatagtcacaaatcgcaagtatatacgttgttagaataggngttgaatatattttaatagtaattgatgtg

SEQ ID NO: 14865 - DNA, 101 bp, rice(Oryza sativa)
  misc_feature (71): n=a or g
gatcctctacatcttcaacaccgcaacaacggtgacacacgaaatggctccatcgttacagcatatttttncaaatgaaatataatttgttaataaaaggg

SEQ ID NO: 14866 - DNA, 101 bp, rice(Oryza sativa)
  misc_feature (71): n=t or g
ctcgtctccgatcctcacccaagcctctctctctccctctcaccggaggcaaggtggggatggcctcgccngcggtggcgacgcggcacccttccccctcc

SEQ ID NO: 14867 - DNA, 101 bp, rice(Oryza sativa)
  misc_feature (71): n=a or g
tacaatgtataaagatttgatgttatcacttttcgaattgacagcttgtagcacacgagtagaggtatcangcccaagcttgggttttacagtattaaccc

SEQ ID NO: 14868 - DNA, 101 bp, rice(Oryza sativa)
  misc_feature (71): n=a or g
caaaatttcagtgctatgtttatgtgcaatttcagttttcatttgatctgcaattctgttattgtctatgnttttattttgttttattataagcttgatta

SEQ ID NO: 14869 - DNA, 101 bp, rice(Oryza sativa)
  misc_feature (71): n=a or g
gaggccgcacttggcattgccaaggggattgagtacctgcacgaagggtgcacctctcctatcatccactntgacatcaagcccgacaacatactgttgga

SEQ ID NO: 14870 - DNA, 101 bp, rice(Oryza sativa)
  misc_feature (71): n=a or g
tttccatctccggttttgtcacaggatgcgcaagccttcgtgctgataaccttaatctcaagcacatcggnttccccattttggttcacaagctgcaactt

SEQ ID NO: 14871 - DNA, 101 bp, rice(Oryza sativa)
  misc_feature (71): n=a or g
aatgcaaaacgctgcataataaaactagtactactagtactccataaactaaagatgtggacatcacgganaggtgggtcccacggttcaatcagggaggc

SEQ ID NO: 14872 - DNA, 101 bp, rice(Oryza sativa)
  misc_feature (71): n=t or c
acttcggtagtccaagcttcaaccaaggtagcggcttcgacatcttaaacggccacacgggcagtggttgnggtgaaggccccttcgaccgccgccgcctc

SEQ ID NO: 14873 - DNA, 101 bp, rice(Oryza sativa)
  misc_feature (71): n=t or c
ttatatgactttggaatcagcaaccaagattgttctagcctccccctcctcatctttgcctcattccttanctcctcattactaaggctatagaaataatc

SEQ ID NO: 14874 - DNA, 101 bp, rice(Oryza sativa)
  misc_feature (71): n=a or g
caagctcgagggacaaagggggaagtggaacttgaccttgctaacgcatcgaggggacgctcggtgagganagggggaggtggagtgctctcaggctcacc

SEQ ID NO: 14875 - DNA, 101 bp, rice(Oryza sativa)
  misc_feature (71): n=a or g
acatctagctagcaatcttattttttccagcaacaaagatgattcaggcattgatcttccctactctactntgtctcaccatagcaacttcaggtggtctt

SEQ ID NO: 14876 - DNA, 101 bp, rice(Oryza sativa)
  misc_feature (71): n=t or c
caaagtgaccttgttccaagccgcagtagcgagcatttctttatatttagaatctgtttggattgctaccnaaaattttggtagggtaacaaaccaaacac

SEQ ID NO: 14877 - DNA, 101 bp, rice(Oryza sativa)
  misc_feature (71): n=t or c
acctccgtgttgttgaaaaaactcatcagcctgtcttaatagagcttgtttttttattctctgtttgtacntgatcaccccccatccaaggaaaccaaaga

SEQ ID NO: 14878 - DNA, 101 bp, rice(Oryza sativa)
  misc_feature (71): n=a or g
tgggcctggtaacgcatgcatgaatcttggctaggaattcggttgataaaacaaaaaatctcagcaggttnttgtatagtaaatcccttttatttagagcc

SEQ ID NO: 14879 - DNA, 101 bp, rice(Oryza sativa)
  misc_feature (71): n=t or c
ggatgctgaagcgaggttgcgcagccaatgcagctatatacactgcactcattgactcgatgggtaaattnggaagagagaaggaggcaatggcactcttt

SEQ ID NO: 14880 - DNA, 101 bp, rice(Oryza sativa)
  misc_feature (71): n=t or c
ggtattgttttagttctatgaaatgcctagctaaagactgtaattttgataaaatagttataaatgttttncttttaaaaaaataatttaattattactct

SEQ ID NO: 14881 - DNA, 101 bp, rice(Oryza sativa)
  misc_feature (71): n=a or g
atttttttcgcattgcacggtgccgaaccgaatttttttataaatgcacgtattttcttgcgttgggttgnacaattttttcggagcaatactttttataa

SEQ ID NO: 14882 - DNA, 101 bp, rice(Oryza sativa)
  misc_feature (71): n=a or c
cgatcaagttttccggcggatggagcggcatctaaaggaacacaaaagggaggaattaacgcatatatttnagttagctgcacaaactagactcatttaat

SEQ ID NO: 14883 - DNA, 101 bp, rice(Oryza sativa)
  misc_feature (71): n=t or c
gaacttattagtttatatgatggcctctttgaatcactgtcaggaattttaatttagctttcatgaggagntccttttaaatctgtgcaagcacataacac

SEQ ID NO: 14884 - DNA, 101 bp, rice(Oryza sativa)
  misc_feature (71): n=t or c
tcgtcgtcaggacagcggcggtaaggcacgagagtttcccaatgaagtagagctggatagataggtagagntagctagcttgcagtggacattggttggga

SEQ ID NO: 14885 - DNA, 101 bp, rice(Oryza sativa)
  misc_feature (71): n=a or g
ttggaaagggatcggtgacatttttttgaccggcaaagagaagccgaccggaatctattatattattaaanggatagaaaaaggagccaccacgttcactc

SEQ ID NO: 14886 - DNA, 101 bp, rice(Oryza sativa)
  misc_feature (71): n=a or g
aatatgcacactacttccgttgttacaggatattttagagcaaatagtactacgaatctagctgtcctatntagtattggtatcctatgtagtattgtatt

SEQ ID NO: 14887 - DNA, 101 bp, rice(Oryza sativa)
  misc_feature (71): n=a or g
tctcttcactctagctttgcctttctctctatgttttttttaacaggcgcccctgggattttattgcagcnaaatcccctcccgagggggctcgacagtga

SEQ ID NO: 14888 - DNA, 101 bp, rice(Oryza sativa)
  misc_feature (71): n=a or g
cgcaccgggacttgagattaggattaaactagtcaaaagctcgcgcgttgcagtgaaaatttataaaagtnaagttgtgatgaaattttaggggacgaaaa

SEQ ID NO: 14889 - DNA, 101 bp, rice(Oryza sativa)
  misc_feature (71): n=a or g
gtttccagtgctaaatatgtccttgaggacaggttgaacattttataaacccaagcaaacgatgaaacgangcagctagatttgtaaggtggtttttgact

SEQ ID NO: 14890 - DNA, 101 bp, rice(Oryza sativa)
  misc_feature (71): n=t or c
ggcagtacgaagagtggaaaaggtgaacactttggcaagggaaaagcctattgtagtaggagcctggcagnccagagatatagaatggaggtaacgcaact

SEQ ID NO: 14891 - DNA, 101 bp, rice(Oryza sativa)
  misc_feature (71): n=a or g
atgtcaaatacaaaatgagatcataaggctacaggagcacaaacaatatcaatggaagaacacaaacatcnatgcagagataataaggactcacccagacg

SEQ ID NO: 14892 - DNA, 101 bp, rice(Oryza sativa)
  misc_feature (71): n=t or g
cacttacctttaccaacctgcagatgttttcaggggaaatccaaattttgctgaagatgagaaggcatatnagaacctaaaaagaagcatccttggagcag

SEQ ID NO: 14893 - DNA, 101 bp, rice(Oryza sativa)
  misc_feature (71): n=a or g
gtccatctcgcagcacgaatcttgaacagatcaatggcccaaaaaacgacagattcagccaaaaaaaaaanggactacatatacatttgtcgacaaatttt

SEQ ID NO: 14894 - DNA, 101 bp, rice(Oryza sativa)
  misc_feature (71): n=a or g
gtgcagaattgcagagaggcaaaagaagaacaagcagagagcaagaacaagcagaagcagaagcaaagagncgatggacggcgacacgctgtcggcggcgg

SEQ ID NO: 14895 - DNA, 101 bp, rice(Oryza sativa)
  misc_feature (71): n=t or c
tcctccacattttgactcactcttaactatcaacttgatgcagcttatgcaaccttctttcgcgcttgtgngtgacaaaaaatccaagtgctttctgcttt

SEQ ID NO: 14896 - DNA, 101 bp, rice(Oryza sativa)
  misc_feature (71): n=t or g
caagattagatggattgcactacaacgtatcacctgctagtgttggcaaagtgctccatatttaacacgtngtaaacacacggtgcatatatacgtaggta

SEQ ID NO: 14897 - DNA, 101 bp, rice(Oryza sativa)
  misc_feature (71): n=a or g
cgtgctaaaagatcaactagacagacatagtgtttctcagcaggtgtgatcttgaagtgattaaccatgcnaccaaaccatagtttcccttcctccacaag

SEQ ID NO: 14898 - DNA, 101 bp, rice(Oryza sativa)
  misc_feature (71): n=a or g
agggccattctcagggtataactctgttttcattgcgtttacgttcctttctcatatattactgttaggtncaatgttttcattgcattcccatgtgacaa

SEQ ID NO: 14899 - DNA, 101 bp, rice(Oryza sativa)
  misc_feature (71): n=t or c
gatgaaggcatactgaaaaagatcatcaagcgtggactggggagcgataagccttgtgatttggatgaagnacttggtatgcaatactacattagttactc

SEQ ID NO: 14900 - DNA, 101 bp, rice(Oryza sativa)
  misc_feature (71): n=a or g
cgctcgcactcaaaaactttcagtcgtcctcttgatatgtttgacaattttcatgctgaggagtcaaagangcagaaaacaaaagctccatcgttttggag

SEQ ID NO: 14901 - DNA, 101 bp, rice(Oryza sativa)
  misc_feature (71): n=a or g
cactgccattagcgacttccaatcctgtagaaagtgccgccttcttccccctcaaattcttggatgaacanacttaattctccaaaagaaagcactgaagg

SEQ ID NO: 14902 - DNA, 101 bp, rice(Oryza sativa)
  misc_feature (71): n=a or c
tcaatggcgcctacttgtgttgttacggggatatttgttaggtaccctcgttgtagtccacacgattttgnacagggttgatgccgaacccttttcacgca

SEQ ID NO: 14903 - DNA, 101 bp, rice(Oryza sativa)
  misc_feature (71): n=a or g
acgcagttaattggtcctatcttctagaagttctggagggttttggtttcggaatcaaatggcgcaattgnatctcaaacctcctgggtacctcctcttca

SEQ ID NO: 14904 - DNA, 101 bp, rice(Oryza sativa)
  misc_feature (71): n=a or g
agtactctactaattagtctagggctcaccacaacggcgacatgaatggatcaaatcttagagaaaaaaanagagaaaagaaaaggagtataaccattatc

SEQ ID NO: 14905 - DNA, 101 bp, rice(Oryza sativa)
  misc_feature (71): n=a or g
gaaatttgcagtgatgttgtcttcaaatacataacttaagttcttaaggacaggagatggtgaaggttgtngaggcataagagcgaacgcctggtctacag

SEQ ID NO: 14906 - DNA, 101 bp, rice(Oryza sativa)
  misc_feature (71): n=t or g
accgaatcagtaggattagcaaacccactggctccagaagttcctgtagattgatttgatgaagtagaggnattctctgcagcagatgagcctccttgagt

SEQ ID NO: 14907 - DNA, 101 bp, rice(Oryza sativa)
  misc_feature (71): n=a or g
tgtgttccaaagactgactagctttacccttttgctgttttgcagggaaaagacctaagtattcctgaganaaaaaaagagcaacctttgagtgaaaaatg

SEQ ID NO: 14908 - DNA, 101 bp, rice(Oryza sativa)
  misc_feature (71): n=t or c
gatggatccttcagctcgtgggcgatggcccgaagcatctgaatagaaacccgcggttcgtgttgattgtncctgagctttgagcagcgctgccgctcggg

SEQ ID NO: 14909 - DNA, 101 bp, rice(Oryza sativa)
  misc_feature (71): n=t or g
aatgccagcgatccatatatatcatgtgtgcgcaatattactgttgcagatacgtggaggtgaacgagagnactagcgtgcgcctcttctactactttgtt

SEQ ID NO: 14910 - DNA, 101 bp, rice(Oryza sativa)
  misc_feature (71): n=a or g
tcttcctcgtcgagaacagcttccgaatcgaccgcgggattggcaactatatgcgaaaaagagaaaatcancacaagggctaataaaatagctcaaacagt

SEQ ID NO: 14911 - DNA, 101 bp, rice(Oryza sativa)
  misc_feature (71): n=a or g
tgcagtaactcccgtgctgaaataattccatgaagaaggaggaatcatatgcaatggcataggatccaccnccgccgccgccgtcgccgccgcggccgcgg

SEQ ID NO: 14912 - DNA, 101 bp, rice(Oryza sativa)
  misc_feature (71): n=a or g
aattcttactaatgaacttcatcctcgcagaaaagctctgaatccaaatatgttgggcttgatcctgtccncgagcttcgattccccttcgaggtaaagaa

SEQ ID NO: 14913 - DNA, 101 bp, rice(Oryza sativa)
  misc_feature (71): n=a or g
ttcaacggtcatgagtgaatttaaattgaagtctgagaaactaccatgcgcaacagacccagaattttccngcggcaatctctctcctttccttggaatac

SEQ ID NO: 14914 - DNA, 101 bp, rice(Oryza sativa)
  misc_feature (71): n=t or g
agatacaaacaagcagagataccaacaacaaattgatcagacattagcaagtgccaaatagctatcatcanaacttgagacctgatcctttgaacttgtcc

SEQ ID NO: 14915 - DNA, 101 bp, rice(Oryza sativa)
  misc_feature (71): n=t or c
cggtggctacaatgcggcaatttggtaagaacttgccgccgtcaagaagctagggtttcggtgtagggaangaatggcgagctggtcgagccggaccagag

SEQ ID NO: 14916 - DNA, 101 bp, rice(Oryza sativa)
  misc_feature (71): n=t or c
atagttcaagcatgagccaaacatggtactctggccaagaacctgtgtcccccagccgccatcttcattcnataaacatgtattatacatataaacaaaat

SEQ ID NO: 14917 - DNA, 101 bp, rice(Oryza sativa)
  misc_feature (71): n=a or c
aatagaaccttgagggataccatcacagacaatacctggtcgcaagacctaaatctctcaatcatcggagncatgtcaactaagcttctagagcaactagt

SEQ ID NO: 14918 - DNA, 101 bp, rice(Oryza sativa)
  misc_feature (71): n=a or g
actatctttatttttcctataccatatgagcatttttcagaaggttggattagcatatcttgagattgacnaagttaccatggacgtcttactgttgactg

SEQ ID NO: 14919 - DNA, 101 bp, rice(Oryza sativa)
  misc_feature (71): n=a or g
ggcgggggagacgacgctcctttggaacctgaggttcgtggaggtcacagatgaggcgccatacatcgacnggattcacccgtgctacagtaggttgtcgt

SEQ ID NO: 14920 - DNA, 101 bp, rice(Oryza sativa)
  misc_feature (71): n=a or g
ctcgagctcccactgctgccgtgaagactctgagagccccatgaagaaccactaaaactttttagtatatntagatggtagaggggactgtaactctatct

SEQ ID NO: 14921 - DNA, 101 bp, rice(Oryza sativa)
  misc_feature (71): n=t or g
ctagcaaaagccacattataaaattgatgatgatactccctttgggctgataatatttatcttttggacanaacacggtctcaaacaacaactttgaccac

SEQ ID NO: 14922 - DNA, 101 bp, rice(Oryza sativa)
  misc_feature (71): n=a or g
caaactaccaaaattataaactaacactagataacgagatacgatttaggtttagttccacgtcaaaattnaaagtttgaagaaaaaagttaaaagtttat

SEQ ID NO: 14923 - DNA, 101 bp, rice(Oryza sativa)
  misc_feature (71): n=t or c
aagccgtagcacgaatgttggaataaatcggatggccgcaaatttgcctgacaaaacaaaaaaaaagtaantgtgtttttacccttatttgcatatgcagt

SEQ ID NO: 14924 - DNA, 101 bp, rice(Oryza sativa)
  misc_feature (71): n=a or c
gtttcatgcaactgttttcagcattttttctttgatgagttgatctcttaatctaacttgcaagcaataangctatccaccgcccgatgacctgggtggct

SEQ ID NO: 14925 - DNA, 101 bp, rice(Oryza sativa)
  misc_feature (71): n=t or c
ccatatggcttacgtactaggctaacgaatatgtattacaactgtagctaactggcactactggatatttncttgacatacaagttaacataattcccgag

SEQ ID NO: 14926 - DNA, 101 bp, rice(Oryza sativa)
  misc_feature (71): n=a or g
cgcgggggaggtagatgtcgccgaacaaacagccagaagggacctcattagggttaacgcgtgccggattntcctaaactcagcatgccagttaggacatc

SEQ ID NO: 14927 - DNA, 101 bp, rice(Oryza sativa)
  misc_feature (71): n=t or c
attgggatgcctagggtattccagcctcagacccacgtattactaaaattgaactacaagttcagaaaatnatacatttgcaaagacttgcaaataacctg

SEQ ID NO: 14928 - DNA, 101 bp, rice(Oryza sativa)
  misc_feature (71): n=t or c
gatcctgaaagccgtcagttgcgtgctgctcttgctgaagattctggtcttgaatctgagtacatacttgntggatgtggtgcagatgaattaattgattt

SEQ ID NO: 14929 - DNA, 101 bp, rice(Oryza sativa)
  misc_feature (71): n=a or g
cttttattcttccactttccttcctttccccgttgattacgcgtggttggctgccgacgatgagctcgctncgcgcggcggcctacatgcggcacggcggc

SEQ ID NO: 14930 - DNA, 101 bp, rice(Oryza sativa)
  misc_feature (71): n=a or g
gacagcattatgaggaaaatccagacagattggacaagtgatatcctccatccaacttttatcaagtttgncatccaaatcgaaagaaccggccttcacca

SEQ ID NO: 14931 - DNA, 101 bp, rice(Oryza sativa)
  misc_feature (71): n=a or c
aaacttgctcggaggatgtctctctcttcagacaacatggtatatgatttggtggaatatcatgtcaaggngcaaatgcgacaaggcaatcaaccatatct

SEQ ID NO: 14932 - DNA, 101 bp, rice(Oryza sativa)
  misc_feature (71): n=a or g
gaggggaggagggcaagatggccatccatctgcgaagaccaatcttcttaggtagacgacataatgcgccncctgagaagatacattttgcacaggaggag

SEQ ID NO: 14933 - DNA, 101 bp, rice(Oryza sativa)
  misc_feature (71): n=a or g
tactgcagtgataagccacaggtgtgtgcggtgatttattttatgctgctgaggcttcttgccacgtgatnctttatcttctttgctggctgaaatagtag

SEQ ID NO: 14934 - DNA, 101 bp, rice(Oryza sativa)
  misc_feature (71): n=a or g
gaggaagctgggagtccctgtcttgatgttctacccgtccaacgccggccacctcgccgttaacttgcagnctcctctgcttgttgacgggttcaagaagc

SEQ ID NO: 14935 - DNA, 101 bp, rice(Oryza sativa)
  misc_feature (71): n=t or c
gaagcgttctgcgttgtggccaggagttcctattgtttgagctcgaaagtggtgtttttggactgttttgnccaatggtgatgtttcaaacaagataaagc

SEQ ID NO: 14936 - DNA, 101 bp, rice(Oryza sativa)
  misc_feature (71): n=a or c
cagttgctgttcttcccatgttcttgatgccagtgatcttgacaatcttgttattgttaccatcaccaacngagatttcctcaaccagatgtgcatgacca

SEQ ID NO: 14937 - DNA, 101 bp, rice(Oryza sativa)
  misc_feature (71): n=t or c
attcagcagcaaggtttgcttaatgcatcggctgggttcaggacacccgataatcagctgagatagcacgntgcaaatcgagttgtcctagagcatttggt

SEQ ID NO: 14938 - DNA, 101 bp, rice(Oryza sativa)
  misc_feature (71): n=t or c
caatatcacatcattgtcgagtttggtatttcgctcaggtgacattttgctaacttgtgcatgcaggatgngtatacctgtgatgggtgtatccaccagct

SEQ ID NO: 14939 - DNA, 101 bp, rice(Oryza sativa)
  misc_feature (71): n=t or c
cgaggtcgtcggggtcggccaaataccccattacggtgatgacgacgtcgtccggcagcgccgaccagtcngcgacggcggtttcttcctccatggcggcg

SEQ ID NO: 14940 - DNA, 101 bp, rice(Oryza sativa)
  misc_feature (71): n=t or c
caccagatccaatgcatctctaatgaccaatgtccccagtttcctcttgcctagtttgagctaggtggtgnttgagatcaaggtcaccatccctcttctcg

SEQ ID NO: 14941 - DNA, 101 bp, rice(Oryza sativa)
  misc_feature (71): n=a or c
aggaaagttcaaagacatgtgtaaatcactcaatttgcttcagtaggccatccacaaacaaatggaactgnagaaagagcaaatggcaagataatggaagc

SEQ ID NO: 14942 - DNA, 101 bp, rice(Oryza sativa)
  misc_feature (71): n=a or g
tcacccgtcttcttcgtctcggctaccttcttccatttcttccatgtatggattaaccggaacttgccctngctcatgtcgtctttatgagggttgggttt

SEQ ID NO: 14943 - DNA, 101 bp, rice(Oryza sativa)
  misc_feature (71): n=t or c
tgcaaatatcaaatcttgggatctgttaattcacgaaccaaataccaataaaaaaaaactagaaatggaangttttatgattaaattgttcttatgatgcc

SEQ ID NO: 14944 - DNA, 101 bp, rice(Oryza sativa)
  misc_feature (71): n=a or g
cttttcaaactcattcaaacaacctacactcttggtatccaatgctaagcgatgctatctgcaggcgtgcngacccatgttgcagctgttgagcaagcact

SEQ ID NO: 14945 - DNA, 101 bp, rice(Oryza sativa)
  misc_feature (71): n=t or c
tccacctgggtggcaatgttcttaaatgtagtcatcttcttccgtaggtgcagcaaccttatagaactcancattcgattgaatagatttagcaaattatt

SEQ ID NO: 14946 - DNA, 101 bp, rice(Oryza sativa)
  misc_feature (71): n=t or c
atgcacttgcatacacaccatgcatcacagcatggaagtacaacacttcaaatcaaagttatcagtgcaantgggccaaacaaaatcaattagttttaatg

SEQ ID NO: 14947 - DNA, 101 bp, rice(Oryza sativa)
  misc_feature (71): n=a or c
gaacaaatgctgtgcaacagtggaacaggttgagcctaattaacctgctcacttatgacgcatgcaagacncttacagagtgctactcttgcaaagctaat

SEQ ID NO: 14948 - DNA, 101 bp, rice(Oryza sativa)
  misc_feature (71): n=a or c
aattaccaatcctcgaagcatctcatgcacagcgagtgcgcgcaatcgggcagcacaatcttggcattcanctcgaggcagatgccgcactcgagctccct

SEQ ID NO: 14949 - DNA, 101 bp, rice(Oryza sativa)
  misc_feature (71): n=t or c
atgtaatcaccctcacacatgtaattctagactaaaattactttgaacgtgcgaaaaaaatatcgtgttanaagaattattcaataaagttggttgttata

SEQ ID NO: 14950 - DNA, 101 bp, rice(Oryza sativa)
  misc_feature (71): n=a or g
taatgtgtagacatatggcttttggttacccgttaatctgattattactggtattgcaggcaagaacgacnaacacatccgcaaaactgccgttggccggc

SEQ ID NO: 14951 - DNA, 101 bp, rice(Oryza sativa)
  misc_feature (71): n=t or c
gtgggtcctatattaattataaagagctaactattatctgggtaaactgagagaagactgcaaagaaccgnatagccaacaagtcggctatattattagcc

SEQ ID NO: 14952 - DNA, 101 bp, rice(Oryza sativa)
  misc_feature (71): n=t or c
taagtacaaccgaggtcactgtatctatctctagatcaatataattttcagcacatcaccaccctcttttntgaggttttatcaccggtaggacttgacac

SEQ ID NO: 14953 - DNA, 101 bp, rice(Oryza sativa)
  misc_feature (71): n=t or g
ccgccgccaccatcgatcatcagacacaacaacaacacagtcatatagagggaaacgagatttctcgtcgntggaggaggggggccggacctgtgtcgccg

SEQ ID NO: 14954 - DNA, 101 bp, rice(Oryza sativa)
  misc_feature (71): n=a or c
ccagaacggccaaatccactaaaaacggagtcctctctcggaatgatgaatgcgacacctacctaatagcnggctaaatactgaggtggaggagagaagag

SEQ ID NO: 14955 - DNA, 101 bp, rice(Oryza sativa)
  misc_feature (71): n=a or c
ttacactaattcagatgtgacttgttatgttttcatgcgatgcacaggcttgcctgaaacaaaggtttggnagatggtagcaagacaaaacaagagaccag

SEQ ID NO: 14956 - DNA, 101 bp, rice(Oryza sativa)
  misc_feature (71): n=a or g
atttataaatagtataaaaattcctaactataccgaaactgtttctataaaaaggagtaatgtactagcantaatgtactagcaataatgttgtcttcgac

SEQ ID NO: 14957 - DNA, 101 bp, rice(Oryza sativa)
  misc_feature (71): n=t or c
cctggctgccaagttgctggcggtgaaatgacattggttgcgcggatcgagagaggtggcttcagatcganctcgggcgatggcagcatgtcggcggcaac

SEQ ID NO: 14958 - DNA, 101 bp, rice(Oryza sativa)
  misc_feature (71): n=a or c
ctttgttcagtattttcaccgttatctggtcaggctcaataaagtcatccagaagttcagtttcatcagcnccgccactgttactagatcagaagttaatt

SEQ ID NO: 14959 - DNA, 101 bp, rice(Oryza sativa)
  misc_feature (71): n=a or g
tacctcccaatgaaaattttaaaaacatttacgtgttgtttggtgataaatctgttttatgatcaaagcanatttctttgtattatataatcccttatttt

SEQ ID NO: 14960 - DNA, 101 bp, rice(Oryza sativa)
  misc_feature (71): n=a or g
ttgctagcagagagggagattcgacaaaggcatgtatgtgggaatcgaagaataggagggctagagcctgnaggggacaagagtgcgcgacgttgtacaac

SEQ ID NO: 14961 - DNA, 101 bp, rice(Oryza sativa)
  misc_feature (71): n=t or c
ttgttgacaatgttttagctgttaccaatattcccatgtcacaagtgagccagcatattcagtattcttgntagttctagacttcgttgttctttacaatc

SEQ ID NO: 14962 - DNA, 101 bp, rice(Oryza sativa)
  misc_feature (71): n=a or g
tttacttggagtaacatgcatgacagccctttacttgagcagcttgactgggtgttcatttctcccagctngttaatctcctaccctaataccttggcttt

SEQ ID NO: 14963 - DNA, 101 bp, rice(Oryza sativa)
  misc_feature (71): n=a or g
aaacgtgagtggcttcacttatgtttccaggattacaaatctgtggagtaatataactcagttcttcaccncattgtcacttgtcttaagctatgtggaga

SEQ ID NO: 14964 - DNA, 101 bp, rice(Oryza sativa)
  misc_feature (71): n=a or g
tcatcagtgtcttcattgccttctccaaaatcatcacatacagtttcttgttcagatggtgtggcaagctntggaagggtattttcttcttcagtctgttc

SEQ ID NO: 14965 - DNA, 101 bp, rice(Oryza sativa)
  misc_feature (71): n=t or c
tcctatcaccaaaagggatcgatcaacaaacattacatgacaagaacaattaatttgccgacgacgatgangacaacaacaacaacgtgaacatgaaccgt

SEQ ID NO: 14966 - DNA, 101 bp, rice(Oryza sativa)
  misc_feature (71): n=t or c
tagacgcggttcgcccggccgttagattgccgctgcagcaagcgagcgtattcggctgttataaggccccngatcatattcgccgcttcagcctcggcatc

SEQ ID NO: 14967 - DNA, 101 bp, rice(Oryza sativa)
  misc_feature (71): n=t or c
gtataatatactatacattcttgaaatgaccttcacaatcccatcatctcttgaagcttttaccacgaaanttgattgacatggtatgtttcatggaaata

SEQ ID NO: 14968 - DNA, 101 bp, rice(Oryza sativa)
  misc_feature (71): n=a or g
ggtactctataggcttaaatacgctaaataggcttaacatgttagcccagcccaagatgtttcctgcaagnaacggtgggcctgaacagagcggccatgtt

SEQ ID NO: 14969 - DNA, 101 bp, rice(Oryza sativa)
  misc_feature (71): n=a or g
acgaactcctcgtggtacggtggtaatgcacatcaagttcctgctccatcagcccacaactaccatggccntgctctctcggcgggatttgtgccaccggt

SEQ ID NO: 14970 - DNA, 101 bp, rice(Oryza sativa)
  misc_feature (71): n=t or c
acgagcccgtcgccagacactggaactggtcttaatggcttgcccgacgccggacacgaaatcaggtgtangcgagacctcctgttatccatgcgaaccga

SEQ ID NO: 14971 - DNA, 101 bp, rice(Oryza sativa)
  misc_feature (71): n=t or c
gaagggtgggacctacatgtgggccccatattttccaaatttttaatttttggttctagtgccacatcacngtcacgtaggacgaggaccaagtcaaaccg

SEQ ID NO: 14972 - DNA, 101 bp, rice(Oryza sativa)
  misc_feature (71): n=a or g
gagaagttatagttgtaaaattcagaaaacgaactcaagacatctagattctcagaagctcatataaagtnttgtttagaggagtttctagctgctatatc

SEQ ID NO: 14973 - DNA, 101 bp, rice(Oryza sativa)
  misc_feature (71): n=t or g
tctgagtggtgtgatttattgatcgacagacggtgcgtgcaccctcgtataccacagatggcgatcattgnttacgcggagagcgcggcgaacatctaccc

SEQ ID NO: 14974 - DNA, 101 bp, rice(Oryza sativa)
  misc_feature (71): n=t or g
tacagtgcatctctgaacatgcacccaaaagaaaatctacaagctaagcaatcatggcacatatgattgancagagtatattatgaagctttaaagaaact

SEQ ID NO: 14975 - DNA, 101 bp, rice(Oryza sativa)
  misc_feature (71): n=a or c
tctttggtgtatatataattaaacggtctgagcttttaatttctacaaattgtttggaaaaatgtcacaancagtgaagaaaaggcaatgtggttatattg

SEQ ID NO: 14976 - DNA, 101 bp, rice(Oryza sativa)
  misc_feature (71): n=a or g
tgatccaaaccctgcgacacggatctcagtttcagaaattatggaagatccttggtttagagtaggtcttnattcagatctacttaacaagaccataccaa

SEQ ID NO: 14977 - DNA, 101 bp, rice(Oryza sativa)
  misc_feature (71): n=a or g
agccgctgcatcgaccctgatccatccaagagaccatcgatgcagatcatcacaggagttctggagaacgngatcgacttgtcggcagccgccatcctgaa

SEQ ID NO: 14978 - DNA, 101 bp, rice(Oryza sativa)
  misc_feature (71): n=a or g
aaggcagcgaaggtggaaggagtgcatgcacatgaagtggaccgcaggaaggtcaagcgtaaaggtgcacntcgtacacttgctaagctgaaagacctttg

SEQ ID NO: 14979 - DNA, 101 bp, rice(Oryza sativa)
  misc_feature (71): n=a or g
tttctcattggttggcagatgctcaagcaaccatgcgtccaagtcaactcaagtatggaagctgctagccntagccttgaacgacatggcatcgagagtaa

SEQ ID NO: 14980 - DNA, 101 bp, rice(Oryza sativa)
  misc_feature (71): n=a or g
gcagaggaaacagttggggtctgcccaactctatatgcaggaaaatcaccaatctagtagacaagtatgcngtcactggaatgaaaattcaatgctcctat

SEQ ID NO: 14981 - DNA, 101 bp, rice(Oryza sativa)
  misc_feature (71): n=t or c
gcgctgttttctccgtttgctccagaattttgtcctgcactctcaccactggaatcagtaggattaggatnattaattagaggttgatcatgtactactgc

SEQ ID NO: 14982 - DNA, 101 bp, rice(Oryza sativa)
  misc_feature (71): n=t or c
gaattgtgcactgagctatggtctgctgctgctgcaattttagctcagagaggaacacacctgagttcatnggtgtgctccaattgccgactcccttcaat

SEQ ID NO: 14983 - DNA, 101 bp, rice(Oryza sativa)
  misc_feature (71): n=t or g
atctccaccaagaaccgccgggctttgcaggaaagcacccctggcaactgcgacaactaccaccaacgcanagaagagctagggcgagcagagcagcagag

SEQ ID NO: 14984 - DNA, 101 bp, rice(Oryza sativa)
  misc_feature (71): n=t or c
gaagagaaagaatggaaggaagaaaaaggaaaatgaatcgagaaaatgaagttacttttataataattggntatagctctgatgagcaaagatagggatgt

SEQ ID NO: 14985 - DNA, 101 bp, rice(Oryza sativa)
  misc_feature (71): n=a or g
gccaacattgatgtgggaacgggaagtatccatttccgtatcaacagaaggaatagaagttcgagtttcanccaaggactaagcaatgctccatggtgaga

SEQ ID NO: 14986 - DNA, 101 bp, rice(Oryza sativa)
  misc_feature (71): n=a or c
ctttagaagttttctgcttttgtggaattgaagctggaacattgtcattccgtatttcagccaaatcgttnttgtttgattctgaaacaaataaaacaaag

SEQ ID NO: 14987 - DNA, 101 bp, rice(Oryza sativa)
  misc_feature (71): n=a or g
cattaggggatgccaatgcgtgttcttaggttgcaagaggagatcgccgaccggagtttgggcgtgaatcnagggggtcacgcggtgtccggcgaggaggt

SEQ ID NO: 14988 - DNA, 101 bp, rice(Oryza sativa)
  misc_feature (71): n=t or c
tagacgcataaaaaaatatagtttggataccgaaaaacttgtatctggccgtatgtctcatattatgaaanatatatgaaaatatattgtacatccatatt

SEQ ID NO: 14989 - DNA, 101 bp, rice(Oryza sativa)
  misc_feature (71): n=t or g
ctcgtcctcgccatgctgcaaggggtaaaccctaaatatgagaatctccgaacaattcttcctctacaacncccgttaccgtcgttcatcgaagctcgcag

SEQ ID NO: 14990 - DNA, 101 bp, rice(Oryza sativa)
  misc_feature (71): n=a or g
ctacatcagtatttgtaagagttttgagattctttttaaggctgcgttcgatcgaccgttttgaaggcagnattttaaggcacataaaacgagaaacctta

SEQ ID NO: 14991 - DNA, 101 bp, rice(Oryza sativa)
  misc_feature (71): n=t or c
gtgaacagtgtggaacttactgtattggaaaccaaaagcctcgaccaaggtatccctaaccagaggagaangaactgcaaacaagcccactgccaacagat

SEQ ID NO: 14992 - DNA, 101 bp, rice(Oryza sativa)
  misc_feature (71): n=a or g
gcttcagctgatgtacggtccatgttaggtagtactcccaccgtattttaaccgtattttaatgtatgacnccgttgactttttaatcaatgtttgaccac

SEQ ID NO: 14993 - DNA, 101 bp, rice(Oryza sativa)
  misc_feature (71): n=a or g
cttacgctccgccgctagtgtgaggctgactccactcgtttccttccagttcgcccctcagaaatccatcncggctgtgcatagtgcacgcgaaagcccta

SEQ ID NO: 14994 - DNA, 101 bp, rice(Oryza sativa)
  misc_feature (71): n=a or g
aataaattttagaacagtttatttttaaaatagaaatagaaatgttaagaaaatcgactgtgggactggangataaaagaggtctgttcagattcgttgta

SEQ ID NO: 14995 - DNA, 101 bp, rice(Oryza sativa)
  misc_feature (71): n=a or g
tcatctggtgctaccacggtttgagtcacaggtacaatatgaggtaccaaatttattggaatattatcctnttggatttccggtgtaacattagcccgaat

SEQ ID NO: 14996 - DNA, 101 bp, rice(Oryza sativa)
  misc_feature (71): n=a or g
tcattgtggtatcctcagggtaggaggagtgtactggtgtatagtgctcgctgcaaatgacggtaaaaacnagtcgctgcccgtaggccgtagctcggtcc

SEQ ID NO: 14997 - DNA, 101 bp, rice(Oryza sativa)
  misc_feature (71): n=a or g
gttaaatttgtttacatacatcagtggagtggagcactgcatgccttctcgtactttacaattttagtgtnctactggcatgccgatcaacggccggccgg

SEQ ID NO: 14998 - DNA, 101 bp, rice(Oryza sativa)
  misc_feature (71): n=t or c
gccaccaagtttcaagaggtgtccaactacttccgtcaaaattaccaacatatgaatgaccgcgcacaggngcggtggatgaaccccgtcgtgccgaactg

SEQ ID NO: 14999 - DNA, 101 bp, rice(Oryza sativa)
  misc_feature (71): n=a or g
catttctaccaagctttatggcagatattgctggaacttcaaagcagaagaacaagttcatggcagatatntctggccttcttccaggtttggcaatcaac

SEQ ID NO: 15000 - DNA, 101 bp, rice(Oryza sativa)
  misc_feature (71): n=a or c
agtttttgccctccaacctctctattagtctccaactctccattaaacctacaataagataaaccgggatngattttgctatatctcactcgaaagatttt

SEQ ID NO: 15001 - DNA, 101 bp, rice(Oryza sativa)
  misc_feature (71): n=a or g
actcatgccgttgtgtggtccatctagtccgcagctgacgagtaaatacgtagtacatatctccaaagtgncagtgcaattctggtctttagttcattctt

SEQ ID NO: 15002 - DNA, 101 bp, rice(Oryza sativa)
  misc_feature (71): n=t or c
tatgccccaccactatcgcgtgctgccgttgtccatgatttaccttactcagattcccaggtcaggtggcngtggcagcgctccttccgcagagtccgttg

SEQ ID NO: 15003 - DNA, 101 bp, rice(Oryza sativa)
  misc_feature (71): n=t or c
aagaagaggccaccgatccgagccatggaggattacttctacttctccgccaccttggagttggagcccgntggcaacctcgagtcagtctcaccgtcgcc

SEQ ID NO: 15004 - DNA, 101 bp, rice(Oryza sativa)
  misc_feature (71): n=t or c
aattgtcttagaaaagggaatcgatcctcctacatgtgatattgacatataatggtaacactagcctctgnccaacaggagtaggactattaccagtaatc

SEQ ID NO: 15005 - DNA, 101 bp, rice(Oryza sativa)
  misc_feature (71): n=a or g
gcaccaagattatcacaccataacctggccattagaggactagaaacacccagttctgccaataaggtctntatccacatgatttctgctgtagcgttggc

SEQ ID NO: 15006 - DNA, 101 bp, rice(Oryza sativa)
  misc_feature (71): n=t or c
gtttaggagcactttcctacagacatgaaagaagccacctactactgtctacagccaaactattgtgcttntcttgtcaagttccagtactacgccaaact

SEQ ID NO: 15007 - DNA, 101 bp, rice(Oryza sativa)
  misc_feature (71): n=t or c
ttcttgaagagggcctcaaagttcaacacaagaggtatcatgtaacccaaagagagaactacaagcatggngattgacatggcaggaagcgcttcaggaac

SEQ ID NO: 15008 - DNA, 101 bp, rice(Oryza sativa)
  misc_feature (71): n=a or g
gcattgccaagcatccatctgttatctgtagtacctttccttgctatagtctccttagggcgttcacaatncgtcaatatggtattcagcctcaacaccaa

SEQ ID NO: 15009 - DNA, 101 bp, rice(Oryza sativa)
  misc_feature (71): n=a or g
ctttgttaggttttcaggggaggaatagctgagtttgaacaaatgacacttagatttgaggagtccattcnaagctatcaagtttaaatgtgcttttagat

SEQ ID NO: 15010 - DNA, 101 bp, rice(Oryza sativa)
  misc_feature (71): n=t or c
ctgtgtattttccctggcatcactcctaatcactctctgtttgaactgatgatgattgcagtcgacgacgnggagcctgaatcttctcccggagaacgccc

SEQ ID NO: 15011 - DNA, 101 bp, rice(Oryza sativa)
  misc_feature (71): n=t or c
tcacatcctcccttggtactgtcggctcataaaggtgctcaacaaaaacatatgaaggggctacttctcgntttgaaccgaaattagctagtctgtcggcc

SEQ ID NO: 15012 - DNA, 101 bp, rice(Oryza sativa)
  misc_feature (71): n=a or g
tcgcactccactgggtcgccaccctcgtctgtcaccaccgccgccaccgtccttgtccaccatgatcgtcntcttcgtcgtgcttcactgggtcaccgccc

SEQ ID NO: 15013 - DNA, 101 bp, rice(Oryza sativa)
  misc_feature (71): n=t or c
actcaagatacgtttgtcaggtcagccttcttctgaggtaacatgggaagatggagctgcacttcgccaangattccccgatgcgccggcttggggacaag

SEQ ID NO: 15014 - DNA, 101 bp, rice(Oryza sativa)
  misc_feature (71): n=a or c
gagcataaatatttaatgattataatataaattttcagtctcgaaaggcagtgaaatcatactttagcagnatcttcaggattattctttacaggagcata

SEQ ID NO: 15015 - DNA, 101 bp, rice(Oryza sativa)
  misc_feature (71): n=t or c
tagtgctactttgcctcgtgaagttgcacatgttgtgagcaatcttaatagggattttgaatctcgagtgngtagtacgtcctccgggcaaaatcgacgct

SEQ ID NO: 15016 - DNA, 101 bp, rice(Oryza sativa)
  misc_feature (71): n=t or c
ctgccccctcaggatcgccaacaagaccgagaggacggtcgcgtttaaggtggtttgcggcccgtttgatngcggtgtaaaaccctagaaatatttttctt

SEQ ID NO: 15017 - DNA, 101 bp, rice(Oryza sativa)
  misc_feature (71): n=t or c
caaggtgaatacggctatctaaagaacatgcatattactggatttgttgcatcgacaggcgagcttgaatntctgctacatgtcgtggaaagtgcctctat

SEQ ID NO: 15018 - DNA, 101 bp, rice(Oryza sativa)
  misc_feature (71): n=a or g
gaaaataaccacaaattcacagtaaagaaaactaggtcatacttggtatttctctctgtaaatctgaactnctgctgcatgagccaaaagttgattgtgag

SEQ ID NO: 15019 - DNA, 101 bp, rice(Oryza sativa)
  misc_feature (71): n=t or c
tttggaatgattgggctgttgcactggctaattaattagaacagcctgcagaaatgcatggcctgcgtttnttggccagcataattaattaactaactaac

SEQ ID NO: 15020 - DNA, 101 bp, rice(Oryza sativa)
  misc_feature (71): n=a or g
agaatgtcgtcgaaaaacacaaggacgaaccttcgtaagaacggcgcgaggacagtgttcatcagtgcctngaacgtcgcgggtgcgttcatcaggccgaa

SEQ ID NO: 15021 - DNA, 101 bp, rice(Oryza sativa)
  misc_feature (71): n=t or c
ctgcatgaagatcgaaaggcgttggacgccgtccccgtcgagatgatctcgacgctagtgaccaaggaaanggcgaaggcggcgtgggactgcatcaagac

SEQ ID NO: 15022 - DNA, 101 bp, rice(Oryza sativa)
  misc_feature (71): n=t or c
tgtgttacctctgaccataaggattctagataggtgaaagcagcaagctgcttgaaagaagaatgagccangtcgtcggaaattgcaagcaccatcggatg

SEQ ID NO: 15023 - DNA, 101 bp, rice(Oryza sativa)
  misc_feature (71): n=a or g
tcaaattgaaaattcttaactccgtcgcagtgttaaaatttccaaattgtaaattacaactcgaggcaatnagagcaggaggctataagccagctgtaaac

SEQ ID NO: 15024 - DNA, 101 bp, rice(Oryza sativa)
  misc_feature (71): n=a or c
catatgacgttataatatcatttgtctttcccagtaaaattagagacgatggggtggttaacatgtgaacnttttgaccccacatattatttctttattac

SEQ ID NO: 15025 - DNA, 101 bp, rice(Oryza sativa)
  misc_feature (71): n=a or g
aacgcagcctaaatatacagccaggttttctttcttttcgtgtgttatagatcgacttagggtgtgtttgnttcgtggtcaaggctggataggatatggcc

SEQ ID NO: 15026 - DNA, 101 bp, rice(Oryza sativa)
  misc_feature (71): n=t or c
aatggggagaagaagtgttggttttgtaaagaagcttggttccctaggcatcaatgcaaggtaaagaaggntttacatgctctgttgctggaagaagaaga

SEQ ID NO: 15027 - DNA, 101 bp, rice(Oryza sativa)
  misc_feature (71): n=t or c
ttttttattttttctgtgtcgcaatctcttcttcctcctgtgtattatagaaggcagcgaagctcctcctncctctctccctccgaatcctcccccgcatt

SEQ ID NO: 15028 - DNA, 101 bp, rice(Oryza sativa)
  misc_feature (71): n=a or g
tcaaaaagataaaaaaaagttgtacatctctctcctctacactaattaaaatttttctaggaggggtgggngacaagaggacggcaccagcgactctggcg

SEQ ID NO: 15029 - DNA, 101 bp, rice(Oryza sativa)
  misc_feature (71): n=a or g
ctaccgatgtacaccccgaaaatggcacgtgacttggcgacagttgagcaagcgaatctgcagatggttantgatgaaacagaatgagaagctgttaccaa

SEQ ID NO: 15030 - DNA, 101 bp, rice(Oryza sativa)
  misc_feature (71): n=t or g
ttcgcactcttgtgcaagttgattggtacaactccgttttcatggcaagaccccatccagtggtagagatnaagtatgtggactggatattcatgaggcac

SEQ ID NO: 15031 - DNA, 101 bp, rice(Oryza sativa)
  misc_feature (71): n=t or c
cgtctctcacattttacttggagaccacttcattctcgcactagaacaaaaatgcatgagcaacaatcctnaagttcctcctcgatccgtctctcaccttt

SEQ ID NO: 15032 - DNA, 101 bp, rice(Oryza sativa)
  misc_feature (71): n=t or c
tatagctttgagtagtcccgagcttggaggagacgttcctggatttccgcaagaaagatatttcgttctgncaagctgcgttatcatagcaacatagggtg

SEQ ID NO: 15033 - DNA, 101 bp, rice(Oryza sativa)
  misc_feature (71): n=a or g
actaagcatgtaaggtggtatctgcttttgaagtttacatattgaagttctagcggtggtttcctagtaanactagaagtgcatcatgaacactatcctaa

SEQ ID NO: 15034 - DNA, 101 bp, rice(Oryza sativa)
  misc_feature (71): n=t or c
acttctctattccctcattgctgaaggttggctggtctacgatttggccctctcttctgttccctagcagnagaaaccgcgattggtttgtcattcgggtt

SEQ ID NO: 15035 - DNA, 101 bp, rice(Oryza sativa)
  misc_feature (71): n=t or c
gtgttttggtccttgtcagtgtttggctatttatgtgcctagtttagttagcgtgtaccggccgtgtcacngttgccggtggccgacctccatttgatagc

SEQ ID NO: 15036 - DNA, 101 bp, rice(Oryza sativa)
  misc_feature (71): n=t or c
atcaaccaatccaagactgatgtagtcaagacctggtggacccatcagcacacggccaccatcaccctcangggtacctttggacttggctttagccttgg

SEQ ID NO: 15037 - DNA, 101 bp, rice(Oryza sativa)
  misc_feature (71): n=t or c
gtactgctctgatatcgtccagatattcatggaccggagtttccagaattccagaattttcaaacatctcncaaatttgtcccctcccatgtctacgacta

SEQ ID NO: 15038 - DNA, 101 bp, rice(Oryza sativa)
  misc_feature (71): n=a or g
agatggccttgattgatggaactcgtcatgacatactcgtcgacctccccccatgttgacggtcgttagcnatcagtttcgcccgtcaatattaccaaaat

SEQ ID NO: 15039 - DNA, 101 bp, rice(Oryza sativa)
  misc_feature (71): n=a or g
atgtgtttgtgtatgttatgtctgtaattacttttaggcattgtattgcaagttcccggacagtttgctcncccgcacaaataaccctgcagtttgctcag

SEQ ID NO: 15040 - DNA, 101 bp, rice(Oryza sativa)
  misc_feature (71): n=a or g
gacatggatggcacgaggagcgccaagaggatgaagcgtttctcgggggcttgcccttgtccactgcccgncgacatcgtcgacgagatcctctcccacct

SEQ ID NO: 15041 - DNA, 101 bp, rice(Oryza sativa)
  misc_feature (71): n=t or c
ctagggaaggcgaagcaatggttctgcgtgaattgtgttgcagtaaatatttaggataagcgctccactgngttcctctccaagttcttcccgatgggaaa

SEQ ID NO: 15042 - DNA, 101 bp, rice(Oryza sativa)
  misc_feature (71): n=a or g
agaaaataataggataagcggatgtgcttgttcttctattaatcaagtttgtacccctaatgttgatactnagtcattagatgaccagttggaggataatt

SEQ ID NO: 15043 - DNA, 101 bp, rice(Oryza sativa)
  misc_feature (71): n=t or c
catctctatgcgatccagtgaaaaatgcacaaactctgatgaagggtagtaccggtgagcttatagacganattggctatttgacttgtcgatggctgcaa

SEQ ID NO: 15044 - DNA, 101 bp, rice(Oryza sativa)
  misc_feature (71): n=t or c
agattttggctcaaaccaaattgaagtcgctgaggcacaacaacttgaattcaaaacattcgtacatttcncaatgcctcctaggccaagctgctgtgttt

SEQ ID NO: 15045 - DNA, 101 bp, rice(Oryza sativa)
  misc_feature (71): n=t or c
atgcgccgaaatatgattgtattcatctcacgactaagactctgggtgttcatatttatatcctcaggttngtacaagtccaaatcagacatgagataatc

SEQ ID NO: 15046 - DNA, 101 bp, rice(Oryza sativa)
  misc_feature (71): n=t or c
atgtgtatgcacttgagaatctcgctttcggcacttctacagcgcaatgatggatccactatctctgttantgtgcccctagtccaattctcccatacctg

SEQ ID NO: 15047 - DNA, 101 bp, rice(Oryza sativa)
  misc_feature (71): n=t or c
cgactgctgtcatcatcgaggtcgccatcaccatctattgcgttgtcgaggtcgccgtcaccatccattgngtgtcgaggtctgacgtcggggagaaaaga

SEQ ID NO: 15048 - DNA, 101 bp, rice(Oryza sativa)
  misc_feature (71): n=t or c
ggaggatagccatagccatggccatatccaaagaagtcgaagttaggaggcaacccagcaaatggatcctnaatctcttcatcctctggctcatcgggctc

SEQ ID NO: 15049 - DNA, 101 bp, rice(Oryza sativa)
  misc_feature (71): n=a or g
accagcacgtacaagctctctgcggctgcgcaatgctcgccgaacttgttgactaaggctattggatgtcncaacaatctggcacaccccattgacgaagg

SEQ ID NO: 15050 - DNA, 101 bp, rice(Oryza sativa)
  misc_feature (71): n=a or g
agacaaggatgagagttaccttttgatgagccgcttatcgagaaattggagtcttgaagcttggtgatacngtctctcagatcatgctcagtcttcctggc

SEQ ID NO: 15051 - DNA, 101 bp, rice(Oryza sativa)
  misc_feature (71): n=t or c
aagcaattagttcgcttggaaggcctgaaccatcttgatagcctggagcaccttaccatcatcaagtgtcncagccttatggacttgaaagtagccggcaa

SEQ ID NO: 15052 - DNA, 101 bp, rice(Oryza sativa)
  misc_feature (71): n=a or g
ctttttagtgtttttgagcttgcaatagaaaaactggaatacgttgaatagtcaattgtagtagctttaancccagaagtatgctgaacagtgctccaatg

SEQ ID NO: 15053 - DNA, 101 bp, rice(Oryza sativa)
  misc_feature (71): n=a or c
cttcacttcatcatacaatttcttctcccatgcaagcatcctatcaagtactgtggcatgagtttcaaacntttcatcaatttcaaaattatcaccaaaat

SEQ ID NO: 15054 - DNA, 101 bp, rice(Oryza sativa)
  misc_feature (71): n=t or c
ccattttgataagagccgtggttggctggttgccgaaaacaaatagagcaagtttgctaaacaagcctacntgggagaagacaaccggcaaatggctctcg

SEQ ID NO: 15055 - DNA, 101 bp, rice(Oryza sativa)
  misc_feature (71): n=t or c
aaattggtatgaaagagaggaccctgagttgtccactcacaattcagtatctcagcagaacaaggaagcantgtgacattagccactttcacctgaactaa

SEQ ID NO: 15056 - DNA, 101 bp, rice(Oryza sativa)
  misc_feature (71): n=a or g
aatgctggatcctgtggcaaacagatcacgcatgattaacacaaaactgattattaccacaccatctgcantgacatccggggttggaccaaagaatgcaa

SEQ ID NO: 15057 - DNA, 101 bp, rice(Oryza sativa)
  misc_feature (71): n=t or c
gcaactttcgcctcctcctcatcctccccctcctcttcatcgtactggtcatcgacagtgtcctcatcgtnggcatcagagtcagtggaggcaggggcctt

SEQ ID NO: 15058 - DNA, 101 bp, rice(Oryza sativa)
  misc_feature (71): n=a or g
ttcttgggtaggcttggttggcctaatcacagtgcactcctttgattcctggtgtttcccagtcctatatntgtaggtctacatgccacatttcccatggt

SEQ ID NO: 15059 - DNA, 101 bp, rice(Oryza sativa)
  misc_feature (71): n=a or g
gaaactatttcagagtttgtcctgaatgatcaaattcataacaacttgcagtttatgaagaatcgcctccnagaagttctttctgacaaaagcagtttgat

SEQ ID NO: 15060 - DNA, 101 bp, rice(Oryza sativa)
  misc_feature (71): n=a or g
agatcgaagactgaggtgcacatgaccgtacactgcagagatcattggaggatggcgaagttgaacccccnagatgtagctccagtgcaaatcgattccgt

SEQ ID NO: 15061 - DNA, 101 bp, rice(Oryza sativa)
  misc_feature (71): n=t or c
atgttattggttcttgtatagtattgaccactggcgtctaaatgatttgccagaccacttgtgctgtgccntggaatctctcgttaattaagtaggatttc

SEQ ID NO: 15062 - DNA, 101 bp, rice(Oryza sativa)
  misc_feature (71): n=t or c
tcaaaccccactcaaaccaaaattgaccgtgcttttgcgaccacggattgggattccttgtttgcaaattngtgtctttatcctctatcctcagcgtgttc

SEQ ID NO: 15063 - DNA, 101 bp, rice(Oryza sativa)
  misc_feature (71): n=a or g
aactatagtgcatatggactttttacaactgtaacttttgctgtattaattttccaggagaaagtatatgngtgtggggctagcaaaatggcaagcttcac

SEQ ID NO: 15064 - DNA, 101 bp, rice(Oryza sativa)
  misc_feature (71): n=t or g
gcaacgcaattggtctattcccagaaaatcatgtcccaaaacaaacttcttgtcctgaaccctctgtatangtttgctagcgtaaattactcattttttgc

SEQ ID NO: 15065 - DNA, 101 bp, rice(Oryza sativa)
  misc_feature (71): n=t or c
agagcaaatcacaaaatccaacttgcaccacctatatagaaggattttatgcatcccaaattccaaagttnaattctactacttcaagttacaattctctt

SEQ ID NO: 15066 - DNA, 101 bp, rice(Oryza sativa)
  misc_feature (71): n=a or c
attcaacgtacacttgagctagcttagtggttgttatgctgtcctatttaaggggagggtctgggttcgantcctgtctacgacaatatttttagctgttt

SEQ ID NO: 15067 - DNA, 101 bp, rice(Oryza sativa)
  misc_feature (71): n=t or c
atgaccctccatttccttgtcgtgaaaataatctcagcgggagaaagctagctttttggtgatatccggtntcttgagaaattaccttcaaattttgtaac

SEQ ID NO: 15068 - DNA, 101 bp, rice(Oryza sativa)
  misc_feature (71): n=t or g
cactccgcatacatatttgacagttacctccgcgtgagagatcagagagttaagcataaagaaagaaaaanatagagttaagcacagatcttaaaatcaaa

SEQ ID NO: 15069 - DNA, 101 bp, rice(Oryza sativa)
  misc_feature (71): n=t or c
cgtgccaaactagcccaaaaccacaacgtcgcacaccaactttcgtgagagttttgcaggaaaatagtacnaccttcgtttttttaatatgcaacactatt

SEQ ID NO: 15070 - DNA, 101 bp, rice(Oryza sativa)
  misc_feature (71): n=a or c
cacggcgtatgtgcatcctctatgagaataaaatggatgaggaactcagctggagcacggtagacattgantttgaaaaaagcatccttgtgtggcatgtc

SEQ ID NO: 15071 - DNA, 101 bp, rice(Oryza sativa)
  misc_feature (71): n=t or c
atcgtacatgatctcaatctacccacgataatctcttattaaatgaggagcattaaagtcttttcttctcnaacttttaactaaacaactaaatgttggat

SEQ ID NO: 15072 - DNA, 101 bp, rice(Oryza sativa)
  misc_feature (71): n=t or c
cacctgtgtaaccttggtttacaggactgcattgagtgtttcttagatttagtggtgaacttcctgaaaangatcatttgttttgtccgatgaagcttaca

SEQ ID NO: 15073 - DNA, 101 bp, rice(Oryza sativa)
  misc_feature (71): n=t or g
cccaaactggaagggggcgatggaagacgagatgaaatcgatcgaggagaacaatacttggagcctcactnatttacctgcagggcacagggcgatcggtc

SEQ ID NO: 15074 - DNA, 101 bp, rice(Oryza sativa)
  misc_feature (71): n=a or c
ctccggcacggatgggaggaaccagtcgtctctaatcttgcgaagcagcagcaactgattgtgcatagatntagcttgtgtgttaattgcagctcgctaat

SEQ ID NO: 15075 - DNA, 101 bp, rice(Oryza sativa)
  misc_feature (71): n=a or g
ggggttgttggatgtaacccctcacccatgcacgcgctttgattttttttcctttcccgcttgtatgtatntaattacactataataaaatatactccctc

SEQ ID NO: 15076 - DNA, 101 bp, rice(Oryza sativa)
  misc_feature (71): n=t or c
gaaccaccatctgcacctgccattgtcgtatatggaggaggaggagagccgccaccctcgctgtcacgccnagaaattcacgaaccagaatttctaagctg

SEQ ID NO: 15077 - DNA, 101 bp, rice(Oryza sativa)
  misc_feature (71): n=a or g
cccttctgagacagcggaatgtcgagaacatgccttgaccaaaccaacaagtatcacctcattggcccttntgcccaccgtacccaccatcgcaacatatg

SEQ ID NO: 15078 - DNA, 101 bp, rice(Oryza sativa)
  misc_feature (71): n=a or g
atggaatcctgcttattaccacaccacagcaacacgaacaagagaaacacatatttctcaataaaagggangaagattggcatgtttctgaacaagaaaga

SEQ ID NO: 15079 - DNA, 101 bp, rice(Oryza sativa)
  misc_feature (71): n=t or g
gaaattagatgttgacatatacagttaattgtgcgccccgggcgactcggtggccaaatatatgcagcggnacctgcatatcacatatgcatctgcagcag

SEQ ID NO: 15080 - DNA, 101 bp, rice(Oryza sativa)
  misc_feature (71): n=a or g
tctttttcagttctatgcctccaccatcaagacaaactaaaatatcaccgacttcagataaaaaaaaaganaagaaaagatgtcaccgactttctttgtaa

SEQ ID NO: 15081 - DNA, 101 bp, rice(Oryza sativa)
  misc_feature (71): n=t or c
ggcggaggcaattccagttgttgagatctatactcagcttcccagttttgagagccgagccaagctacganaacaggcgaacggatcctccgtcaacagcg

SEQ ID NO: 15082 - DNA, 101 bp, rice(Oryza sativa)
  misc_feature (71): n=a or g
ccttcgatctgagcatgatgatgaaggagtcatcgacatcgggaagccggcaacaatccattcatccaacnccacctccaaggtcttcaattgctacctca

SEQ ID NO: 15083 - DNA, 101 bp, rice(Oryza sativa)
  misc_feature (71): n=a or g
tagctatggatcatcataattcatactagtgatcatggacgacagatgttaaattagctagctagttatcnaggaccttgaagtggtcgcggttcttgagg

SEQ ID NO: 15084 - DNA, 101 bp, rice(Oryza sativa)
  misc_feature (71): n=t or g
gtacaagaataatgtagaggataaattcgcgatacgtaaccacgaaatgcaattgaagtttctagcctggnagaaaacacagcagtttcggattaagatga

SEQ ID NO: 15085 - DNA, 101 bp, rice(Oryza sativa)
  misc_feature (71): n=a or g
tcacgcgcgcaaatggaatgaagaatgaggaatggagccgatccccccttagcaaccttcctcctgtgccnacggatggaagtggaattgcaggaggagga

SEQ ID NO: 15086 - DNA, 101 bp, rice(Oryza sativa)
  misc_feature (71): n=t or c
gatatatgcatcaattgcaaacagggattattggtctgttaaattattggtggtcataaaagaggggtgcncaatacgccacttgttactaggtgatatca

SEQ ID NO: 15087 - DNA, 101 bp, rice(Oryza sativa)
  misc_feature (71): n=t or c
atctgcaggaggaggagcaaggagaatcggagatgggcgaggcgtacaaaaccgtagcccttggagcggcnggtgtgcttgtcggcgatgacaacggcctc

SEQ ID NO: 15088 - DNA, 101 bp, rice(Oryza sativa)
  misc_feature (71): n=t or c
tacttagaacttcctatttcgatgtagtatcacgattttaacaacataccccctctgtcacgtaaagaatnaaatcttgggaacagattcatccccagaat

SEQ ID NO: 15089 - DNA, 101 bp, rice(Oryza sativa)
  misc_feature (71): n=a or c
cacgtagcaacgccgccacatccttcatggtcggtcgatcctcaggtcgtgggcttgcgcatagcaatgcnatgccgagagcttgcagcatctcttggacc

SEQ ID NO: 15090 - DNA, 101 bp, rice(Oryza sativa)
  misc_feature (71): n=a or g
attaagaaaaagtttgttgacacgagcctttataatgtgggagagtatgtaccctcactccatcgaaaatngagagactgggtaagtaggtccttgagtga

SEQ ID NO: 15091 - DNA, 101 bp, rice(Oryza sativa)
  misc_feature (71): n=t or c
aatttgggtctttagatctacattaccagtactaaccaatagagaaaatataggaaatggagatcgagagncagtcagtctaccgctgccattgcagtctg

SEQ ID NO: 15092 - DNA, 101 bp, rice(Oryza sativa)
  misc_feature (71): n=a or c
tgtatatttgagcaagtagagtgggggatgtcatgtgatagagtgcttttgtttacctcttcatgatgcgntacactacatcacacttgtaatatatcata

SEQ ID NO: 15093 - DNA, 101 bp, rice(Oryza sativa)
  misc_feature (71): n=a or g
gccataagagccctaaagacaaaagctacctccataggtaaatatgttggcctgctgtcgctgccagcctnaaggcacggccagttaatatatttcaaaga

SEQ ID NO: 15094 - DNA, 101 bp, rice(Oryza sativa)
  misc_feature (71): n=a or c
cgtcgaagggttccagtgactgagcctccggaggaaggtgccgacaaagatgacgaaggcgaggctaaggncgtgcgagagctggagcgcatgcatgtcaa

SEQ ID NO: 15095 - DNA, 101 bp, rice(Oryza sativa)
  misc_feature (71): n=t or g
cacacccgtctccacgggtgagtttcgttccatgtcgtcctgcgagacacgcgtttggagggcaatcgccngggcgatcaccggtgagtcgggctgctcac

SEQ ID NO: 15096 - DNA, 101 bp, rice(Oryza sativa)
  misc_feature (71): n=a or g
gtttcaaaataattagttcggtgaaaaaaaaaaagaaacggcctgagcatttatcggacaaatcgttaccntacaattaactcacgattccttcttttcaa

SEQ ID NO: 15097 - DNA, 101 bp, rice(Oryza sativa)
  misc_feature (71): n=a or c
gcaaaaatatgacctatttatacaagtgaacgaaatacagcttcgtcggaatattcataactatatatacngcatattcttctctctatctattattttca

SEQ ID NO: 15098 - DNA, 101 bp, rice(Oryza sativa)
  misc_feature (71): n=a or g
atggtggatagaatggaagaaacacttatttcaccaatcaccatccatgtatctcgcaagtctttttcctnatgaaattcctcaggtaaaaatcttctctt

SEQ ID NO: 15099 - DNA, 101 bp, rice(Oryza sativa)
  misc_feature (71): n=a or g
atgattaactggagattcatttctatgctgttgaccccaatctgcacttgagaatcccttgtgatcttcancagtgggttcttcagtgtgctttgaagaga

SEQ ID NO: 15100 - DNA, 101 bp, rice(Oryza sativa)
  misc_feature (71): n=a or c
ttttcagctggctaatggtgcaaaagaaaatcctatcctcggacaagcttcagtttaggggctgggataanagcccaatttgctcactctgtggtatagag

SEQ ID NO: 15101 - DNA, 101 bp, rice(Oryza sativa)
  misc_feature (71): n=a or g
atcaatggttccagaggggtccttgaacctgatttgacataaatacagggtctcgagcctccaccacttangaatgttttctggcacaaataaaagtttag

SEQ ID NO: 15102 - DNA, 101 bp, rice(Oryza sativa)
  misc_feature (71): n=t or c
caagaggagtgtgtaaagaagtggtcgggaaacatatgcccaaaaatatagaaaaaggttgataaaaatgnagaattgtcaaatacatgctatatattacc

SEQ ID NO: 15103 - DNA, 101 bp, rice(Oryza sativa)
  misc_feature (71): n=a or g
gcgattctaaataattcataagtccaattagctagagcttagctcgatctttcataaagacgcgcgtaggnaacgagagatcaagctacgtacaaccgtgt

SEQ ID NO: 15104 - DNA, 101 bp, rice(Oryza sativa)
  misc_feature (71): n=a or g
tattttgggcgcagctcggcactgcatttgcatcagcaaaatgcaggcagggtctcatcttttcacttatntttatacttaccagttaaaatttgaatttt

SEQ ID NO: 15105 - DNA, 101 bp, rice(Oryza sativa)
  misc_feature (71): n=a or c
ctctgcagaagcattttgctggtttggtggatgagacagcaaacaaacaggagttcctgatggcattccancgaagctcaagaaatgctactcttggccct

SEQ ID NO: 15106 - DNA, 101 bp, rice(Oryza sativa)
  misc_feature (71): n=a or g
tccatcacaaggtgccacctcatgttctttgctatctttttcaacctcatgaggggccgatttcttttgtngaggtgttggtggtttcagcggagcatcga

SEQ ID NO: 15107 - DNA, 101 bp, rice(Oryza sativa)
  misc_feature (71): n=a or g
gtagagtaatgggcaaagaaaagagtagtaagctactctaattgctagctaggcatgcagtggcgttggcnattgtgagagagatgatgagtttgtgagtt

SEQ ID NO: 15108 - DNA, 101 bp, rice(Oryza sativa)
  misc_feature (71): n=a or g
ttggaaagccgaagtcagtttcaccacttgaaacacagtgtggactgcttgtacagctgcagagggctgcnctaagtgagtcgaagcttgtattgcttgtg

SEQ ID NO: 15109 - DNA, 101 bp, rice(Oryza sativa)
  misc_feature (71): n=a or g
gagggagaaaaaggaagggaggtggcccgagtgaaacagtgtctctttttattttccatggatttgtttgnggggtatttggaagatttgatatttgaact

SEQ ID NO: 15110 - DNA, 101 bp, rice(Oryza sativa)
  misc_feature (71): n=t or c
caatgcagactataaaacccttgggacaaagagctagcatttgaatctatcaaaggtgagccaataagccnaatagaatgtcaagggtcaccgagcagtag

SEQ ID NO: 15111 - DNA, 101 bp, rice(Oryza sativa)
  misc_feature (71): n=t or g
aatgatgaacttatcatagttctagtaacagaaattgtataagatgggctgctgatccacttttcacgaanttatggtgaaacactttttgtacaaattgt

SEQ ID NO: 15112 - DNA, 101 bp, rice(Oryza sativa)
  misc_feature (71): n=t or g
atctccctatctccctcccgtttcgctggctcgacgtggcaacagtgagggctcgacgtggtgcagcgatngcgggggtacgatgcggagacggcggtgat

SEQ ID NO: 15113 - DNA, 101 bp, rice(Oryza sativa)
  misc_feature (71): n=a or g
aaagaaattaataacgaataaatttggccacctcatctagctaggagggactaaatttcagaattattaanatacaaagaatacaattgagattgcaaaca

SEQ ID NO: 15114 - DNA, 101 bp, rice(Oryza sativa)
  misc_feature (71): n=a or g
aaagaggctactgaagaatataagaaacgcaagtctacccatcaagggaattcttcccgaggtgcaccccnccctcgctttggtcagcctaagcagtatca

SEQ ID NO: 15115 - DNA, 101 bp, rice(Oryza sativa)
  misc_feature (71): n=t or c
gattctgaatggagcaactaatgctgaatctgctccgagcacaaattctgcaagctcaattgatgattccngtgaagggtaaggttggtttctggaaagaa

SEQ ID NO: 15116 - DNA, 101 bp, rice(Oryza sativa)
  misc_feature (71): n=t or c
ctcgacaaatttccagcccaaatacatgatgctcttgcttgtatgtatgcatgttttagcgtgcagcaatnctgggcaggcaagtgacggcagggagtgtt

SEQ ID NO: 15117 - DNA, 101 bp, rice(Oryza sativa)
  misc_feature (71): n=t or c
ctggagggtgtgtgacatccacttcatctcactacaatcaccggcaacccacgttgtggcataaaattggnggatgagctcctcatcatagtcttgtgcca

SEQ ID NO: 15118 - DNA, 101 bp, rice(Oryza sativa)
  misc_feature (71): n=t or c
agaccaaagccagacaaaaacgggttcaaatccttccgggacatccctcaaacacgcttccactgaagtanttgaaaagttagtactgataactactcctt

SEQ ID NO: 15119 - DNA, 101 bp, rice(Oryza sativa)
  misc_feature (71): n=a or c
aatacggaatgctgcataagagtacaaccataaaagcagtgtccaaaccatacatgttgtgtaaatgctanatcaatattaaaccgtggaaaggaaagaaa

SEQ ID NO: 15120 - DNA, 101 bp, rice(Oryza sativa)
  misc_feature (71): n=t or g
gacaactttgccacaaaggttggggtggtattagctgaagatatcactgacagtcaagaggaagatgttanaagaagtaagagactgagggacaaggagga

SEQ ID NO: 15121 - DNA, 101 bp, rice(Oryza sativa)
  misc_feature (71): n=t or g
taaagtcattatggtattcagcttaggcctttgggttaaattggtctgtgcaagaacatcatcaggagttnaacttatccatgcaagtgcatgagtaagaa

SEQ ID NO: 15122 - DNA, 101 bp, rice(Oryza sativa)
  misc_feature (71): n=t or c
cggtcaggggagggcgggaacttgtgcccaagaatgtcatagaatggcttcgcagcagcgcggagcgccgnggactcctcctggtacatgctgaccttctc

SEQ ID NO: 15123 - DNA, 101 bp, rice(Oryza sativa)
  misc_feature (71): n=t or c
aaacaagaactaaagggaaaaaacaaaaatccagagatcctgcatacagcaatgttgcaccatctgcatgngccacccccttacaagatgatctcaagcca

SEQ ID NO: 15124 - DNA, 101 bp, rice(Oryza sativa)
  misc_feature (71): n=a or g
gatgtgatatatcttctgctttatgtcgacgacattgttcttactgcctcgtccacctcgctccggcgctngaccatctcatctatgcagacagagttctc

SEQ ID NO: 15125 - DNA, 101 bp, rice(Oryza sativa)
  misc_feature (71): n=a or g
gaggttgaagctaccttggccaaacaagaaaaccacagctgcccccagaagacgaaaaaccgaataccaangaaagaacaccgttcttctgtgttggtcac

SEQ ID NO: 15126 - DNA, 101 bp, rice(Oryza sativa)
  misc_feature (71): n=t or c
aagattcttccggggaatattagagttttatgggatcagattgcaccatctaaaccccaactctatagttnacattgccaacttcattcatgcttgcgagg

SEQ ID NO: 15127 - DNA, 101 bp, rice(Oryza sativa)
  misc_feature (71): n=a or c
gtcttacataacatctgccaggtaaaatgtctgaagaaggaacttgttaatgttcgcaatggtaggaaagnggtatcttctatgctgagagttgctatgca

SEQ ID NO: 15128 - DNA, 101 bp, rice(Oryza sativa)
  misc_feature (71): n=t or c
aattatttagttttaaggctagctcactgactagttcttcagaaaatgcgggtccaaaacccttttgtttnccaagtttgatgttaggatcaattgttggg

SEQ ID NO: 15129 - DNA, 101 bp, rice(Oryza sativa)
  misc_feature (71): n=a or g
ctttataaaaagctgcttttaaataatcatattactatccaccattcctaacccccctccacagaacagtncctcatgtactaaatagaacgtactccctc

SEQ ID NO: 15130 - DNA, 101 bp, rice(Oryza sativa)
  misc_feature (71): n=a or g
tgtcacatgatcaaggatcggacgtttgctcatacccaagcatatgacccgaaccttattcagaaaatagntatggatgttgattttcacaatgtgtggta

SEQ ID NO: 15131 - DNA, 101 bp, rice(Oryza sativa)
  misc_feature (71): n=t or c
aaagatgttactcctactaattagtacgtgcgctgcacatcatttcggctagtcaataatcccggcgtatntgacgccgttgacttttttaaatatgtttg

SEQ ID NO: 15132 - DNA, 101 bp, rice(Oryza sativa)
  misc_feature (71): n=t or c
gtataaaattcctgtcaactttaatgtttctacaactgtgttgcatctgactggaaatgcagcgcaatggnggtggaagatatgcacgattgggctcattt

SEQ ID NO: 15133 - DNA, 101 bp, rice(Oryza sativa)
  misc_feature (71): n=a or c
ttcacagccgccgccaaggctctaggttttgtcgagctccttcctttgccataggctcagctcgtcaaatntgtcttagagtcgcgaagatcctcttgaaa

SEQ ID NO: 15134 - DNA, 101 bp, rice(Oryza sativa)
  misc_feature (71): n=t or c
acatcgactctggctacctatcatcaacgaaaattttaccagtcatttctaccatgctcacggtactcccnatccggcagaaacaaaaatcagggatgtgt

SEQ ID NO: 15135 - DNA, 101 bp, rice(Oryza sativa)
  misc_feature (71): n=t or c
ccatgctgtcgcataaaactgtctgcgccaccaccacgtcttcggagtgtgcgatatcaagcaaaataatncatatgcacatgaggagtgcaagtgcccca

SEQ ID NO: 15136 - DNA, 101 bp, rice(Oryza sativa)
  misc_feature (71): n=a or g
agaagcattgggtcaaggatggagacagaaacacctcattttttcatcaagccgccatcaagagaagaagnaaaaatagaatcacttctatcatgtctaat

SEQ ID NO: 15137 - DNA, 101 bp, rice(Oryza sativa)
  misc_feature (71): n=a or g
gccaaagggtgaaagtaggaagatttttgactgtggatgttgtggcgcgcgctagctgcttgagccacgcncgccgagcttcttgacctccaccttgagcg

SEQ ID NO: 15138 - DNA, 101 bp, rice(Oryza sativa)
  misc_feature (71): n=t or c
taatgctattaatctgaatgggctccttcccgattaatagttttgtctatattcatagtatttagaatgcnccatccaattaaaagttgttatattttagg

SEQ ID NO: 15139 - DNA, 101 bp, rice(Oryza sativa)
  misc_feature (71): n=t or c
cagtactacagtgctcgggtgtattttttgcaaaaaaagcccttagatttgtccataattcggagtaggtncctcatgaaagtcgctctgaggcgattttt

SEQ ID NO: 15140 - DNA, 101 bp, rice(Oryza sativa)
  misc_feature (71): n=t or c
tcaaagatgtatttttcacctactttcaggatagccatccacaacctctgaaggcaagctcaaagtctgtncatgaatttcataatataacattgtttcta

SEQ ID NO: 15141 - DNA, 101 bp, rice(Oryza sativa)
  misc_feature (71): n=t or c
tgcggaagtgagacgaactgcacgatgttttgaaccactgaggcttcgactctgaactttgaggcaatctngtccacgctcattgggccagggtggttact

SEQ ID NO: 15142 - DNA, 101 bp, rice(Oryza sativa)
  misc_feature (71): n=a or g
tgctgaggaaacgagtttccaacacaaggaaacgaacgcactcgagtctactagtactactcgttagagtngataatcaggggtgtagtcttggccgaagt

SEQ ID NO: 15143 - DNA, 101 bp, rice(Oryza sativa)
  misc_feature (71): n=t or c
tgctcaagctccgccatcggatgcgctacccatgccccaagccatcgccgaatttgctgcctgcctccagngaccgagctccaccgcctgtggcaacccca

SEQ ID NO: 15144 - DNA, 101 bp, rice(Oryza sativa)
  misc_feature (71): n=t or c
atatgggccatttaaataagatttttgacttttgtccaaaataggctcttttgaaatggtatggatgcaanctttttgaaaaattcatgtttggaagcaag

SEQ ID NO: 15145 - DNA, 101 bp, rice(Oryza sativa)
  misc_feature (71): n=t or c
tcaagatgtagttgtttgtgcactgtttgcaggactggttgcagtataatcctgttatcctctgtatgcantgttatttgtatgcctgtgcaaatattgat

SEQ ID NO: 15146 - DNA, 101 bp, rice(Oryza sativa)
  misc_feature (71): n=a or g
attgaaatgccatctaatatacatttggattccagattgttgtcggaagcttcctaccaagctatcaaatngaacagaagaataagaagcctagggtggaa

SEQ ID NO: 15147 - DNA, 101 bp, rice(Oryza sativa)
  misc_feature (71): n=t or g
accaaagttaccagaacatgtgaaagtgttaaaaggaatgcaccgatttgttctgcaattgtttcctgagnagaaagcttaaatccatataatttttgaaa

SEQ ID NO: 15148 - DNA, 101 bp, rice(Oryza sativa)
  misc_feature (71): n=t or g
cctcctcttcttcctcctctccccatctcaccatcatcacctctctcttctttcctccctcctctcaccgncagagatgcggacagcgtggaggcgcagcc

SEQ ID NO: 15149 - DNA, 101 bp, rice(Oryza sativa)
  misc_feature (71): n=a or c
gagagaatattttcttttctggactgccccatccaccatatctctcaaccatacacaacaaaaaaaatcgngcaacatcttccatccagataggggtgaaa

SEQ ID NO: 15150 - DNA, 101 bp, rice(Oryza sativa)
  misc_feature (71): n=a or c
actgcgtttaaaatgggatggagttagcactttgctaattagttgctccttacctagcatagttattggtntttatctctttcatcaaaagccgtaagtag

SEQ ID NO: 15151 - DNA, 101 bp, rice(Oryza sativa)
  misc_feature (71): n=a or g
atgcagcaattcctttgtttgcttcatttgtgtagctaagctagagaactgtgtgaagtttcactgggaanttgatacctcttctgctgcaactagcaggc

SEQ ID NO: 15152 - DNA, 101 bp, rice(Oryza sativa)
  misc_feature (71): n=t or c
tctaatctttccttgagtttaatcacaaatccaggagaaactgttgaagataggatgatggatgttccagnggccattactgaaaagcaaaggtattcaca

SEQ ID NO: 15153 - DNA, 101 bp, rice(Oryza sativa)
  misc_feature (71): n=t or g
tgcataggttctcgtgttgaagttgtgtcttgcatgagacccaggccctgtttgatttcatgggctaatgnttagccctcaccttttagcctcaaattagc

SEQ ID NO: 15154 - DNA, 101 bp, rice(Oryza sativa)
  misc_feature (71): n=a or g
gttccatatagtgaatagcgatgcactagcagtggctgagctagcgtcaccatcgttcctaggcaactaantagctctttactaatgaatatgaatttgcc

SEQ ID NO: 15155 - DNA, 101 bp, rice(Oryza sativa)
  misc_feature (71): n=a or g
ctgacaaattcagatgctgtattgcagttgctattttactgccttcagttggatccccagcaacaattgcntgatgctgctgagagaagtttaagtgctca

SEQ ID NO: 15156 - DNA, 101 bp, rice(Oryza sativa)
  misc_feature (71): n=t or c
aacgactatgtggaatggctatttccttgtttcatgtgagcacgttcccgaattgctaactaatgtatttnatgtaaaaaaattttataggtaagtttctt

SEQ ID NO: 15157 - DNA, 101 bp, rice(Oryza sativa)
  misc_feature (71): n=a or c
tgcggcgagctgaacctcacaggccgctccttgatgacgtcaaccgtcgtcgtggtcagcgcggccacagnacggtcgtcgtcgctcctgggcctgggcgg

SEQ ID NO: 15158 - DNA, 101 bp, rice(Oryza sativa)
  misc_feature (71): n=t or c
ccatcaggcttcttatcagtcttttcttcaataagctttgggaactcgactttattcttttgaatcagctncccttgtcgagtcatactgtaacaaccaag

SEQ ID NO: 15159 - DNA, 101 bp, rice(Oryza sativa)
  misc_feature (71): n=a or c
aggatttattaaggccgattgcagacaaataattgtttcggcaccgactgcgcatgagctgctgagaaagntggaggtaaactgacctcatttatctgtgg

SEQ ID NO: 15160 - DNA, 101 bp, rice(Oryza sativa)
  misc_feature (71): n=a or g
ttgggacggaggaagtacatggcaagatacacttgataatgcagtagtaagggtgtgtggttgcaatcctntggacccgtgtttaatccctagcacgctca

SEQ ID NO: 15161 - DNA, 101 bp, rice(Oryza sativa)
  misc_feature (71): n=t or g
tctgtccctccagagtgaatacggcagggaattccctctttttgaggtagatgcgactatggtagagcctntattccagaggctctattcatttatttttg

SEQ ID NO: 15162 - DNA, 101 bp, rice(Oryza sativa)
  misc_feature (71): n=a or g
cagcaatcatgtaaccgaaattaaggcaggcatggagacactgctcttaccggggaacgcggggaccgacncggcgttgatggagctcccggcgctgcacg

SEQ ID NO: 15163 - DNA, 101 bp, rice(Oryza sativa)
  misc_feature (71): n=t or c
aagccattaagaacaattttcttacaaaaattcttaaggacaattaggacaaggatccggcctaaattgcnctgatcatttttaaatacgtaaaaatctac

SEQ ID NO: 15164 - DNA, 101 bp, rice(Oryza sativa)
  misc_feature (71): n=a or g
gcatgttgcaaagactaacatgcttgcatcatctaatattctacttctaatttgctgcagcgagactagcnatgcattcagcaagcaaggatgcttcacat

SEQ ID NO: 15165 - DNA, 101 bp, rice(Oryza sativa)
  misc_feature (71): n=a or g
tttttgtagctagtgttctagaaatttttcttcgccggagattgtgtgtatcgtggaggagatggggtcgnggacagggaatcctgcgagctgctgtaatg

SEQ ID NO: 15166 - DNA, 101 bp, rice(Oryza sativa)
  misc_feature (71): n=t or c
atcaaaccataacgtttcgttgttggagtaacgagtgcatccatcagttacatctttagttaaaacataangtttgggaaatagagcagccagcccttgcc

SEQ ID NO: 15167 - DNA, 101 bp, rice(Oryza sativa)
  misc_feature (71): n=a or g
ggttgggaggcggcaatggctcctctgaagccgcgggttggagtagggcagtgggaccatcggtggaggcnggggcactagatctggagtgattaagaggc

SEQ ID NO: 15168 - DNA, 101 bp, rice(Oryza sativa)
  misc_feature (71): n=t or c
atctgtacatggcaattacttgctttgctttgttcaacgttagacgtttttagcctcgagaatggtcgtcnggtctctgtctgccgattttgcattcgacg

SEQ ID NO: 15169 - DNA, 101 bp, rice(Oryza sativa)
  misc_feature (71): n=t or c
gagtgatgttgatcgcatatgcgaatttataccagaggggctgatatctttgtatgtgtttagttccttcnaaagttggaaggttaggttgaaattggtac

SEQ ID NO: 15170 - DNA, 101 bp, rice(Oryza sativa)
  misc_feature (71): n=a or g
attgttaaacagagcaagcacttttttactcgtgtattcatgcattggggtgatggttctcctgcaacgcntggatccaacggcgaacaaaaccactgacg

SEQ ID NO: 15171 - DNA, 101 bp, rice(Oryza sativa)
  misc_feature (71): n=a or c
aacatttccactttgatcgagcacctggtatatatcgaaatcacagccggtgatgtttagtctagcatatncaagggtgaaagatttcccaggagcatccc

SEQ ID NO: 15172 - DNA, 101 bp, rice(Oryza sativa)
  misc_feature (71): n=a or c
gctctgctttcacagattccatgtcctcggtcctccagtaattaaccagataagtgaaggccttgttcaanatatatgagataactggtgttgcaaccgct

SEQ ID NO: 15173 - DNA, 101 bp, rice(Oryza sativa)
  misc_feature (71): n=t or c
atttgctaaaggaaatcagacaggttcggaaagacaaacgagtttccatttttaaaaagacaatatactcnctccgtttcaaaatatttgacaccgttgac

SEQ ID NO: 15174 - DNA, 101 bp, rice(Oryza sativa)
  misc_feature (71): n=t or c
gtgtgtatttgtgtgtctttgtgtgtgtgatcgatgacaaaatgtagtactgaccaggatttggtcctcgncggcaccggcgatgtcagctgcgatgacga

SEQ ID NO: 15175 - DNA, 101 bp, rice(Oryza sativa)
  misc_feature (71): n=a or c
gcagaggcattgcgcaccattaatcagttcatatacgagacgatcgtgaagcggcgggcaaagaaagcaancgaagggatcgaggactcggaggatctgct

SEQ ID NO: 15176 - DNA, 101 bp, rice(Oryza sativa)
  misc_feature (71): n=a or g
atagttttcctacctatgtgatcttattaatttgttatcataaaccgtacctggttttgaatcaagctacntgtactaatattgtagttttctgcatcatg

SEQ ID NO: 15177 - DNA, 101 bp, rice(Oryza sativa)
  misc_feature (71): n=a or g
cacaagagttataaacgtctgaccatcaccattggatatagactggacaatagaggagaccctagtcaccngtcagggtcactcccacggaccaactggtc

SEQ ID NO: 15178 - DNA, 101 bp, rice(Oryza sativa)
  misc_feature (71): n=a or c
acgtggtctacttttatccactaagatagtcttatatgtcatcctcaagtgtcgattaaaataaattggtnaaaaaaaagagtcaaattatcaaaattctc

SEQ ID NO: 15179 - DNA, 101 bp, rice(Oryza sativa)
  misc_feature (71): n=t or c
accacaactgctattgccactgccattggatgtttggattgggctaaaatcttcccctgcctcgccctcgncctcgtcctcggccccttcctctcccccgt

SEQ ID NO: 15180 - DNA, 101 bp, rice(Oryza sativa)
  misc_feature (71): n=t or c
ttccaagaacaatatatcattcatattgtcatttgcagaatggagatcattagcccacctcgcaaacacangaaagacctacatagagagtgtaaagagag

SEQ ID NO: 15181 - DNA, 101 bp, rice(Oryza sativa)
  misc_feature (71): n=t or g
gctttatggcagctccaaatttcgccagaaaaacctaaaatggccgtcaaaaaaatagttttcgtagtagngaataatgaatggaagataacagaagtact

SEQ ID NO: 15182 - DNA, 101 bp, rice(Oryza sativa)
  misc_feature (71): n=t or c
gtgggagggaggcgctgatggaggggatagagaaaaggcaaagaaaatcgggaggggaacaagcggtggtngatgggtgactcggtgagaggataaggtag

SEQ ID NO: 15183 - DNA, 101 bp, rice(Oryza sativa)
  misc_feature (71): n=a or g
aggtgagcactcaacaggaaccatcaggcaacaaccatccttcagctatgcaagtatctatcattccaccnctatctatcagaatttccagtttgctcatt

SEQ ID NO: 15184 - DNA, 101 bp, rice(Oryza sativa)
  misc_feature (71): n=t or c
caccaccaacacataagatagctcaatggccggacaaggaacatgaacgttccaacaaaagcaaacgaggntcccgcgcaggcgatcacatcacatcaggc

SEQ ID NO: 15185 - DNA, 101 bp, rice(Oryza sativa)
  misc_feature (71): n=t or c
cagccatgttataaccaatttgaccatgcatggttagtaggttcctcaaactgtttttaggtgattattancaccccacaagtttgacggttacctgcgag

SEQ ID NO: 15186 - DNA, 101 bp, rice(Oryza sativa)
  misc_feature (71): n=t or c
caaggcggcattgctacctcctgcctggctacctgtagcctgcatcaagtcatcatctctcctctacagantgtctgacacttcgactccagcgctcctga

SEQ ID NO: 15187 - DNA, 101 bp, rice(Oryza sativa)
  misc_feature (71): n=a or c
tttcttgattcggtggtggggtgggatcgatcgccatgggagagcagcggcactggatttatttgtgaggntgattgttgaattggtgagttgttcgttct

SEQ ID NO: 15188 - DNA, 101 bp, rice(Oryza sativa)
  misc_feature (71): n=a or c
agagagagagctagggttcggaggcggcggccatgagaggggaggagggagaggtgtgatgagtggaacancacgggacgagagctctctctctctctctg

SEQ ID NO: 15189 - DNA, 101 bp, rice(Oryza sativa)
  misc_feature (71): n=t or c
cttaagtgcctaagtgcgaaaatctgatttttgcatacctttgggcgtttgcaggctacctgtccgcatgnaaaaatcgatttttagtagtgaattatctc

SEQ ID NO: 15190 - DNA, 101 bp, rice(Oryza sativa)
  misc_feature (71): n=t or c
tgatcaccggccgtgctatatatcttcgttttgtggccaaatgtcgtcaaaacattgctaccatgcttgcntgcatcgttcctgtccatttcattcttttc

SEQ ID NO: 15191 - DNA, 101 bp, rice(Oryza sativa)
  misc_feature (71): n=t or g
gaccaccccacccccaccaccacagccgcctctcatatatcaagcggccgcccacgcgcccctcgcatctntcgcgaaggcgattcaggcgagaagagaga

SEQ ID NO: 15192 - DNA, 101 bp, rice(Oryza sativa)
  misc_feature (71): n=t or c
tgcagcaatctgctccgcgtgtcactcgcatcactcggttggatggcaagctaccaatgcttctttttaancttttcttttttttttccttatctaaactc

SEQ ID NO: 15193 - DNA, 101 bp, rice(Oryza sativa)
  misc_feature (71): n=a or g
gcatctaccccctctgccgccccgttgccgcgcttgtccaggaggctcaccaaagttattggaagggatcntcgaggcttggacagcagcggcttcggttg

SEQ ID NO: 15194 - DNA, 101 bp, rice(Oryza sativa)
  misc_feature (71): n=t or c
ataccaccgacgtccatgccgccagcatgccaaatggcgccaaaccgtgcttcggcccctctcactatctngcacgcaccgctgtgtctgaacgagcgata

SEQ ID NO: 15195 - DNA, 101 bp, rice(Oryza sativa)
  misc_feature (71): n=t or c
gcgtgtcgctgtcattgctcaccgtgtggatgttgttcctagcccacaaccttgccaagtctgtcgctggngtcgaggcgaccatcccgaggttcctcgac

SEQ ID NO: 15196 - DNA, 101 bp, rice(Oryza sativa)
  misc_feature (71): n=a or g
gttgtcagtaggaaatcacgtaatatctcttagaaagcctgcagagacaccttagtgaaaaaaaaagaaanttcctttagcggatttgagatatttttata

SEQ ID NO: 15197 - DNA, 101 bp, rice(Oryza sativa)
  misc_feature (71): n=a or g
ccacaagtccctgcagcaaaacaaacagcacctgtggcttcagcagttcaaactgtaccacttctttcccnttcgatgagtgcagttggacgtctaggcaa

SEQ ID NO: 15198 - DNA, 101 bp, rice(Oryza sativa)
  misc_feature (71): n=a or g
cgcccatcgaccccttcatttatcaccatatgccatgctcatgcacgcctcgtggagtgaagatgacgacngtactctccaagagcccagatagggaataa

SEQ ID NO: 15199 - DNA, 101 bp, rice(Oryza sativa)
  misc_feature (71): n=a or g
gtgcagatcatcaaaccagaagtgcaccatcttggtcccgtgttgaagctgcaatgctccaaggtggagancagtggattcatctccagcagcaccggcac

SEQ ID NO: 15200 - DNA, 101 bp, rice(Oryza sativa)
  misc_feature (71): n=t or c
tccgctccaagatacagttactatgatacagtacatcgtatgcccgactttgcttctgctgtccgcaacancaacagttagggtttgtctagttcccaaac

SEQ ID NO: 15201 - DNA, 101 bp, rice(Oryza sativa)
  misc_feature (71): n=t or c
acacgagctacatcacgaattttatctattgttaatgaaggaagaacccctttcgaactccagaatgcaangtctgcatcagaaatatttaccctgttgaa

SEQ ID NO: 15202 - DNA, 101 bp, rice(Oryza sativa)
  misc_feature (71): n=t or c
caacaatccatcaaactgttgagaagaaatccatgctcaagtagtttccttggcgcgagcatgtgtataangaagattgatgcaaagctccttgatttatg

SEQ ID NO: 15203 - DNA, 101 bp, rice(Oryza sativa)
  misc_feature (71): n=a or g
gccaaggtgccatttgcagattttggctcagggggctctaggtatcgattgctctcgccggttgaaaatangattgtgctgatgcgaactggcctatgcgg

SEQ ID NO: 15204 - DNA, 101 bp, rice(Oryza sativa)
  misc_feature (71): n=t or c
accggaactatacgtgcacgagagggatgtcatttgcaagggttacatcgactacttcgagcaacggcagnaggtgcaggagcgcttccgtgcagtcgcta

SEQ ID NO: 15205 - DNA, 101 bp, rice(Oryza sativa)
  misc_feature (71): n=t or c
aatatatattcaaaataagaatacttaagggtaggtgaactcattgaatatttaaaaataattggtgcaanataaaatcatgaggaaattcatggaggtac

SEQ ID NO: 15206 - DNA, 101 bp, rice(Oryza sativa)
  misc_feature (71): n=t or c
aagttagcgtaccctcctactgttcctatcgacaaagccaaagcaactttgcctccggcgccatttccacnacagcatccaggtcgagcagatccggcaga

SEQ ID NO: 15207 - DNA, 101 bp, rice(Oryza sativa)
  misc_feature (71): n=a or g
gtttgacgtagcaagtttcagctcttcataggtaaacagcctacacgttgaagagtacttctcttgaagcnattccacttcatttggaggccatgatatat

SEQ ID NO: 15208 - DNA, 101 bp, rice(Oryza sativa)
  misc_feature (71): n=t or c
ctaatgcaatggttggagcgaaaaagaaccctctagcttcaatgcctacatttttcggtgacaaaaaagtnatgaaaatatcgtgtatataatagttaatt

SEQ ID NO: 15209 - DNA, 101 bp, rice(Oryza sativa)
  misc_feature (71): n=t or c
acggtgtcactttgacggcgccagccactctggtgaaaaaaaaaaaagatcattcttggattaagtttttncaagagtttatttgtaaaataagtttttaa

SEQ ID NO: 15210 - DNA, 101 bp, rice(Oryza sativa)
  misc_feature (71): n=a or g
attcaatttgttagcctcacctgaatgccttgtgagaactcaacttcttgttttgctgtcagaagcctccngccggtcatcttgtagaagcagccgagagg

SEQ ID NO: 15211 - DNA, 101 bp, rice(Oryza sativa)
  misc_feature (71): n=a or c
cggaggagcacgagcggagtgcgacgatgtgagtgaaaggggacagtgcgagcgagtgaacggggtgaagnggcgcgcctcacgccgtgagcccgttccag

SEQ ID NO: 15212 - DNA, 101 bp, rice(Oryza sativa)
  misc_feature (71): n=a or g
tcccaaaattagcgtcagatagctgtcggaaaagaattgatattagcttcagaccatctgtggcgagaagnttagtgtcagatggtccgttggtagttcat

SEQ ID NO: 15213 - DNA, 101 bp, rice(Oryza sativa)
  misc_feature (71): n=t or c
actgccatgtagatatggggtatccataatctccacactggcattgatatggtaggaggttccgttgatcnagagggtgactgccagtatctctgcactgc

SEQ ID NO: 15214 - DNA, 101 bp, rice(Oryza sativa)
  misc_feature (71): n=t or c
tagacactcctagctaggttcaccacttcaatgaacatctttgacagagagagagaggccgtgtttagttnacccccaacttttaactttccatcacatca

SEQ ID NO: 15215 - DNA, 101 bp, rice(Oryza sativa)
  misc_feature (71): n=t or c
tgtttatcatttcattcaaaaagaagattccggtgagactcttgaagtgttctccaaagaaccaccatcanaacctcctatcgagcctaaaccttgtccct

SEQ ID NO: 15216 - DNA, 101 bp, rice(Oryza sativa)
  misc_feature (71): n=t or c
ctacccatagtcgacaccacctcttcatcgcagctcctagccggtgccaccacgtcgccatcatcctcggntgtagacaccttgtcgctgccctcaatcat

SEQ ID NO: 15217 - DNA, 101 bp, rice(Oryza sativa)
  misc_feature (71): n=a or c
tgaccttcattggaactcttttcttcttcattgtactattgcttccaccgtcatcatccctgtctccacanttataccgagaagccttgcatactggacat

SEQ ID NO: 15218 - DNA, 101 bp, rice(Oryza sativa)
  misc_feature (71): n=a or g
gctattgacacacatcaaatcactcaacaaagttctcaaaaaaaaaatcactcaacaagagagagagaganaaataccaatagtgcattcatatttccata

SEQ ID NO: 15219 - DNA, 101 bp, rice(Oryza sativa)
  misc_feature (71): n=t or c
ttgagaagatgagatgcaggactgcttgcagttgcttcctttctgatcagttcctaaacagtaagcatcgnatgcagggagggaggaaatgtgtgtgagtg

SEQ ID NO: 15220 - DNA, 101 bp, rice(Oryza sativa)
  misc_feature (71): n=t or c
gcgcctgttatgttctttcttgactatttaacggatggtcagcttggctacggggaagagaattctctttncccatgtttggttgagcgttttcaagattt

SEQ ID NO: 15221 - DNA, 101 bp, rice(Oryza sativa)
  misc_feature (71): n=t or g
ttcagatgatgagttcatagctttaggagttgcaaacatgtttgtttttacctgccactctccattctctnttgacaacgcccagtgaagtataagtggct

SEQ ID NO: 15222 - DNA, 101 bp, rice(Oryza sativa)
  misc_feature (71): n=t or c
ttaacgaaaacaatttctatcattttgaatcttgctccccgccgagagattcagctttatgattcatttgnatacggagtaatagaagaaacaatattcaa

SEQ ID NO: 15223 - DNA, 101 bp, rice(Oryza sativa)
  misc_feature (71): n=t or c
tccatgccggatagcggcgatgcgcagcagtaggccgacctaagctttgggttctcgtcgacgtcatccgngctcacgtcgctgcacgctgcctccttggc

SEQ ID NO: 15224 - DNA, 101 bp, rice(Oryza sativa)
  misc_feature (71): n=a or g
tcaagataacaaaactaaagattttttatgctactgccacacgcgcgtatatggtgtgcatttattctaancatattattagtcgatacccatgcttttta

SEQ ID NO: 15225 - DNA, 101 bp, rice(Oryza sativa)
  misc_feature (71): n=t or c
ataccgtttctcagcttctcccctcctctaccccacgcacggttctcaatttgctaaagacagttgatttncagcgctttgatgtgaaaattaatttttaa

SEQ ID NO: 15226 - DNA, 101 bp, rice(Oryza sativa)
  misc_feature (71): n=t or c
gtcatgcaaggcgttgaaggccgccacgatgttgtccttgatgatgtcccaacatgacttgaagtatttcncagtgaagccatctgggcctggtgccttgt

SEQ ID NO: 15227 - DNA, 101 bp, rice(Oryza sativa)
  misc_feature (71): n=a or g
ttctctcttgtcatgccaagtgtccaatttctgacgggttccacggtgaaaacggtcataaccgtcattgnggagcggttagcaaccgaactggacttggg

SEQ ID NO: 15228 - DNA, 101 bp, rice(Oryza sativa)
  misc_feature (71): n=a or c
catagagttcatacagttcagaatcgcaggctcaatcttcatttacttcttgtgctcattgcaggactagnttgatttacagggacactatccaagtacat

SEQ ID NO: 15229 - DNA, 101 bp, rice(Oryza sativa)
  misc_feature (71): n=t or c
tcgccagatcagagctagtggtcgacggcagtatacaagcacagacaggggcggatccaacgtgatacccnctaagcccccccttcaattttttcatcaca

SEQ ID NO: 15230 - DNA, 101 bp, rice(Oryza sativa)
  misc_feature (71): n=t or c
aattatatgctaataatgtatctcgttttacgtgcaaataataagccaaaatcaaacagaaagaacacgcncttactagttttcctccaaaattatatcga

SEQ ID NO: 15231 - DNA, 101 bp, rice(Oryza sativa)
  misc_feature (71): n=a or g
gtgaccccttctatagatcctaggacaacgaatctaggataggaggggtcacagattgagttttttttagnacggagggagtaagtaactagtctcgtttg

SEQ ID NO: 15232 - DNA, 101 bp, rice(Oryza sativa)
  misc_feature (71): n=a or g
acttcttttgcaacaccaccaaggtttaagcttgttgtcggaaaggattaggccaatcttatcgacttagnccgagtttgaattagctatagtgctgtagc

SEQ ID NO: 15233 - DNA, 101 bp, rice(Oryza sativa)
  misc_feature (71): n=t or c
ctttactggcaggcttgcatgtaggagtagacagtagatgatacagcaagatatatgcccagatggatggngcatgaaatttgtgaggctcagaccgactg

SEQ ID NO: 15234 - DNA, 101 bp, rice(Oryza sativa)
  misc_feature (71): n=a or g
aatgcctttcgcagcaaggtaaatgagttggaattgaaagaagtgtatttgttcgggaggcggtatacctngagcagcgagcaggcggttcccactttggt

SEQ ID NO: 15235 - DNA, 101 bp, rice(Oryza sativa)
  misc_feature (71): n=a or g
tatttagaccattttgccctcctttttcatctccctgtcttctttcccctctctcatgtcctaatcagggntgggcagaaaaagaccaaaccgaaaagact

SEQ ID NO: 15236 - DNA, 101 bp, rice(Oryza sativa)
  misc_feature (71): n=t or g
aaagggaacgggtctgaatttgatacatctgatttttggatggagctttgcatgcaatgtatggatgagtnaatatttttgttggcaccagaatcaaaatg

SEQ ID NO: 15237 - DNA, 101 bp, rice(Oryza sativa)
  misc_feature (71): n=t or c
gctaagtagctaaaagacagtacaattatggtacctgaaattacagcggtgtgcttccaaccacatgatanctacataggatatatggtgagtgtccacca

SEQ ID NO: 15238 - DNA, 101 bp, rice(Oryza sativa)
  misc_feature (71): n=a or c
gttgtcagttatgaaagcccaaaaccaactgcagggatacatcgttttgtctttatattatttcgccaatntgtacaacagactatttatgcaccaggatg

SEQ ID NO: 15239 - DNA, 101 bp, rice(Oryza sativa)
  misc_feature (71): n=t or c
agagtttggttccaactacataaactcaggcaagtctctgttttgatcatgttgatagatgatactatttnaacttaaaaacctagtattgcatcgaacta

SEQ ID NO: 15240 - DNA, 101 bp, rice(Oryza sativa)
  misc_feature (71): n=t or c
aagtaactggagaaatcaccgctatgttttctctttcggatcaaccacttgcaactagggttatggttcangtattctttttttatttcaaacaccatggt

SEQ ID NO: 15241 - DNA, 101 bp, rice(Oryza sativa)
  misc_feature (71): n=t or c
agaggaatgggaatggttgcaagaaaatggatcagtaaaagacaggagggcagggcagtgaggcagttagnggtgagtggaagcagcacgggagcggcggc

SEQ ID NO: 15242 - DNA, 101 bp, rice(Oryza sativa)
  misc_feature (71): n=t or g
aggtaaggtagtatattttaaggacgggagaaaacctcacatttttgttgcatgtgtgtagtttggattanagtataattatttttaaacttggataaaac

SEQ ID NO: 15243 - DNA, 101 bp, rice(Oryza sativa)
  misc_feature (71): n=t or c
tataactacgacgctcatcatctatgacatcttcatcgatcgaaaaattatgggttgtggtctggacctcnaattcagttaggccttacaaaagctaatta

SEQ ID NO: 15244 - DNA, 101 bp, rice(Oryza sativa)
  misc_feature (71): n=t or g
tatagagagcagcagtaattttgagttaacaaagcaagtttagagttttgatcctgtccaactaatcgccnggttaatcgggtctacacgcgtgacatgcg

SEQ ID NO: 15245 - DNA, 101 bp, rice(Oryza sativa)
  misc_feature (71): n=t or c
aatgaacttgctcctatatagctcggagcagaatgccttttgcaaagtcaagtaactaccgtttcctaacnttgtacatctctggatggagaataagatga

SEQ ID NO: 15246 - DNA, 101 bp, rice(Oryza sativa)
  misc_feature (71): n=a or g
atttcaaataattgcatatggcatgccaaaatatactgtggtagatcttcaatcttgaaggcaactacaancttaatattcactagtacagaaaccctata

SEQ ID NO: 15247 - DNA, 101 bp, rice(Oryza sativa)
  misc_feature (71): n=a or g
tatcaaccatcaaaactaacaagaggtatatcatcaaacaagcgagaaatagtagattatgtcctcttcgnttctcagctaagatctcccaaattatagat

SEQ ID NO: 15248 - DNA, 101 bp, rice(Oryza sativa)
  misc_feature (71): n=t or c
agaaggtaaacttgattagtgcttgttaaaattgcctgtcaaaattgggagttggtaagaacgggtcaganaaactaaattgcgtagagaagtgagcatga

SEQ ID NO: 15249 - DNA, 101 bp, rice(Oryza sativa)
  misc_feature (71): n=t or c
agtgcgtgttccatcttcgtcatggctctgtcatgcatgctagtaatccaactgcagagaaggaagcacancatcgagaagcaggagtacttcaggcgaaa

SEQ ID NO: 15250 - DNA, 101 bp, rice(Oryza sativa)
  misc_feature (71): n=a or g
gcgttcactggccatatgtcagagcgctccgggcgaatgttgaagttcgcacttccgaagacggttttctnagtgccagctggggtagtcaccgtcttcga

SEQ ID NO: 15251 - DNA, 101 bp, rice(Oryza sativa)
  misc_feature (71): n=t or c
caggatggtggtatctgatatagtaacatccttgcagtcatatatatgaagtgtccagaagggagaatccngtagagtgatgttagaaatggtaatgttac

SEQ ID NO: 15252 - DNA, 101 bp, rice(Oryza sativa)
  misc_feature (71): n=t or c
aaatggtgatgggtggaagaccagaagaaaacgaggtggaagtttcttacatgctactaaaagagtactantccatccgtcccaaaataagtacagtttta

SEQ ID NO: 15253 - DNA, 101 bp, rice(Oryza sativa)
  misc_feature (71): n=a or c
gtttcaccgtcgtcgaggatgctcacgacatgtactctcaagactccttcctatggcaacaagtcgaagtngaaggagaagatcaatccgagagacatgtt

SEQ ID NO: 15254 - DNA, 101 bp, rice(Oryza sativa)
  misc_feature (71): n=t or g
agactaagttcactttgactcccttgacaccagtgacccaatctaattcgtatgactgcaataccggatancttcacacacacacccaattattaaaactg

SEQ ID NO: 15255 - DNA, 101 bp, rice(Oryza sativa)
  misc_feature (71): n=t or c
tctttcctcgcatgcagcagtggaaagaagtttgatgacatgatcgagaaggagctgtcaagacgatccgnaaagtgcagcgacgcagatggcgttgcgat

SEQ ID NO: 15256 - DNA, 101 bp, rice(Oryza sativa)
  misc_feature (71): n=a or g
aagaatgtgcatattggtcagaaccaaaatttctctttttctaggggactttaatttttacatgtcggtgnaggatagaaataagtctagggcaaatataa

SEQ ID NO: 15257 - DNA, 101 bp, rice(Oryza sativa)
  misc_feature (71): n=t or c
gcgagaaacaactgaatgctgggcataaggctggagcttcaagtaaaccatgtcaccaacttgaaaagaangcaacgtgcgattagcattagctgcctgtt

SEQ ID NO: 15258 - DNA, 101 bp, rice(Oryza sativa)
  misc_feature (71): n=a or g
ctcacccttgagatgaagcttgctctgccaggttccacaatggagacatcaagcttgccatcttccacctngcgccgtggcccatgccgctgctcggccgc

SEQ ID NO: 15259 - DNA, 101 bp, rice(Oryza sativa)
  misc_feature (71): n=t or c
tgtggttggaacacctgcatgctaaaatcacgatcttcgcaattacctcgagagaggcggtttacttgttnaactgcaaaaaccacttttgatcgtctgaa

SEQ ID NO: 15260 - DNA, 101 bp, rice(Oryza sativa)
  misc_feature (71): n=t or g
cagccagctacaacatgacctctaataaactatgagagatgtatggattagtttttttttcgggggattanttttttttttcggggaattagttattaatg

SEQ ID NO: 15261 - DNA, 101 bp, rice(Oryza sativa)
  misc_feature (71): n=a or g
gagaaacggtttttactcctagtttacaactatttctactcccgattgtatcaaccaggacgagcaaatcnggactaaaatttgagatctttagtccagat

SEQ ID NO: 15262 - DNA, 101 bp, rice(Oryza sativa)
  misc_feature (71): n=t or c
tcttttgcctggccaggggcatgtggtctgtgctttaggaaaagcaactgcagaaaattcactctgatggncatcctgtctgagacggtcttgtcattatt

SEQ ID NO: 15263 - DNA, 101 bp, rice(Oryza sativa)
  misc_feature (71): n=t or c
caaagagagaggaacttatgccattgctaacttctatatcttggggataaggttcacatacctgcttttgnagtcgaagcaaatagatcgaatctgcaatt

SEQ ID NO: 15264 - DNA, 101 bp, rice(Oryza sativa)
  misc_feature (71): n=a or c
tgcgtccatggttagcagaaacagaagagcacaagcacgcaaataacaaggaaacaaacagcagtaatacnagcagcaataaagatcactagaagtaaact

SEQ ID NO: 15265 - DNA, 101 bp, rice(Oryza sativa)
  misc_feature (71): n=a or g
tacaggatgttgtggtgctggcgctggtacaggggaagaagcagaagtagcagccgactcatgtgttgccntagatgaagctgacgaagtcgacgacgacg

SEQ ID NO: 15266 - DNA, 101 bp, rice(Oryza sativa)
  misc_feature (71): n=t or c
cctgcgactcaaagagagcgcgaaactgagccaacatgggttgagattcctcaggacttgctgattaaaancgatggcgataaaatacctgcacttataga

SEQ ID NO: 15267 - DNA, 101 bp, rice(Oryza sativa)
  misc_feature (71): n=a or g
cgatccatcagttggacgtcaagaacgccttcttacatagtacacttcaggagacggtctactgcatccanccacccggcttcgtcgacaccgcccacccc

SEQ ID NO: 15268 - DNA, 101 bp, rice(Oryza sativa)
  misc_feature (71): n=t or c
aattttctgctggtcattaatgttgggatttctagtagtgaaggccttcttggtcggccttcgtcgcttcngccgccccttcgttttccccttctccaatg

SEQ ID NO: 15269 - DNA, 101 bp, rice(Oryza sativa)
  misc_feature (71): n=t or c
ggccaaaattaggcaggagcatgttaaatcatcccatgtcaaccaagttcaccacattgactcgtaccatntccttcccccattattcaatatgaaaaatg

SEQ ID NO: 15270 - DNA, 101 bp, rice(Oryza sativa)
  misc_feature (71): n=t or g
cacacaagcccaatatacataaaaaaataaggttatggtgacaatggttaacccttttatacctaacatgnatgcatgtgtgtttcgccattacaagcctt

SEQ ID NO: 15271 - DNA, 101 bp, rice(Oryza sativa)
  misc_feature (71): n=t or g
tgtttgatatggtttataatcgtcggtcgatttcttcgtctcatcttctgataatttactccagtttactnctgcctgcggattccaattccgagcatcgc

SEQ ID NO: 15272 - DNA, 101 bp, rice(Oryza sativa)
  misc_feature (71): n=t or c
caaggacatcaagctcgccatcctccacccatggcgctactcgatcgcctccccacgcgtagttgctcgcngcttctcttcctttgcaactttgccgccgc

SEQ ID NO: 15273 - DNA, 101 bp, rice(Oryza sativa)
  misc_feature (71): n=a or g
tactaataaatgggatctccatgttggaagactttagttggagacggaacaataatgcatcgtacggctanagtacgtccaatggacgaacggcaaattgg

SEQ ID NO: 15274 - DNA, 101 bp, rice(Oryza sativa)
  misc_feature (71): n=t or c
tttcgaagggaaagtagccggtggtaacggtgaacaagttttaagcagagatgtgtaccgtctggggcagntgtttgacttctttaggatgcttactttct

SEQ ID NO: 15275 - DNA, 101 bp, rice(Oryza sativa)
  misc_feature (71): n=t or c
ctgtcgttgacccatcttgatgatatttgacacttgcaggtcctacttggggatagtcctgtttatgatanagatgcaactgaaccatcagaggagggcat

SEQ ID NO: 15276 - DNA, 101 bp, rice(Oryza sativa)
  misc_feature (71): n=t or c
tgagaaaattccttgtgtacacctcaaaactctctcaatctcttatatgcacccgaaaaataccgaatccnttgtgtgccctcgaaaatttatttggaacc

SEQ ID NO: 15277 - DNA, 101 bp, rice(Oryza sativa)
  misc_feature (71): n=t or c
catagaataggcgttttagaagctgtacttgcttaattatctgcacacacactgctcgcgcagtttacttntatcgttctggaatgaattaaaggtttcaa

SEQ ID NO: 15278 - DNA, 101 bp, rice(Oryza sativa)
  misc_feature (71): n=a or g
gttcttctctttgtgtatttttactgtgtattaacagtgttgcacaatggacgaggacgaagttagcttgnaggagatggaggagtataacatggttgcta

SEQ ID NO: 15279 - DNA, 101 bp, rice(Oryza sativa)
  misc_feature (71): n=a or g
tagtgaaaaccattagaacacataaaaagaactatacgcggtgtccgttgtttataaatttttatataggntgataattccattatctaaaaaaatataag

SEQ ID NO: 15280 - DNA, 101 bp, rice(Oryza sativa)
  misc_feature (71): n=t or c
aagtggctccgcccctgcttaagagaagccatccccatcacgccgttgcccatcgggggaactcagctccnttgcggagtcgcggtccgaagcttgcaatg

SEQ ID NO: 15281 - DNA, 101 bp, rice(Oryza sativa)
  misc_feature (71): n=a or c
ggagtattttgggccgttttggattgaagacaaaacatgaccctttatccacgctcaatttggattgaagncaaacaattcgtagtgcccacgctcaattt

SEQ ID NO: 15282 - DNA, 101 bp, rice(Oryza sativa)
  misc_feature (71): n=t or c
taataatgtctatatgcagttcactttttcctaaggtcacatgtgctgatattaccttctctctctctctnttttgacaggatctgctgaactaccctctg

SEQ ID NO: 15283 - DNA, 101 bp, rice(Oryza sativa)
  misc_feature (71): n=t or c
catacaagtacaggagctatcccaactagtagttgtatacaccactatgatgaggctactggcaatggaanatggaccacaggaacaagtaaaaggtcatg

SEQ ID NO: 15284 - DNA, 101 bp, rice(Oryza sativa)
  misc_feature (71): n=t or g
atgccgtgccatattgcgacactcgagccaatcgaggtcacccaaatagtgctatacatcttttttttttnggtaaaacacactacaaatgtagttgacca

SEQ ID NO: 15285 - DNA, 101 bp, rice(Oryza sativa)
  misc_feature (71): n=t or c
atgaaatttattggcaaaacgtaagcatgcataccagggtcacaccacgaaataacaggcaagcgtctgcnggatcggaaagaagaagcttgcaataaatc

SEQ ID NO: 15286 - DNA, 101 bp, rice(Oryza sativa)
  misc_feature (71): n=a or c
ccatgtgtttgatatggctttaactgaaggaagggaagagatagaaaggaaaaggttctccaggcacacangaaacacctttggacatacgccagaccgag

SEQ ID NO: 15287 - DNA, 101 bp, rice(Oryza sativa)
  misc_feature (71): n=t or c
aatccagccgtcaacaacacgagtcaagtgatcggtcatccgccgatgtgccgatggaggatacgggtgcngaaccgctactcctaaccgacgccgatctt

SEQ ID NO: 15288 - DNA, 101 bp, rice(Oryza sativa)
  misc_feature (71): n=t or c
tattgcggtccttgacttgttgaaaaaggaggcaaccatgcaagcatgaggtaaaggatgagaaagacacngtgtcactctccttggttgataaaaggaag

SEQ ID NO: 15289 - DNA, 101 bp, rice(Oryza sativa)
  misc_feature (71): n=a or g
ggcagcaattctcaagttgcactgtggtaactatcgctcacagggttccaactgtaacagacagtgacaangtcatggtactttcatatggtaagttacta

SEQ ID NO: 15290 - DNA, 101 bp, rice(Oryza sativa)
  misc_feature (71): n=t or c
caacgttctccttgcactaacgacaactcagaagggacccatttccatctccgagtacatcgccaagatgngatctcttggcgacgagatggcgggtgcag

SEQ ID NO: 15291 - DNA, 101 bp, rice(Oryza sativa)
  misc_feature (71): n=a or g
ccgccagagtcccacacgccgccgctgatagacgcgcccgtgttttggtctagagcccacgcccgctgcanggtgcacctctcggtgcgtgggacgctgcc

SEQ ID NO: 15292 - DNA, 101 bp, rice(Oryza sativa)
  misc_feature (71): n=a or g
agccaagtaatgcaaacaggcatcattagttcttgaatccatcttattccaggagctcccaccgctgtgcnttgcagaagtcaagaagtccaatggtgccc

SEQ ID NO: 15293 - DNA, 101 bp, rice(Oryza sativa)
  misc_feature (71): n=t or c
tagtatgttgaaatgaacaaggcagaacctgtgctttacctttcgtaggtagtccgaatcgaggaggcccnagtctagagaacactggtggagaaaccctc

SEQ ID NO: 15294 - DNA, 101 bp, rice(Oryza sativa)
  misc_feature (71): n=a or g
ttatataaaacggactgtttagcaattcgggaaactttttcaacatattctctccgttctaaaaaaataancgtagaaagagatgtaacatcttctagtat

SEQ ID NO: 15295 - DNA, 101 bp, rice(Oryza sativa)
  misc_feature (71): n=t or c
acgcgatcgatggcagattcacgagccaacgcatcgtcgcatgctgattcgatcggaaacgttaggtcaancgtaccattaatgatggagatgctacgtga

SEQ ID NO: 15296 - DNA, 101 bp, rice(Oryza sativa)
  misc_feature (71): n=t or c
agtgttcaacgctggagccgttgacttgtgagttaaaaatgtctcgagttggattctgtgtgggccccagngtcagcctcggtggtgagtggtcgtgtacg

SEQ ID NO: 15297 - DNA, 101 bp, rice(Oryza sativa)
  misc_feature (71): n=t or c
atttcttgcatattcatacaacttatagttctttgtcattgttttctataatacctgcaatatttgatacnagtattataggttagtgtaatttttaatta

SEQ ID NO: 15298 - DNA, 101 bp, rice(Oryza sativa)
  misc_feature (71): n=a or c
ttctcgtagtcgaaagccgtgtgatgttgtttccagctgcaagtcaaatccgatactactattcacaaagntgatagttccccttcttcctccctgtgctt

SEQ ID NO: 15299 - DNA, 101 bp, rice(Oryza sativa)
  misc_feature (71): n=t or c
tacccttcctcctcgccgtcctagtttgatgaccaacgcctaccgcttcaacttgagcacctacaccatgntgccatcgtcatctccaagcaaagccaatg

SEQ ID NO: 15300 - DNA, 101 bp, rice(Oryza sativa)
  misc_feature (71): n=t or c
ggggacgggaaagaatcaaagaagaggaagggaagaaggagagataagataagagccatccatcatttttntagaactgcccatttacatagtatctccat

SEQ ID NO: 15301 - DNA, 101 bp, rice(Oryza sativa)
  misc_feature (71): n=a or c
ccctagtcgcagaccgtcagtccgtgggtttgaacaacatggaacataccacatctgcatacattgcatcnaatgtgccaatgcccctactgggtgtagtg

SEQ ID NO: 15302 - DNA, 101 bp, rice(Oryza sativa)
  misc_feature (71): n=t or c
ccatcatcaccagtgggttctgcggctttgtttggagttggtggtggtagtggatcaagatgtgaggactnagcttctccggtcacttctccaatagctca

SEQ ID NO: 15303 - DNA, 101 bp, rice(Oryza sativa)
  misc_feature (71): n=a or g
tcccccgaactctgtctatgatcagttatcaagtactgaaccacaccaataaagcctctagcctgacggcntatgtttctccttttatgtggccggcccgg

SEQ ID NO: 15304 - DNA, 101 bp, rice(Oryza sativa)
  misc_feature (71): n=a or g
aatcctcttcgctctttgcgaaaccgtcaatgatgcgaaccaagtgctcgagtgtttgtggttccttgttngcgattttccttgtgagttcgccttcgagc

SEQ ID NO: 15305 - DNA, 101 bp, rice(Oryza sativa)
  misc_feature (71): n=t or c
acgtgcagcgaattaagcctgggcgtactactccgtttatacagccgtacagtacctagattatctagctnacttatttttctgaaaaatgaagctgtgtt

SEQ ID NO: 15306 - DNA, 101 bp, rice(Oryza sativa)
  misc_feature (71): n=a or g
tggtagaaagagatggcccacctccatttgaaattagacctggagcatacttaatgaccttaccgctattnctctggcgaggaggagaagattctgttgtc

SEQ ID NO: 15307 - DNA, 101 bp, rice(Oryza sativa)
  misc_feature (71): n=t or c
ggcatatttagttcgcggaaagaaaatatttggatgtcacaatatttggtcggatgttgaaagggattttnggacacgaatgaaaaaactaatttcatcac

SEQ ID NO: 15308 - DNA, 101 bp, rice(Oryza sativa)
  misc_feature (71): n=t or c
ttgtaccttgtgttttattttagttctgcgtgtcgtgtttggctgggtttatcacggggagattgaggttntttttaactatttgccactcttacggagtg

SEQ ID NO: 15309 - DNA, 101 bp, rice(Oryza sativa)
  misc_feature (71): n=a or g
gatgcctgctctgctgctaccatctcagcaaccgttttggcataacagtaccagtcctatatttgaaattnaaaaattagtactacatccttatcaaaata

SEQ ID NO: 15310 - DNA, 101 bp, rice(Oryza sativa)
  misc_feature (71): n=t or c
agccagcagagtctctgggtgttgcggatttcgtcttcgtgacgatatgaaagcgaagtatattcccttcnagagccattcatctcggcgccaatggcagc

SEQ ID NO: 15311 - DNA, 101 bp, rice(Oryza sativa)
  misc_feature (71): n=t or c
ttcggtggttcattcagaggtcaaccaaaatctggaaatcttggaagcaattttggcaagcaaaggcagcnatattgtgcaatggacaacaatcttctact

SEQ ID NO: 15312 - DNA, 101 bp, rice(Oryza sativa)
  misc_feature (71): n=t or c
cctctcaccgctaccggcacccgctacttcatatgtggcttcaatggccattgcaccggagggatgaaggncgctgtcaaggttgaggccgccaccggcag

SEQ ID NO: 15313 - DNA, 101 bp, rice(Oryza sativa)
  misc_feature (71): n=t or c
attgcgcaggcctaatggcagcctggtgtcaaatgaaaaggagatgggagaggttgcccgtgatttcttcnagaatctatatatgaaagatgaaaatcttg

SEQ ID NO: 15314 - DNA, 101 bp, rice(Oryza sativa)
  misc_feature (71): n=t or c
cacgcttttggcacgcctagtgggacaagtttcattgttcaatcatgtcatcacactcaataactgatgtngttgacaaaacgttatccctgctacagttg

SEQ ID NO: 15315 - DNA, 101 bp, rice(Oryza sativa)
  misc_feature (71): n=a or g
cacgcgcgggggcgagcaaggcgggaaaaacgaggagtctcgtccgacgtgctcggcgccattactagccntctcgtcaactgcccgaccgccaggcgcgt

SEQ ID NO: 15316 - DNA, 101 bp, rice(Oryza sativa)
  misc_feature (71): n=a or c
atcccatagcttatctaagcaaggcattaggtccaagaactagagggctatcgacttatgagaaggagtgnatggctatactcttagcagtagatcactgg

SEQ ID NO: 15317 - DNA, 101 bp, rice(Oryza sativa)
  misc_feature (71): n=a or c
tcagtgtagccgacggtgttgcagccgagcacgaccagcatgttgtgggtgttggagatgcggtacactcngccgcggttcatctccgtcttcgcgcggct

SEQ ID NO: 15318 - DNA, 101 bp, rice(Oryza sativa)
  misc_feature (71): n=a or g
aaatccagtgtccaagctcaatcaagttctgttatattgatatcgcatccagtcgcaagccaaactgaggngcctacgtcgggcagaagtcagtacaatgc

SEQ ID NO: 15319 - DNA, 101 bp, rice(Oryza sativa)
  misc_feature (71): n=a or c
tcagtcagttgaatcagaaaggagcagtgcagtatgcggatccaccagatcagtcagaccgctcaccagcnccagctttctttctagccatcccagaatct

SEQ ID NO: 15320 - DNA, 101 bp, rice(Oryza sativa)
  misc_feature (71): n=a or g
accatggtaaagtgcaaactctgatcttgctaccaacattttgctaggtcaaaacaacttctccaaaaagntattgtgttcgaccaaatgtaggagtcatt

SEQ ID NO: 15321 - DNA, 101 bp, rice(Oryza sativa)
  misc_feature (71): n=t or g
ctaaaacaaaactggtcacgaggacctcttctacccatttgtacaaacccattactgtgtacggcttcctnatctttgacatgttgtgtttggccacctcc

SEQ ID NO: 15322 - DNA, 101 bp, rice(Oryza sativa)
  misc_feature (71): n=t or c
aaacctaatagttggcatttgagtggttgtggacttgcttttgaaaactgcagcaaatgaccataaagggnttaagatcagatcatgtacggttatcactt

SEQ ID NO: 15323 - DNA, 101 bp, rice(Oryza sativa)
  misc_feature (71): n=t or c
tccctattttttctatttctttccctcaataattcctagtccactaacttccatctaaaccaagggtaaanggataattcgttttaaaaaagtaggggcaa

SEQ ID NO: 15324 - DNA, 101 bp, rice(Oryza sativa)
  misc_feature (71): n=t or c
ttgtcagctaatggaaccactaaaatatttttcccttaacccgaattgttttatgactactgatttttttntcaggcacgtttagccttagttcttcgaga

SEQ ID NO: 15325 - DNA, 101 bp, rice(Oryza sativa)
  misc_feature (71): n=a or g
attttgactcaagcaatgaggagatatttttagacagctaggttaaagttctcatttcaccaagaaatacngaagaaaatccaccaaccttctttaaatag

SEQ ID NO: 15326 - DNA, 101 bp, rice(Oryza sativa)
  misc_feature (71): n=a or g
acagttggtcttactgccatctctgatcaacgggctgtcggaactgagatgtcagatattcagaacacacnttttacattttcttctagaaagatgatcag

SEQ ID NO: 15327 - DNA, 101 bp, rice(Oryza sativa)
  misc_feature (71): n=a or g
ggaaaatctttaggtgttgaccgtttaccttaaatatgttaactaatttgtcacggagtgtgattgccccntgcgaagaggtgtcgatgacgtcgaacggt

SEQ ID NO: 15328 - DNA, 101 bp, rice(Oryza sativa)
  misc_feature (71): n=t or c
gtaaaacaagaacagaacacacgtgattcagagggggatgaatgttaaacaaagtgacacacaatggctancttccattccaatcatccaatctatggtac

SEQ ID NO: 15329 - DNA, 101 bp, rice(Oryza sativa)
  misc_feature (71): n=t or c
accaggcctcaatcttcctctccaatctccttgtggctagttcggacagcagcagcagcgtgggtggtgcngctgcgattccggaggagggggcggtagtt

SEQ ID NO: 15330 - DNA, 101 bp, rice(Oryza sativa)
  misc_feature (71): n=a or c
aaaaaatatgtttgtatttttttctatatgcgactggcatgtgggtttccactgatacataggcatcaccnaggcatgccacgtcaacatacaaagcgggt

SEQ ID NO: 15331 - DNA, 101 bp, rice(Oryza sativa)
  misc_feature (71): n=a or g
gccgcataccatcggcactcctccgcttctctggtatagtattattttataggccttggaccgaaaagttnatatggcgtgccagagaggaccttaagagg

SEQ ID NO: 15332 - DNA, 101 bp, rice(Oryza sativa)
  misc_feature (71): n=a or g
agccggagttctggatcggacaaggttctattaagcttgcatggctgctgctctttgaaagacgaggtctngtggaagaggcgggtcgggcaagtcgagta

SEQ ID NO: 15333 - DNA, 101 bp, rice(Oryza sativa)
  misc_feature (71): n=t or g
tattaatgttcttcagcattcccctctctttgcaaggctagctgaaggacaggctccacaagtgaattatnaaatcaatggtcacaactacacaatgggtt

SEQ ID NO: 15334 - DNA, 101 bp, rice(Oryza sativa)
  misc_feature (71): n=t or g
accaccaccaccaccaccaccacctttaaaagaaggtgctaaagggggtgtcctgcaaagaaaaggagagnagtgccccctaacctttccctgctttccac

SEQ ID NO: 15335 - DNA, 101 bp, rice(Oryza sativa)
  misc_feature (71): n=a or g
atgtgcggcagagatgcagagagtattagaaggaagcaatgtggagggtgaagagagtagagatgcagctngagacggagagggcgtgtcggtggcaagag

SEQ ID NO: 15336 - DNA, 101 bp, rice(Oryza sativa)
  misc_feature (71): n=a or g
gaagacccgcctgaccacttgtgatcctcatgcaaaacatataattacatcatctgattctccccaggagnttgaagttggcaaagacataatatttactt

SEQ ID NO: 15337 - DNA, 101 bp, rice(Oryza sativa)
  misc_feature (71): n=a or g
tacaccctcacatttcagtggctagcactatcttctcctctcttcccagtaccatccaaggcagccacgcntggctggccgccacatttcctctgcgcgcc

SEQ ID NO: 15338 - DNA, 101 bp, rice(Oryza sativa)
  misc_feature (71): n=t or c
cttctggcttacatcattatttttaagaggaaaccgccatatgaaatatatatcagaagaactcttttgcnatatggaaatgcttgggatactagacctct

SEQ ID NO: 15339 - DNA, 101 bp, rice(Oryza sativa)
  misc_feature (71): n=t or c
tttctccttaattttatcttgggaagttagggtttggcattttgtgacacttcctctatcccataaaaaancaatctagtattggacatggcacattacta

SEQ ID NO: 15340 - DNA, 101 bp, rice(Oryza sativa)
  misc_feature (71): n=t or c
acttttatagaagttgtaaagatccaatacaatgtggtaagttcgccattacataacaaccatttgtgctngcgcagagcatgtaacctttgtccaaaatg

SEQ ID NO: 15341 - DNA, 101 bp, rice(Oryza sativa)
  misc_feature (71): n=t or c
ttgattccggcggatcacttgggcatgatttaatttgacagttgtgatttatcccttaccaccacggcacnacctagcagtatctttatcgggcacacaat

SEQ ID NO: 15342 - DNA, 101 bp, rice(Oryza sativa)
  misc_feature (71): n=a or g
attcagtgcattcactgtcggtttgttgttgtacgtttcttggatggactgcactgcaatgttgcagctcnaaccggtgaggctgaggcggagcgcaaagg

SEQ ID NO: 15343 - DNA, 101 bp, rice(Oryza sativa)
  misc_feature (71): n=a or g
gatttacctttggatgattggatctacattcacattatatgtttgccctgattcagtttgttcgttctccnttttgttttcaacaggtgacactagaagat

SEQ ID NO: 15344 - DNA, 101 bp, rice(Oryza sativa)
  misc_feature (71): n=t or c
ttgatacccatcggtgcacttgcataagtaaccagcacgggaagctgtaaagctcaagttatcatcgcacnggctgtgcttgctggcacaggcatagctgc

SEQ ID NO: 15345 - DNA, 101 bp, rice(Oryza sativa)
  misc_feature (71): n=a or g
aggatgtcgatcaaatgttggatcgacagggtgggaaaacccccaattcccctctttgccagcttgatgcnagcccgcgactcgaatgattccaccgccgc

SEQ ID NO: 15346 - DNA, 101 bp, rice(Oryza sativa)
  misc_feature (71): n=a or g
accaaagataatttgggaaaagttggaagctcagtttatgtccaagactctgaccaataagctatatctgnagcagaagttgtatgggctaaagatgcagg

SEQ ID NO: 15347 - DNA, 101 bp, rice(Oryza sativa)
  misc_feature (71): n=t or c
attatccaaataaacattttcctacaaaattgaaaaacaatctatgcttcttttcttcaaagttgtacatnaaattgcccaaatggcacttcctgtatttt

SEQ ID NO: 15348 - DNA, 101 bp, rice(Oryza sativa)
  misc_feature (71): n=a or c
ggggttttctagtctttacacacttagcttagataaatggcattaccaaaaaccggggtagccaaacaacnaagatttgccaaccaacatattttttaaac

SEQ ID NO: 15349 - DNA, 101 bp, rice(Oryza sativa)
  misc_feature (71): n=a or g
gataaaaaccaaacttatcatactttgggcctatagaataaaaaatataagcctttacaaaattctaattnggcctacttgtcctacattagatgaaaaaa

SEQ ID NO: 15350 - DNA, 101 bp, rice(Oryza sativa)
  misc_feature (71): n=t or c
tgcttccatgaacaagaaacgtagtgctgatcgatgagaatatgagatgaagaagcttcttcactaggatnaataattctgagcatttacgtttgagtgaa

SEQ ID NO: 15351 - DNA, 101 bp, rice(Oryza sativa)
  misc_feature (71): n=t or c
atgctcctgggagcactatagtagttagggtagataccacatatggatggcaagttgaaggtcaacagagnttgggcttgagcttgagtctgatcaaagta

SEQ ID NO: 15352 - DNA, 101 bp, rice(Oryza sativa)
  misc_feature (71): n=a or c
ccgaaaaccctaggtgtttctcaaattgagacacattccaagttaacatatgagcttcactattcgaatcntgaacttgatactattcgaatcctgaactt

SEQ ID NO: 15353 - DNA, 101 bp, rice(Oryza sativa)
  misc_feature (71): n=t or c
ttaatttgtgcagcggatcgatcgaatctatgtttttactagaagaagaaggaataaaaccctatatcaangacctttataataagcttccctatgtagcc

SEQ ID NO: 15354 - DNA, 101 bp, rice(Oryza sativa)
  misc_feature (71): n=t or c
gatgagagggtatatatatgataggtgggccccaccattaaaaaacgagaaaatactgactggattgtcangcatgcatcgggtaattcgtactctttcca

SEQ ID NO: 15355 - DNA, 101 bp, rice(Oryza sativa)
  misc_feature (71): n=a or g
agcatagtaaagatacagggtgaactgatggttgaatcgaaaaaaagaaatccaaaccagccacctttgcngctggttctatgaaaatcatgcactattaa

SEQ ID NO: 15356 - DNA, 101 bp, rice(Oryza sativa)
  misc_feature (71): n=t or g
ctagttaaacaagtcatcgagtcatgtagtgcttacaatagctgtgactcggtaaatccagtgtggtgctngagagtgtcagtccatagagggctcttctt

SEQ ID NO: 15357 - DNA, 101 bp, rice(Oryza sativa)
  misc_feature (71): n=t or g
caggaggcaaggtacacatgaccaagtcggtaattaacataatttacaagtagaagcgtaaatacaatacntttattacatgggcaacaagggcccaacac

SEQ ID NO: 15358 - DNA, 101 bp, rice(Oryza sativa)
  misc_feature (71): n=t or g
gaccatacgagcgtccccatagaaggcataaagttccacggcggctatttagtggctaaaggatggtatangaatggtttagaaatcaaaggaaattgaat

SEQ ID NO: 15359 - DNA, 101 bp, rice(Oryza sativa)
  misc_feature (71): n=t or c
tctcttcttgtggtgggttcgctttgaatgcttggatatctcaccatgtggaagagctttcctgtcactcnttttctctttcttcttttcagccttttccc

SEQ ID NO: 15360 - DNA, 101 bp, rice(Oryza sativa)
  misc_feature (71): n=t or c
cacacctcgcaaccttggagcgcttccacggcttggtcttttttgacttccaccatagtcctcttgagttnggccacctcggacttcgtcctccaatatta

SEQ ID NO: 15361 - DNA, 101 bp, rice(Oryza sativa)
  misc_feature (71): n=t or g
gggtttttgctaagcatgatggcagattggttgtcaatcctcaatgtgacggcgtcggcctcctctccctngagttcagcaaggagacgcgccagccacac

SEQ ID NO: 15362 - DNA, 101 bp, rice(Oryza sativa)
  misc_feature (71): n=a or g
aagtaaaaaatccgcggcaaaatcaagcaaaatttcggtgtttcttggatctgccaagtgaaagagagagnaaagaaataaacactagaggcaaacaaaac

SEQ ID NO: 15363 - DNA, 101 bp, rice(Oryza sativa)
  misc_feature (71): n=t or c
atcatgtgttttgtacctaaagcaagcccttcaactgcaagggtactcaataatgatagtttttcaacttnaatttttatgaaattgattctattcaaact

SEQ ID NO: 15364 - DNA, 101 bp, rice(Oryza sativa)
  misc_feature (71): n=a or c
aggatgggaatgtcttttcttcggcatctattcaatgtctcaaaatgattggctgcaacctgacagtgganatttttcttagtgtgtttcagaacattagt

SEQ ID NO: 15365 - DNA, 101 bp, rice(Oryza sativa)
  misc_feature (71): n=a or g
acaatcattcatgtattggcacacactgtcatccaatagtgcccttaactcagaattaagatctttccctnggaacaacaaatgtagcattgttccttcag

SEQ ID NO: 15366 - DNA, 101 bp, rice(Oryza sativa)
  misc_feature (71): n=t or c
gattgccaagtgattgggctgctgccgaggaagaaaatcaccccagtcatgctcttcctagcatcgacatnaccagcataaccgctgtcactgaaccccct

SEQ ID NO: 15367 - DNA, 101 bp, rice(Oryza sativa)
  misc_feature (71): n=t or c
tgtaagaaaatcctgctacatcatcataatataatcaaagtacgtagggtatcgtactcttcctttttttncaaattgtttttctccttgctttggtcctg

SEQ ID NO: 15368 - DNA, 101 bp, rice(Oryza sativa)
  misc_feature (71): n=a or g
agaagaatatatatatcccctcatggacatgcccacaggattttcgataaacaattgaaaagactgcaacnggaaatcgtcatcgatatatatgggcaatc

SEQ ID NO: 15369 - DNA, 101 bp, rice(Oryza sativa)
  misc_feature (71): n=a or g
tcaactttgggtggtttaatgtccgatccggctctaacaaccgagccgatactaggttgctaaattatgtnacagaggaagtagtaaaaataacatgacaa

SEQ ID NO: 15370 - DNA, 101 bp, rice(Oryza sativa)
  misc_feature (71): n=t or c
aacactagaatcgtacagagggtagggatgagcggagaaggttggtggacgtgcacgaggacgacttgggngcaggcgaagcggcggaaggcccatcgcag

SEQ ID NO: 15371 - DNA, 101 bp, rice(Oryza sativa)
  misc_feature (71): n=a or g
acagcagcactggagtcattgacttcatttgtcttcttgttttggcacatatgctctgggttaaactgacnagtggttgttttcaaaccactcgaaacttg

SEQ ID NO: 15372 - DNA, 101 bp, rice(Oryza sativa)
  misc_feature (71): n=a or g
agaggtgaatggtgtccagttgttttcaaggattttttttttgagtcccactccggtgcttctacttgtantagagagtaatctacaccgttgattgtatt

SEQ ID NO: 15373 - DNA, 101 bp, rice(Oryza sativa)
  misc_feature (71): n=t or c
gccccgcttggacttgggcttgtcgtcgacgctggacgactggcaccttcaacaacaacaacaaccaccanaacatcacccccccccccccaccccaaaca

SEQ ID NO: 15374 - DNA, 101 bp, rice(Oryza sativa)
  misc_feature (71): n=a or g
tggatttaatctcattggttgatgatgctcggctggccatttttatcccaatcccaaattttatggatccnttccgattttggaaaaaacagaaagactag

SEQ ID NO: 15375 - DNA, 101 bp, rice(Oryza sativa)
  misc_feature (71): n=a or c
gaaccttcatttgttgccagatcagatcgaagtcttactctgccaaatgttctgtaaagagattgagatcntcttactttacacagtgaagtcagagaagc

SEQ ID NO: 15376 - DNA, 101 bp, rice(Oryza sativa)
  misc_feature (71): n=a or g
caaagctagccgagtagccggtcattgccatgctcattcacacctgtgcccattttagtttaagattattnaaccaactattgtcgcatactacctccgat

SEQ ID NO: 15377 - DNA, 101 bp, rice(Oryza sativa)
  misc_feature (71): n=a or c
aggccgccgccgccgccgtcgccgaggactaccccgtcttcactccggtgagcaatctctctctctctctntatatatatatcttcagctttcgtttcttc

SEQ ID NO: 15378 - DNA, 101 bp, rice(Oryza sativa)
  misc_feature (71): n=a or g
gcaaactgtgaggcgaaccgcgccaacaacgctggtgattccaaccaggacaatggaggcaacctcttctntgacaagagaacaacctcaggtaacctttc

SEQ ID NO: 15379 - DNA, 101 bp, rice(Oryza sativa)
  misc_feature (71): n=a or g
tatatcatgatcatatgcgcccgacattgtcgcagctacacctcttccctgtgtgggattggcagcgattnggatggctgctgctgatgctcttcggcttt

SEQ ID NO: 15380 - DNA, 101 bp, rice(Oryza sativa)
  misc_feature (71): n=t or g
aaggcccaagtatcctacgaacatgggccaaccaccgacgtaggagaggtcctggctgacgcaacagcccnccacgtgaacatggtggtgagggggagccc

SEQ ID NO: 15381 - DNA, 101 bp, rice(Oryza sativa)
  misc_feature (71): n=t or g
gattccgttcatcaggttgtgtggcagatggtcttgaagaatcggctgctggtgtggtggtaatggcagcngcggcggcggcggcgaggactggccgccgc

SEQ ID NO: 15382 - DNA, 101 bp, rice(Oryza sativa)
  misc_feature (71): n=a or g
ctaaaaagacctaagcccatcactagccagcaactaaagataattaaccctacatactaatccttacaagnggcatatatatcgaagacaatggaggaact

SEQ ID NO: 15383 - DNA, 101 bp, rice(Oryza sativa)
  misc_feature (71): n=a or g
gtcgatcgattgatgtatccgaaatgcatgcatatactatatacggggaagctatttcatccctcgagagnatattatctcgttgttaaagtcaaactact

SEQ ID NO: 15384 - DNA, 101 bp, rice(Oryza sativa)
  misc_feature (71): n=t or c
gcggttggaggaggagaggacagggtttgaagcagtaaggaaagagatggtagcagttagggagatagtcnaggataatctagctaagttgactgctttaa

SEQ ID NO: 15385 - DNA, 101 bp, rice(Oryza sativa)
  misc_feature (71): n=a or g
gtccgcttgggcacgtgcgtgaggaaacagaaagaggaatcgagaaggaggaataaaacaaacccgatacntacgtattaatttcgtgatttccatataat

SEQ ID NO: 15386 - DNA, 101 bp, rice(Oryza sativa)
  misc_feature (71): n=t or c
gtgtcatagatgaaatgaatataaatgatgtatcgatgcaagtgtaggtgatataacaaaataaagggtgntgcatgcacatgcctttctacgtataagag

SEQ ID NO: 15387 - DNA, 101 bp, rice(Oryza sativa)
  misc_feature (71): n=a or g
cccagtcctctagtaaaggcagccacattcaggaagccatatctccacccgagttagggaacaaaatactnccaaatatgtataacgcgtacgctctgcag

SEQ ID NO: 15388 - DNA, 101 bp, rice(Oryza sativa)
  misc_feature (71): n=a or c
ggttatgtgggtgctctttattggggttgggacctggaagttatgatctatctggttatgcaatgttttgncctcatgccgatcggacctactgctagatc

SEQ ID NO: 15389 - DNA, 101 bp, rice(Oryza sativa)
  misc_feature (71): n=a or g
aagttctattatggaaaccataagttctatgttgggttgttcgattgggtttgtttttccaaatcctatcngaagttccggttggcatcaaaagttctgga

SEQ ID NO: 15390 - DNA, 101 bp, rice(Oryza sativa)
  misc_feature (71): n=a or g
gatgccggagggtgttaatgatactgctattgtgcttattccgaaaacccaacagccgttagagttgaaanagtttcgtcctataagtctgtgcaatgtgt

SEQ ID NO: 15391 - DNA, 101 bp, rice(Oryza sativa)
  misc_feature (71): n=a or g
catctctaatgaaaaatccatttacaggtttagaggtatgacgtctattaattggaacgtagtccaacacntccaaacgaattaacaattagtatcctagt

SEQ ID NO: 15392 - DNA, 101 bp, rice(Oryza sativa)
  misc_feature (71): n=t or c
gatctttggaaggtagcagagcgtaccgagcttttcacgggcgcagatcttgaaggcctgtgcagggaggngggaatggctgccttgagggaaagtctgag

SEQ ID NO: 15393 - DNA, 101 bp, rice(Oryza sativa)
  misc_feature (71): n=a or g
aaaaaaaaaagcagcagcaggacaggggagcggagatcgaattgggagttggggaggattggattagattngattggattggggaagaagaagaggaattg

SEQ ID NO: 15394 - DNA, 101 bp, rice(Oryza sativa)
  misc_feature (71): n=a or c
gaagagtgttgtggttgcaacccagatgagtcgtcttttttaaaatcaggaaatatatttctcctttgtgnactggttacaattttgtcattcataaaacc

SEQ ID NO: 15395 - DNA, 101 bp, rice(Oryza sativa)
  misc_feature (71): n=a or g
tatctagccatatccaatctctcattcatcaaatatgtgagtatatgtaaataggggagatcatcggtatnaggatgccgatgtgcttgaggccgttgata

SEQ ID NO: 15396 - DNA, 101 bp, rice(Oryza sativa)
  misc_feature (71): n=t or c
tttttcttaatatcccctccaactggatggcactcgaggatatatttggctgtgttattatcacagttttnccaatccatctctctcgttttccgcgtgca

SEQ ID NO: 15397 - DNA, 101 bp, rice(Oryza sativa)
  misc_feature (71): n=a or g
ttatttcttgttgtagattgcaattagcttttcggcttaaggcatcagcaactacgttggcttttcctggntggtatagaatttccaaattgtagtcctta

SEQ ID NO: 15398 - DNA, 101 bp, rice(Oryza sativa)
  misc_feature (71): n=a or g
ttgttgaatttgttttacatcagtcttttttggcagtagcacaatgatcccaaagtttaggctataaaggngtaatgtccctttatgaaattctctgaata

SEQ ID NO: 15399 - DNA, 101 bp, rice(Oryza sativa)
  misc_feature (71): n=a or c
ccgctgcgcaacaacatttgattgaaccatcttacgatgctttttctcaggctcatgcagccatgcttggntgcttgcgttgttgagacttgagagcacgg

SEQ ID NO: 15400 - DNA, 101 bp, rice(Oryza sativa)
  misc_feature (71): n=t or g
ctgaacacaggatttctgaactccttcaagttcatgctgcttgcttaccttttttgatgagttacttcctnctgattttccattgctgaaattcactaggg

SEQ ID NO: 15401 - DNA, 101 bp, rice(Oryza sativa)
  misc_feature (71): n=t or c
acgttgtatcttgggtactaatttgacgtttcgtttcatccttcgctaggctgatataagatcaaaggtgntccttcaaaagcaccaaaaacttgaagagt

SEQ ID NO: 15402 - DNA, 101 bp, rice(Oryza sativa)
  misc_feature (71): n=a or g
tacacatcaagaaatgaaaattgcatacatgcataatacaactaccggctggtaggtatatataaaaaggnaccttggaaaaccaacaagaacaagttccc

SEQ ID NO: 15403 - DNA, 101 bp, rice(Oryza sativa)
  misc_feature (71): n=t or c
agtttacaaaccttttctgcaacagccttaaacgttgcaggggttgacttcgcactgggtgcatcgctgtngatgaacccaacctttatcccggtccgatc

SEQ ID NO: 15404 - DNA, 101 bp, rice(Oryza sativa)
  misc_feature (71): n=t or g
acgaggataaagcccaccaagatcaggatcatagtggttccaaaaagttgaagtcaccatgtatcgatgangccaagaaggtgatgctagctgaagccgat

SEQ ID NO: 15405 - DNA, 101 bp, rice(Oryza sativa)
  misc_feature (71): n=t or c
tctaatttagcggcttccagctgctgctttagctcataaatatggttctggagctcagacttgtgagaatncaattcttgagtcttcttagcaactgcatc

SEQ ID NO: 15406 - DNA, 101 bp, rice(Oryza sativa)
  misc_feature (71): n=t or g
taaaagttatacaccagcatctggaacatgccatgagaagctttgacaccgagtgtcgtgtgctccgaatngctcgacatcgcaacctgataaagattctg

SEQ ID NO: 15407 - DNA, 101 bp, rice(Oryza sativa)
  misc_feature (71): n=a or g
tggcaatgcttcttcttcctcctccaattccagcacccccagtattcctcctcctgttgcccctactcctnctgctcctactcctcctattcccagccccg

SEQ ID NO: 15408 - DNA, 101 bp, rice(Oryza sativa)
  misc_feature (71): n=a or g
taacatgttttaacgcactcatccagtcatgtttataactagatctcgccgctgttgtttctctctttacnttgaccacatcgttgtcagccgtgttcctg

SEQ ID NO: 15409 - DNA, 101 bp, rice(Oryza sativa)
  misc_feature (71): n=a or g
ctattttctggcatggtattgctgtttccaatcgagttctctattagctgggctcagtatggcagtagtantactaatttctaagatggtacccttcttcg

SEQ ID NO: 15410 - DNA, 101 bp, rice(Oryza sativa)
  misc_feature (71): n=t or c
cttctgccattccacaaggtaaccattgacatggaaacttgggccttgaggttgattgataactagaggcntcacatcagttctatcaacaccacctcgtg

SEQ ID NO: 15411 - DNA, 101 bp, rice(Oryza sativa)
  misc_feature (71): n=a or g
tgtacttacccataggacggcgaccatgtcttcctcctccagcctctcctctccttccagccccaacaagncgtccacgaaatcgccgtcgccgtcgcagc

SEQ ID NO: 15412 - DNA, 101 bp, rice(Oryza sativa)
  misc_feature (71): n=t or g
cctagcaagccagctttcgtcgttagaaattgcatattttcgtgcagtccaaccaaaccaagatggcccgnacgcaggttctcctcctgctcgtcttcctc

SEQ ID NO: 15413 - DNA, 101 bp, rice(Oryza sativa)
  misc_feature (71): n=t or c
tcgctgctgtaagggttgtcctgcgaaggccggtggtccttgctggatacatggatgacacagaggtcttngatgcccctgtcttcagctttcagttcctc

SEQ ID NO: 15414 - DNA, 101 bp, rice(Oryza sativa)
  misc_feature (71): n=t or c
tccagaatatttggtaatgtttcggattttccatattcgtgtctccgagagtatcgctcattgccgttttnccgaccgttaccgcatcgctttaaatacta

SEQ ID NO: 15415 - DNA, 101 bp, rice(Oryza sativa)
  misc_feature (71): n=t or c
atattctgtttatttctgtgacctctttcatcccaccctttaagccactcattgaggaattttacatgctnggaattaccacaaacctgatcaaccaagat

SEQ ID NO: 15416 - DNA, 101 bp, rice(Oryza sativa)
  misc_feature (71): n=a or g
ccttccctcgcgtggaggaggaatcgagaaccctagaatccaaaataaaaaaagaactcacgaattcgcanattaaaccgccgatcgagccatcgaaatgg

SEQ ID NO: 15417 - DNA, 101 bp, rice(Oryza sativa)
  misc_feature (71): n=a or c
gaactcccctccgcgcgcgcgtggggcacccctcacctcactctcactcaccctcttcttcctcctcacgnctcacaccgctcagtgacctcgcaaaccag

SEQ ID NO: 15418 - DNA, 101 bp, rice(Oryza sativa)
  misc_feature (71): n=a or g
cttcgaatctaatggcttcccatgtcccttgaggaggaatccttctgatcacttcctgagaatgattaacnaagactttgaggtataaaatgaatatagaa

SEQ ID NO: 15419 - DNA, 101 bp, rice(Oryza sativa)
  misc_feature (71): n=t or c
cccaccaccatcccgcctgatttgcatcctccaccagctgaagccggcagcaaagtcagaaaggtgtttgntgttgttggaggcttggagcgcgcgcgggc

SEQ ID NO: 15420 - DNA, 101 bp, rice(Oryza sativa)
  misc_feature (71): n=a or g
gttggtaaccatgattggtttccattggaaacaccgtgcacagggtagtacagctagagcctatagagagntttgcacctttttgctgggccctgggagtg

SEQ ID NO: 15421 - DNA, 101 bp, rice(Oryza sativa)
  misc_feature (71): n=t or c
gttccaactccaatgaagtatccaacgaacagcagccagaaatcagccttgacaagcgcctcactgaactngaagtcctcccctctcctcggccgccgcct

SEQ ID NO: 15422 - DNA, 101 bp, rice(Oryza sativa)
  misc_feature (71): n=a or g
aggtcacatggctggtattcttcctgataaaacacttcaacatattttttttgcctcgattttctagcatnttcctgttggttttaaaatttggtgacatc

SEQ ID NO: 15423 - DNA, 101 bp, rice(Oryza sativa)
  misc_feature (71): n=t or c
gttcgaggaatacgcccggggagaagaggaaaacatgcggcggagagtggccaggggcatgccccgctgcncccacgtgcgacggaggcgcaaggggcttc

SEQ ID NO: 15424 - DNA, 101 bp, rice(Oryza sativa)
  misc_feature (71): n=a or g
acgccgatattctcgatctcaagcacacagtgctactcgccctcgatcgggtttgagctcgagtagatccngaggggcacgcttaaaggcaacctcgtccc

SEQ ID NO: 15425 - DNA, 101 bp, rice(Oryza sativa)
  misc_feature (71): n=a or g
atttgtgtttagcattgcaattagcagaaattgagggacattgccaagaacaccaacgcgtcatcggattncaaaagatcaaaacagcctgtttattagaa

SEQ ID NO: 15426 - DNA, 101 bp, rice(Oryza sativa)
  misc_feature (71): n=t or c
gagaagctaaaatgcggatagttgaaagagtaggtaatgaggtaaattatgttataccaaaggtttgggtncattttgtcttttcctcgatgaccctcatt

SEQ ID NO: 15427 - DNA, 101 bp, rice(Oryza sativa)
  misc_feature (71): n=t or c
ctcctcatgaaaatctcgactaaactcgaaatcctaacttcttcacaattcgatgctctcaaaagcgatancgggaagcctcacactccctctctatttat

SEQ ID NO: 15428 - DNA, 101 bp, rice(Oryza sativa)
  misc_feature (71): n=a or g
taccgaggaagaataacagaaatagttatatgtgaatgaattgctaaatcctgggacaaaggaatggaatnaaaggcttgttcggcatgtcatgaaggaag

SEQ ID NO: 15429 - DNA, 101 bp, rice(Oryza sativa)
  misc_feature (71): n=t or c
aatcaacgcgggccgtgaatttaggtgatctcaccggcaatttagcacgcctatctttaaccttcaccttnatgcatggctttactttcactggttcacaa

SEQ ID NO: 15430 - DNA, 101 bp, rice(Oryza sativa)
  misc_feature (71): n=t or c
aacttacgtgaaattctgcctctcaggttgccattctgaacgtattcgaagacgagatacaattgcgtganggtggaatcgtcgagattgtattcgaagca

SEQ ID NO: 15431 - DNA, 101 bp, rice(Oryza sativa)
  misc_feature (71): n=t or g
gtagctacaaccaaatattgaaaatcaaacctttccaaaagagtacaagccaaatattgctgtgtgtgganattatgggtaccccatacccacacggcatg

SEQ ID NO: 15432 - DNA, 101 bp, rice(Oryza sativa)
  misc_feature (71): n=t or g
aacaacaacctggtaaatgcacggttttcaggcgagagatacacaccagtacgcatatcagaactgtgacntgtttgtccagtgctaataaaaccattaat

SEQ ID NO: 15433 - DNA, 101 bp, rice(Oryza sativa)
  misc_feature (71): n=a or c
cgaatttataaaaggaggaaaaaaaagggtaagcgaggatgaaatcgaccggtacaaatggatcaagaacnggaagaaaccgctgagatctgctaggaaaa

SEQ ID NO: 15434 - DNA, 101 bp, rice(Oryza sativa)
  misc_feature (71): n=a or g
cggaggaaccgtcatcatggtagaccaacggaacaagtctcagcgaggccatctgataatcaaaatcaccncggggccagagaatttacagttgggagaca

SEQ ID NO: 15435 - DNA, 101 bp, rice(Oryza sativa)
  misc_feature (71): n=t or c
ggtgacacggtttatgttagcagcatgcgctgccgcgtccatcgaggcttgcccagaaagaatgtgaatgncgtgccgccactgttgatctcctcgggcca

SEQ ID NO: 15436 - DNA, 101 bp, rice(Oryza sativa)
  misc_feature (71): n=t or c
gactttcactgtcacaaccgcctaaggaaccaacctatcagtgcctgaccgaagctggaggcctactaganaggcccaggtttgtgttcggccgaacccta

SEQ ID NO: 15437 - DNA, 101 bp, rice(Oryza sativa)
  misc_feature (71): n=t or g
tgcaacactctaacaacctgagcttcatcagtgacttctacctcaggagcttcaacccctgtggcagcagnctgagaggattgaccactaacccctatggc

SEQ ID NO: 15438 - DNA, 101 bp, rice(Oryza sativa)
  misc_feature (71): n=t or g
cgatcaccgcactatacacaatacgaccattagctattactagctagctatatatccctcccttgtttctntcgagcaagagcgatggaaacggcgccggc

SEQ ID NO: 15439 - DNA, 101 bp, rice(Oryza sativa)
  misc_feature (71): n=t or c
ccttgcatgataaatatcgatctcaataattctgtaggtacaccataaggctttgggcatcgctagcaaanaggacggcttgcgaccagctaaaccctaac

SEQ ID NO: 15440 - DNA, 101 bp, rice(Oryza sativa)
  misc_feature (71): n=t or g
cacgaaccagaacagtgttgttcgtatcgatgccattagacagaatggcccaaccagcacgtattacggtnccatcgacgacatatgggaacttaactatt

SEQ ID NO: 15441 - DNA, 101 bp, rice(Oryza sativa)
  misc_feature (71): n=a or c
tgttgcacgagatcatcccaagcaccccctcccccctgattaccaggatgtcccagttgccaaatatttcnatcatctgggtcatcagcattatcctcatt

SEQ ID NO: 15442 - DNA, 101 bp, rice(Oryza sativa)
  misc_feature (71): n=t or g
aatcaatgaagttccacatcactattgcgttaacgacttaccctacttctgtctggatgactgcaacgtanaccacatatgcgtgtgagtctggagctcct

SEQ ID NO: 15443 - DNA, 101 bp, rice(Oryza sativa)
  misc_feature (71): n=t or c
cctagatacaaatatccttcctagtggcctcccctacggttttccggtactaatacccttctagccatccntggtttcagaaataattgctttttgttaac

SEQ ID NO: 15444 - DNA, 101 bp, rice(Oryza sativa)
  misc_feature (71): n=t or c
gccccatgattgcagccagcaaggaacctttgaactcacactatcgagcaacgacacctcagatcccctcntgtcctcctcccccaacggcaccaaccggt

SEQ ID NO: 15445 - DNA, 101 bp, rice(Oryza sativa)
  misc_feature (71): n=t or c
aaagaaaaagaaaagtgtactatatataggcaacagtaattacagtatgaaatttggagtaatacactaanactccctctaacccataatataagacgtga

SEQ ID NO: 15446 - DNA, 101 bp, rice(Oryza sativa)
  misc_feature (71): n=t or c
caggtgaggccggtgacgataagcaccgacggcatcccgacggggaggttcttcatccccttgaacacggngaggagccccgacgcctcaccctcgttccg

SEQ ID NO: 15447 - DNA, 101 bp, rice(Oryza sativa)
  misc_feature (71): n=a or g
ctccttgcctcgttgtcgtctacaccatcacctcacctcgcttgtctccctgtgccggtcgcttgattccnttggccggaattttgttgcactttattcta

SEQ ID NO: 15448 - DNA, 101 bp, rice(Oryza sativa)
  misc_feature (71): n=a or c
cagagagcaccaaaggagagagagagagagagctggttaggtagtagtagctgcttacggagaaggggttntcgtcggcgccctcgtcgaaggggttgggg

SEQ ID NO: 15449 - DNA, 101 bp, rice(Oryza sativa)
  misc_feature (71): n=a or c
cgagactgatctcgtgtcctgtttagcatgccgtttgattgtttttctcgtgatgtatttcctcctcctcntcgtgatgcgtaatttctatctcgatcaca

SEQ ID NO: 15450 - DNA, 101 bp, rice(Oryza sativa)
  misc_feature (71): n=t or g
aaccatctccatcaagtaagcacaggagcgttcacgaatcgtcgattagtgagagagaaaatcgcaacagnctaatgaaggaatcagtggtggtgcgccgt

SEQ ID NO: 15451 - DNA, 101 bp, rice(Oryza sativa)
  misc_feature (71): n=t or c
gaaattgatcgctccgacgacgtagtactgatctacgtacacggtgggcttgttcatgttttatctgtgcnaataatgttaattaattggggtacaattct

SEQ ID NO: 15452 - DNA, 101 bp, rice(Oryza sativa)
  misc_feature (71): n=t or c
tgaatatggtctcaccgatcacttacccattttatatctctcctcctatggacctacatctttgaatattnctagcattgaggtcaaattatatagctaca

SEQ ID NO: 15453 - DNA, 101 bp, rice(Oryza sativa)
  misc_feature (71): n=t or c
caactctgcgaggttgtaacccgtaaaaacaaagaaaaacgcatcgccgtcaagagttggcagctcctcanaacacacaatagagaagacactagcaccaa

SEQ ID NO: 15454 - DNA, 101 bp, rice(Oryza sativa)
  misc_feature (71): n=a or g
tggtggtattttagttggctgaaacagttcagtttttgggggatcaggtattgtaattgaaaggtttgctnttaagattactttcacctcatatcattctg

SEQ ID NO: 15455 - DNA, 101 bp, rice(Oryza sativa)
  misc_feature (71): n=t or c
ggtttaacaaagaggatgggatcgatcgatcgatgagaatgagatcctcctctacctgcgacgtcctggcngtagtacttcccgcggaagagcgtgccgtg

SEQ ID NO: 15456 - DNA, 101 bp, rice(Oryza sativa)
  misc_feature (71): n=t or c
cagggggacacacatgtgctgatcaacgaaaatgtcatgctcttcttgtcttgatgctcagccaaacatgntgggaagaggccttattgccatgaaagcat

SEQ ID NO: 15457 - DNA, 101 bp, rice(Oryza sativa)
  misc_feature (71): n=a or g
ttatttttttgctcttgtgtagaaatggtttctttatgagaaatagtttcatctttttacctctcaccatngcacatcagatttttgtttatgtgacaaat

SEQ ID NO: 15458 - DNA, 101 bp, rice(Oryza sativa)
  misc_feature (71): n=t or c
tacccagctttgtgcaatgtagtcttgagcttgctgtcccatcttgcatctatgattttccaaatatgacnatatttcttctcatttccatttaggcatgc

SEQ ID NO: 15459 - DNA, 101 bp, rice(Oryza sativa)
  misc_feature (71): n=t or g
aaacgggggccaatcaaccggctccaaacaagacccatgaatttactacagtatctgctgtccttctttcncagtgacagaaataattgagagacactaat

SEQ ID NO: 15460 - DNA, 101 bp, rice(Oryza sativa)
  misc_feature (71): n=t or g
gttctagcagaaatcaattggtgatattcaaactctgcttccggaagaggtagggaggcaatgttgtgctnaatatctattatcaccaaccattagattcc

SEQ ID NO: 15461 - DNA, 101 bp, rice(Oryza sativa)
  misc_feature (71): n=t or c
atgtagctaggcagagtaaagtagaacatttgtaccatgtacctatttgttaaaacaagtgccttcgaganattgcagcggaattgggtaaccacaagcga

SEQ ID NO: 15462 - DNA, 101 bp, rice(Oryza sativa)
  misc_feature (71): n=a or g
tgagatccatagctgggccagactgaaatcaccagatgttgcaatcgttggttgccacaaattgattgtcnctttggttccgtagtagttagcatccccag

SEQ ID NO: 15463 - DNA, 101 bp, rice(Oryza sativa)
  misc_feature (71): n=a or g
tgatgccgatgttcgtctgggttttgctgctagcacacgtcacctgctgaacaatgtgctgccttcagtcnacggctactacggtaactgtgtctaccctg

SEQ ID NO: 15464 - DNA, 101 bp, rice(Oryza sativa)
  misc_feature (71): n=a or g
tctatttttaaaagaaaagctttttgattaaaagaggtgagattaaaagagtgagcaatttgctgagcaancacaatattattagagatgcgtctcccctt

SEQ ID NO: 15465 - DNA, 101 bp, rice(Oryza sativa)
  misc_feature (71): n=a or c
gtctagcttacattataactgtgtgcaaacaacagcacaaaatcacatttgcattcctactagcatgtcanacagaacatccaagacccaatcacacaact

SEQ ID NO: 15466 - DNA, 101 bp, rice(Oryza sativa)
  misc_feature (71): n=t or g
ccaggactgtcagaaatttggaactattcagaggacaccagcatcggctacgaatccgataatcaagccanggccgttcagaggttgggggatcgacatga

SEQ ID NO: 15467 - DNA, 101 bp, rice(Oryza sativa)
  misc_feature (71): n=a or g
cgtatctatgcctttttctcctcctccatgggtgtgacaagacaagaacgaaggcaggaggaaggagaagnagaagatggtatgcttggttggaaccttct

SEQ ID NO: 15468 - DNA, 101 bp, rice(Oryza sativa)
  misc_feature (71): n=a or c
atgacaatctcttgagttttctgcagctctatgattctggacttcagctcctcgatttcagtttggagagnattgttttctgatatcaaatttacatactg

SEQ ID NO: 15469 - DNA, 101 bp, rice(Oryza sativa)
  misc_feature (71): n=a or g
tggaattcgtggaatctatctctaatagacccacagctggttaccagagtttccaaagagccttctagtcnttttgaaatgtctagcagggttgctttcac

SEQ ID NO: 15470 - DNA, 101 bp, rice(Oryza sativa)
  misc_feature (71): n=t or c
atttccatttctcacagtagcatgcaaggcattgtggccatatgttccaacatggctagatccaggaattnccaacagtttctcagaaacatctgtaaaat

SEQ ID NO: 15471 - DNA, 101 bp, rice(Oryza sativa)
  misc_feature (71): n=t or c
gagatccaggattgcctgagaaggaagcagttcgataaggatactatcgagctgatcaagacggctgatgncgggagggctaaaatctataagcctccact

SEQ ID NO: 15472 - DNA, 101 bp, rice(Oryza sativa)
  misc_feature (71): n=t or c
ggagcggttcttctctcaactttcccagtctcccatatcttgtttttcgtgtacaagcctccaaaactatnagtagacggtaccattttttgcgaaaattt

SEQ ID NO: 15473 - DNA, 101 bp, rice(Oryza sativa)
  misc_feature (71): n=t or c
gtgagcacccagtcgccgttgctgggtagccaggaaaatactctcaggtggtcgtcgttgctcacgccgangatacggagctcgccgccgccatcgtcgtc

SEQ ID NO: 15474 - DNA, 101 bp, rice(Oryza sativa)
  misc_feature (71): n=t or c
gtcatgcaaacaaaaatggaggtagtaatatggaagaaaaaattttaaaacacgtttatgttcagaggtcntcgcatgatgccccattatcggctagcttc

SEQ ID NO: 15475 - DNA, 101 bp, rice(Oryza sativa)
  misc_feature (71): n=a or c
ttcaggtacagctgatgctgtcattgaactgaataccatctgatcttacagggtcacactccaagaagtcnagcgactttctcgacagcaagtccgtcccg

SEQ ID NO: 15476 - DNA, 101 bp, rice(Oryza sativa)
  misc_feature (71): n=t or c
aaaatagtgatattagctgttgttttaacgcaaacttccaaagcaggccgctttactaaatgttattactntgtgataccattactttcaagtttcaacta

SEQ ID NO: 15477 - DNA, 101 bp, rice(Oryza sativa)
  misc_feature (71): n=t or c
atggagatgcttctccggtctccaagatatttccgccgccgatgaggctatcgcgattggctcagtgaagntgcagccaccggagaagccatggcgccgcc

SEQ ID NO: 15478 - DNA, 101 bp, rice(Oryza sativa)
  misc_feature (71): n=t or g
cgcctacggaaatgggaagaccgtgcaagatttggagattgctactacgtccgatattttgcaaaacatcngacgatgttttgctatattgttgcaagatg

SEQ ID NO: 15479 - DNA, 101 bp, rice(Oryza sativa)
  misc_feature (71): n=t or c
ggaattggctggtctggttgccgatagagtaaccttaaggataaacgacacggggtcggcttcacttcacnagtgactccagatttgaaattggtcggcag

SEQ ID NO: 15480 - DNA, 101 bp, rice(Oryza sativa)
  misc_feature (71): n=a or c
tgagggtctcagccgatatagttagaccagattggctgtatactggataggataaagcatgaaaaaaaaanccttaataagcttattagctgtaatattgt

SEQ ID NO: 15481 - DNA, 101 bp, rice(Oryza sativa)
  misc_feature (71): n=a or c
cagcgtggagactgcatgcacctcaactattatgtggttgtcccgttcgttggatctcctctacgcgcctncgcctctatcgtcggcgtcatcttcgcccg

SEQ ID NO: 15482 - DNA, 101 bp, rice(Oryza sativa)
  misc_feature (71): n=a or g
ggccggtgtgttcccggaagcatgagcccgcagaagtcttcaaagcattaatgagggaatgacaggggatntcccccgtgtcagttaggagatggctctgg

SEQ ID NO: 15483 - DNA, 101 bp, rice(Oryza sativa)
  misc_feature (71): n=t or c
accaggctgttactaaaatcaccacagaagacagttactcaatcacaggaagcctttcgaagctaatactnggggcagtgggtgtgctctttgtgttgggg

SEQ ID NO: 15484 - DNA, 101 bp, rice(Oryza sativa)
  misc_feature (71): n=t or c
tcatctcatactgcttccgtgcatttttgttccttttctgtacaggttgaatattcttgctgagctcctcngttttggtgatcgtgaattctacaaggact

SEQ ID NO: 15485 - DNA, 101 bp, rice(Oryza sativa)
  misc_feature (71): n=t or c
ttcgataaaacaaaaactccacaccaagaatattcttgaagttaaaactttggtgccaatgattttgttanatatttgtcgacaaaaattcttaaatatac

SEQ ID NO: 15486 - DNA, 101 bp, rice(Oryza sativa)
  misc_feature (71): n=a or g
tagctgtttagcagtgttttaatttgggtacaagattacagattctaactggtcacgtgctcaattttctnttattaatgaactgcggttgacaatgagtg

SEQ ID NO: 15487 - DNA, 101 bp, rice(Oryza sativa)
  misc_feature (71): n=t or c
tttttaatttttttagaggatatgctctcaagagatgaaatcacttttccatatatacctgccaaatcatncatccattgggatgttccggtgttgcagac

SEQ ID NO: 15488 - DNA, 101 bp, rice(Oryza sativa)
  misc_feature (71): n=t or c
agtagggagaccctggtacgtggattgccattgttgacgcaggtcgatcaggtttgcgaggcgtgtctcgncgggaagcatcgacgggcgccgttcccacg

SEQ ID NO: 15489 - DNA, 101 bp, rice(Oryza sativa)
  misc_feature (71): n=t or c
tactccagagcggcataactttgcatgatcgatgcactttgcttaggaagcaacggtgacaatttcagctncattggtgcagaagcggtagcacgcttcgt

SEQ ID NO: 15490 - DNA, 101 bp, rice(Oryza sativa)
  misc_feature (71): n=a or c
tgaccataatagagcacacgtccttggaattccaatttcgagatccgagtctccgagacaagaacattgcngcagcagaacacgcgagaaaattaagcaaa

SEQ ID NO: 15491 - DNA, 101 bp, rice(Oryza sativa)
  misc_feature (71): n=a or g
ctacgcacggcttcatcgaccacggctctttcggctccttcattttggctacgtcgacaatggcacaaagngctatcatccgtgttgagcactcttgccgg

SEQ ID NO: 15492 - DNA, 101 bp, rice(Oryza sativa)
  misc_feature (71): n=t or g
gagttgatgaccaccaccaccacatgctcgacagcgaccgcctttcaaactttttagtgatcatctaccgntggtcggtggttcgtgtcgtcactggagta

SEQ ID NO: 15493 - DNA, 101 bp, rice(Oryza sativa)
  misc_feature (71): n=t or c
atatatattgtgatgtcttcacgcatgagttggttttgctgcttggaatatattgtactcctgtttttttnaaacagtaaattgatgatctgggttgggtt

SEQ ID NO: 15494 - DNA, 101 bp, rice(Oryza sativa)
  misc_feature (71): n=a or g
tattttgccactttaaaaagttttaagaccagaatacctctgctatggacagagaggaatgtgagcgcctnggagaaggctgagctagtgctcgccggtgg

SEQ ID NO: 15495 - DNA, 101 bp, rice(Oryza sativa)
  misc_feature (71): n=t or c
atggtgcacgtagaggaaaggttgagcttttgccggtgggttctcggtgatgtcgttgcaacttggtttgnggagacgcgggaaggccaccaatctatctc

SEQ ID NO: 15496 - DNA, 101 bp, rice(Oryza sativa)
  misc_feature (71): n=a or g
tcttatccacaaaactgaaagtagcagcggtacagctcactagatatcccccccccccctaattttgacanttctccgtaataatttttgggactacctat

SEQ ID NO: 15497 - DNA, 101 bp, rice(Oryza sativa)
  misc_feature (71): n=a or g
agcaatacaagctgagtacgataaggctttcgtagccgctgctcaagcccaacaacaagttcaagttgtcnaaccacctcctctcgttgttcgccagcccc

SEQ ID NO: 15498 - DNA, 101 bp, rice(Oryza sativa)
  misc_feature (71): n=t or g
tcttgtcccccagaaatttcttcctaattgccatctaccagtcatcctcgtctttaatttacatccatgcngagaagtttcctgtatagacatatcgctag

SEQ ID NO: 15499 - DNA, 101 bp, rice(Oryza sativa)
  misc_feature (71): n=t or c
ttcctggtctcgtccagagaggtggatgctcaaagcgtacgagtttggaggattggtgctgccaaactcantccaatgagttttcaacttgttacagttat

SEQ ID NO: 15500 - DNA, 101 bp, rice(Oryza sativa)
  misc_feature (71): n=a or g
gactctttggtttgagttccgactttttgaaggtttacattctggcgtttggcgatctaggaagacactanttaattaataagaacgaaactaatccatag

SEQ ID NO: 15501 - DNA, 101 bp, rice(Oryza sativa)
  misc_feature (71): n=a or c
ttcacgcctctcctactgcacattgcacctcgagtccagaggctgagagagctcacggggagaagcaaacnaaaagcccaaaggacttttctaccatggcg

SEQ ID NO: 15502 - DNA, 101 bp, rice(Oryza sativa)
  misc_feature (71): n=a or g
ttttggaagtgactgcggatcgggcgtccgattttagcttccacccacgcatcaattgagatttcctaccntactgcagacgacctgcatcccccacgcat

SEQ ID NO: 15503 - DNA, 101 bp, rice(Oryza sativa)
  misc_feature (71): n=t or c
gtttaattttagtggggatttgttgtagtatttgatgtgacgtatttatgcactgcttctaatagtaagcncttgtttagttccaaactttttctttaaac

SEQ ID NO: 15504 - DNA, 101 bp, rice(Oryza sativa)
  misc_feature (71): n=a or g
acatctaatttcaactatgctctggaagaaacactgaaagagttaggaagcttacgggtattagtgctccnccatcctgctggtgttctgccaaacaacat

SEQ ID NO: 15505 - DNA, 101 bp, rice(Oryza sativa)
  misc_feature (71): n=a or g
cgtggaatgagcctttaatcagacatatagtccaggaaaatgatgcatctggaattctgaagatcaaaatncctagaagggagatgacggactttccagca

SEQ ID NO: 15506 - DNA, 101 bp, rice(Oryza sativa)
  misc_feature (71): n=t or c
gatatcattcagtataatagcacgtttttgttaaccaaactataatgttttctattgggcaggtcaacacngttgcaagttattcatattttgggaaactt

SEQ ID NO: 15507 - DNA, 101 bp, rice(Oryza sativa)
  misc_feature (71): n=t or c
agggtgggaggacggtcgtaaggagggaaagaggagggttttggtgggaggggaagatgagggttttccanaggcctagagggatggcttgggcagcggcg

SEQ ID NO: 15508 - DNA, 101 bp, rice(Oryza sativa)
  misc_feature (71): n=a or g
cagttaattgcagcttatttgcgggctccagatatgtggtgattgcttgtgttcgttgatgcgctgtatancatacatgcatgttccatcgatccattgta

SEQ ID NO: 15509 - DNA, 101 bp, rice(Oryza sativa)
  misc_feature (71): n=a or g
aatgattgcatgctgtactggaaagaagatatagatgctaaatcctgcaaggtttgtggatcatctaggtngaaagaagaaaaacacacaggggaaattaa

SEQ ID NO: 15510 - DNA, 101 bp, rice(Oryza sativa)
  misc_feature (71): n=a or c
attatattcctttcattccaaaataaaaataacattttatactatgtttgtagggagtattccctccgttnaaaaaaacctcaaaccctagtatcccaata

SEQ ID NO: 15511 - DNA, 101 bp, rice(Oryza sativa)
  misc_feature (71): n=a or c
cacactcgggcgatggtttggggaggcagcgttgtgaccatcggtcacaaggtttcccccgagcacgtgtnggcggcggatgggatggacggcgatgaggt

SEQ ID NO: 15512 - DNA, 101 bp, rice(Oryza sativa)
  misc_feature (71): n=t or c
tgtttgctatgtggatgcaaaggcgacttcattactttatgggactttggcatgatttcagtttcatctcncatttcattagtgataatctgtatgcttta

SEQ ID NO: 15513 - DNA, 101 bp, rice(Oryza sativa)
  misc_feature (71): n=a or c
cgtgaccacagttctcacgagtaccatcgaagcaacttgaagagctcacacaggaatagccattcccttgnttgacatgctgtccagaatgtcgttcagcg

SEQ ID NO: 15514 - DNA, 101 bp, rice(Oryza sativa)
  misc_feature (71): n=t or c
aggatcattcatgcacaaaacgccgttggaaggaaaaataattctagaccgcattctagaaagtacctccntcatggcacagtctgatgaaccccctccgg

SEQ ID NO: 15515 - DNA, 101 bp, rice(Oryza sativa)
  misc_feature (71): n=a or g
taaccctttcaaaagaggggtaagttgagagaaaacggatgatatgccactctctaacatcggttcggatnaaatgccactttggagacttttatgcccaa

SEQ ID NO: 15516 - DNA, 101 bp, rice(Oryza sativa)
  misc_feature (71): n=t or g
aggagttggttgagatggatctgttggagaagaagaacattaagaaggggggagaagtggaggaggaggtngcgcgcaagggagaggagaggaaggaggaa

SEQ ID NO: 15517 - DNA, 101 bp, rice(Oryza sativa)
  misc_feature (71): n=a or g
ggtcctaattcaagtgactggccaaaaaaaaaaaaagaaagaaatcatgattcaatcatttgtggtcacantcaaagttcaggcaatttatgaaatggagc

SEQ ID NO: 15518 - DNA, 101 bp, rice(Oryza sativa)
  misc_feature (71): n=a or g
ctctctatatatatatatatatagacacacacaccaacaacctagaccatacacatggtccgaaatctcancgcagcctctaaccacctcacccaaccctg

SEQ ID NO: 15519 - DNA, 101 bp, rice(Oryza sativa)
  misc_feature (71): n=t or c
ctacgaccgagctggatctagagaggcaaaagttagccaatcttcccaatgctgtcgaagaacagaaatcnagactgaaatcgactatcaagaatgtggct

SEQ ID NO: 15520 - DNA, 101 bp, rice(Oryza sativa)
  misc_feature (71): n=t or c
actctgcacatggtacttgatgcaccgctatactgaggtgatatgcatcagcttgttcggatcgaccttgncagccttctcgatgtacaccgtccagcctt

SEQ ID NO: 15521 - DNA, 101 bp, rice(Oryza sativa)
  misc_feature (71): n=a or g
ccaggattggaagaagaagcaggggccggaaaatcactttgttaaagtgactggaactgatacccctcctnctgatgctcccatggaggttgatcccaaga

SEQ ID NO: 15522 - DNA, 101 bp, rice(Oryza sativa)
  misc_feature (71): n=a or g
actgtgacagctaaaaatatggtggagcaaagtgtggtcataaaccaaacaccccgtaaagtgtggtcatnaaccaaacaccctgtaaagtgtggtcataa

SEQ ID NO: 15523 - DNA, 101 bp, rice(Oryza sativa)
  misc_feature (71): n=a or g
agccagtgggatttccgaaaattttcaaaacgaacttcttgaattttgaaatgatttccactgaatttgancctaaaattttctggaaataaaatgttttg

SEQ ID NO: 15524 - DNA, 101 bp, rice(Oryza sativa)
  misc_feature (71): n=a or g
tcatacacgtcgcgacttggttgcgcttgcgcgccctcctctctactttatgatatactccctctattttntaatggatgaagccattgatttttgaacag

SEQ ID NO: 15525 - DNA, 101 bp, rice(Oryza sativa)
  misc_feature (71): n=t or c
ctcggaggtgttcacgattccccaatttgtacccagcattacagagaaacattttttttaacgactcgcancaaacaatatgaaattcatattgatatacc

SEQ ID NO: 15526 - DNA, 101 bp, rice(Oryza sativa)
  misc_feature (71): n=t or c
gcctcgtaggcatgctttgctagttttgatgcagtagatgctgcactatggacaagggcccgaaagctatntcctggatctttctttgatctctcatggct

SEQ ID NO: 15527 - DNA, 101 bp, rice(Oryza sativa)
  misc_feature (71): n=t or g
aaaataaacggagattcatcggagagaaagaaaatgctgggatttttttacctcggtttcatgcttcggangcagcgtttctttggagtcctccgccggct

SEQ ID NO: 15528 - DNA, 101 bp, rice(Oryza sativa)
  misc_feature (71): n=a or g
ttatacacttggtcaggtctgctgatgtagataccgcagggcttggtcttcagttcctagaactggtgagnaaatctttaccatattagctatctctgttt

SEQ ID NO: 15529 - DNA, 101 bp, rice(Oryza sativa)
  misc_feature (71): n=t or c
taagaaaatatgtcaataatcatctactagagcgttttagaagtgctcatctctaatatactccctctttnccaaaatgtttgacgccgttgactttttta

SEQ ID NO: 15530 - DNA, 101 bp, rice(Oryza sativa)
  misc_feature (71): n=a or c
caaccttggacgcatttttcactgccagcgttagcgcaagaacgacctttgtagggcttatctttcttagntttcagcttgggaagagcatcatagtttat

SEQ ID NO: 15531 - DNA, 101 bp, rice(Oryza sativa)
  misc_feature (71): n=t or c
gaaaaacaaggtaattaactaaaaatggtgcaaagtgatcgatcgagagtttgtcttcacgtccttttctnttgcttcaaatacgtttcagtaccaagcat

SEQ ID NO: 15532 - DNA, 101 bp, rice(Oryza sativa)
  misc_feature (71): n=t or c
gcgactcggcgagcgaggcggtgaagttgcggaagtagacgcggagacggagattggagggaaaggttagnattcggccacggattggctcgctttccggg

SEQ ID NO: 15533 - DNA, 101 bp, rice(Oryza sativa)
  misc_feature (71): n=a or c
gtacaatgctaatgcgtgtggctcacctaacagcgccaacaaatgcctaacccatgtaatttgtagagaanacaatgcgttttctgcaaaagtggcgccca

SEQ ID NO: 15534 - DNA, 101 bp, rice(Oryza sativa)
  misc_feature (71): n=t or c
atgaggatgttctctatctgaattggtgtccttctctttaactgcagttctgcagtcatgagacagcacantttcaccatcatggtacaaatcatgttcat

SEQ ID NO: 15535 - DNA, 101 bp, rice(Oryza sativa)
  misc_feature (71): n=t or c
tatttcctctctcctcctccacctacttactacctatatacgttgtatatgttgcaatagttaaagcccanaaatgtgggtcccatctatatagactgtta

SEQ ID NO: 15536 - DNA, 101 bp, rice(Oryza sativa)
  misc_feature (71): n=a or g
tgtggattcacttagaggagacatgccagactacagctatctggttcagctggtaaaggaagtcagggatncattgtatgagatggttcctaaaggttgga

SEQ ID NO: 15537 - DNA, 101 bp, rice(Oryza sativa)
  misc_feature (71): n=t or c
aaacccgatcgatcggtgatctgcaccgtccatcgctccacacccaattccctccggccacaccgtatcgnatcgcatcgcatctcggaaaacggcatatc

SEQ ID NO: 15538 - DNA, 101 bp, rice(Oryza sativa)
  misc_feature (71): n=a or g
gtctgatcaccaccagaagacttctgcatatcgaaggtataaacctgttgcatctcaactcccaaagcctnctccaccatggtgcgaaaatccaccaccgg

SEQ ID NO: 15539 - DNA, 101 bp, rice(Oryza sativa)
  misc_feature (71): n=t or c
ctgcaagctgagatgacccggtttcttcgggttgttcctcttcctcttcgtcactttgtccatctccttcntccccttcctcatgttcttcctccccttca

SEQ ID NO: 15540 - DNA, 101 bp, rice(Oryza sativa)
  misc_feature (71): n=t or c
agattgcgaaatgaactaaagtctggcattcagtattggtctctagagagaaagctttgccaagcattgtngagaaatgacaaggtacttagagccatctc

SEQ ID NO: 15541 - DNA, 101 bp, rice(Oryza sativa)
  misc_feature (71): n=t or c
ggtgtcaatctgagtccactatgtagcccagctgatgtgtcttacaccatcctcccaaacatggcttactntgagttcataccattagaggacggcctcag

SEQ ID NO: 15542 - DNA, 101 bp, rice(Oryza sativa)
  misc_feature (71): n=t or c
tcgtctcctcctaagggtggaggacatcgagtgtcagcgatggtggaggaagctgaggaggctgttgccgncacctgggtcgttgtggagattatgggtac

SEQ ID NO: 15543 - DNA, 101 bp, rice(Oryza sativa)
  misc_feature (71): n=t or c
cggacctagatcacaacgggagcagcaaaaatcattgagttaatctctgcaggagagtagtgcctttctgntttatttttttgggtccgattttcagtctc

SEQ ID NO: 15544 - DNA, 101 bp, rice(Oryza sativa)
  misc_feature (71): n=a or c
aattaaatgcaaaaaacacatcagattaatatcgttgaattaaaagagatagcaagtgtcacaaacctagntcagattttgcaaggcggacgtagagctcc

SEQ ID NO: 15545 - DNA, 101 bp, rice(Oryza sativa)
  misc_feature (71): n=a or g
cgcgcatccgacttatgtcgcgtgtttgtaacactcccgcgttcccatcatacgggagaggtatatttttncaaatcatttccatacatatatatatataa

SEQ ID NO: 15546 - DNA, 101 bp, rice(Oryza sativa)
  misc_feature (71): n=t or c
gtatgtgatcacactcagtaatgtcccaaatgataccgggtgtttgttctgacacccggtaacataggagnataccgtgcgctgcagttgcacacacggta

SEQ ID NO: 15547 - DNA, 101 bp, rice(Oryza sativa)
  misc_feature (71): n=t or c
tccacggcagcagatctcgaatagtgatagctcccggaggtgaccctcatcggagcaatccgatttgagangtggcgtacctgcactcacgcagtggcgca

SEQ ID NO: 15548 - DNA, 101 bp, rice(Oryza sativa)
  misc_feature (71): n=a or g
caagccctgatctccatagatttgcccttggtgctcgacggcgctgtcgatcatgaaagggaacaagatangagggtcctttgctctatggaaggctgggt

SEQ ID NO: 15549 - DNA, 101 bp, rice(Oryza sativa)
  misc_feature (71): n=t or c
cacccggcacgcaaaacgttcggctagtatccgatatttccgcgaggaaaaagtatacttgctcccttaantatcgtccgagtacgattcatatcctccaa

SEQ ID NO: 15550 - DNA, 101 bp, rice(Oryza sativa)
  misc_feature (71): n=a or c
gaccgaaattcaaaacaaaccaagttctctcgagtgtcaaacaactcaccgaatcttctgcaatcagcctnatcctgcaacttatgcatgcagagtgaaat

SEQ ID NO: 15551 - DNA, 101 bp, rice(Oryza sativa)
  misc_feature (71): n=a or g
accaacttaccatggccagtgtactctagcgcatttctttcagctctaagatcaagtgtggaacaggattngaaaaaacacatgattattacagttatcat

SEQ ID NO: 15552 - DNA, 101 bp, rice(Oryza sativa)
  misc_feature (71): n=t or c
tatttaccataaaatcatctctaaaacaaaaaaaaaaaagaagcttcctcacttcttttggcgatgtcgcnggaatcgtcggaccacagatccgtccagta

SEQ ID NO: 15553 - DNA, 101 bp, rice(Oryza sativa)
  misc_feature (71): n=a or g
agcttggtggcgtacaaaaagggggcgacggggcgggtctagcgctgactcatctacctcgtccatgactntggccggcgttggccttgagctcccctcct

SEQ ID NO: 15554 - DNA, 101 bp, rice(Oryza sativa)
  misc_feature (71): n=t or c
aaaatgcagacatatagtcaactctttaagtttgactgactgtagcgactagtgatggttatgctatgagntatatttactcctaactaagctcataaact

SEQ ID NO: 15555 - DNA, 101 bp, rice(Oryza sativa)
  misc_feature (71): n=a or g
ggcaaagaaaagactgctgccatctcgagcaacctagcaaagctcaaggacttgtatggtgatgtaactgngaagaaggacgacggtgaagcccctcgccg

SEQ ID NO: 15556 - DNA, 101 bp, rice(Oryza sativa)
  misc_feature (71): n=t or c
cgactcattccagaccactcgtgatttgctttgccctatgtaatgtttgtgtccatggcgccaatgtgtantgtaactcctgtggcacgtggcaataagtt

SEQ ID NO: 15557 - DNA, 101 bp, rice(Oryza sativa)
  misc_feature (71): n=t or c
gggcgtgacccccttggggtgtcatctacctcccttctcttcttttggtgagaaacaatgggtgaaaacangtcagtctttggatgcacaacaactgtgtc

SEQ ID NO: 15558 - DNA, 101 bp, rice(Oryza sativa)
  misc_feature (71): n=a or g
gcgggcaaccgaacccagccacctgtgaaaattttttttgcaagtacctaggtttaactgaccatatgtgnaaatccaatttttgcatgcggcggattttt

SEQ ID NO: 15559 - DNA, 101 bp, rice(Oryza sativa)
  misc_feature (71): n=t or c
catgattctgaaggacaaaacagtagtagtgaagttaaacaaaaagaaaggacttgctctggcccaattcngtgttctggtgtacataataaatcaataac

SEQ ID NO: 15560 - DNA, 101 bp, rice(Oryza sativa)
  misc_feature (71): n=a or g
actaatgttttcggctgcttcatccacagcttcttctaattcttcaccttccagaaattgctccacatctngatctatagatggcaggtcatcaacagcag

SEQ ID NO: 15561 - DNA, 101 bp, rice(Oryza sativa)
  misc_feature (71): n=a or g
agagaatttggaagatgaagtgtctaaacagaattgaacattttgtacgtaggttggctcacaacttattnaatagtttcacattagttgtggaagggcaa

SEQ ID NO: 15562 - DNA, 101 bp, rice(Oryza sativa)
  misc_feature (71): n=a or g
ctggcgagaagctgatagccgcttcaacccttaggccatttacaatgcaaagacgtagcgttcagcctccncatgccagctcggagattcctctccaccta

SEQ ID NO: 15563 - DNA, 101 bp, rice(Oryza sativa)
  misc_feature (71): n=a or g
aatcaagactgtaggggttcagacagatcttccagggaataacgaatatcttgagcacaagaaagtattgnttgaccgtatctctagcaatctgtgtgcag

SEQ ID NO: 15564 - DNA, 101 bp, rice(Oryza sativa)
  misc_feature (71): n=t or c
tgcctcccagatctccacctcccctcgccacccacattccctcaatttctcacaatacagccttcctctanccctcattgcatccttccctccaatgcaaa

SEQ ID NO: 15565 - DNA, 101 bp, rice(Oryza sativa)
  misc_feature (71): n=a or g
gattttggcccagcccagggaaaagagaggagaacgaacatgtgctgggccaacatgatatgaccaataangaaaaaattgcatatgggccaacatgagct

SEQ ID NO: 15566 - DNA, 101 bp, rice(Oryza sativa)
  misc_feature (71): n=t or c
aaacatagttgatcaatcattaacgctaacaacgggcgcacacttattcctacaaactcacatatgcagancctgtgtcaaatctacaatttaaatctagg

SEQ ID NO: 15567 - DNA, 101 bp, rice(Oryza sativa)
  misc_feature (71): n=a or g
acaaatttagcacctttaagagacaatacaagctatggaagagcctaaagaataagagcggaggtgggtgngacaacaattctagcaccataaggtgcgat

SEQ ID NO: 15568 - DNA, 101 bp, rice(Oryza sativa)
  misc_feature (71): n=a or g
aactaacatttctttgttttgcaggattaaaataaacatgctacctctgggcaaatcattatcaccaactntatctccaagtaatgggccccattcccaag

SEQ ID NO: 15569 - DNA, 101 bp, rice(Oryza sativa)
  misc_feature (71): n=t or c
ttagtggagaaataagcacggatgacgttttctcgctcttgctttctccgcttccttatcgctctctctcnctttcttttctaaataaaaattattttctt

SEQ ID NO: 15570 - DNA, 101 bp, rice(Oryza sativa)
  misc_feature (71): n=a or g
gttgggatacatctatctcttctgagtaacctcttttggattcttaagaccacccttgtagtaggataccntctgctttgggttctttattatattatctc

SEQ ID NO: 15571 - DNA, 101 bp, rice(Oryza sativa)
  misc_feature (71): n=a or g
gaagcatgtgtgtgctgatatgaactatgtcgaccctgtatgcatacaaacgggcaagtactgtactatgnagagcgatgtctatagttacggggtcgtgc

SEQ ID NO: 15572 - DNA, 101 bp, rice(Oryza sativa)
  misc_feature (71): n=t or c
gtcacaaattgttccccttggattgaatatacttgctgatggcattgtgccccagtatatagaaattcccnatttgcaaccctaactgggattgactcaca

SEQ ID NO: 15573 - DNA, 101 bp, rice(Oryza sativa)
  misc_feature (71): n=a or g
tggcagcatgcattgacctgcttaattagtctgctctgccactgaccagctgggacagcttgaattgatcnaattgaagtctagcattttcgatacactag

SEQ ID NO: 15574 - DNA, 101 bp, rice(Oryza sativa)
  misc_feature (71): n=a or g
aggaatcaagacaacaatgttgctctaaattcttcaacaaatggggacgttgaagccagaattggcactancatggagaatactgatgaaccttcagtttc

SEQ ID NO: 15575 - DNA, 101 bp, rice(Oryza sativa)
  misc_feature (71): n=a or g
aacaaatcgtctcgagaaagaggaggaagaatcgatcttttggtggagtttgcaatggtgaagggaggganggaggcgctgctgggcgggtacgagatggg

SEQ ID NO: 15576 - DNA, 101 bp, rice(Oryza sativa)
  misc_feature (71): n=t or c
cccatagaaaaggctggccactgctctccaatccccatgccacctccaagaactcgttggagtccaatgangctaagctcccaaagctcacgtacaacacg

SEQ ID NO: 15577 - DNA, 101 bp, rice(Oryza sativa)
  misc_feature (71): n=t or c
tctgagtcagattccaagagaacagtatcagtgtttgaggttgaaggttcccctgcagccaaacgaaatgnttctgctaactctggatccgcatttgggtc

SEQ ID NO: 15578 - DNA, 101 bp, rice(Oryza sativa)
  misc_feature (71): n=a or c
ccccatcccctctccgccgtctcaacctccgccgattcttcccacccagcaatggcgatggatttggacgngccgctcgacgcggagaagggcgaggcggc

SEQ ID NO: 15579 - DNA, 101 bp, rice(Oryza sativa)
  misc_feature (71): n=a or g
atgagcggaaatgttgccgactcgactgacatggcatagaactgagcatctggaaggtaaggtccacgacnaaattgtgcctgctgatgatattggtcggc

SEQ ID NO: 15580 - DNA, 101 bp, rice(Oryza sativa)
  misc_feature (71): n=a or g
acatctcttgcagatatctttaggggagtagccaagtgtgaaatcaggataggaacaactgctcttttctngaatgatctatggaatgatgattttaaatg

SEQ ID NO: 15581 - DNA, 101 bp, rice(Oryza sativa)
  misc_feature (71): n=a or c
ccttgctattattcccccttttcagaagtatgtgaaaagtatagtgcttctaagccggagatgaggttagnggaccaaggtttataccccaattgagtttt

SEQ ID NO: 15582 - DNA, 101 bp, rice(Oryza sativa)
  misc_feature (71): n=a or g
cttattccaactaaactatagctagcttaactcttccaagaatgtgtccgctgtccacatactacatgccncagaattacgccatgtgttctgtttgctcg

SEQ ID NO: 15583 - DNA, 101 bp, rice(Oryza sativa)
  misc_feature (71): n=a or c
aaatctcgaattcaagccggttcgagaaatctgataaattgcgactagcgagaaatcctgctcaggttccngttcgcgcctgatacacgatgatggcggcg

SEQ ID NO: 15584 - DNA, 101 bp, rice(Oryza sativa)
  misc_feature (71): n=t or g
atggagctactgatcgaggtgtgaaggatacgaacgtggatgcatggatatatatagcgatcgatcgcgcncgctggacggacatacgtgtcgtcttatgt

SEQ ID NO: 15585 - DNA, 101 bp, rice(Oryza sativa)
  misc_feature (71): n=t or c
gcaaatccttaaacacattacctcttgagtaatatttttttaatgcactaaccatcttaacccatcttaanctcaggtcattattataaatgtgtgtcttg

SEQ ID NO: 15586 - DNA, 101 bp, rice(Oryza sativa)
  misc_feature (71): n=a or g
tgatcctgtgccaaccaaatctttatgcaaacacctatgtgatgaatgcacgtaagatatgtcggtagacncaagccatatgaagtttccagcagacagca

SEQ ID NO: 15587 - DNA, 101 bp, rice(Oryza sativa)
  misc_feature (71): n=a or c
aagatgaaaccgtgcaatgccaatgatgccatcccaaggaaacagcagatcacttagggtgtgtttagttnatgtcaaaattggaagtttagttgaaattg

SEQ ID NO: 15588 - DNA, 101 bp, rice(Oryza sativa)
  misc_feature (71): n=a or g
tggtgaagtgaaatttagcccaatgaggcgagtattgttggagatgattgagaaagcgttttcaaccatanaccttgaaacgcacactggaactcacccaa

SEQ ID NO: 15589 - DNA, 101 bp, rice(Oryza sativa)
  misc_feature (71): n=t or c
gattcgtgtttcccttcttaaagaaagcctttcttttgccgcgcaaatctaatggttcgaaaaattgtacntatggttcctcttcataaataaacattttt

SEQ ID NO: 15590 - DNA, 101 bp, rice(Oryza sativa)
  misc_feature (71): n=t or c
ctggtttggtttctctgctggtgcccagcactttgctgcttctgacctctcctccatggattgtcagtccnagccacagctagttggtccttggaaggagc

SEQ ID NO: 15591 - DNA, 101 bp, rice(Oryza sativa)
  misc_feature (71): n=t or c
tcaacctcttttgtcttgtgctcttttgtattccaataagccataataatcgcaatctgccatcttgtctngaggatgtgaccatatcaagagtgacgata

SEQ ID NO: 15592 - DNA, 101 bp, rice(Oryza sativa)
  misc_feature (71): n=a or g
attaatttttctttacaaaaaaaaaattcctcttccttcctcctcccaacaaaatgagatcgacgccgcgntgtgcccccttccccaacccaaaccctaac

SEQ ID NO: 15593 - DNA, 101 bp, rice(Oryza sativa)
  misc_feature (71): n=t or g
tcatattttccttgacatgtcacatacccttttctttgtagactttgcaaaaggagatggtggtacaacanaaattgtcttgcgggaagaccaaggaggtt

SEQ ID NO: 15594 - DNA, 101 bp, rice(Oryza sativa)
  misc_feature (71): n=t or g
ggtacaaatctaaatttgtaaccttctctcatgtattagagtgcacctaaggctagcttctgatggtaganactgggcgggcctaatgggcgatcgatcgc

SEQ ID NO: 15595 - DNA, 101 bp, rice(Oryza sativa)
  misc_feature (71): n=t or c
cctccagatggtatttcagtccatcctatcctggtggatacaaagacacgttacaaaccaacagttccctnagaagcacaaaaaagaaatggaaggtttgc

SEQ ID NO: 15596 - DNA, 101 bp, rice(Oryza sativa)
  misc_feature (71): n=t or c
cctgcaacgtttaaggttgttgcagaaaaggtttgcagaatgagaagcaaaagcagtataccctaaagttngtggtcatgcctacttttgcatggatctca

SEQ ID NO: 15597 - DNA, 101 bp, rice(Oryza sativa)
  misc_feature (71): n=t or c
taccacgatacgtatcctgatactgacaaccttgactacatttacttggtcacttttcttgaatacacttnccgaattgtcgaatattattttttttaaaa

SEQ ID NO: 15598 - DNA, 101 bp, rice(Oryza sativa)
  misc_feature (71): n=a or g
gggcatcgaatcataacgccaacatacccaccacagcttacaaagccgaagcactcaagctgaagccgccngggatatcgtcgatcaatctcgataaggat

SEQ ID NO: 15599 - DNA, 101 bp, rice(Oryza sativa)
  misc_feature (71): n=t or c
agcagctggtgtgcggggtgagctactgccacgccatgcagatctgccaccgcgacctcaagctggagaanacgctgctggacggcagcccggccccgcgc

SEQ ID NO: 15600 - DNA, 101 bp, rice(Oryza sativa)
  misc_feature (71): n=t or c
taattatagattgattaagagatataaaagaaagaatatctcttatatcattggtggtatttcttaacganattactagaaatataattcccagcaatggc

SEQ ID NO: 15601 - DNA, 101 bp, rice(Oryza sativa)
  misc_feature (71): n=a or g
ttgactcagaagtgctatgagttctgcatcaacattgactcctgacttggacttactgccttgctgtctcnatgactctgcaaagagacagagacttaagc

SEQ ID NO: 15602 - DNA, 101 bp, rice(Oryza sativa)
  misc_feature (71): n=t or c
agacagaggggtgtgagaatttgaaataatggggaaagggagatgtgaggcacgcaagagacaagagttcntttaagaataaaaataaaggatatcataca

SEQ ID NO: 15603 - DNA, 101 bp, rice(Oryza sativa)
  misc_feature (71): n=t or c
tccaggtctagcaatgcaggcaagtctccaaggatctggaggatttgctttgtcacttgcttagacctgangcatagcctgtagagattattcattgaagc

SEQ ID NO: 15604 - DNA, 101 bp, rice(Oryza sativa)
  misc_feature (71): n=a or g
aaggaatcggagcgctcgtagaacatatagaacaggatggctgacactaggaaaagagataagagtatganccagacttgccattctgcagaagaataaca

SEQ ID NO: 15605 - DNA, 101 bp, rice(Oryza sativa)
  misc_feature (71): n=a or g
aaatgagcacagtcagcctcaatatcactatcatgactcccaatagcaagttcttgttcttcacatggtgngctctacaaacagccaaagtcctgcgtgag

SEQ ID NO: 15606 - DNA, 101 bp, rice(Oryza sativa)
  misc_feature (71): n=a or g
gtcaatcatgtgtacccttatatgtatgactctgaagaagaagatgacaccgaggtagaagcagccgagtnggccagaagcaaaaagattatagtgagccc

SEQ ID NO: 15607 - DNA, 101 bp, rice(Oryza sativa)
  misc_feature (71): n=a or g
caaaaggaaagtggatttgcgcgggctggatttggactgctgaacaacagtaacttgtgacgaccgccacnacttcatgcggactctgttttgggcatgca

SEQ ID NO: 15608 - DNA, 101 bp, rice(Oryza sativa)
  misc_feature (71): n=a or g
cgaggatgttgatgaagatgatgatgaggagcaagaggagcctttgaggtgcaacaatttccaagaccagnttgactatgctgttcaacatgccttgatca

SEQ ID NO: 15609 - DNA, 101 bp, rice(Oryza sativa)
  misc_feature (71): n=t or c
gcttaatgtggagggtcgatcagtgggataaatatttaaatccaaagtagcttgcctcttgtccgagtttngaagaataagaggcctgctatagaagcgca

SEQ ID NO: 15610 - DNA, 101 bp, rice(Oryza sativa)
  misc_feature (71): n=a or g
ccaaaatgagctcatttttgcatgcggaccacttaagagcctatatggaaaaatcaaatttttctacacgngcgtcttaaggagtcgtatgtgaaaataaa

SEQ ID NO: 15611 - DNA, 101 bp, rice(Oryza sativa)
  misc_feature (71): n=a or c
gcattgggcaatggatgcgagcagagcagcccaagttttagaaccagagaaacctcgtcaggatcaaaacngctcggaatcctcgcgtccaccacgttaac

SEQ ID NO: 15612 - DNA, 101 bp, rice(Oryza sativa)
  misc_feature (71): n=a or g
cttatatttcttcatattttcataattttttttgaataagatctctgttgcgtactgtcgtgaatctcggncgtttggaacttgaacaatttgcgtagctc

SEQ ID NO: 15613 - DNA, 101 bp, rice(Oryza sativa)
  misc_feature (71): n=a or g
gagagctttggaagaagagaatcaccttggttttctcatattagtcttcaattcatccatgcgatactgcnggcgacgacgactcgcagtcgcaggcgttg

SEQ ID NO: 15614 - DNA, 101 bp, rice(Oryza sativa)
  misc_feature (71): n=a or g
ccaaaaggtcataagtataaaatcaaagagatggttgacctttgggtagcagagggattaattgattcacncagccccggggacaagagaattgaagatgt

SEQ ID NO: 15615 - DNA, 101 bp, rice(Oryza sativa)
  misc_feature (71): n=a or g
gaattaaacacacccaaaactccggaagaagaggtccattgaacctacccgtctcgtgggtttctgcccanaaccgtggccgtgcgccaccaggttcatct

SEQ ID NO: 15616 - DNA, 101 bp, rice(Oryza sativa)
  misc_feature (71): n=t or c
ttggaaaaattcgaacccaattgagtgctcttttgggggtattccatgattctcatgggtggatagactanttcataggattctaaggtgggaattctttt

SEQ ID NO: 15617 - DNA, 101 bp, rice(Oryza sativa)
  misc_feature (71): n=a or g
gccagcgggtccaggtggggagctttgagcctttgagtgtcctcccctttgttcgcattttcgtcaccacncctgaaccacaaaaaagaatcgagttaatc

SEQ ID NO: 15618 - DNA, 101 bp, rice(Oryza sativa)
  misc_feature (71): n=a or c
aacagcagcagcaggctctatccaaagctcttgcaatgaggtcaacttaccgatcaaaccaatcttcaccnttatttcccaatcagctcgtaggcaaacaa

SEQ ID NO: 15619 - DNA, 101 bp, rice(Oryza sativa)
  misc_feature (71): n=a or c
ggtgttcaaacttgggtgttcctgttgatgattaaaatccacaacggtagacttgagcgctatcatggctnttggtgaaagtttgatggagcccttctttg

SEQ ID NO: 15620 - DNA, 101 bp, rice(Oryza sativa)
  misc_feature (71): n=a or g
acacgacgaccaaaaggataaattaaaaaaacactatggtgaccacggcgcgaagacgtgatgacggacanacgacgatgtcgaacaatgtcgttgtagct

SEQ ID NO: 15621 - DNA, 101 bp, rice(Oryza sativa)
  misc_feature (71): n=a or g
acacacctctacgcatgcaacaccactctcactctgtaaatgcgccccctaacgcatgttgtaagagacgnaaaccggtgataaattcccaatctcactaa

SEQ ID NO: 15622 - DNA, 101 bp, rice(Oryza sativa)
  misc_feature (71): n=a or g
cctttactcttcacacatgcaatgtttcttgcttgccaaatttaacaaattgtggcacaacccggtaattntgtgagaactagattgaatacattgaatga

SEQ ID NO: 15623 - DNA, 101 bp, rice(Oryza sativa)
  misc_feature (71): n=t or g
taaggctggctccattctgtatatggtcaaattagctgatgtagctgctgcagaggaccagcctattccanaagtcattcaacaagtgattcacaaatacc

SEQ ID NO: 15624 - DNA, 101 bp, rice(Oryza sativa)
  misc_feature (71): n=t or c
tcgtaagaattatctcatgttccactaattcttaattttggtcatcgaaacatgtttttcagcttatactnggtggcgcggtgctgcctgaagcagatggc

SEQ ID NO: 15625 - DNA, 101 bp, rice(Oryza sativa)
  misc_feature (71): n=t or c
cagcagctccggctatcccctatcagggcaggcgatccctgacaagttgacgcacaacaatttccttctanggaaagcacaaattcttgcagtgatccggg

SEQ ID NO: 15626 - DNA, 101 bp, rice(Oryza sativa)
  misc_feature (71): n=a or c
tctaagaaataatgcaatgtttctactcttttgtatgtccttggtagtggtaagtgaagggcacggctgantttatcaaataaaggctgtttcaagtcatt

SEQ ID NO: 15627 - DNA, 101 bp, rice(Oryza sativa)
  misc_feature (71): n=t or c
gtggacgaaaatgtagatgaggccgtgaccattgtttgcttcctttgtctcattttggcaacgagagtctngcctgaaactgcatgcatctgacgcagggc

SEQ ID NO: 15628 - DNA, 101 bp, rice(Oryza sativa)
  misc_feature (71): n=t or c
tgctatttgtgagatgggagagttgaaagatgtgcaccagatctcggcatggccagcaagccggatcaatntagtgataattaaatgccgcactcaaaatc

SEQ ID NO: 15629 - DNA, 101 bp, rice(Oryza sativa)
  misc_feature (71): n=a or g
atatggccaggaaaacataacttgatgttaggcacactgttacttggaaacccgcacaacattatattccntacccttagtgaatttcgaggtgaactcca

SEQ ID NO: 15630 - DNA, 101 bp, rice(Oryza sativa)
  misc_feature (71): n=t or c
tctgactggcctagtcaatttggtcccacatagctagcaccacttcgctaaatatcataagagtaaattgngtccatggtatataaatttggtaggtaggt

SEQ ID NO: 15631 - DNA, 101 bp, rice(Oryza sativa)
  misc_feature (71): n=t or c
aagaaagtgaactttaaaaatagatttaaagcaggtgtgaggatgatgtcatcactaaagcctgagaaggngttctcgccgggggcggcgagcgagggtgt

SEQ ID NO: 15632 - DNA, 101 bp, rice(Oryza sativa)
  misc_feature (71): n=a or g
caccaaaatttttctttgagatcttgatacatcttggtactacccagatgaatagagtattgagtctgatnagcctcggtgagtatcagatctttcagccc

SEQ ID NO: 15633 - DNA, 101 bp, rice(Oryza sativa)
  misc_feature (71): n=t or c
ttttcaagacagaggtttgattattagttcctctgaagatttccagtaaataatctgtgaatagctacaangcgaaattcacgtgttgaatgacaagcgta

SEQ ID NO: 15634 - DNA, 101 bp, rice(Oryza sativa)
  misc_feature (71): n=a or g
agaggatgctaatcccggcaaggaagcggcggtttatctcctgctgcttgaaggtgccgacgtcaggggtntcgctcgtctcccctcccttgaggagggaa

SEQ ID NO: 15635 - DNA, 101 bp, rice(Oryza sativa)
  misc_feature (71): n=t or g
ccgctaatgtgttaatttttgaagcctgcttatgtcatttattgtattcgcactaaatggctgtgcttcanatcacgcaggttagtagtactttcttattt

SEQ ID NO: 15636 - DNA, 101 bp, rice(Oryza sativa)
  misc_feature (71): n=a or g
ttgactgtaaatacgaaatcatctttcagtttttttcaggtggcactgttgatgccatgcgaccactggcnactcaacagttcttttgccctccccactag

SEQ ID NO: 15637 - DNA, 101 bp, rice(Oryza sativa)
  misc_feature (71): n=t or c
ccaggttcacttacatcgatggccacatgcaagctctggtaaccattttcttttggccgtgtgacataatnttttgtccttcctggaacttctttccacat

SEQ ID NO: 15638 - DNA, 101 bp, rice(Oryza sativa)
  misc_feature (71): n=t or g
ggacaatccgttgcttcccttaatgtaacttctggaagaagctggacctataacttatggatggcaagaantggcagtgctcggaggaggctgccctggac

SEQ ID NO: 15639 - DNA, 101 bp, rice(Oryza sativa)
  misc_feature (71): n=t or c
tccgatatcaggattgtgaacccgtaccgtttttcttgaaatcttggccaaaagtaccagtagcattcgtngtaagaaataggtaggcatctattttttgt

SEQ ID NO: 15640 - DNA, 101 bp, rice(Oryza sativa)
  misc_feature (71): n=t or c
gcgcaatctgtggcggcgcgtgggtcgtggcctaagtcggcgtcgtctgactcccaggaagtgatagaggngggggtattttggtcgaaagaaaaaaataa

SEQ ID NO: 15641 - DNA, 101 bp, rice(Oryza sativa)
  misc_feature (71): n=a or g
atgcataaatctcgaggtaatccgatgactgtaaatttgaaagttctgcgggtagcaattctgaaaaaagnacagacagtgtggcacacaccaacaaaacg

SEQ ID NO: 15642 - DNA, 101 bp, rice(Oryza sativa)
  misc_feature (71): n=t or c
acgctctccttaaccttgttaatcgacaaggtcttccctgtaccagggcacccgcacacatacaggctccntgaacgctcctgctccacgcaacccttgca

SEQ ID NO: 15643 - DNA, 101 bp, rice(Oryza sativa)
  misc_feature (71): n=t or c
atcaaaatatagcataagaggctctacatctttgaacgacacaagataaacatgcatacagccactgtcanggtagctaaccaatctcaacacagcaaaaa

SEQ ID NO: 15644 - DNA, 101 bp, rice(Oryza sativa)
  misc_feature (71): n=t or c
ggctaaattaaaggtagacacagaacgggcacacaatgaaaggacgcgcgagaacgcgccttttctggttngccactgccccggccacgccatccgccgct

SEQ ID NO: 15645 - DNA, 101 bp, rice(Oryza sativa)
  misc_feature (71): n=t or c
aatgtccttgcaacctcatactttggcttgccactaacaatctcactgaatgatgcaatccctgcattctnggttcttgatgagagcgtgtcgatgatttg

SEQ ID NO: 15646 - DNA, 101 bp, rice(Oryza sativa)
  misc_feature (71): n=a or g
ggagggcgaagacggaggcggcgctaggggtctttatgatgaaaatcaggcggttctagggtttctgtgangggtcccttgggccggtattattatgggct

SEQ ID NO: 15647 - DNA, 101 bp, rice(Oryza sativa)
  misc_feature (71): n=a or g
gacccacctgatgaagctggagtgcagacattgttgcaagacaggcagctcttttctgaaatgctacagtntcagttattgagagctcagaatcgcatgaa

SEQ ID NO: 15648 - DNA, 101 bp, rice(Oryza sativa)
  misc_feature (71): n=t or c
tcaaaggttgagtgatcatcacacgattaggtctcacacattgcagacaaacaggtactgttgcgataatncactggtggagaaaccatctttcgtcggtc

SEQ ID NO: 15649 - DNA, 101 bp, rice(Oryza sativa)
  misc_feature (71): n=a or g
ctagagctatcctgatctcagtgtatgtcgtatgtttctcagtaaccagttttcttttcgcatgtgtttgntccaagggatagaatggatcaggttgggac

SEQ ID NO: 15650 - DNA, 101 bp, rice(Oryza sativa)
  misc_feature (71): n=t or c
gtttacatccctagtctatcgtagtaggcgccgtggccaaactcgtatttttatatgtaaataaggcattntcatgccttataaaaacacccactattatt

SEQ ID NO: 15651 - DNA, 101 bp, rice(Oryza sativa)
  misc_feature (71): n=t or c
tttccaggggttaaatttaggggttaaagtcttaccaaacaaaccctttatattgaactctgctacactgnaaaaaaacaagtcattctcctccttccctc

SEQ ID NO: 15652 - DNA, 101 bp, rice(Oryza sativa)
  misc_feature (71): n=a or c
tttgattaactctgcagttatgcattatatctgctgattgtcagagttgcttgtagtgttatgtactcctnctgccgtttaatcattggtttctgttcttc

SEQ ID NO: 15653 - DNA, 101 bp, rice(Oryza sativa)
  misc_feature (71): n=t or c
attgatacttactattaatctttgtagtgccaaaaaaaaattcccctctggcttgttagagacgacggacntggcgtagtcctccacggtgatgttcttct

SEQ ID NO: 15654 - DNA, 101 bp, rice(Oryza sativa)
  misc_feature (71): n=t or c
actatttagtaagtcaaattaaatgtgcctttctagggtgttcaagcaggtgtttgatgagatagtctacncattagttgcatatgcagtgtgttcccctg

SEQ ID NO: 15655 - DNA, 101 bp, rice(Oryza sativa)
  misc_feature (71): n=t or c
gtagctggatgccacagcgagcaggtgcccatccttactaaatgacaaagcagctatgcttgacgcatacnttgaatactgcaataaaagaagaacattaa

SEQ ID NO: 15656 - DNA, 101 bp, rice(Oryza sativa)
  misc_feature (71): n=t or c
atatcggtccagtatactgtatacagaggtttttaggagctgtttcgattgatgatattttcaaccataanattatttagtaaaattaataattacgtggt

SEQ ID NO: 15657 - DNA, 101 bp, rice(Oryza sativa)
  misc_feature (71): n=a or g
ggcgaagcttgaagaggcgttgaaggagtcaaatgatcttcgtactcagcttgcctgtaacttccgtctcngttttgctcttattggttttgtgctcacct

SEQ ID NO: 15658 - DNA, 101 bp, rice(Oryza sativa)
  misc_feature (71): n=t or c
aggagatattggtgttgttggtgggtttgagagagcaaaagtcaaaacggcatctttcatctttttgtgtncagaggggaggggggcaggtgggtttgtcc

SEQ ID NO: 15659 - DNA, 101 bp, rice(Oryza sativa)
  misc_feature (71): n=t or c
ttcctgggtaattattaattaagcaagctagctttacaaacaggttttgtacgttgttacatactccctcnattccaaattgatctacatattttataggt

SEQ ID NO: 15660 - DNA, 101 bp, rice(Oryza sativa)
  misc_feature (71): n=t or g
attttaataaagatacttgaataaaagtagctaaaaggaagcggatcctccgatttgtttaacttgactcnggtggacgacgagaaaaaaggttacgcaac

SEQ ID NO: 15661 - DNA, 101 bp, rice(Oryza sativa)
  misc_feature (71): n=t or c
catgttacgcggcagcggtatatttaccatcatgtcctctaactctcatttcctatttcttccttgccctnatcatgttcatgcacatcctaaggccctgt

SEQ ID NO: 15662 - DNA, 101 bp, rice(Oryza sativa)
  misc_feature (71): n=t or c
aaaaaacagtggttcaactagaaaaaccggaaccagtgtcttgatggtgggcaggggcgtcccggccaatngagtccctgtgcaaaatattaaaatggggc

SEQ ID NO: 15663 - DNA, 101 bp, rice(Oryza sativa)
  misc_feature (71): n=a or g
attacccctatacatggccgttttcttgaaaaaagagttagtacagagacagactgcatacgccatttacngaaattgtagaaacagaaaatgttgaagtt

SEQ ID NO: 15664 - DNA, 101 bp, rice(Oryza sativa)
  misc_feature (71): n=t or c
gatgtcagcagttggatagaattctctcccatgatacagtccggcaataaacaaccaattcatgagcagtngagtgcgagccaccacagccgcaatacgca

SEQ ID NO: 15665 - DNA, 101 bp, rice(Oryza sativa)
  misc_feature (71): n=a or g
gaagaacgaaggagctgagcttttgtggattgaaggcacatcataataagggaacgacgacgatgatttcncgtaacagacaccgggagtaactatgttaa

SEQ ID NO: 15666 - DNA, 101 bp, rice(Oryza sativa)
  misc_feature (71): n=t or c
tttgctcgaataaagaaaatgtgatttttttttatctcgggggaatatcggatgaaaactatcggataagnaaggactcatctgtcttataaaaaacccaa

SEQ ID NO: 15667 - DNA, 101 bp, rice(Oryza sativa)
  misc_feature (71): n=a or g
gtacaagaggatgtcggccagcaaatccactcactgggacgaaatcggcatatcccaagctttggcattanctgcagctaatatggcaagggatgaaccca

SEQ ID NO: 15668 - DNA, 101 bp, rice(Oryza sativa)
  misc_feature (71): n=t or c
cgatgaggattctcaaagttattgctggtgcgatacgaggattctctacgggaaaatatgcaatgcaaatnacatatgaattgaaaatctagaaactacta

SEQ ID NO: 15669 - DNA, 101 bp, rice(Oryza sativa)
  misc_feature (71): n=a or g
ttacttgttactacaaggaaaacatgtactactacacatacacaaactctgcaccaaggccactatatacntacacccatattatcacaacattccacaga

SEQ ID NO: 15670 - DNA, 101 bp, rice(Oryza sativa)
  misc_feature (71): n=t or g
caaggttctgaaacgaagctggaattgggggcatctccgtgtccacaacaccttccaacatgcgaacgacntgccccatcgatggcctgtcaccctctctg

SEQ ID NO: 15671 - DNA, 101 bp, rice(Oryza sativa)
  misc_feature (71): n=a or g
taatccgctcaaatatagtagaattaaagcgacgcgggtgttgcttatgaggcataaacccagacttaatnggcttctaagttttgatttataaacatcag

SEQ ID NO: 15672 - DNA, 101 bp, rice(Oryza sativa)
  misc_feature (71): n=a or g
tggtggagctctgagaccccagcgccgctgcgtccgcatcgtagtataagcccccgtaggcggggatgagntgcgccggctcgacctacaggccaaggaca

SEQ ID NO: 15673 - DNA, 101 bp, rice(Oryza sativa)
  misc_feature (71): n=a or g
agtcggtcgtctgcctccaaagggtgtcgcggatcgacgaagatatagaggctgtttggatggattactcnctttaccaaacttctatatcacaaatgtgg

SEQ ID NO: 15674 - DNA, 101 bp, rice(Oryza sativa)
  misc_feature (71): n=a or g
gggctagagtccccacgtgaactattctatgcaaggcataggcctgcagaagcatatttttgggcgttggntgtgtattatgaaccagaatatgcaaagcc

SEQ ID NO: 15675 - DNA, 101 bp, rice(Oryza sativa)
  misc_feature (71): n=a or g
gatttcaagcacaccggacgaagatgctgaaatccttgagatatccccattttggtatttccgacgtttgngcaagaggtgcaaggccaatgctctaagtg

SEQ ID NO: 15676 - DNA, 101 bp, rice(Oryza sativa)
  misc_feature (71): n=a or g
gggcacaaaacgtttttcataatgttaaaaaaaaacgtttttcatgatatgttcagagtttgggttcagtngtactgatagttatatttcatcttgacaca

SEQ ID NO: 15677 - DNA, 101 bp, rice(Oryza sativa)
  misc_feature (71): n=a or g
cttgcattcttttaatggttgatgtgggttactcatagattcaactgacctcgggtggaccatcacggcanagccttcaatcatccttatgaatgaaatgg

SEQ ID NO: 15678 - DNA, 101 bp, rice(Oryza sativa)
  misc_feature (71): n=t or c
tagactgatagtccatatggtctttcctgaatattatcgttgatgtttatggtattacgcaaccctcctgntacacgaagtagtccaagatggtcccgtaa

SEQ ID NO: 15679 - DNA, 101 bp, rice(Oryza sativa)
  misc_feature (71): n=t or c
tgtataatagtacaatttcacaagccttctgtcccaggtacatttgaatgctgaacgaattttagggatgnaaatgctttggaacagtaaatgttgtgtgg

SEQ ID NO: 15680 - DNA, 101 bp, rice(Oryza sativa)
  misc_feature (71): n=t or g
actacttaccattttgcacacccctttttctcaagtaacaaagcattatcaaggaaggtagaatccaaaanattaaactctcataattttacaatgtgata

SEQ ID NO: 15681 - DNA, 101 bp, rice(Oryza sativa)
  misc_feature (71): n=a or c
cgtcgcataaaaccggggtcaaaaccaccgagggagctaaggcaaacggttttattagtcgaaggacgccnggtatctggttttgcgattgcggggtgatt

SEQ ID NO: 15682 - DNA, 101 bp, rice(Oryza sativa)
  misc_feature (71): n=t or g
accgcagcagcttcttcttcgagactcaaaactaaggaacactgactacatatatggtgctgtgatcttcncaggccatgatacaaaagtaatgcaaaatg

SEQ ID NO: 15683 - DNA, 101 bp, rice(Oryza sativa)
  misc_feature (71): n=a or c
aaaaattgtgccgttgtgccgctatgcttgaggaataacaacctggctcgctgacggagcctaatgtgctncagggaggcgagagcaaggcatcgtccctt

SEQ ID NO: 15684 - DNA, 101 bp, rice(Oryza sativa)
  misc_feature (71): n=t or g
cacgtgtgggttttacaggcaagcagtaaggtgaagaacgtggttggacatggaatgacttaatcattttnttaggagcgttttttctttaaaaaaaggtt

SEQ ID NO: 15685 - DNA, 101 bp, rice(Oryza sativa)
  misc_feature (71): n=t or g
gtcttatcgagaaccacagaattgatcacccggaagctggcatgcgtttttgtgggaagaagcatagcaanatggatccaaatggctatggccatggctgg

SEQ ID NO: 15686 - DNA, 101 bp, rice(Oryza sativa)
  misc_feature (71): n=t or c
gtgtgagatgccatttggtaaaggagtcatcaagagcataccaaaatcccaaatgctagaattagcattanagcaaggttaataatacagccgatatgttg

SEQ ID NO: 15687 - DNA, 101 bp, rice(Oryza sativa)
  misc_feature (71): n=t or c
tacatgatattcacaaattatggtagtaattaacccttatttactaatacgcaccatcaaaacatggcttngtacgaatacaccttaaaacatcgatctac

SEQ ID NO: 15688 - DNA, 101 bp, rice(Oryza sativa)
  misc_feature (71): n=a or c
acacatgagctaagtcaatacctgcatttgcacctgatatatgtagcatctcgttgtcttgtggtgtgggntgattcaagcagttactgtgctttacaata

SEQ ID NO: 15689 - DNA, 101 bp, rice(Oryza sativa)
  misc_feature (71): n=t or c
gggagaagcaagcaacctttcccgtgtttgatttatatcttcccacccaggaagaaacaccaagatagctncttcattggaatcaacacaaatttttctga

SEQ ID NO: 15690 - DNA, 101 bp, rice(Oryza sativa)
  misc_feature (71): n=t or g
aaattagcacaagattacctagcccaagattaactatcccgcaacataatcgatcagatctagcccaaganttcaccttcccaaccaccaaaccaatcaat

SEQ ID NO: 15691 - DNA, 101 bp, rice(Oryza sativa)
  misc_feature (71): n=a or g
tgatcactgaggctctcctgcgacggcaaaaatacaccgcttacacagcaggtgcggtaaccacctatgangcttggtcaaagctagataaaccaaacaat

SEQ ID NO: 15692 - DNA, 101 bp, rice(Oryza sativa)
  misc_feature (71): n=t or c
acactgattgggctagccacactgattgggctagatgggggcctcacattgattggtagaacatcctcaancacccttttcggctgagggggtgaaataga

SEQ ID NO: 15693 - DNA, 101 bp, rice(Oryza sativa)
  misc_feature (71): n=t or c
gcattcaggctctcctatcccaaaatgctttgctttccaagcaagcacactccctctctgctttggagatnagctctcgtttctcttagtagcagcagctg

SEQ ID NO: 15694 - DNA, 101 bp, rice(Oryza sativa)
  misc_feature (71): n=a or g
aagtatttcgctctaaaccaaacaccagaggaagagaaagttttagtggctgaaatttacattacaggtcntgctgatcagtggatttccagctctgatgt

SEQ ID NO: 15695 - DNA, 101 bp, rice(Oryza sativa)
  misc_feature (71): n=a or c
gccaagaacgtgtacctgccagatgtctccgcggtgcacggtgcgtataacaatggctacaactttggggngccgggttactcgcttcaccatgagcccgg

SEQ ID NO: 15696 - DNA, 101 bp, rice(Oryza sativa)
  misc_feature (71): n=a or g
catagttatgcactgatcaagataactgggcaatagtactcacaaacttttgatcttgtactagagatggncataatgctctaataattatattaatgaca

SEQ ID NO: 15697 - DNA, 101 bp, rice(Oryza sativa)
  misc_feature (71): n=t or c
aatgcagcttaccactgtagggataactcacatgccaatggtaatagatcgctgcatgtagggatgaaaanggatcataaatggacggaaactagctttat

SEQ ID NO: 15698 - DNA, 101 bp, rice(Oryza sativa)
  misc_feature (71): n=t or c
atggcagtgccaggcctttctgtaggaagataatgtagacttgcggtatacgaaggcctcaaactgatcgntgttgaagcccaactccggtttgggaatcc

SEQ ID NO: 15699 - DNA, 101 bp, rice(Oryza sativa)
  misc_feature (71): n=t or c
cgtcgatggccatggccatctccatctctccctttctttttttttcactgtgtatgacatgtggggcctgnttgtcagcgggattagttattttaaaagcc

SEQ ID NO: 15700 - DNA, 101 bp, rice(Oryza sativa)
  misc_feature (71): n=t or c
tacatataggtccccagaaaactaattatagatatggtatggaaccaccttggtgctacggatattggcancaagatgggatgccttaagactaaatatgt

SEQ ID NO: 15701 - DNA, 101 bp, rice(Oryza sativa)
  misc_feature (71): n=a or g
agactgaggtttctcatcttgtaagagatgttcaagttggagcatttggtgcgtatgagatgaatggcagnttgatttcaagaaacaaggcgtcaaggaaa

SEQ ID NO: 15702 - DNA, 101 bp, rice(Oryza sativa)
  misc_feature (71): n=a or c
tgacatgcttatgcatttccttcttcaaaccttagtaggcttttaatggtccaaaaatatctagtctaccntaaaaactattctcttcatttttttaatag

SEQ ID NO: 15703 - DNA, 101 bp, rice(Oryza sativa)
  misc_feature (71): n=t or c
cattcaggtttctgcccaacaacactacaaccccaaatctccagttggagtggttgactgaaaaaatagcnacagtacaattcatcccccaatccggtcaa

SEQ ID NO: 15704 - DNA, 101 bp, rice(Oryza sativa)
  misc_feature (71): n=t or c
aaagcagcacaaaatgatggatgtgaacactgatgaggtaaccatggtttctaaccaagaccaagaagagncaacaggcaagcctgctgctaccttgccag

SEQ ID NO: 15705 - DNA, 101 bp, rice(Oryza sativa)
  misc_feature (71): n=t or c
gtaacccaacaccaatgcattacatgtgaacgtctctggttccaacccaccctccagcaacagcctgaaanaccggtgcgcggtggtgagatcaccttcct

SEQ ID NO: 15706 - DNA, 101 bp, rice(Oryza sativa)
  misc_feature (71): n=t or c
ttgtaccaaccttactctcaaagaagaattgcaggcaactaggtagcatttgcagctatggagctgcctcngatgctgccttgctgctccggaaatcgcgc

SEQ ID NO: 15707 - DNA, 101 bp, rice(Oryza sativa)
  misc_feature (71): n=a or g
agcggcatattttgagattcacgaactttgcccccgtgagcacctatcgtagattaagccgacatattttnaaattcactcagtcatcacacactcagtca

SEQ ID NO: 15708 - DNA, 101 bp, rice(Oryza sativa)
  misc_feature (71): n=t or c
atgggaaatatactaactcactgaagtaggagtagttgtgaagttaagtgctaggcacaaaaggccaaatntgaataattaagttgcttggtgttgggatt

SEQ ID NO: 15709 - DNA, 101 bp, rice(Oryza sativa)
  misc_feature (71): n=t or c
gcctccatagcagctgatgtcgactgcaacaaggagtaccaggacactgtctatattactattagcgttgnggatgtctttcaactgtaatagcacattac

SEQ ID NO: 15710 - DNA, 101 bp, rice(Oryza sativa)
  misc_feature (71): n=a or c
aatgggaaaagtccgaccggccctgccatgtcggaccggttagtcacagccaaatcggtatcgttttctanggcgcgtgtcacgtcttcgttcgagtgagc

SEQ ID NO: 15711 - DNA, 101 bp, rice(Oryza sativa)
  misc_feature (71): n=a or c
atgggattggtctgagtgcattgcagaattacgtcaacagaacactccaactcggcgaaatcaaatgaatntttcagatccctgtcaaccagtttatccag

SEQ ID NO: 15712 - DNA, 101 bp, rice(Oryza sativa)
  misc_feature (71): n=t or c
aaatgtacaatctctgttgagtaaccagccaggttagtatagaagcaacactgcaacagtacttaaccacngcagaataaccatcgaagttaacaaggtga

SEQ ID NO: 15713 - DNA, 101 bp, rice(Oryza sativa)
  misc_feature (71): n=t or c
actactgtagtactcgtactattcctgactatgcattttctgcttgcagatgggacacaaggattgttgcngggaatccttcagaggttcagcactgcagc

SEQ ID NO: 15714 - DNA, 101 bp, rice(Oryza sativa)
  misc_feature (71): n=t or c
acctccccccccccccccatctaaaccctaactccactagtgttcatcgggtcgtcaccagtagccggtgnttcatgggagctggaggagaagaacttggg

SEQ ID NO: 15715 - DNA, 101 bp, rice(Oryza sativa)
  misc_feature (71): n=a or g
gctggctggagcttgaagacgcactgtagcgagagggaggaagattagactttaggctgggctgaggaagngagagagaagaggaaggaatgggccgaaac

SEQ ID NO: 15716 - DNA, 101 bp, rice(Oryza sativa)
  misc_feature (71): n=a or c
ccatccatgtcattttactgcttaggttcttacgagttggtgtcattcaccaattcctgtgctagtttacntggatgtaatatccccttctgtaaattact

SEQ ID NO: 15717 - DNA, 101 bp, rice(Oryza sativa)
  misc_feature (71): n=a or g
acaatttgtcaatctcaatgggcggtcctttcaagttactgaagttgatgaaagatacaaaatgagaagtntgaactagtgccgttttcgtgccgcgtcat

SEQ ID NO: 15718 - DNA, 101 bp, rice(Oryza sativa)
  misc_feature (71): n=a or g
cagagccagcggaaaacatggtacgagatgaggtgtctgaggagcgaggtggcaaggggtatagcaggtgntgacggatgatgatgactaatgaggcaaag

SEQ ID NO: 15719 - DNA, 101 bp, rice(Oryza sativa)
  misc_feature (71): n=t or c
cataggggctatcctgacatccatgaaggccttgtcatgagggttgcacctcgctctcacacggctatgcnggaggaagaaattgagattcagggggccga

SEQ ID NO: 15720 - DNA, 101 bp, rice(Oryza sativa)
  misc_feature (71): n=t or c
gggctagttgcaaagaaaatagatgagatattgaccgcgtcggtgatgactgtttttctccgattgattanggagatactcccttcgtttttaaacatgtc

SEQ ID NO: 15721 - DNA, 101 bp, rice(Oryza sativa)
  misc_feature (71): n=t or c
ggcgaaacacgagaccggcggcgctcgtatgacacggcacgggtgctcctgtcctttggcatagttacctnaagtcagtcagatgcaaaggtttgttggtt

SEQ ID NO: 15722 - DNA, 101 bp, rice(Oryza sativa)
  misc_feature (71): n=a or g
cggcgacgtgattgacgaccgacgaccagtttcggtgaggcgacgatggattgtgagggcttgtttggttngtgccctgcgcaccaagcctgacaaatttg

SEQ ID NO: 15723 - DNA, 101 bp, rice(Oryza sativa)
  misc_feature (71): n=t or c
agatgagcgcgaaggggaggaggaagacgacggcgaagaagctgttgtacgcaagcagcacgaagatcaanatgccaccgccgatggacaccttggacagc

SEQ ID NO: 15724 - DNA, 101 bp, rice(Oryza sativa)
  misc_feature (71): n=t or c
atcactaattattattagttaattaagtaattaagcactagctgttggactgtgtcactgtttgatttggnaataccgaacggtctcgctctttcgttccg

SEQ ID NO: 15725 - DNA, 101 bp, rice(Oryza sativa)
  misc_feature (71): n=t or c
cgccgaggctggctccacgcgtcaaaggcggcggcgggagggggatcctcatcgtgctggtggtagactangctctgctcgtagcagtggcggatctaaaa

SEQ ID NO: 15726 - DNA, 101 bp, rice(Oryza sativa)
  misc_feature (71): n=a or c
gatatggcaaaacctgatgttttccttgaggttagttaagcatacatccgaataggatcaggatcacctancttcaaagtcatgtgactttgtcactgaca

SEQ ID NO: 15727 - DNA, 101 bp, rice(Oryza sativa)
  misc_feature (71): n=a or g
ctcgacgttccgacgtcgtcaatagctttggtggggatcaatcgaccgggtagttcgccaaagtgaactcngttcgcccagccgtcaagctgacgcgaaag

SEQ ID NO: 15728 - DNA, 101 bp, rice(Oryza sativa)
  misc_feature (71): n=t or c
gaatgcacacggctaacgatgttccactactattgttggatgcaagaagagaagaagaaattacagcgccnctctatacacgcggctcttgttaatttcga

SEQ ID NO: 15729 - DNA, 101 bp, rice(Oryza sativa)
  misc_feature (71): n=t or c
acaactcccaattcaactctgaattccaggttatcagggtcacctggtacggttctgagcaacaatttttngccgccttcaacatttagtgcctcttcaag

SEQ ID NO: 15730 - DNA, 101 bp, rice(Oryza sativa)
  misc_feature (71): n=a or g
agaacagattccaggaatacaacattaccaataaaagattaagtcattccgttctgggttgtctgttgctnagggccttgacccagctgctgcgttgccgg

SEQ ID NO: 15731 - DNA, 101 bp, rice(Oryza sativa)
  misc_feature (71): n=t or c
gcatggcgcagcaacaaccaacgtattttagtgggagtggagtttaaactctcgagagaatatcccatcgntgctcttgcttgtaacttaaatagttataa

SEQ ID NO: 15732 - DNA, 101 bp, rice(Oryza sativa)
  misc_feature (71): n=t or g
taagtaataccatcctatatacacagtcatgctaagaaagaatgacttaactagagtaaattcagaaaaangatgatgtattttagttgttcttattatag

SEQ ID NO: 15733 - DNA, 101 bp, rice(Oryza sativa)
  misc_feature (71): n=t or c
ttgtgcggatgaaatcattgaagagcatcctgcttgacaagatctatggattgtaccttgatgttattgcntgcctgccgatggatggcttgcgaatgcgc

SEQ ID NO: 15734 - DNA, 101 bp, rice(Oryza sativa)
  misc_feature (71): n=a or g
atctatacattactatcatatatacagtctcatactcaatggcactatatgctcttgcggtgttctatgcngcatgcagagatctgcttcggccatataat

SEQ ID NO: 15735 - DNA, 101 bp, rice(Oryza sativa)
  misc_feature (71): n=t or c
ttcacttccgcggatgggctttgactagtttcctcccactgcacgaacggcttgagcgtaagcgcctgaanaatcaccggtatgtcgggctgcccgcgctg

SEQ ID NO: 15736 - DNA, 101 bp, rice(Oryza sativa)
  misc_feature (71): n=a or c
gagcctcgtcggaggtctcgaccaacggtttgtaactatatgcatttgatccagcattgttgatctgtgcnaaaggaacacaaagataaggagaaaatcct

SEQ ID NO: 15737 - DNA, 101 bp, rice(Oryza sativa)
  misc_feature (71): n=a or g
cgatatgtttctgcccaattctttccaagatcagaggactttgaccttacttacaccatatattccttgcngcaacgtgcaatcatcccattcagtcaaac

SEQ ID NO: 15738 - DNA, 101 bp, rice(Oryza sativa)
  misc_feature (71): n=a or g
ctgtcatgcccaacataacaagaacttcatgagatcacattcagtattgctgtgcagatttgtcacgcccngtctgaatagagaatgagttgacagatggt

SEQ ID NO: 15739 - DNA, 101 bp, rice(Oryza sativa)
  misc_feature (71): n=a or g
ttcctatatctttgataatttagtacaagcagttcatcagttgtacaaattactatgtactggtcctgtanaccactgatgttatatgttacttaacatag

SEQ ID NO: 15740 - DNA, 101 bp, rice(Oryza sativa)
  misc_feature (71): n=a or g
ctggcgccgcccctccgtcccactgccgaggccactgtcatctgcaaccgaggtcgtcaggggcgtcatcntcaaggtcgtcgagggcaccgtcgtcgatg

SEQ ID NO: 15741 - DNA, 101 bp, rice(Oryza sativa)
  misc_feature (71): n=t or g
tccagctcctattgataaatctgacactaagtcctggatcaggaagcgacatggaagaaatgtgatagttnttgacactaagtcatcatcttggaagaaac

SEQ ID NO: 15742 - DNA, 101 bp, rice(Oryza sativa)
  misc_feature (71): n=a or g
cgctcgacatgtcgtcgtcctgcttgttcatcgatattgtggatgcagagttgttccgtgtctcgttgtcngcgccactcgttcagaacgttacggaggtt

SEQ ID NO: 15743 - DNA, 101 bp, rice(Oryza sativa)
  misc_feature (71): n=a or g
cggtgaccatgatctcatggtgccatttctgggcactcaggcatggataagatccttaaacttcaccattnttgatgactggagagcatggcatcttgatg

SEQ ID NO: 15744 - DNA, 101 bp, rice(Oryza sativa)
  misc_feature (71): n=t or c
cttgctggtatacttgatgccaatggaagcaaagataaaaaggtaagaacctcaaccaatgacatgaatgngttgtgtgcttcagaggagaatacaactgc

SEQ ID NO: 15745 - DNA, 101 bp, rice(Oryza sativa)
  misc_feature (71): n=a or g
ttatcgaggtcagagaggacggggaaaagcgatggaggttagggacgagatgcacaatgccgccggtctcngggaggatggaaggggcagcggcgacatcc

SEQ ID NO: 15746 - DNA, 101 bp, rice(Oryza sativa)
  misc_feature (71): n=t or g
gacagtggtagccgctattgttatgttcttattgttcaggaggcagaggagggcaatttatgttgagctgntggaagattgggaggtcgagtttggaccgc

SEQ ID NO: 15747 - DNA, 101 bp, rice(Oryza sativa)
  misc_feature (71): n=t or c
gtgtacctaagcctcttataaatcaattggacactctcatgtttattgcaggaactaatatatattacttnctccttttcaaattgatcatcatataatgg

SEQ ID NO: 15748 - DNA, 101 bp, rice(Oryza sativa)
  misc_feature (71): n=t or c
gttgggaacagagggaacaacacctgaactaaagaacaaatatagatgcaaagaacgttgacaactactcnatttgttttatattattagttattggactt

SEQ ID NO: 15749 - DNA, 101 bp, rice(Oryza sativa)
  misc_feature (71): n=t or c
tgtcactatggcatcttaagtaaaccacttactaatctgctgcgaaagggtcagttgtacatttggacatntgaaacggaggcagcctttcaagcattaaa

SEQ ID NO: 15750 - DNA, 101 bp, rice(Oryza sativa)
  misc_feature (71): n=t or c
ctcgagtccatgagggccaaggttaagcaagagatccgggaagagcaacataacccgtaggccgtcgctgncgctgcacatgaagagttaggaattcccac

SEQ ID NO: 15751 - DNA, 101 bp, rice(Oryza sativa)
  misc_feature (71): n=t or c
cagtgttatcatgccaatagctaacactccagtatggcccaataatccaccaagggttttgatactgaaantgttcctagccaaagcaacgctagaagcta

SEQ ID NO: 15752 - DNA, 101 bp, rice(Oryza sativa)
  misc_feature (71): n=a or g
ctgcgaccattcgtactattacaactactgaccatgagagatcccaaagtccaattgaaactgaagggcantgttccttctcttcaagctaaatatatttt

SEQ ID NO: 15753 - DNA, 101 bp, rice(Oryza sativa)
  misc_feature (71): n=a or g
aaaatggttgtttgcaatctgagaactggatatccttgggctcttcaatgagcagatgaaggatacgaacncctctaggtcgccatcaacaagttcatcaa

SEQ ID NO: 15754 - DNA, 101 bp, rice(Oryza sativa)
  misc_feature (71): n=t or g
tgctgatgaaaagccacatacctgtacttgagttgaaggaccaagagaggagctggtgcgactcgacaagntccccggtggccgccgagaatcccacggcc

SEQ ID NO: 15755 - DNA, 101 bp, rice(Oryza sativa)
  misc_feature (71): n=t or g
aagtcaaaaatgcaaagatggaacataggctacgcctacgcacatggaagatggtaaaaattgacaaattnaacatgttgtactaggcaagtggtcggcac

SEQ ID NO: 15756 - DNA, 101 bp, rice(Oryza sativa)
  misc_feature (71): n=t or c
tcagcaaagacaccaattcttaagaagtcacatactccagcaacaattgcacaatattcagaaactttagnggagacactaattcttaacaaatcaaatcc

SEQ ID NO: 15757 - DNA, 101 bp, rice(Oryza sativa)
  misc_feature (71): n=a or g
cggtaccgtcaagaagaccgtccctgttgaagatggtgccccaagcacttcaccagaaacaactgaaaccnccgctgccgctgagccagagaaggcgccag

SEQ ID NO: 15758 - DNA, 101 bp, rice(Oryza sativa)
  misc_feature (71): n=a or g
tagtacaacaaactgagctttggcaacagctaattaggcgtccttctctgccacaagcttgtcgataagcncagcagcatcctccactgtctgaatcactt

SEQ ID NO: 15759 - DNA, 101 bp, rice(Oryza sativa)
  misc_feature (71): n=t or c
gcttgcgtgtgctccgggaatgatggatttaggtggggggaagtagatttggttgtggaaatgtgttggantcagagcacgataagtcgcccttccccaat

SEQ ID NO: 15760 - DNA, 101 bp, rice(Oryza sativa)
  misc_feature (71): n=t or c
agccataaaatttccacaattgagcttggaaccatggttttccaggtagctgcatacatatatgctgttgncatttctattttttggtatgttatttcttc

SEQ ID NO: 15761 - DNA, 101 bp, rice(Oryza sativa)
  misc_feature (71): n=t or c
tcagattgccacctccattcctaagtccaatgtcttcaggtttgagaattactggttgaagcagcctgggnttttggatcaggtctctactgcatgaacag

SEQ ID NO: 15762 - DNA, 101 bp, rice(Oryza sativa)
  misc_feature (71): n=a or g
catcacctctccaaccacagtaaggagtaggaggtgaagatggcagcagcgcctggattcggctgatgacngtggaggctagatgcggcctcctcgaagct

SEQ ID NO: 15763 - DNA, 101 bp, rice(Oryza sativa)
  misc_feature (71): n=t or c
atggccctccacctcgtcgggtcttcctccttcaacctcccgttttcacattggcctcttcttcttttcangctccctccgctgtctcgctcgccatggcc

SEQ ID NO: 15764 - DNA, 101 bp, rice(Oryza sativa)
  misc_feature (71): n=a or g
atctatgggtcgtttgatcggaattttgccgaccacatcaagtagacaagtagaaggccagaagctagtgncgcagggccttttctcactatagaccccgc

SEQ ID NO: 15765 - DNA, 101 bp, rice(Oryza sativa)
  misc_feature (71): n=t or c
gcaaggaacaaggtaaacctctatatgtcctcagggacattacactattgttttctttttttgcaggcttntcatggagctcttgatattagattttgcat

SEQ ID NO: 15766 - DNA, 101 bp, rice(Oryza sativa)
  misc_feature (71): n=a or g
gccgggacagcggggaaggagaaggaggaggagcgggttgtgtctggcatgtatgagctccaacgccaccnggagggtcgcgctggggttcaccatcgaca

SEQ ID NO: 15767 - DNA, 101 bp, rice(Oryza sativa)
  misc_feature (71): n=t or g
atgttcactagagcatgactggctgttgttcagagactgacttgaactacagcttttctcctctttcaccntatgcaactcagggctacaagtcccaccag

SEQ ID NO: 15768 - DNA, 101 bp, rice(Oryza sativa)
  misc_feature (71): n=t or c
gagtagatctcggctgcgtttgggagtccaaatggagccgagtggtttttccgtcccgactggttcgaatncgagtcaaggagaaaaatgttgccgaagtc

SEQ ID NO: 15769 - DNA, 101 bp, rice(Oryza sativa)
  misc_feature (71): n=a or g
agctttttcattcacaatcccatcatcaagtgagcttctgcagatttttgaaattgcagctcctgttttcntaacaatgacctccaaggtatgcttttttt

SEQ ID NO: 15770 - DNA, 101 bp, rice(Oryza sativa)
  misc_feature (71): n=t or c
ggagaagatggtcctatttggcaagcttgacctcgcggtgccatctttttttgtctaggaacaagttcttnggcggcagacggtggaggattaaggagagg

SEQ ID NO: 15771 - DNA, 101 bp, rice(Oryza sativa)
  misc_feature (71): n=t or g
gcacttgtgaatttcctagtctacggatcctagatctggcctccaataatttttcaggcacactgagtgangcatggtttatgagacttaagtcgatgatg

SEQ ID NO: 15772 - DNA, 101 bp, rice(Oryza sativa)
  misc_feature (71): n=a or c
actgagattagtactgttgttcctgtcaatcagctggctcccaataccagtgaaatgaacacacataatcnaggcgactactcttctcaggcaacgatgcc

SEQ ID NO: 15773 - DNA, 101 bp, rice(Oryza sativa)
  misc_feature (71): n=a or g
gtgcagttgattctttttaaaaaaccgctctaagcctatttctctatttgttatgttggtcataacagcanttactcattattttgaggaattagacacat

SEQ ID NO: 15774 - DNA, 101 bp, rice(Oryza sativa)
  misc_feature (71): n=t or c
catcgttatgggctgggccaacggaaaaacgtttcacgtaacagaggctgagtaggatgggctggtctggnctggcccaatattgttgaatgtcgatctaa

SEQ ID NO: 15775 - DNA, 101 bp, rice(Oryza sativa)
  misc_feature (71): n=t or g
ccattctcaccaacacgtgctgttgcttccattgcgaccgtctttgccgccatctccttattcggccacanctccgaggctaccatgtcgtcaccgaccat

SEQ ID NO: 15776 - DNA, 101 bp, rice(Oryza sativa)
  misc_feature (71): n=a or g
cattcctctagtataacggacaagcactcagtaacatatgtatttacagagtgttccgttcgaacaatccncaacttacaaagtgctacatgaataaaacc

SEQ ID NO: 15777 - DNA, 101 bp, rice(Oryza sativa)
  misc_feature (71): n=a or g
tttcatccaccactttactagtcttggcaggtgataggatattgttagctggctggttaaagtcgcagttntgctgcctatttgagtccctgcctatggtg

SEQ ID NO: 15778 - DNA, 101 bp, rice(Oryza sativa)
  misc_feature (71): n=a or c
gaacttatgcaaggaatttacagatgaagagatagccgatgccctcttccagattggcccattgaaggccnctgggcctgacggattcccagtgagattct

SEQ ID NO: 15779 - DNA, 101 bp, rice(Oryza sativa)
  misc_feature (71): n=t or g
aacttcgctccggaaaatttgcatcaatctcaccaatctgttcggcaggccaatggctgcggctgcggctncgcaaagtgagtgctgcactgttcgtgcgg

SEQ ID NO: 15780 - DNA, 101 bp, rice(Oryza sativa)
  misc_feature (71): n=a or g
catctgaccacacaaaccaaccatcttaatacaagcccttgacctaaaattctccaaaaatcaagcaaganaaagcgctgttcttgctcagagaccacata

SEQ ID NO: 15781 - DNA, 101 bp, rice(Oryza sativa)
  misc_feature (71): n=t or c
atggcgaatgaactgttgtctacttaggccgacacatgaggttggaaatgaggaaacctgcatatcccganggctagaacctagccagtggaagttcccat

SEQ ID NO: 15782 - DNA, 101 bp, rice(Oryza sativa)
  misc_feature (71): n=a or g
aagcaaaagggaaaaagatcaaaggagattttgttgagggactctatatgatcttccgttaacacctttanaaatactgataggatcatgtatcaggaatc

SEQ ID NO: 15783 - DNA, 101 bp, rice(Oryza sativa)
  misc_feature (71): n=a or g
aatgattgtgttttcaatggtgctaatcctgatttggcggggggctgcaagctgtggctaattgagggtantatatggtgtttagtgggagcccatgcgct

SEQ ID NO: 15784 - DNA, 101 bp, rice(Oryza sativa)
  misc_feature (71): n=t or c
cgattgacatggctttgataccaatttttggctatgcacaagaaagcacacccaattcctcactcagtatnacgtattccaacaaggagaacacatcaaaa

SEQ ID NO: 15785 - DNA, 101 bp, rice(Oryza sativa)
  misc_feature (71): n=t or g
actcgatctacttcacaccggattaattaattgcacgtaattaatcgtgatcgatcatggcttggcctctngctcggccgggaagtggaactcggggacgc

SEQ ID NO: 15786 - DNA, 101 bp, rice(Oryza sativa)
  misc_feature (71): n=t or c
atttttgcattccctgctgactagtgggccactttgtttttaataccatcgcatatgcagggcatgccganaacaaagacaaggtggtcattcgtggtgca

SEQ ID NO: 15787 - DNA, 101 bp, rice(Oryza sativa)
  misc_feature (71): n=t or c
gctggatgtcagctgtaatgaagaaatcaagcaacttccgggatccatcggaaaccttacctgccttgaanacctctcagtgtctggttgcgaaaaattgg

SEQ ID NO: 15788 - DNA, 101 bp, rice(Oryza sativa)
  misc_feature (71): n=a or g
tactcagtatccagtatcatgtcgtcattgcatgaataaaagagtacacatagagaccattgcccaaaagnaaaggtgcatgaagctacaattaatcatgg

SEQ ID NO: 15789 - DNA, 101 bp, rice(Oryza sativa)
  misc_feature (71): n=a or g
tatcataataaatcaacctcgtactagaatgcgtcaatgaatctatctactagaatcattgtattaaaatnttaacacatcagtatgaggtttgtttattt

SEQ ID NO: 15790 - DNA, 101 bp, rice(Oryza sativa)
  misc_feature (71): n=a or g
atgcagcatgctgcgtacgtacaataagatacatattatgggaaacggtgatgacactactacagaaatgntttttctggacgaggcagggcagcagcagc

SEQ ID NO: 15791 - DNA, 101 bp, rice(Oryza sativa)
  misc_feature (71): n=a or g
cctgagactttcaagcagacatcattaaccagctcgttagacgcaaaccgccagttgttggattgcacaancgcggcgacacaaagagcagagccaaaaga

SEQ ID NO: 15792 - DNA, 101 bp, rice(Oryza sativa)
  misc_feature (71): n=t or c
tgtgaaaataaaaggtgtagccatattaagcgtcgagccaggaaaaatagcgaaacacataagcgcatagngaaagcgcaatctcaccgttcgtcccctca

SEQ ID NO: 15793 - DNA, 101 bp, rice(Oryza sativa)
  misc_feature (71): n=a or g
ctgcctggagtactcttctactatacaagtacatctcgtggatcaacaggaccaagattgcttccagctgnattgccaatgtttttccagtaacaatgggc

SEQ ID NO: 15794 - DNA, 101 bp, rice(Oryza sativa)
  misc_feature (71): n=a or g
tgcaatgctaatcaggggaggaggaggagattatacgggcgtagttgaactggcagtcgccgggggtgtcngcgaagtggagggggctcgaccaccggtac

SEQ ID NO: 15795 - DNA, 101 bp, rice(Oryza sativa)
  misc_feature (71): n=a or g
aatttaggagcattaattttcaaataacatttcagattggctgtataggttgtgcatcatttcacaatggngaagaggcggagggaagagttgaatgtgca

SEQ ID NO: 15796 - DNA, 101 bp, rice(Oryza sativa)
  misc_feature (71): n=a or g
ccgcgcaaatttcaacgcagctggagttcaaagcaaaaacaattatgcaatcacatacatcagctttcggnagaacgaaatcatggataatttcagattat

SEQ ID NO: 15797 - DNA, 101 bp, rice(Oryza sativa)
  misc_feature (71): n=t or c
gattgggcgatcgaggaccgagacacgaagagcgatctcatctgcagggcgaaaaggtgtcgttgcgaggnggacgtctgaggttaattatgtagtatatt

SEQ ID NO: 15798 - DNA, 101 bp, rice(Oryza sativa)
  misc_feature (71): n=a or g
cgagcttcctgctgttcttcctggtgtgcagaaactctccattacctcagacactctacatctatgatgangtttaatttgtctctttctgaaagcaatta

SEQ ID NO: 15799 - DNA, 101 bp, rice(Oryza sativa)
  misc_feature (71): n=t or c
ttttttctctctcttaaataatggtcagatgtacagatcaggctctagcaacagcaatcatcctgtcagcntccagaagttgacatcagctactgttaaca

SEQ ID NO: 15800 - DNA, 101 bp, rice(Oryza sativa)
  misc_feature (71): n=a or g
ggtgccccattagtaagacgcagcagtagctagttggtgcgtggccggaaatcctaattggcgattgatcncctgggacgcggatccccctccccctatct

SEQ ID NO: 15801 - DNA, 101 bp, rice(Oryza sativa)
  misc_feature (71): n=t or g
tttagtaggaatattgtgctttagctgattgcgaagaaccacatgttctcaggagttgcatttcagttgantagatgcttatctaaactatggtagttgga

SEQ ID NO: 15802 - DNA, 101 bp, rice(Oryza sativa)
  misc_feature (71): n=a or g
ccagttaaaaccaaatttacaacggttcaataactaaaataatcgacatgcagctcttcgccaacttcagntagaggttcacaaataaaattcagtagttg

SEQ ID NO: 15803 - DNA, 101 bp, rice(Oryza sativa)
  misc_feature (71): n=t or c
tttatgagcaatatctataagttacatggtttgcctcaattcatcatctctgatcgtgataagatatttangagtcaattttgggaacaattgttttctcg

SEQ ID NO: 15804 - DNA, 101 bp, rice(Oryza sativa)
  misc_feature (71): n=t or g
gtgcgataccgtgtcggactaagcgccaaccagaaaatcaccatgggacccactccacagttgctcttgcnctatgaaagcgcggtaccgagtccactctc

SEQ ID NO: 15805 - DNA, 101 bp, rice(Oryza sativa)
  misc_feature (71): n=t or c
actcttacttaatatgttatcttttcttcacagtttccttgacaaagctgccgtcattttgtcgaatgaangtggtggttctcatgatccttggagacttt

SEQ ID NO: 15806 - DNA, 101 bp, rice(Oryza sativa)
  misc_feature (71): n=a or g
tctattccatgattccatcatgcttgcatgcaccggggactttggagagtattggtctgttaactttcatnacatttttaaccatatcaatttttaagtaa

SEQ ID NO: 15807 - DNA, 101 bp, rice(Oryza sativa)
  misc_feature (71): n=a or g
acggcggggagggacgactatccttgcaggcacaatggacacggaaggaatgatggatcaagaagaagagnaggaggacgacgaacaacctgctgatgttc

SEQ ID NO: 15808 - DNA, 101 bp, rice(Oryza sativa)
  misc_feature (71): n=t or c
acatagaaactgttctggaatgatgagcctcttctttcctacctaagatcaggattctctactaatgctgnagataatctttcattatgataggaaatgaa

SEQ ID NO: 15809 - DNA, 101 bp, rice(Oryza sativa)
  misc_feature (71): n=a or g
aggcggtggggacgagttgcttgtccagagcggcgccgccatggatatgacaaggcataacgcctgcctcnctgtcacgcccagaaattcacgaaccagaa

SEQ ID NO: 15810 - DNA, 101 bp, rice(Oryza sativa)
  misc_feature (71): n=a or g
ggcccactggagggcctttttttttttacacccactggaggcccattggaccctctataacagaactgatnataagttttttttataagaaagagagagag

SEQ ID NO: 15811 - DNA, 101 bp, rice(Oryza sativa)
  misc_feature (71): n=t or c
aaagcatcagtacatctgtacacgaacagaatggtaagcgtataagtctgaaacaaataggagtagtaacngattaactgaacggtcagaaatagtattga

SEQ ID NO: 15812 - DNA, 101 bp, rice(Oryza sativa)
  misc_feature (71): n=a or g
agtcatggttcgacttaccgtcggtaacatgatcatcaggctcattatgctttgccaatgctttgccaatngtcactacgtgtctgtatgactctgtggta

SEQ ID NO: 15813 - DNA, 101 bp, rice(Oryza sativa)
  misc_feature (71): n=a or g
ttttgctactagcgttgaactgggtctatatgatgtgttgtttgtactactatgttaatttggagcaggtngtgctggatcgagcgttggtactcgggttg

SEQ ID NO: 15814 - DNA, 101 bp, rice(Oryza sativa)
  misc_feature (71): n=t or c
ctttcttgttcgattcttgaagctcaccggcaatcagaacctcatccaatataaagtatgcctgtaaatanagacagaagcacagaaaagacagcaggttt

SEQ ID NO: 15815 - DNA, 101 bp, rice(Oryza sativa)
  misc_feature (71): n=a or g
tcaacaacctatagtagcagtataattttctcaggactctgaaactgaaaaacacctcgctgagtcactcnctcgctgtagcagcttcaagctgaggcatt

SEQ ID NO: 15816 - DNA, 101 bp, rice(Oryza sativa)
  misc_feature (71): n=t or c
ttctccaactcggattgaaggcgcttgacttcaactttcacctctttgagagtgttcgcgagggcctccanctccaagttcttgcggcttatttcgtcgtc

SEQ ID NO: 15817 - DNA, 101 bp, rice(Oryza sativa)
  misc_feature (71): n=t or c
tcaaaatattgtaactactactatccagggaacttttggatacttagatccagagtactaccgtaaaagcngacttacggagaaaagtgatgtatacagct

SEQ ID NO: 15818 - DNA, 101 bp, rice(Oryza sativa)
  misc_feature (71): n=a or g
catttcaaaatacttttcagagttcttcttccagagcttaggattgtcaccatcaaactttgggaaatcanactttggaagcctaggaccatggaatctat

SEQ ID NO: 15819 - DNA, 101 bp, rice(Oryza sativa)
  misc_feature (71): n=a or g
cgctgcagcgacaacggcaaatggtcgaaatcaccaagtccccatgtggaccgctgcttcccggcgcgagncccgtcgatcgactcgcctccggtttggat

SEQ ID NO: 15820 - DNA, 101 bp, rice(Oryza sativa)
  misc_feature (71): n=t or c
atggccaccaagattttcaacccagtgagtgaaatcgtgcaaccactacttaaccaccacaccaacttcancatgagaatattaagggcctatttggcaca

SEQ ID NO: 15821 - DNA, 101 bp, rice(Oryza sativa)
  misc_feature (71): n=t or g
caggtccaagaggtgtttgatagatttcttcagtttaagcctctgttgttcgatggccctggggaggttgncgagctttttctcctgcgaagatatgtcag

SEQ ID NO: 15822 - DNA, 101 bp, rice(Oryza sativa)
  misc_feature (71): n=t or c
aacatcgctccgttcacttcatcttttgtgcaaaattgctaattcgccgagacgagggccgcgcgtgggcnttttttttattcggtatttttttttgtttt

SEQ ID NO: 15823 - DNA, 101 bp, rice(Oryza sativa)
  misc_feature (71): n=a or g
tgagtataacactgatggtgaagattattccatcgatgatgagggtgaggagttagatcacgcaagcaacnattcacttgatgaggatatcaatgaagatg

SEQ ID NO: 15824 - DNA, 101 bp, rice(Oryza sativa)
  misc_feature (71): n=a or g
agatggaaggatctgtactagtgtctctgaaacagggttaggtgatagctgctgcttattgccgacgtcancaatgtcgtctgtaccatcagtacccaaca

SEQ ID NO: 15825 - DNA, 101 bp, rice(Oryza sativa)
  misc_feature (71): n=a or g
gtcgatacctctaagataacatcccatccaccgagctgatccggcccccgctcctgtgaagagaaagaggntgtgtaagtgacaaatggatctcacacaca

SEQ ID NO: 15826 - DNA, 101 bp, rice(Oryza sativa)
  misc_feature (71): n=a or g
cttctcctccccctcccctcctgagtggggtggaggtggaatcgccggtgggttgtgggttgctgcggacnattaggatctaggagggagagcggcgagcg

SEQ ID NO: 15827 - DNA, 101 bp, rice(Oryza sativa)
  misc_feature (71): n=t or c
aaatagagggacctaagtgaacttactcccctaattttacatgtgttttggttcaacgagggtggatgaangcaatgctaattggcgcagagggttttata

SEQ ID NO: 15828 - DNA, 101 bp, rice(Oryza sativa)
  misc_feature (71): n=a or g
gcacgcaagacaggaggcagctgctggaaaggaaaacatccacgtgggtcggtcttattaagccacgtgtnccgggaaaccgatcccgtgccgcgtcgacg

SEQ ID NO: 15829 - DNA, 101 bp, rice(Oryza sativa)
  misc_feature (71): n=a or c
aatggttgaaggtccaactgattcagttgaaccacaaaatgatggatctgctgcggtgtcaactgaaggantatcatctctatcttctacttggagatcag

SEQ ID NO: 15830 - DNA, 101 bp, rice(Oryza sativa)
  misc_feature (71): n=a or g
ccggtgcttactttgccccaacctggtaaacgtttcactgtctattccaatgcttcatgtcacgccccganctagtaccgaccggaactagcccgtgacgc

SEQ ID NO: 15831 - DNA, 101 bp, rice(Oryza sativa)
  misc_feature (71): n=t or c
aaacatgtataatgagttaggggcaaatatgtctttttacagctgacggcgatgacacacagtagagattnaagaaaacacgatggtatattatttaactt

SEQ ID NO: 15832 - DNA, 101 bp, rice(Oryza sativa)
  misc_feature (71): n=a or g
ttgcactgattgtagtctatatttaatctttcaggggaccaacaactgctttgtgttcaccaatatagctngccgtcctgttatatatcgtccaacaggta

SEQ ID NO: 15833 - DNA, 101 bp, rice(Oryza sativa)
  misc_feature (71): n=t or g
accattttagatctgtgagtgattaaaagtgcttccaatgtgtatacactcgggtgttcaataattcttcnggtaaatgatgtacccgttaacataagtta

SEQ ID NO: 15834 - DNA, 101 bp, rice(Oryza sativa)
  misc_feature (71): n=a or g
tgcacgaggccgacgcgagatcacacaggcgcagaatcgtgcgtgaagattgtagatgatagtgtcattcnttggatcgacaaaagcatcaggcaccagta

SEQ ID NO: 15835 - DNA, 101 bp, rice(Oryza sativa)
  misc_feature (71): n=a or c
gttaggtgacacgacgggatgagagtcctctatcataaatgttattatcaggatgtggattttcatctctngaggaatattacctcgttgtctgcatgtca

SEQ ID NO: 15836 - DNA, 101 bp, rice(Oryza sativa)
  misc_feature (71): n=t or c
gatgaagatgacctagctctccatgtggcaatcttggtgtttatctggtcagtgacatcctgactttctcngtcgatgtcaaactcttcaagaacagctgc

SEQ ID NO: 15837 - DNA, 101 bp, rice(Oryza sativa)
  misc_feature (71): n=t or c
tggaggtggagcgatggtagagccaccaaactaaactatttgtatttaatgcattctttattagttactcnctccatcccaaaatataaggctcaaccact

SEQ ID NO: 15838 - DNA, 101 bp, rice(Oryza sativa)
  misc_feature (71): n=a or g
ttgttagctgaatttgtggccatggatttttttttgttcaagattcgtgcacaagccaagcccaagtaagngagaaggcccccgtgctcctgttgttcacg

SEQ ID NO: 15839 - DNA, 101 bp, rice(Oryza sativa)
  misc_feature (71): n=t or c
aaaaatgctatcccacagtatagacagttgtaaggaagaccaagaacatctagctcttctagatcctaagnttgccccggtgctactgttggttgcttacc

SEQ ID NO: 15840 - DNA, 101 bp, rice(Oryza sativa)
  misc_feature (71): n=a or g
gagcaaaactataagctggcatggccccaaagtccttcccaacaagaaaggcctgacagaagaaacatatnaactatcaggagcaaacaacaaactaaagg

SEQ ID NO: 15841 - DNA, 101 bp, rice(Oryza sativa)
  misc_feature (71): n=t or c
agaacagagcattctgtaatctaaggacattgcttctcatttgggtttttccaatgatcagtgactttctnatatacttggattatcaaagtcgaagaatt

SEQ ID NO: 15842 - DNA, 101 bp, rice(Oryza sativa)
  misc_feature (71): n=t or c
aagagagaaatgattttgttagcttggaggcaaaatatttcataccaaatggccccaagtgaaatatacancgatataccttcatgaaaaccaaacgtata

SEQ ID NO: 15843 - DNA, 101 bp, rice(Oryza sativa)
  misc_feature (71): n=t or c
gcaaagagatacctcattagccagttcatcttcccacaccaaacacagtaaaaactaccatctgacttctngttgcacccattcttgaaaatgccagcttt

SEQ ID NO: 15844 - DNA, 101 bp, rice(Oryza sativa)
  misc_feature (71): n=a or g
aattgccggtcgttgatggacacgctggccaaatgccgtgccaataatgaaaagatatatttgctagacgncatttgcccgatattacactagcgcttcaa

SEQ ID NO: 15845 - DNA, 101 bp, rice(Oryza sativa)
  misc_feature (71): n=a or c
ggaaaagaactgagttagatcacaaaatcttctgacgaaactaaagatattgaagccaattttctatcaancactaattgcatgcacaattgagttgttta

SEQ ID NO: 15846 - DNA, 101 bp, rice(Oryza sativa)
  misc_feature (71): n=t or c
ccaagctctctctgaagggaagttgcttcctttgggaaaatattttcttggcgccacttaccaacttctcnagcaagcatcggccaaactgttagccggtc

SEQ ID NO: 15847 - DNA, 101 bp, rice(Oryza sativa)
  misc_feature (71): n=a or g
tttccccaaaatcggagtgaatccgcatctaaatcgtcgcagcccaattccgcaaatagtttgattaaacnagattaaatccgacaaactaaagccaaatt

SEQ ID NO: 15848 - DNA, 101 bp, rice(Oryza sativa)
  misc_feature (71): n=t or c
cgctacgtcaatcaatgacttcaatgaaaacagctcggctgcaataatatagctgtattatagcatcgcantttttcgctctatatattagtatgttttgt

SEQ ID NO: 15849 - DNA, 101 bp, rice(Oryza sativa)
  misc_feature (71): n=t or g
ggataacttccagcactctgatgtcaatgtatctgattctgagagtgaagcttcaactcctccagcagcancatcccttcagccatggatggctgacattt

SEQ ID NO: 15850 - DNA, 101 bp, rice(Oryza sativa)
  misc_feature (71): n=t or c
tcttctttggaagttgagcatttgaatcacaaacctgtggctgtttttacagaagaaaagaaggccgcaangaaaaatgcaagtgcgatctgaagatttat

SEQ ID NO: 15851 - DNA, 101 bp, rice(Oryza sativa)
  misc_feature (71): n=t or g
ccagctcgcaagcgcaggcaacccgagagagcttttataccttcaggttagctccaagccatataaatttntatttctacatttgaaaccattttcctatt

SEQ ID NO: 15852 - DNA, 101 bp, rice(Oryza sativa)
  misc_feature (71): n=a or g
ggacgtacacggtacacagcacggtgcacccgtatgccatataaaccggaagtggatttttgtccctcaangagacatcctcttgtttctgtgcatgtcgt

SEQ ID NO: 15853 - DNA, 101 bp, rice(Oryza sativa)
  misc_feature (71): n=t or c
accaaggcttgtgtatctcaaccttgcatcgaatagtttatcagggaacatccctagttcaatcggccagnttaaagtgcttactaatctataccttgatg

SEQ ID NO: 15854 - DNA, 101 bp, rice(Oryza sativa)
  misc_feature (71): n=t or c
cttaatctaccttgtgtccaagagcttaattagctagcactaatggcgtggtcatcatcaagaagcccagnagcgtggctgtcactcgctgcagttcttgc

SEQ ID NO: 15855 - DNA, 101 bp, rice(Oryza sativa)
  misc_feature (71): n=t or c
ggtggtggtcgcaactcattgaactttttatccctttgttctttcgcctttttctctcttagttcttgggnccgaagacgttgcaaccttctcttttgtgt

SEQ ID NO: 15856 - DNA, 101 bp, rice(Oryza sativa)
  misc_feature (71): n=a or g
acataaacacactggactagagaattttttttgctgcacacctgcacaccacagcactcacaagcgcactnctattaatcacaccacaaaacacaagctaa

SEQ ID NO: 15857 - DNA, 101 bp, rice(Oryza sativa)
  misc_feature (71): n=a or g
tgcatgccatgtagatgttggtaggtaggagttggaaggagaaaagcaagagacacaaatggcctacaacnaaacgaagaccgggtttagctcccaaattt

SEQ ID NO: 15858 - DNA, 101 bp, rice(Oryza sativa)
  misc_feature (71): n=t or c
gagcgacatgcttggcaactctctaaggtggcatttgtttctactgaagataaacgatagaaaaagttganagaaaaaaattagtacatgattaattaagt

SEQ ID NO: 15859 - DNA, 101 bp, rice(Oryza sativa)
  misc_feature (71): n=t or c
atcagaggagggagagcgcggcgaaagacgagatttttgctaggtttctcgtctcgtggggattcagactnagagaaagagagagagcccaactccttcct

SEQ ID NO: 15860 - DNA, 101 bp, rice(Oryza sativa)
  misc_feature (71): n=a or g
gcgtctaattcatggttgtgtttcttggtggtttgaggtgggagcgcctccggaggtggcgtcgctgctgnaggagatcggccgggagaggcgcgccggcg

SEQ ID NO: 15861 - DNA, 101 bp, rice(Oryza sativa)
  misc_feature (71): n=t or c
acatgccagaccagtacaagccaattcagtgtgaagggctgtatgcatcagctgccaagataagaagttgnattgcagcctggaggcatcttgcacctcgt

SEQ ID NO: 15862 - DNA, 101 bp, rice(Oryza sativa)
  misc_feature (71): n=t or c
aggacgaacgcaactgaaaccgaggagagctatactgagatggcgtacataaagcaagtcctcattgccgngggactatacgaagacgggtcgtcgtactc

SEQ ID NO: 15863 - DNA, 101 bp, rice(Oryza sativa)
  misc_feature (71): n=t or c
gtatgtgtgggaattaattatagttcagaacgtttcaagtagaagattacccccatgctggcaaccgcaantgcaccagctgcgatgcctagccggagaaa

SEQ ID NO: 15864 - DNA, 101 bp, rice(Oryza sativa)
  misc_feature (71): n=a or c
ttacagaagataatagctatttagacagctatgagcctcacacatgtacctttgaatcgccaaacaaatanttctagcgcatttatatatgaacatataat

SEQ ID NO: 15865 - DNA, 101 bp, rice(Oryza sativa)
  misc_feature (71): n=t or c
cttggcgccataatacttcttgtaaacttgtttggcttgcaccaggaggtcatgtatatcagcgagggaantgtccctggcacagaccatattgtcaactg

SEQ ID NO: 15866 - DNA, 101 bp, rice(Oryza sativa)
  misc_feature (71): n=a or c
caatggagataaaagcatacctctgtaatcagcaggatttcatcatctcccagtgaacaagcagaacttanagcctgaacaagatcattaagactcccaaa

SEQ ID NO: 15867 - DNA, 101 bp, rice(Oryza sativa)
  misc_feature (71): n=t or g
tcgtagagacgcgctgcatcgatgcacgcattgcacacacatatacctggcggtacatgacacgtaggttntgatcaacctgttggttgtcggtgaaccgt

SEQ ID NO: 15868 - DNA, 101 bp, rice(Oryza sativa)
  misc_feature (71): n=t or c
ctagggtaatccctgctgatgccgtcgaagatggactctgtcgtggcgacgccaagcctgtcgatctgctngaggcacctacgctgtgcggaggtgacggc

SEQ ID NO: 15869 - DNA, 101 bp, rice(Oryza sativa)
  misc_feature (71): n=t or c
cgcgaggtgaatcttccccaggaatggacatactgaggcgcagatttgcttcgttcgtctgttctaatccnagtttaatggatcatatttaagaattatta

SEQ ID NO: 15870 - DNA, 101 bp, rice(Oryza sativa)
  misc_feature (71): n=t or c
cttgaggatgcagttcagagtgccggtggcagagcaagcaagattgaggtcctttccttttccatcctgancgaggtgcctgagctgctttgtaccgagaa

SEQ ID NO: 15871 - DNA, 101 bp, rice(Oryza sativa)
  misc_feature (71): n=a or g
atagtgataaaaattatttttcgaaaaccgtattctaagtctaaaacgataattagtttcaacccaaaggnaatattaagtttcaactttgtcttgttgct

SEQ ID NO: 15872 - DNA, 101 bp, rice(Oryza sativa)
  misc_feature (71): n=t or g
taaaagagaaaatacgcaaataataacatgtaaagctggtaccggggaaattaatgttaacttcgtacggnagtacctacgcggtaccgattctaattttg

SEQ ID NO: 15873 - DNA, 101 bp, rice(Oryza sativa)
  misc_feature (71): n=a or c
tacatagtctatactgaaaagaaagtatagcattatcaacaaatgatgaaaatatgacacaataaaaaaancttaacaaatgttaacctaggtaagtactc

SEQ ID NO: 15874 - DNA, 101 bp, rice(Oryza sativa)
  misc_feature (71): n=a or g
ggtttctccaatagtgtttcattcggatttactcagctatggtcaccttcaagcatgttcatgtatgagtnttgtaaactggtgcattgcaaatagtgcct

SEQ ID NO: 15875 - DNA, 101 bp, rice(Oryza sativa)
  misc_feature (71): n=a or g
cttactaaaatattccgtttaaattgggcacagtgaagagagtgatgagatttatgcgcatgtttggtttntaataaaaataaaccttaccaaattttaat

SEQ ID NO: 15876 - DNA, 101 bp, rice(Oryza sativa)
  misc_feature (71): n=a or c
tttttgcaggaaaaggttggaagcgctgaacagtggaatcgtaaaaagagggagccaaagttctccagtgnaagagacaactcctgcagtcaggaagaggt

SEQ ID NO: 15877 - DNA, 101 bp, rice(Oryza sativa)
  misc_feature (71): n=t or c
aaagacttaggcttgagctcaagaggaaaaaaaagggaaactcagggccttgtggactactataatgattncgagagcaagatgaaggctcctcgccagga

SEQ ID NO: 15878 - DNA, 101 bp, rice(Oryza sativa)
  misc_feature (71): n=t or c
cccctcctcctctcctcctctgcccccttccctttcgatcggctgagtcgatagtgacagcaagcaaaaanggatccggcagtgtcggtggcggcgtgagc

SEQ ID NO: 15879 - DNA, 101 bp, rice(Oryza sativa)
  misc_feature (71): n=a or g
agtctgaaaagatatgtatgatgactaatttggtgtgtacttccgccgttaaagaaaaagtccaattctantgatgtatatagacatatacgttatccaaa

SEQ ID NO: 15880 - DNA, 101 bp, rice(Oryza sativa)
  misc_feature (71): n=t or c
gtgactaacattatacttccctgtgccaaaacatttgaaaaaggtgcacaaaacctcttccaacatcgtcngctttccctcagggcatcatcccacatgtc

SEQ ID NO: 15881 - DNA, 101 bp, rice(Oryza sativa)
  misc_feature (71): n=t or c
gtctttactctggagtttgcgtactagtacgtcattgcatagatcagacaagcataaaaatcagagatatnattgcacattttaattagcagtaatatatc

SEQ ID NO: 15882 - DNA, 101 bp, rice(Oryza sativa)
  misc_feature (71): n=t or c
aaacataacttttggattttttctttaacaaatcctgggctagccgaggacggtgatggcggtagtttctnggccatgaagaaaattgcttatctgactcc

SEQ ID NO: 15883 - DNA, 101 bp, rice(Oryza sativa)
  misc_feature (71): n=t or g
acaagctccggtttttataaggtcttgcttattatgtagaatatccttcaaattcttcctcagctccaagntattcattgtaatctgaaaaataaggatgc

SEQ ID NO: 15884 - DNA, 101 bp, rice(Oryza sativa)
  misc_feature (71): n=t or c
aatttccttatatttagcgacgggggagtaatatatgtggaagaaaattgttaaaaataattacgaacagncaatgaatatagtcatgcatttaggggacc

SEQ ID NO: 15885 - DNA, 101 bp, rice(Oryza sativa)
  misc_feature (71): n=a or c
caacatgcatcccggtcgttttgcttctcatcttatgttttcttgcacttcaattcgttacctgtgagcantgagtacctgggcggtcgtcccccctcctg

SEQ ID NO: 15886 - DNA, 101 bp, rice(Oryza sativa)
  misc_feature (71): n=a or c
gaatcaaatcaagcctgaacctccggtcatcccggctgctgacagtaactagtggatgtgagtaaaaaaantcaggacactggccgtcgagtgaacggaat

SEQ ID NO: 15887 - DNA, 101 bp, rice(Oryza sativa)
  misc_feature (71): n=a or c
cctccgttgtggcaatatcatcgttagccgaggtgtttatcatccaagaatgatactcttaaagtcacacncgaggtgtttatcatcgtgacttgaagccg

SEQ ID NO: 15888 - DNA, 101 bp, rice(Oryza sativa)
  misc_feature (71): n=t or c
tgcactatggaggaaggtaccaatataccaatagtctacaatctgaacataaggtgcaaaagtactccatntgcctcacgaaccgaatcgtaagttcccat

SEQ ID NO: 15889 - DNA, 101 bp, rice(Oryza sativa)
  misc_feature (71): n=t or g
tggaattgaacaggtgcatcggttttctggagaaaggaacactcaccgcttctttatcagagtttgagaanaaagagaaaaacacctcactcaatattgaa

SEQ ID NO: 15890 - DNA, 101 bp, rice(Oryza sativa)
  misc_feature (71): n=t or c
gatagacgccctgatatatgtgatgtggctgcataccttcggatgcttaggaagatgagtcaacaagcacnacaagaaaattttggttggcacttgtttgc

SEQ ID NO: 15891 - DNA, 101 bp, rice(Oryza sativa)
  misc_feature (71): n=t or g
cgagatttttcgccgaacaatttccagaccaaaatgcaacaaatggactttcgcaatgacccgatctcaanactctacgaaagttcaggtaggctatgttt

SEQ ID NO: 15892 - DNA, 101 bp, rice(Oryza sativa)
  misc_feature (71): n=a or g
ttctatgcactacgagacttgtgccaaccctacggatcaaaaattgtcagaaaaatagggtttatccatanaaattgtatttttgagggaaccgacaagaa

SEQ ID NO: 15893 - DNA, 101 bp, rice(Oryza sativa)
  misc_feature (71): n=a or g
ttgctgtagttggtatgatgtgttgtcaagctggtatcaatcctcagcagagaaccttcgtatcaaacttnttatgttttcagtaaagcagggtcttgtgt

SEQ ID NO: 15894 - DNA, 101 bp, rice(Oryza sativa)
  misc_feature (71): n=a or g
caatgatccagcaacaaatccaccaccaatttctgtgcctccacagtactctataactggtttgtagcaanctcttcccatcaaccataaataatcatcca

SEQ ID NO: 15895 - DNA, 101 bp, rice(Oryza sativa)
  misc_feature (71): n=t or c
agacccctgaaatctcttatgtagcaaaccggttcgacaacacaacaattatgaaggtatgcgctgacatntgccactttatccgctgtgattgctgcaac

SEQ ID NO: 15896 - DNA, 101 bp, rice(Oryza sativa)
  misc_feature (71): n=t or c
gttaaagtttcaaaagttcaaccgaatagagttaccagtttcatgtactttcctctgtcctagaatatacnggtaacctattgcaacttttgttcagaatt

SEQ ID NO: 15897 - DNA, 101 bp, rice(Oryza sativa)
  misc_feature (71): n=a or g
cataaatatcgacagattgaacagcccatcatgataccacccatttcacgttcggaaaagtacaccgaagntccctcaacttgctaccgagataaaaaacg

SEQ ID NO: 15898 - DNA, 101 bp, rice(Oryza sativa)
  misc_feature (71): n=t or c
tcaaagctaaaatatcacacgctgaaattaatttcagacatcataaatcttcagggtaattaactaagggnaactaatggactaatccacccgaagcacct

SEQ ID NO: 15899 - DNA, 101 bp, rice(Oryza sativa)
  misc_feature (71): n=t or g
agataatagtattcagtcacagtcacattgcagttggttccaacctgattgatcccatgcaaaaacgtgcnttgaacctgataactttttatagaatcagt

SEQ ID NO: 15900 - DNA, 101 bp, rice(Oryza sativa)
  misc_feature (71): n=t or c
tgtggtttgcactacatattttccctatatgccaggaccaagacatgttagaaacagtgataatacatacngctagcaatgaacatcacacactttcagta

SEQ ID NO: 15901 - DNA, 101 bp, rice(Oryza sativa)
  misc_feature (71): n=a or g
tctgtccactggatccagtaagggggtcgatgttgcccatcttcactattgctgcgctgaaatcagtgaanaatgttgccatgtttgatgagtaggtggtc

SEQ ID NO: 15902 - DNA, 101 bp, rice(Oryza sativa)
  misc_feature (71): n=a or g
ggtctctgcagactctgcttctgccgctggccaccgtctattttctgttgtgctctctattttctgagccnctcccacgatactggaggggatgccgacga

SEQ ID NO: 15903 - DNA, 101 bp, rice(Oryza sativa)
  misc_feature (71): n=a or g
tactagttggtgttaccaccaggtactaaagatcgttgctttttatactcttcttccttctccagcccganccattgttgcaagtgaaagaaggaggaaga

SEQ ID NO: 15904 - DNA, 101 bp, rice(Oryza sativa)
  misc_feature (71): n=a or g
ctttaatgtgataacagcagttgtaaaaatgccctttctgatgcctttttgtatttgtgtattgaggattngacaatcttcaagtgccaatgtttcccaat

SEQ ID NO: 15905 - DNA, 101 bp, rice(Oryza sativa)
  misc_feature (71): n=t or c
ctgagtcgtcgtcgccgacccatcgtcggatccgccgtctcccacctgctatcgctgccgtgaccttcgcngtcgccgagagctgtggagcctcccatcgc

SEQ ID NO: 15906 - DNA, 101 bp, rice(Oryza sativa)
  misc_feature (71): n=a or g
cacacactgtcaggtgagcccatgctaggctagtattgtggttctgcatgggtcttcactgcatgactgtngacgactcttgagccgaccacgttttaggc

SEQ ID NO: 15907 - DNA, 101 bp, rice(Oryza sativa)
  misc_feature (71): n=t or c
caccatggcaaggtttggggggagaagtatttcagggccaatttcgaaaggcttgccaaagtgaaggccanggtggatcctgatgattacttcaggaatga

SEQ ID NO: 15908 - DNA, 101 bp, rice(Oryza sativa)
  misc_feature (71): n=a or g
tctctcatcaggatccccatcaaatttcccacctcccgaatcaaaatttcccagagaattcattgaaacangagtaacttcgaacttacccttgcccggag

SEQ ID NO: 15909 - DNA, 101 bp, rice(Oryza sativa)
  misc_feature (71): n=t or c
acgtgcgaaagaattctcaattgatgagaaggaaacgctatggtataagaagaggatctacgtacccaaanagggtggactgaggggattaattctaaaag

SEQ ID NO: 15910 - DNA, 101 bp, rice(Oryza sativa)
  misc_feature (71): n=a or c
gcgatcaccacgagatgctggcctgtcagctccccttccaggacttgggtgatcaacaacataagactttncggccaaattagggaacagaacgctggcgt

SEQ ID NO: 15911 - DNA, 101 bp, rice(Oryza sativa)
  misc_feature (71): n=t or c
atgctaaataagatgaacacgataaattccaatcagtataatcatcaccaacatccagtatactagcaagngtcgtagtgataactaagcagaagatcata

SEQ ID NO: 15912 - DNA, 101 bp, rice(Oryza sativa)
  misc_feature (71): n=a or g
atttctattttcacggccagccacttgattttcacgggtgggtgctagcagccacttgatttttacaggtnccagtgaccacatgtggtaacacgatttta

SEQ ID NO: 15913 - DNA, 101 bp, rice(Oryza sativa)
  misc_feature (71): n=t or c
gaggaggcgaggaacaagatgagataaggaggatattggtgacatgtgagtctcaactcaacgagtaaacngcggttaacatgctatgttagtaaaaaaag

SEQ ID NO: 15914 - DNA, 101 bp, rice(Oryza sativa)
  misc_feature (71): n=t or g
aacttacgtgacacgtatacttattacttgcacagtggttgagttggactataaataagaggagatccgtncatacgcatctgtaatatagtagtagtaat

SEQ ID NO: 15915 - DNA, 101 bp, rice(Oryza sativa)
  misc_feature (71): n=a or g
attgaatgcctcttcatcaattgcaaatgattactaattagcttctccctagtgcctccagttacttagancagatacagtagcatactataaattaacta

SEQ ID NO: 15916 - DNA, 101 bp, rice(Oryza sativa)
  misc_feature (71): n=a or g
ggagaaaaaggcaaagatgcaagatttatagagaggcctgagctgtgtgatactgtgatggtggtggtggnggagatgagatctaacaacaatgttgcaat

SEQ ID NO: 15917 - DNA, 101 bp, rice(Oryza sativa)
  misc_feature (71): n=a or g
gattggataatctttttgcagaaaatgcagctgctgcgggtggtcgttactcgttacgttgcatattatcngttatggcgatcgagatatatgcctcgctt

SEQ ID NO: 15918 - DNA, 101 bp, rice(Oryza sativa)
  misc_feature (71): n=t or g
aatcaaacaatatcttgccacttgtttcaagtacttaagtactggggagttctgttggcccatgccaactngctgaattggtgagtcttctcttcccactt

SEQ ID NO: 15919 - DNA, 101 bp, rice(Oryza sativa)
  misc_feature (71): n=t or g
ttttcgataacattataggagcaaatgaaaaggtggtgttcggtaaaaatggcaaaagttaaattccctanaaattttatcgtgtggtatgaaaattctga

SEQ ID NO: 15920 - DNA, 101 bp, rice(Oryza sativa)
  misc_feature (71): n=a or g
cacctctctgaaatcttgcagatgcccacagcgcattgctagaagggggtactatggtgcgtttctcatgnacaaccttcctctcgtaaaatcccttgtac

SEQ ID NO: 15921 - DNA, 101 bp, rice(Oryza sativa)
  misc_feature (71): n=a or g
ataggataatgtatgtttagtgtcataaccctctttttttacaggagcaaattgttgatagagtagacatnggtgaggaagatcgccttcttgctgctgtt

SEQ ID NO: 15922 - DNA, 101 bp, rice(Oryza sativa)
  misc_feature (71): n=t or c
tcaatcagcagaaattcagtttactactattactatgtgctgctgccaaatcctgtcgttttacactctcnaagcaacaaatcgttcgagcgaccaacaac

SEQ ID NO: 15923 - DNA, 101 bp, rice(Oryza sativa)
  misc_feature (71): n=a or g
ccaaggcgttccctaccgttgtgggtgacaccattgtctttcaccattaccagcaaggttatcttgctcantaccacctccgcagcggcacattggagcca

SEQ ID NO: 15924 - DNA, 101 bp, rice(Oryza sativa)
  misc_feature (71): n=a or g
acgaagagctaagcaacatcaaggtggcatcaaactaaagatatgatctaatcaattgttgcctaatactnttttttcactgcccctgttgttgtgcttaa

SEQ ID NO: 15925 - DNA, 101 bp, rice(Oryza sativa)
  misc_feature (71): n=t or c
ttaacacttaccagttattcttacttcggcgcccaaatactttattaacttctgcttatcaggtggatagntattagggattacagcaataaatttgtaac

SEQ ID NO: 15926 - DNA, 101 bp, rice(Oryza sativa)
  misc_feature (71): n=t or c
cttgaatgctatccattacttactgggtggagtatatgcaaacatttactattacttgggtgcctctcctnctcctcaagccgctgctctgcattataaca

SEQ ID NO: 15927 - DNA, 101 bp, rice(Oryza sativa)
  misc_feature (71): n=t or g
cggatgagaacggagatagctgatccatctactagtgttggttttgtccacagctgtttctttacacaagncatagtatgtttctagctacttgctagttg

SEQ ID NO: 15928 - DNA, 101 bp, rice(Oryza sativa)
  misc_feature (71): n=t or g
gatctccaaagatggcttcttcaggaagggaggaaccggtgactggagcaatcacatgtcaccagagatgncagcgaggctggacaagatcgttaaggaga

SEQ ID NO: 15929 - DNA, 101 bp, rice(Oryza sativa)
  misc_feature (71): n=t or c
tttgggactggtggagtactaaatcaccgtgccaatcgcgaaactacctttgtttgtctgcaaaaggacangatatgggcttacacgagtttacatgctgt

SEQ ID NO: 15930 - DNA, 101 bp, rice(Oryza sativa)
  misc_feature (71): n=a or c
tcgccctcctcctcctctgctgccgcccaacaactcaagcaacaaccagtcaggaaaaaaccatgaaaccngaggagaagaggctcaaatcttccgcgcga

SEQ ID NO: 15931 - DNA, 101 bp, rice(Oryza sativa)
  misc_feature (71): n=a or g
actagattaattacatatgcacgttgctaaattaattagtctagtggtgggccttaattaaccctgactgnacgcaatcgtaaataaatcaaggaggaaca

SEQ ID NO: 15932 - DNA, 101 bp, rice(Oryza sativa)
  misc_feature (71): n=t or c
aaggtgaggagaggatcttattttttttgtactgcgaattcagaatctgaacttgtggtgcttgtcgaaangaggtggtcaatccagaagcgttttttccc

SEQ ID NO: 15933 - DNA, 101 bp, rice(Oryza sativa)
  misc_feature (71): n=t or c
gacgtgccggcgccgaagacgaactccccggggaaatcctgccttgtgaagttgagagctctcgccgccgncgccgccgcctcgcctgaccgccatggcgc

SEQ ID NO: 15934 - DNA, 101 bp, rice(Oryza sativa)
  misc_feature (71): n=a or g
cactgagatccttgctgacctgttcggaactccacgtggaggggggggggtcatataattagagtattgcncaataatttgtaaacaatgtactggtgttg

SEQ ID NO: 15935 - DNA, 101 bp, rice(Oryza sativa)
  misc_feature (71): n=t or c
gatgccgatatgactggccctggtgaggtcgccctcctgatatcgttgtttgcccttgttgtcatctacancttcacctcacctcgcttgtctccctatgt

SEQ ID NO: 15936 - DNA, 101 bp, rice(Oryza sativa)
  misc_feature (71): n=t or c
tccatagtccactcttccaatagacattgcccctctcccagataaaaaaatcacccttctcatttggatcnatcccaaaagaatagtctcctattgctggg

SEQ ID NO: 15937 - DNA, 101 bp, rice(Oryza sativa)
  misc_feature (71): n=a or g
tttttcggcgtttttatggttgataatgagacaaaagaaaaacacctcgctcgtgaagccgatgaacaacnagcacgacaagaagtcaagcggctcagatt

SEQ ID NO: 15938 - DNA, 101 bp, rice(Oryza sativa)
  misc_feature (71): n=t or c
cccaatcaaactcgcgtcaccatttggacaagaaaccgcgggagagtagaggtaaagaggaagtgcatacnggagtagaggcggagaggtggtggatctgg

SEQ ID NO: 15939 - DNA, 101 bp, rice(Oryza sativa)
  misc_feature (71): n=a or g
gctctaaggatagtagatggagatgagacaccgatagctctagagatcatggcagccatggatcatgcaangcgttccataaatgatgctttgaaagacaa

SEQ ID NO: 15940 - DNA, 101 bp, rice(Oryza sativa)
  misc_feature (71): n=t or g
ttcatgaacgcccattttgttgattagatcttccttggattctgatgattcttgttccatgggtatgagcngactgactaactgtcttagaagactaagga

SEQ ID NO: 15941 - DNA, 101 bp, rice(Oryza sativa)
  misc_feature (71): n=a or g
cgattattagctagttgaccagacaaaagggatagtagtagtgtaaggattttaagtttattccctgtgtnggtattattttaagtagagtatataatgat

SEQ ID NO: 15942 - DNA, 101 bp, rice(Oryza sativa)
  misc_feature (71): n=a or g
ctgaggagcctcccggcgacactctgctctctcaccaggtgaagttagagccataacatcaggaacagcancaacagttccagtaaatatgaccctgaaaa

SEQ ID NO: 15943 - DNA, 101 bp, rice(Oryza sativa)
  misc_feature (71): n=a or g
aggatgttaaacgtttctaatttaaacaatgctctataactaatcattcggctaagaacactaaggcatcnttcgtttaggggtgataggggagattggct

SEQ ID NO: 15944 - DNA, 101 bp, rice(Oryza sativa)
  misc_feature (71): n=t or g
gttcaccatgagcctgtccaaaggtaaatgttcagtggtttcactggagttgggagtaggtggcttctcantcccaactttactgtgaccattcatggtag

SEQ ID NO: 15945 - DNA, 101 bp, rice(Oryza sativa)
  misc_feature (71): n=t or c
aaatgttctgttagcgactttgcttttggtttctgtatcttttcgacaggctcaacgtagaatttagcatncgcgtaaaaggattcagccaccgtgaatgg

SEQ ID NO: 15946 - DNA, 101 bp, rice(Oryza sativa)
  misc_feature (71): n=t or c
tcttatttatcaaggttggaacattggaatgaacatcataaaaacagtgtcccgtttcacggccggactcnctttttaattttgcgctatggaagatcgag

SEQ ID NO: 15947 - DNA, 101 bp, rice(Oryza sativa)
  misc_feature (71): n=t or g
tcgtcatcgtgcagctgttaccgtcattgtcatcatcgcagcctccatcactgccatcatcgtcgcccctnctcccgtcccactgcctgagcccgctgctc

SEQ ID NO: 15948 - DNA, 101 bp, rice(Oryza sativa)
  misc_feature (71): n=t or c
tgctagtgatcttggctcccaatctttgacagcggtggcgcgaagttatggatcttcaacaactgcgacgngagaggagtgcgacagagagggagcgctgg

SEQ ID NO: 15949 - DNA, 101 bp, rice(Oryza sativa)
  misc_feature (71): n=t or g
ataaaaccaattcctggagtcatggagatgaatccggatataatgtatgtctatatttattctcatgacangatttttttagatagaggaagtagatattt

SEQ ID NO: 15950 - DNA, 101 bp, rice(Oryza sativa)
  misc_feature (71): n=a or g
atttgctatgtccggatcttctatgaagtcttcttcaggtaatctctcatcctgaactacattattttctnaattgtcattcatatttgcatcttgatcat

SEQ ID NO: 15951 - DNA, 101 bp, rice(Oryza sativa)
  misc_feature (71): n=a or g
tagtagctgcaagcttaaagacaacccaaataaagaatctcaattcactttttgtttttttggtctacccncatgctaagccttctctcctgtaataatta

SEQ ID NO: 15952 - DNA, 101 bp, rice(Oryza sativa)
  misc_feature (71): n=a or c
tgaacgttgaacaagttctttgaggtagtcttcagccacttcttccaatgtaatatctcccctttcttcantaaaaccttcagctatccatagccgaatta

SEQ ID NO: 15953 - DNA, 101 bp, rice(Oryza sativa)
  misc_feature (71): n=t or g
aatcctattgacaaatgtgggaccgcctttttcgagtctggtagcatcggcttgactccgtcagatttggngctagccgatatgcggcagccgatactgcc

SEQ ID NO: 15954 - DNA, 101 bp, rice(Oryza sativa)
  misc_feature (71): n=t or c
taggcaagtaacaactaaataactagtcggacgaagcttgtaagcaccagttgtatgtgtggccatttgcnttttctctttctctcgtgtagccgcatgcc

SEQ ID NO: 15955 - DNA, 101 bp, rice(Oryza sativa)
  misc_feature (71): n=a or g
ttgattaatggttactgtaaaattaatagaatggaggacgcattagctcttttcaaggagatggaaagcantggtgttaatcctgatattattacatataa

SEQ ID NO: 15956 - DNA, 101 bp, rice(Oryza sativa)
  misc_feature (71): n=t or c
cgcgagaccgtgcggtctcgcgctttcgccacgcgataccgcccgcaacgtcatcgtcatatcattttcgngtaacagaagtgcgacaccgatggtatatt

SEQ ID NO: 15957 - DNA, 101 bp, rice(Oryza sativa)
  misc_feature (71): n=a or g
atcatggctcccaaatcttgtctcattagatttaagcaacattcctaactgtagctgcctaccacccctcngacacatcccttatctccaatcgcttcatc

SEQ ID NO: 15958 - DNA, 101 bp, rice(Oryza sativa)
  misc_feature (71): n=t or g
cgcggcgtgccggcgtgctacgtttggatgtactactacgcatcgatcggcagagacgtatggtcaaaagncgatgggaccgccggcgttgaacggctgtc

SEQ ID NO: 15959 - DNA, 101 bp, rice(Oryza sativa)
  misc_feature (71): n=a or c
tcctagtgccactccgaacgccgatcaattggaaaagatccaaggtcctccttgcaaacaaccagatagtnaagctccaatggcgtgattctgaaggcaga

SEQ ID NO: 15960 - DNA, 101 bp, rice(Oryza sativa)
  misc_feature (71): n=t or c
ccttatagaataatttgctcaataatctgtgcttaagtctttaactaccttatgcaagtcagaaagtcacncttgaaggcctcatcacatgatcaagggtg

SEQ ID NO: 15961 - DNA, 101 bp, rice(Oryza sativa)
  misc_feature (71): n=t or c
gctgctcgagtatcgccactttgtttcctttgccgaggcgaaacaaagagaggagatatagtgggagatgngacccactataagccactgtggagtatata

SEQ ID NO: 15962 - DNA, 101 bp, rice(Oryza sativa)
  misc_feature (71): n=t or c
taccatgatggagtactgcgtggctgatggatttatggcagtttggctgacgcttgttgtgctccctggangaacgccgagtcagtgatgggttagccgca

SEQ ID NO: 15963 - DNA, 101 bp, rice(Oryza sativa)
  misc_feature (71): n=a or g
ttcgagctgcaaacaaagaatggcatgaatcagcagaaaaccaattggataaaacgtaccagcaccaagtngaagaggagcaagatgcttctatatttaat

SEQ ID NO: 15964 - DNA, 101 bp, rice(Oryza sativa)
  misc_feature (71): n=a or g
tacacaataaacaaaaagaaaatgaaacacacaaatcctatctgaaaaattgcaaagttagccctacctgnctctggcagacctacccaaaaatcaaactg

SEQ ID NO: 15965 - DNA, 101 bp, rice(Oryza sativa)
  misc_feature (71): n=a or c
gttcttgctaagatggacgaaatgggagttcttgctaagatggaaggacaagcctaaaacaacatatttgnattgctaccagtcttaatgcctttcataag

SEQ ID NO: 15966 - DNA, 101 bp, rice(Oryza sativa)
  misc_feature (71): n=a or g
gtgaagaaaaaaaccctaaaccacaaactcaccacttccatcttccagcgatctccatggatctcccaaantctgttgccgacgaagtcgctctggcgaag

SEQ ID NO: 15967 - DNA, 101 bp, rice(Oryza sativa)
  misc_feature (71): n=t or c
aaacgcagtttcattacacgtgaggtgcgttgacatgttgtttatgtgacgcttacttggcatttgcaatnaaaattgaagaaaatgtaaatagcacagtt

SEQ ID NO: 15968 - DNA, 101 bp, rice(Oryza sativa)
  misc_feature (71): n=a or g
cctgaccaaatttaccgcaaatctccaatgacagaaagcaggaggcctggcagagtacgtggcggcatcgnagagcgacaccgtgtcccgccccgccggaa

SEQ ID NO: 15969 - DNA, 101 bp, rice(Oryza sativa)
  misc_feature (71): n=a or c
gaagtagagggcattgtcttcatcttcctccttcctcaggaaagggtagactggctgagtctccggcaatncattcttcttgaagtcctccagctcccaca

SEQ ID NO: 15970 - DNA, 101 bp, rice(Oryza sativa)
  misc_feature (71): n=a or g
caagagtagcagacagtttatcagaatccaagttgcaatgcaatgcatgtcagatggagaaagcagactangacgagcaggatactgagacttgatcaaag

SEQ ID NO: 15971 - DNA, 101 bp, rice(Oryza sativa)
  misc_feature (71): n=t or c
ttacaaaaaggaccgtgcaatctgatcaatgtaatcagaggcaacaatccgaacgaatccgaaaacctttnctcccgtcaatgagaagaagaaaagggtga

SEQ ID NO: 15972 - DNA, 101 bp, rice(Oryza sativa)
  misc_feature (71): n=a or g
ttacttatgctgtgaacctcgttgacgcgtgtcgaacaggatcaaagtatgcacaaaactagccattctcnacatagccatcgctactactggttatagcg

SEQ ID NO: 15973 - DNA, 101 bp, rice(Oryza sativa)
  misc_feature (71): n=t or g
ataaacacacggccggatttgcagacgtggtgaacatgccaccatctgtatgtatacattacaccatgaanaaaaggtcatattatacatggaccatctaa

SEQ ID NO: 15974 - DNA, 101 bp, rice(Oryza sativa)
  misc_feature (71): n=a or c
caggcatgtctggatcagaatttgcaaaaaatgtagccacttggcttaaaggagtcccttcagaaaactgnaataaaaatccgagatgctcaaatgtctct

SEQ ID NO: 15975 - DNA, 101 bp, rice(Oryza sativa)
  misc_feature (71): n=t or c
ttgagaagccaatgacgaagacacgttttaacacattgccaacagcatgtgttagaggggtcaccctttcnaatgtgtttgtagcaacctggataaaagag

SEQ ID NO: 15976 - DNA, 101 bp, rice(Oryza sativa)
  misc_feature (71): n=a or g
cacgtgcttattatgagaaataccagcctcatgtcttgcttttatgcctgcctctctaatcttggatatgnccttaaccacttcagtttctatctccggaa

SEQ ID NO: 15977 - DNA, 101 bp, rice(Oryza sativa)
  misc_feature (71): n=a or g
acacaggcaagacagttcatacccttgatacagatgcaagattcatcccatattgctcaactggattttcntagccacgtattcttttaccccacaatatg

SEQ ID NO: 15978 - DNA, 101 bp, rice(Oryza sativa)
  misc_feature (71): n=a or g
atatgaaaaagaaaagcacaaacaacaacctatattctggtacagcacctaactaagcaagaagccagatngataacaaagggactagtatttgatggtac

SEQ ID NO: 15979 - DNA, 101 bp, rice(Oryza sativa)
  misc_feature (71): n=a or g
tcaaaacatgctttaccagctctggatcccatccctcataaatatattctccagaaacaatgtgcttctcngaataatatagcatattttctgcaaaagaa

SEQ ID NO: 15980 - DNA, 101 bp, rice(Oryza sativa)
  misc_feature (71): n=t or c
tggtgaattatagggtagatcagtaatcagccataacatgttttgtcgagctcacaagattggaatctccngctagggaatcaattttcaactgtaatttg

SEQ ID NO: 15981 - DNA, 101 bp, rice(Oryza sativa)
  misc_feature (71): n=a or g
agcgctcaaatttacatctcaccccctaaaaaaacatataataacaccgaaagcatcaaacgatctgcacngcgcaacggacaacggcagttttccctaaa

SEQ ID NO: 15982 - DNA, 101 bp, rice(Oryza sativa)
  misc_feature (71): n=a or g
atgattgcggcgagataaagcactttaacacatcgcgttatgttaggtcattccatcgcggcaaaattgcngcttattttctggaaatattctactactat

SEQ ID NO: 15983 - DNA, 101 bp, rice(Oryza sativa)
  misc_feature (71): n=t or g
gattaatttatttggcatgtttagaaggcacttttatggcagcaactttacaggcagaagacacgttactnaagtcactaaagaaacgaaaaacaatttag

SEQ ID NO: 15984 - DNA, 101 bp, rice(Oryza sativa)
  misc_feature (71): n=a or g
ggggagagacatcgagcttggagtgacgaacgcgtgtggggaaagtgagtggcattttcgtcagagaaccncagcgacacagtagagagcagttagttgaa

SEQ ID NO: 15985 - DNA, 101 bp, rice(Oryza sativa)
  misc_feature (71): n=t or c
aaagtcgagttcattcagttcgcgggttaccccaattggtaacaagtttacgccaagagccaatgtgaatngaggtaccaccataaactcgagtggtggtt

SEQ ID NO: 15986 - DNA, 101 bp, rice(Oryza sativa)
  misc_feature (71): n=t or c
ccgccagcctgggcgttcacagacggcctcatcacattcaagggctgcgtcctcgtgccgctgtcgtccgnatcattgccgaccatcctcgagccggcgca

SEQ ID NO: 15987 - DNA, 101 bp, rice(Oryza sativa)
  misc_feature (71): n=a or g
caaaaggactacgaaaggtggctgcggcgtctgaggctgttatgatggaggcatatgtcacgtgatgtacntgaggcctatgtgttgtgagtagggtttct

SEQ ID NO: 15988 - DNA, 101 bp, rice(Oryza sativa)
  misc_feature (71): n=a or g
ttttttgcgtcaagcaaagccttttgtgcttttccaatttgtaggtaacaaaggcttctgtttgaatacanggttgcatcaaaatagtctagctcaagcgc

SEQ ID NO: 15989 - DNA, 101 bp, rice(Oryza sativa)
  misc_feature (71): n=t or c
tatgtgcatcatatgatctagaacggaaaggatacacagtgattactgtagcgaaatattatagcagaggnatatttggtacttaaacagtcatctagagc

SEQ ID NO: 15990 - DNA, 101 bp, rice(Oryza sativa)
  misc_feature (71): n=a or c
tatgagaccgaagggtatgccgtggtagtacgaatcatgattgcctgtttgaacacttttcacttagatgnaaggatggtccacaagagagcaggaccaat

SEQ ID NO: 15991 - DNA, 101 bp, rice(Oryza sativa)
  misc_feature (71): n=t or g
ccatgtattgccaagaatgttctcttctttctttccatcgaagatgtttgatcggtcgcaaatcttctctngtgagcttcgccgcattccaaccatggaaa

SEQ ID NO: 15992 - DNA, 101 bp, rice(Oryza sativa)
  misc_feature (71): n=t or c
atcctgtttgttcttggttaggatactccaaagagttctccaagctcagttcaatcaccggagatctcgtngaaggaagcgcaggatgacaatgtgaaggt

SEQ ID NO: 15993 - DNA, 101 bp, rice(Oryza sativa)
  misc_feature (71): n=a or g
gcattcacttatgagccaaataaataggtactgctaacacaccccttaaggccatgtctagttttcctctnttcccaactttccatcacattatatcacat

SEQ ID NO: 15994 - DNA, 101 bp, rice(Oryza sativa)
  misc_feature (71): n=t or c
tctatggagtggctccatattcagttcatgaaccaggttgttggtgtcgatgtcaattggggactgctgcnttccgttcgagcaacgcgtgaagtcggcac

SEQ ID NO: 15995 - DNA, 101 bp, rice(Oryza sativa)
  misc_feature (71): n=a or g
cgactaggatgtatatctagcaaatgtgggaaagggcatcaaattaagagtattcaagctctctctctctnctagagacaaacaagaaagtacaatttcat

SEQ ID NO: 15996 - DNA, 101 bp, rice(Oryza sativa)
  misc_feature (71): n=a or g
gtggtactagttttattgtgaggtttaaacggatgagggttgtagctgagtcaatgacatgtcagccacgncaaattcaaatggacgtggctttgcataca

SEQ ID NO: 15997 - DNA, 101 bp, rice(Oryza sativa)
  misc_feature (71): n=t or g
agaatcgaatgggacctaaggtttcatacaaagatgcatccacgccaaagaatcacatcatcatggttaanaatgcatcccccacatcatcatatcttatg

SEQ ID NO: 15998 - DNA, 101 bp, rice(Oryza sativa)
  misc_feature (71): n=a or g
aaaatatgtttatagctggctaatgtgtctgctattgtacctgcttagtgggtgaattatgaaaatatacnttaggtgaaaggagaataaatgaattaaat

SEQ ID NO: 15999 - DNA, 101 bp, rice(Oryza sativa)
  misc_feature (71): n=t or c
tttttcatcacaattgtctttgggcttctcaagaattatatatagcaagatccacgtaccaacggtccaangcaataagtgaacaaacaggtcggtgtgct

SEQ ID NO: 16000 - DNA, 101 bp, rice(Oryza sativa)
  misc_feature (71): n=a or g
aattctggtcatattaacggtacagggcttactagaatgggatttgcattttaggtctaagaagaattatncaaggttaaaaattttatctttagttttga

SEQ ID NO: 16001 - DNA, 101 bp, rice(Oryza sativa)
  misc_feature (71): n=a or g
tctacggctcaacagcaaatctccaatttgtgcaatttctatgaaggcgaccgaaggggattactggttcntcaagcggtctgcatgctaaaggagaccca

SEQ ID NO: 16002 - DNA, 101 bp, rice(Oryza sativa)
  misc_feature (71): n=a or g
gtttttcccaacaatacacattttagtgcaaacgagcaaagaaaaggtaaagaggagaatgaacaaggcgncaaggtggtttagttttctgcattttcata

SEQ ID NO: 16003 - DNA, 101 bp, rice(Oryza sativa)
  misc_feature (71): n=a or g
ggtgctggcatgcacggtgcccttcttcggctatctcatgttgttcatcgggtcctcgctgaacgtcaccnttgctgtgctggtcccgtgcctgagctatc

SEQ ID NO: 16004 - DNA, 101 bp, rice(Oryza sativa)
  misc_feature (71): n=a or g
tttcaaaactaccatttgatagttacgcggaaaaatgaggaattcaagacacatgaagaagaagatatgangtaagacgtcgtactaattttcctccaaaa

SEQ ID NO: 16005 - DNA, 101 bp, rice(Oryza sativa)
  misc_feature (71): n=a or c
tgaatgggctcttcctcagatttttctgttgatgaaacagtgggcaaacgcacatttctgacatgtttacnacttgaataattatcaacatttgttgatgg

SEQ ID NO: 16006 - DNA, 101 bp, rice(Oryza sativa)
  misc_feature (71): n=a or g
aatataaactttggatccaactaaacacagccttggtctgaccggattgcaatgccggtcgttgtgcactngacttatttttttttaattttatctacatt

SEQ ID NO: 16007 - DNA, 101 bp, rice(Oryza sativa)
  misc_feature (71): n=t or c
ggagtttaaagcaccgagaactagatatgagaatcttaaaagattggtttttcaccttctgacttttagtntataataactagattttcagaacttgactg

SEQ ID NO: 16008 - DNA, 101 bp, rice(Oryza sativa)
  misc_feature (71): n=a or g
agttgcgccattattcgtttgtctgatactttcttcggaacaaaacaatcatttgttacagcacaacaccnaaccaccctcggtcatgataatgctagctc

SEQ ID NO: 16009 - DNA, 101 bp, rice(Oryza sativa)
  misc_feature (71): n=t or c
ttctgatcttctgcaaacaaaggagaaaaatcataacgaggtacataatggtctgggctatcctggtacangcccaatagccagcagcgatgtggacctta

SEQ ID NO: 16010 - DNA, 101 bp, rice(Oryza sativa)
  misc_feature (71): n=t or c
ttgaatgcctcatccggaggtcactgcacggcacgccccaaaaaaacaaaggtcgtacagacgtacgggancagtatatatatactgtataaggcacgctg

SEQ ID NO: 16011 - DNA, 101 bp, rice(Oryza sativa)
  misc_feature (71): n=a or g
cagttggtggttgggccacagcttggaccacaaaatagaaacttttccaaccacatcagggggaaaagctntgtgttccttgggggtgacagggccagatc

SEQ ID NO: 16012 - DNA, 101 bp, rice(Oryza sativa)
  misc_feature (71): n=a or g
gtaactccaaattttgtcacaggacctgacaaatacctttcctattaaggtggaacctttggatgatattnttccttttgatcctgaaatagtagtccttt

SEQ ID NO: 16013 - DNA, 101 bp, rice(Oryza sativa)
  misc_feature (71): n=t or c
taaacatattattttgggtatgaattggcattgccaatgtccttgttttgaattagcttagttaattgtgntcaaccagttcttttcaacaatagtgtctg

SEQ ID NO: 16014 - DNA, 101 bp, rice(Oryza sativa)
  misc_feature (71): n=a or g
tcatatcattgctaggaaagctagttcaatatcctgagagacctggtgaaccattctgtcgatactacatnaagtttggggaatgtaaacatatgactttc

SEQ ID NO: 16015 - DNA, 101 bp, rice(Oryza sativa)
  misc_feature (71): n=a or g
tggggatagcttatgggaggggaagagtacggcaaacctggcgcaaaattagttacctccttggctgggtngacatatggctccctgatcgccggtgggct

SEQ ID NO: 16016 - DNA, 101 bp, rice(Oryza sativa)
  misc_feature (71): n=t or c
agtagtagcaccatccagataatctggcatggtagagaaatgagcacctgtcacaatgtgacagtcacgtnggtgggccagcggtgaagctcggtcggcgg

SEQ ID NO: 16017 - DNA, 101 bp, rice(Oryza sativa)
  misc_feature (71): n=t or g
aagcagcatgtggtgaatttatgaatccaagaaattcgatttgtttttggtaatatcgcttttataataanatctttttttttttcgaaaaagacggcagg

SEQ ID NO: 16018 - DNA, 101 bp, rice(Oryza sativa)
  misc_feature (71): n=a or c
gacaataatcatatttcacatttctttgttgttgttatccttaaacgagagaatttgcagctacgaagcgncctttttggcttgtattatttgtatatggt

SEQ ID NO: 16019 - DNA, 101 bp, rice(Oryza sativa)
  misc_feature (71): n=t or g
ttgtcgaaccatgctggcgacgctaatggcatcctgacggactagccgaaatcctagcttagaaggggagnagcgtaaatccggtctttaagcaaaaccat

SEQ ID NO: 16020 - DNA, 101 bp, rice(Oryza sativa)
  misc_feature (71): n=t or c
actcaacagaaagatttgtctgaaagcaagcataatactggtcagtcaggtgctggaatcagttgaccccntggcatgctcatacttggtcttgaattcct

SEQ ID NO: 16021 - DNA, 101 bp, rice(Oryza sativa)
  misc_feature (71): n=t or g
gtgacaatcgtatataaggatctatcttcttctgtaaaattgtgctgtacagggtcctcaggaatttgccntggtgatcctctttcagctgtcaatcactc

SEQ ID NO: 16022 - DNA, 101 bp, rice(Oryza sativa)
  misc_feature (71): n=t or g
gcgtctgagatgaagatgaagatgaagggagtcgggaagacttaccggctttcgctcccggccgtcttggncctccggcggcgtcgtctctgcagatccag

SEQ ID NO: 16023 - DNA, 101 bp, rice(Oryza sativa)
  misc_feature (71): n=a or g
aagctgcctgacaaccatataaaaaccaggatcatgcaaggcatcagtgcaattaatgcatgtactaatcncgcacctgtgatgacattatgcctgcagca

SEQ ID NO: 16024 - DNA, 101 bp, rice(Oryza sativa)
  misc_feature (71): n=a or g
ccatctctgctctctcccttatcggcgatgcaccctctccctctccaacgctactctctccctctccggcntctcaccctcttcctctccctctctagctc

SEQ ID NO: 16025 - DNA, 101 bp, rice(Oryza sativa)
  misc_feature (71): n=t or c
tacaaccagctgcctcgagcttctccttggctgaagcagagaatgccccagccttgatattcaacttgacngatacatcaccatctcctaaaatctacaga

SEQ ID NO: 16026 - DNA, 101 bp, rice(Oryza sativa)
  misc_feature (71): n=a or c
agaagatggagggaaggtgatcatcatagatatagttattggtgctccttcaggactgctgctagaagccnagctcctcatggatgtggctatgatggtgg

SEQ ID NO: 16027 - DNA, 101 bp, rice(Oryza sativa)
  misc_feature (71): n=a or g
ctgtcggtctggccggtgtagatcgcctagtctaatcgtcccgaagtcacctctgcctcttgacgacgtcnccggtctgaccgccagtgtccagccggtct

SEQ ID NO: 16028 - DNA, 101 bp, rice(Oryza sativa)
  misc_feature (71): n=t or c
ttgtgctttcgttattttgggcctttccagatcctgagtaaagttgggttagtggcatacaagttacagtnacctcctgatagcaccattcatcctgtttt

SEQ ID NO: 16029 - DNA, 101 bp, rice(Oryza sativa)
  misc_feature (71): n=a or g
tttggtgtctaattcaactggtgtttagatgtacttttacatgcgtgttgtgttggtttcctgcagctcgnccaccaacaggatcatcaccgccaaggacc

SEQ ID NO: 16030 - DNA, 101 bp, rice(Oryza sativa)
  misc_feature (71): n=a or c
aagcaaaaaatcagcattcctgatatggctagcgagaggatgccagtctgaatcagcacttaattcacatntaaactgcgtgccaaataagttttgtgtta

SEQ ID NO: 16031 - DNA, 101 bp, rice(Oryza sativa)
  misc_feature (71): n=t or g
agtcatatatagtactagcctactaggcctgagtatattgcagaatactcgagaaatattgcaactacaantagtcaaatactagcagtatactcatagct

SEQ ID NO: 16032 - DNA, 101 bp, rice(Oryza sativa)
  misc_feature (71): n=a or g
agatctgcactctattggtggattagatcccctacttggttacttgaaaaattcacatgctggcatcagancaaaggctgcagaggttgtgagcacgattg

SEQ ID NO: 16033 - DNA, 101 bp, rice(Oryza sativa)
  misc_feature (71): n=a or g
cggatctaagatccacattgccgcataagaggatgatgacattattagatcagaggttggcagcgatcctnagttgggagggatgacgtggatgaaagagg

SEQ ID NO: 16034 - DNA, 101 bp, rice(Oryza sativa)
  misc_feature (71): n=a or g
ccctagacagcttagagggagagggagggagaactccaaatccacttcttctccatctatgtcgaccactngagcccgcctgccggcacttctgggcccaa

SEQ ID NO: 16035 - DNA, 101 bp, rice(Oryza sativa)
  misc_feature (71): n=t or g
gggcgagcgatcgagcgagccccactccaaccaccggacgaagcttatcagccgcgactacgacccaacgncgcgccgcgcgcacgagttcggcgcgccat

SEQ ID NO: 16036 - DNA, 101 bp, rice(Oryza sativa)
  misc_feature (71): n=t or g
tggaaggtctttaagggataaggtgtgcgtgtgtgtttatagtttgagtttgcgcgtgttacgagcatctntatttgttttccaaaatacaattacatgga

SEQ ID NO: 16037 - DNA, 101 bp, rice(Oryza sativa)
  misc_feature (71): n=a or g
ttcgtgtggtcgttacgagctttcagttatcttggcattcatcacatggtcgttcatagctacatcagctntttccatgttttggttactagcttcgcttt

SEQ ID NO: 16038 - DNA, 101 bp, rice(Oryza sativa)
  misc_feature (71): n=t or c
tcgaatggctagaaatgtcaccaactcaccatgccaaatatcactacagtgatgggagacatatatccatnccatgaggatattcccttgttttgtactta

SEQ ID NO: 16039 - DNA, 101 bp, rice(Oryza sativa)
  misc_feature (71): n=t or g
gtttaacaccctccaactataataactagctcaacccttcgcccaaaatccctcttccctccctccctgtntttgttatgttttcttatgtacacagtagt

SEQ ID NO: 16040 - DNA, 101 bp, rice(Oryza sativa)
  misc_feature (71): n=a or g
ttctatgcaggaccctagcacacctggcatttttgctcaaccagttgcttatggacctgagctagtccctncatacacatgggatccttcttttgcccttc

SEQ ID NO: 16041 - DNA, 101 bp, rice(Oryza sativa)
  misc_feature (71): n=a or g
ggacatggaaatggggatgatccaggcaaaattcccacgacaatgggccaagaagaagaagaagaagaagnagaagcagactaagtcatgcatacagaagc

SEQ ID NO: 16042 - DNA, 101 bp, rice(Oryza sativa)
  misc_feature (71): n=t or c
tttccttctttcagccagcgtcttcctttttccgagaaatatagttgcattctacatttccgagaataaangtagttggtaagattttattatatttgtaa

SEQ ID NO: 16043 - DNA, 101 bp, rice(Oryza sativa)
  misc_feature (71): n=t or g
ttaggcttatatctgtcttacttttatacagttttgcatcaataattttgtagctgcccaataccttcatntgtctatgttattttattcattctaaaaat

SEQ ID NO: 16044 - DNA, 101 bp, rice(Oryza sativa)
  misc_feature (71): n=a or c
aacgggaaagtggaactccgaatgatcaagcacaactcaaaatgccacatgtcttatggcaccgatggtancattaaggtattgttctgaataataactta

SEQ ID NO: 16045 - DNA, 101 bp, rice(Oryza sativa)
  misc_feature (71): n=t or c
ggttcaggagggccagtgattgaccatgatggtaatatcattgggattgtatttgacaataacccgggtcnggtagtaacctctatcactacaatcagaac

SEQ ID NO: 16046 - DNA, 101 bp, rice(Oryza sativa)
  misc_feature (71): n=a or c
cgattcggctttcttgaggaaaacctttcactccaccagagtttgataactcgtcttgtcgacgagggcanagtttgtatggggacacatactgagtatat

SEQ ID NO: 16047 - DNA, 101 bp, rice(Oryza sativa)
  misc_feature (71): n=a or g
gatgaagattctggttcaggctctggattttcaaataccccatcttttgacatgtttgatgatgcttcacngaataagaaaaaagatttaattctggtact

SEQ ID NO: 16048 - DNA, 101 bp, rice(Oryza sativa)
  misc_feature (71): n=a or g
tatggcccataattgattctttagtgcctcacctttgtatagcactgcaaaattttggtaaagatgtctancacaaaacctatgctcactatcagggaact

SEQ ID NO: 16049 - DNA, 101 bp, rice(Oryza sativa)
  misc_feature (71): n=a or g
aattcaagtcagaaactgatacatgtttggaagggacgtcattgtccaccaattttttgagcacacgctcncgtcgagtgggtcgtactccctttggcctc

SEQ ID NO: 16050 - DNA, 101 bp, rice(Oryza sativa)
  misc_feature (71): n=t or c
ccgtctctattttgcgagctgaggcgtctatctctgagaatgtgtatcaaacgaactggccggttgacttngacttgaacaaaaaactttgactgagctag

SEQ ID NO: 16051 - DNA, 101 bp, rice(Oryza sativa)
  misc_feature (71): n=t or c
cctgcctgctctgttgctttgctttctgctgccgatcgtgcagtactgcagttgccctgatcgaaagccancctctattcattcattcattcattcagttt

SEQ ID NO: 16052 - DNA, 101 bp, rice(Oryza sativa)
  misc_feature (71): n=t or c
gccacagtgacattcgtccgtgttcctcgggctactcggaaatgggaggtcatcatcacacgtgctggcgngggacgaggtgccttgccattacgtctcca

SEQ ID NO: 16053 - DNA, 101 bp, rice(Oryza sativa)
  misc_feature (71): n=t or g
ccgagttgccgagaccacccccacactatatctctagcctggatttttgttgagaaatggagattcaaggnaagttggcctagtccaaattgtcttgctgc

SEQ ID NO: 16054 - DNA, 101 bp, rice(Oryza sativa)
  misc_feature (71): n=t or c
tacgaaatatggcacatctagtatcacgaatctaaggacctgttacgaatctaaggacatgtttatattcnctggcaaattttttcaccctatgacatcga

SEQ ID NO: 16055 - DNA, 101 bp, rice(Oryza sativa)
  misc_feature (71): n=t or c
acttaaacttcaacaaccatgtgcgaaatgtaatcgtgttgctcagtgctctcccatccaattttaaatgnggttgtgagtttatattcgtcttatttaaa

SEQ ID NO: 16056 - DNA, 101 bp, rice(Oryza sativa)
  misc_feature (71): n=t or g
acgcatatgcacaccgattgattgattgctctggtttcgcttccgcgattgcgagatagtagtagtagtanagggtcgctcactgtggttgtggttgtggt

SEQ ID NO: 16057 - DNA, 101 bp, rice(Oryza sativa)
  misc_feature (71): n=a or g
agcacttgtcagttgtcaagaaaccaggatatcagcacagtgaagcatcggatagccaagcattatcatanaatagagagtaacataagatttcagatctt

SEQ ID NO: 16058 - DNA, 101 bp, rice(Oryza sativa)
  misc_feature (71): n=a or g
cccctatgaataccttcgaaacccacatgaatgccttcgaaagggaaaggccacccacatgaatgtcttcnaaaggccgatttatatattttgagattgac

SEQ ID NO: 16059 - DNA, 101 bp, rice(Oryza sativa)
  misc_feature (71): n=a or g
cgcacaattacgttggttaattgaaatggagaagtggtagtaattcaatctccatttattcagaagaaagnagtaagcttgaattaagtggaaagtgaaca

SEQ ID NO: 16060 - DNA, 101 bp, rice(Oryza sativa)
  misc_feature (71): n=t or c
aggtacacaataaaaattagcagccttatgtgtatcttcccctacttccatacattcagtaagattttccngtgccgcttctagaaaatgggacactggct

SEQ ID NO: 16061 - DNA, 101 bp, rice(Oryza sativa)
  misc_feature (71): n=a or g
tgcagggatgaaagcaacaacacttccatccaaaaaggaaggaagactccagtcgaaatatgctagtaacnttgctcttaaatattcttctataagagaac

SEQ ID NO: 16062 - DNA, 101 bp, rice(Oryza sativa)
  misc_feature (71): n=a or c
cacatatgcagctacttgctgcgatgcaacgccgttgtccacccctcctccttgctctcatcctcttattntccgccgccgtcaccgttggcgtcgccgcc

SEQ ID NO: 16063 - DNA, 101 bp, rice(Oryza sativa)
  misc_feature (71): n=t or c
ggcttttgttgtcgttcttttacactaatccctcgctcctaaaatataattgcttctatagtactccctcngttccataatataagggattttgagttttt

SEQ ID NO: 16064 - DNA, 101 bp, rice(Oryza sativa)
  misc_feature (71): n=t or c
cattagcacatgcaatacatacccattttgctgcaaaggaatatcatcaactaactcttcgtgccaagtgnttgtgtcgatctctttattactcttgtcct

SEQ ID NO: 16065 - DNA, 101 bp, rice(Oryza sativa)
  misc_feature (71): n=t or g
cccggtgcccgtcctcgccacagttccttgtcttcttgtgtcgcgccgtctcctgcgggtcgccttgagcncgatggaggaggaaactgcccattcctcct

SEQ ID NO: 16066 - DNA, 101 bp, rice(Oryza sativa)
  misc_feature (71): n=t or c
caaaatgaattgaagagagaaactatgtgaaaaagaagattttgccccctcaagctagtaagttgtagcangtctgagtcttgttcgaatccttccaagcc

SEQ ID NO: 16067 - DNA, 101 bp, rice(Oryza sativa)
  misc_feature (71): n=t or g
attgtatatgtcacttgatgcatgcaaaagagggttcttaaagggctgcagacctcttatttatttggatnggtgccacataaagacaaaatttggtggtc

SEQ ID NO: 16068 - DNA, 101 bp, rice(Oryza sativa)
  misc_feature (71): n=t or c
tctttgttctaacgaactaattaaacgagcagctcaagctggagactttaatcaaagaataacgcatgcangtcacaccgcctatgcaatcatgcatgatt

SEQ ID NO: 16069 - DNA, 101 bp, rice(Oryza sativa)
  misc_feature (71): n=t or c
gttgctagcacttgagccggccggatgacacgctagtgccaccatcaccggtaccatccacgtctggctcngtctctggctaagacccatcgttctgaggt

SEQ ID NO: 16070 - DNA, 101 bp, rice(Oryza sativa)
  misc_feature (71): n=t or g
aaagtaatgtacaacatagatattttttatcgagtataatcatgtaagatctaattgcaatgaaaacaatngtataattgaattatagatcggataagtaa

SEQ ID NO: 16071 - DNA, 101 bp, rice(Oryza sativa)
  misc_feature (71): n=t or c
ccatactaatgggctgtctaacggcccatatggtgcagctgggggttattttggcaaaaatatgaagaatnggtgcacctagtgggaatcgaacccaggtc

SEQ ID NO: 16072 - DNA, 101 bp, rice(Oryza sativa)
  misc_feature (71): n=a or c
cgacttagcatagcgagggagagcggctgcagcagcgtccgaccaaggattgttgtaactctgatacactntaatatgctggatcggggaggaacgcccat

SEQ ID NO: 16073 - DNA, 101 bp, rice(Oryza sativa)
  misc_feature (71): n=a or c
aaggaaaccaaaaaactagctaaactaagtaattaatcgaccaaccaaccctgaagaagaagaagaagagnaatctgggagctccgctccaccgccatggc

SEQ ID NO: 16074 - DNA, 101 bp, rice(Oryza sativa)
  misc_feature (71): n=t or c
aagtatgatgatgattctacacatacttggagttgatctgtagaaagtgttggctatatgctctggatgtnctctcaagtatgctgcttgcccaatgtaag

SEQ ID NO: 16075 - DNA, 101 bp, rice(Oryza sativa)
  misc_feature (71): n=a or g
tacgacatgatcatgcggtcaaatggcccggtttttccaatatatgatgatgattatttacacgaggggangaggagatacagatacgaggacacacgata

SEQ ID NO: 16076 - DNA, 101 bp, rice(Oryza sativa)
  misc_feature (71): n=t or g
gcaaataatcataaaacaaaaggaaaatgccacattatttagttactaatgcaacatctttttttccaatngtcaaatgcctttattattattattattta

SEQ ID NO: 16077 - DNA, 101 bp, rice(Oryza sativa)
  misc_feature (71): n=a or g
tggaaccttaaaggtgccagttcctaaaccggcacatttaaggataccacaaatgtgccgactaataggtnctggttgggggtttcctatgggggttctca

SEQ ID NO: 16078 - DNA, 101 bp, rice(Oryza sativa)
  misc_feature (71): n=a or c
aacaaaaaattggcgaaaaatacctgaaacatgtttccagattgagaaccacctaacaaagcatactctgnaggttgttctgagtgaaccttctgcttctt

SEQ ID NO: 16079 - DNA, 101 bp, rice(Oryza sativa)
  misc_feature (71): n=a or c
tagtaagtgctaatctagagagaacaccggctgctaaaaattggtaagcagttttgtgcggtcaccaagtntcttagggcatgtacaacggccgttattag

SEQ ID NO: 16080 - DNA, 101 bp, rice(Oryza sativa)
  misc_feature (71): n=a or c
ctcacaatcatcagaaccaaattcacagctaaatcgcacgcacaccacagtctacagcatctctgctttgnagctgcagcttaatttcagagctagcgagc

SEQ ID NO: 16081 - DNA, 101 bp, rice(Oryza sativa)
  misc_feature (71): n=t or c
acccttgatggctcgggcgtcattgtcgtcccaagattggctgaaattttcttcttacaaggagcgcctgnttggcctttcatttggtttgatttcaacca

SEQ ID NO: 16082 - DNA, 101 bp, rice(Oryza sativa)
  misc_feature (71): n=t or c
aagccacacactagtaccagtactagccatgctctttttgggacatggaataacaaatgcatgctccctcnattaaaaaaaaaaagacaaaccttggtttc

SEQ ID NO: 16083 - DNA, 101 bp, rice(Oryza sativa)
  misc_feature (71): n=t or c
aaattgattcaaatccagtcaaacattgtttgcaatttaaatctctagctagatttcaccgagagcggcanccctgagaaaaggatccctgctcaaggtat

SEQ ID NO: 16084 - DNA, 101 bp, rice(Oryza sativa)
  misc_feature (71): n=t or c
tcggcatcaccgagccaagccctatctcggcatcccctcttttccccaatctcccaccaaaacactacccnactgtcaacccgagccgccatcgcctttgc

SEQ ID NO: 16085 - DNA, 101 bp, rice(Oryza sativa)
  misc_feature (71): n=t or c
caggtgagatgggagcaggatcagggtggcgaccaaacaaggtctaaattcactcaggctagtctcaggcnaggtaaattttagtcatggtagcaaccaaa

SEQ ID NO: 16086 - DNA, 101 bp, rice(Oryza sativa)
  misc_feature (71): n=a or g
gggctaccgtatcatctgaagtcatgctttctgtacctcagtatttttcctgagaaccatgagatcagatntactcgtttggttcggcggtggatagcaga

SEQ ID NO: 16087 - DNA, 101 bp, rice(Oryza sativa)
  misc_feature (71): n=a or g
atcagcaattgcacctttgcgatataacacctcgcttttgggcactagctgcacagccttggccggaacangtggcttcgccggcttatccttcttccagg

SEQ ID NO: 16088 - DNA, 101 bp, rice(Oryza sativa)
  misc_feature (71): n=a or g
attgcttgtgccttggccctgttacaggaggaaccatttggaaagggttaagcaaatcctctcttactatntaaagtcagagcccactaaatcctaagcga

SEQ ID NO: 16089 - DNA, 101 bp, rice(Oryza sativa)
  misc_feature (71): n=t or c
atttgaattctcagctcgggtcggcatctgcataaaaaggcccaacaactcagcttctattgtaaacctcntgtttgggccaatggttacttctttgtgga

SEQ ID NO: 16090 - DNA, 101 bp, rice(Oryza sativa)
  misc_feature (71): n=t or g
gtacactagagacaagagatgcctagctaagcttggagaaggaggcgacaaagaaaatatatgcgacaacnatgtatcgatcatgcaaaatcaaagacggg

SEQ ID NO: 16091 - DNA, 101 bp, rice(Oryza sativa)
  misc_feature (71): n=a or c
ggaccactttaaactttatagtgaagtgcatggttgatgacacaaatagaagtaataattaaccacttagnaccctcgtaaaaaaaaaaaaacttgttccg

SEQ ID NO: 16092 - DNA, 101 bp, rice(Oryza sativa)
  misc_feature (71): n=a or c
aagtgcactagcaaaagtgaacaccgagcaggtaaactctaatgaaaatacaagagatgcatcagaaaggnaaataagaccaaccaaagtaatagatggta

SEQ ID NO: 16093 - DNA, 101 bp, rice(Oryza sativa)
  misc_feature (71): n=t or c
atcagttgcaggcgtacgtatgcacgtatatacacacagatgagccgtacatgaatacgttgtgtgtgtgnatatatatatatatatatatatgtatatat

SEQ ID NO: 16094 - DNA, 101 bp, rice(Oryza sativa)
  misc_feature (71): n=t or c
atgatatacacatgacattctattcgacatgcatatgggataaggattaggtttcaccatgcagttggtgnaccctgttaagagaattatactgtatatgt

SEQ ID NO: 16095 - DNA, 101 bp, rice(Oryza sativa)
  misc_feature (71): n=t or c
gaggatcgcattgcaccgctagcttgaaagagaggctcctctccatagagtaattgccatctgaaattgcngctaggtgggttggtcacgagtgcagcagt

SEQ ID NO: 16096 - DNA, 101 bp, rice(Oryza sativa)
  misc_feature (71): n=t or c
actactggtgtaggatccatttggtgtaggaaccattgtatgcaaaagcaagaagaaggtgcaattctgtnccagccaaatacctatatttatagaaaaaa

SEQ ID NO: 16097 - DNA, 101 bp, rice(Oryza sativa)
  misc_feature (71): n=t or c
ttatactggcttaaacgtctttcaatccttacacgaatgatgcccatgtgtgtgtgatgtttgtgggcgtnaggatttatacagtggtccgtggagtcttt

SEQ ID NO: 16098 - DNA, 101 bp, rice(Oryza sativa)
  misc_feature (71): n=a or g
ggaaactaggaattgtccttgcttttacatacttactggaattaaatggcaggagtgctgcatatgcctgnctcagtacaaggagaaggaggaggtgaggc

SEQ ID NO: 16099 - DNA, 101 bp, rice(Oryza sativa)
  misc_feature (71): n=a or g
attcccatcctaaagctctagtcatccgacactatcattgagcttgagcttctcgccaattcaatgtgctngttgaaaattagaaatacaaactatccttc

SEQ ID NO: 16100 - DNA, 101 bp, rice(Oryza sativa)
  misc_feature (71): n=a or c
tacttcacaggcttcaagcttatgattttctttttcagactgaattctgcatcaatataatgtgccgtganaaccatatatcttaagttttgatttgaggt

SEQ ID NO: 16101 - DNA, 101 bp, rice(Oryza sativa)
  misc_feature (71): n=t or g
tcctgttttcctcactcgagccagagcactgcttcctgaattttctaaaggtattgaagttctgcaagttnctgagaaaagctacttgtcagccccccatc

SEQ ID NO: 16102 - DNA, 101 bp, rice(Oryza sativa)
  misc_feature (71): n=t or c
atttaaacttgtaggaaggaggtgatgatgcaaacaatgcatcaaagctgcatagcaagaagaagaagcgngttgcaccaagcttaaacgaagagtatgag

SEQ ID NO: 16103 - DNA, 101 bp, rice(Oryza sativa)
  misc_feature (71): n=t or c
tgtgagagaaagaggaagtggttaaggaaaagaagaatgttttctctttcctgcctttctcttctttatanttttaaccttttttgctagtgatttacttg

SEQ ID NO: 16104 - DNA, 101 bp, rice(Oryza sativa)
  misc_feature (71): n=t or c
tctgatctaacagtactgacccttttcttgttggcatatctcctagcccagaatgcataattgataaatgncaccagctcgaaggttgccaataacaagaa

SEQ ID NO: 16105 - DNA, 101 bp, rice(Oryza sativa)
  misc_feature (71): n=t or c
ttcaacctttcattcgatagagaaaatattttgttcgcatggaaaatgagactatgagaggggtggctgcnatcaaggacaagaaaagcgataaaaagttg

SEQ ID NO: 16106 - DNA, 101 bp, rice(Oryza sativa)
  misc_feature (71): n=a or g
attccgaattactcaggtatagtactattttgcttcttgtccgaatcactgtgccaggtgctcagtagcanagatttttttttgttgtcccattgcttttt

SEQ ID NO: 16107 - DNA, 101 bp, rice(Oryza sativa)
  misc_feature (71): n=t or c
tctatatttccatcgccgtcatgaccaatttttccaagcgtgcaactgttgccaagctccaatctcaatgnttgttcagagaccatctcggagcagaggtt

SEQ ID NO: 16108 - DNA, 101 bp, rice(Oryza sativa)
  misc_feature (71): n=t or c
tcgactatactcattttagggtggccaagcaaactattttaggccccgtttggattccaactttattcttnaaacttttaacttttccaactttattcttc

SEQ ID NO: 16109 - DNA, 101 bp, rice(Oryza sativa)
  misc_feature (71): n=t or g
acttcttcctagtaggagcactaggtgcctgagaacaccaatgttcactcattgcttttagcgagcctggntcttgcaatatttcattgctgttaccagaa

SEQ ID NO: 16110 - DNA, 101 bp, rice(Oryza sativa)
  misc_feature (71): n=t or c
aaagaatcctgtatagcacgatccttatcctgtggaatctctggaggctttctgctgagctgattaaacantgtctcaagtctttcaagacgctctagaca

SEQ ID NO: 16111 - DNA, 101 bp, rice(Oryza sativa)
  misc_feature (71): n=a or g
aatttgaacaatttctttaggggtaaaattgatgcaccaaagctgaagaaccttttgtttgagccgcctcntcaggatgagctgatcagtaatcccagtct

SEQ ID NO: 16112 - DNA, 101 bp, rice(Oryza sativa)
  misc_feature (71): n=a or g
attttaatggcaccggcgatgcaaggtgcagtcattggggtcaaattggcagtgaaaacacatgaccaccnacgcctggctccacatcacagcacatccaa

SEQ ID NO: 16113 - DNA, 101 bp, rice(Oryza sativa)
  misc_feature (71): n=t or g
ttatagtcagtgcagaacaatacattctgccacaacacaactagtttagaactttattcttaccagccaantaagaaacattgcaactccattaacaacgt

SEQ ID NO: 16114 - DNA, 101 bp, rice(Oryza sativa)
  misc_feature (71): n=t or c
gggccgttaactccgtatgaggatatttcaggatccatgagggtgagataaaaaccaagtcaggctgttgnaaaaggggatgattttgcatgttactccaa

SEQ ID NO: 16115 - DNA, 101 bp, rice(Oryza sativa)
  misc_feature (71): n=t or c
tgtaaataaggattctattctattctcgtgtagtatgtgcttgctactccctccggtctataatgtaagtnattctaatattttctacattaatattgatg

SEQ ID NO: 16116 - DNA, 101 bp, rice(Oryza sativa)
  misc_feature (71): n=t or c
agttgctggggttgtattgagagttatattttctcatatcaaattggggctcatccggtccgaatggtccntcaaaatggactgtaatatgaacaatacaa

SEQ ID NO: 16117 - DNA, 101 bp, rice(Oryza sativa)
  misc_feature (71): n=a or g
aatcaaggaacgcttgatcaaaagactgaatagctgggcagaaaagttcatgtcgtcgggagcgaaggatnttcttatcaagttcgtggcgcaggcaatac

SEQ ID NO: 16118 - DNA, 101 bp, rice(Oryza sativa)
  misc_feature (71): n=t or g
gcccacctatagggggtctcgtcaaaaaaaaatcaattatgtattggtggaggtggtggggtgtcgctttncctattgacttgcttgccaccagctacctt

SEQ ID NO: 16119 - DNA, 101 bp, rice(Oryza sativa)
  misc_feature (71): n=a or c
tacctgcaggcagcactcgaggctcctaggatcctaaacctcaacaacaacccatacttcaaaggaacttntggtgagttacaattgatctcaagatctta

SEQ ID NO: 16120 - DNA, 101 bp, rice(Oryza sativa)
  misc_feature (71): n=t or g
caaatctgattgggtacgacatgactctggctgaagttaacatacataccaagtgataaaagggggctcangttctcctttgcttgattctgcagcagatt

SEQ ID NO: 16121 - DNA, 101 bp, rice(Oryza sativa)
  misc_feature (71): n=t or c
catccctcaagctaaagatgtgaggttcccctgccctgttgtcttccccatctcctatggctcccgccaanggatccgccaccaccaatcacctcctccta

SEQ ID NO: 16122 - DNA, 101 bp, rice(Oryza sativa)
  misc_feature (71): n=t or c
aacttatcacggagaatataatgcgtttcctccccatgagcacacttatacggcgaacatgtaatctgctntactatttcatctataactctttctgcatc

SEQ ID NO: 16123 - DNA, 101 bp, rice(Oryza sativa)
  misc_feature (71): n=a or g
gtcagtctggtccggccaagtgtccatgattctgcaacgcgagaatgcaagccagctgtggcgtcgcctcncgacagacagacaggccgaccggccggaga

SEQ ID NO: 16124 - DNA, 101 bp, rice(Oryza sativa)
  misc_feature (71): n=t or c
agcagggacatgcgcgacccgttacagccaactgaaatctgcacagattctgcacatattcgattacatgngcacgtatatatgcagtgcatgcagggtat

SEQ ID NO: 16125 - DNA, 101 bp, rice(Oryza sativa)
  misc_feature (71): n=a or g
aagtagtgggctgtactactaaacttgctctaagaaaacataaatttatggaaccttgtggaggacagggnaacttgttaaactccaagaactaaaatggg

SEQ ID NO: 16126 - DNA, 101 bp, rice(Oryza sativa)
  misc_feature (71): n=t or c
gccaaccttgattgttgcttcttgtttgtagaattgtggcaacgatattggactccgaaatgggaatacanggtgatctttttaagagcgtgtaatggcag

SEQ ID NO: 16127 - DNA, 101 bp, rice(Oryza sativa)
  misc_feature (71): n=t or c
aggaataattttccaacataacaaaccagaaaagcgcacaaagtacagatcgaactggtgatagaatttcnatcatttacaaccgtggaaaataaaatatc

SEQ ID NO: 16128 - DNA, 101 bp, rice(Oryza sativa)
  misc_feature (71): n=a or c
aatcacgttttttatcatcagatagaccaaaatgaccccccacatatggaacccgtgtatcagtttcatcntcttcaaccctcccctttcattttacttct

SEQ ID NO: 16129 - DNA, 101 bp, rice(Oryza sativa)
  misc_feature (71): n=t or g
gagtccatctctgaaatatatattgagatcagttactattttcaatttttcatcctgaattttgaagactncagatcatgaatggcagcacagtttcctga

SEQ ID NO: 16130 - DNA, 101 bp, rice(Oryza sativa)
  misc_feature (71): n=t or g
aacagtgggggtcaacatccacagaataaggcccccaattgcatcttatgaaaccattcctctctggagcncttgtacttgtatccctgtggcacaaattt

SEQ ID NO: 16131 - DNA, 101 bp, rice(Oryza sativa)
  misc_feature (71): n=t or g
actttttcaatagctgctttcatgctggcatcttcgtcagttatgatgagtgtaggggctttccctcccantgctcttaggaaggtcttaaacaaccaaac

SEQ ID NO: 16132 - DNA, 101 bp, rice(Oryza sativa)
  misc_feature (71): n=t or c
atatagagagctcctaattctgttttcctcgtacatctatctgcatttcatgagtgagctgagcctaattnttttcattctctcctccttcagcatggctg

SEQ ID NO: 16133 - DNA, 101 bp, rice(Oryza sativa)
  misc_feature (71): n=t or g
aggcgagagcgacggggccaaggaggcgtcaatggtggaggcagtcgaagaagtccatggcagcggcaganactggtcccccacggcgccgacaacggagc

SEQ ID NO: 16134 - DNA, 101 bp, rice(Oryza sativa)
  misc_feature (71): n=a or g
taatggtacgcctgagaaattttccccttcccctattcctttcaattgcgattcggcatcacccacttttngtaacggaatggggacaatgaatctaagta

SEQ ID NO: 16135 - DNA, 101 bp, rice(Oryza sativa)
  misc_feature (71): n=t or c
atatgttgcatggattttggataattgtgtaggggtagggatctcgaagcacggttaaggagttaggcttngttcgttcctgggagatctgggagattgag

SEQ ID NO: 16136 - DNA, 101 bp, rice(Oryza sativa)
  misc_feature (71): n=a or g
cgacctacttttcgaatcgaactccattcatcctaccagtatagcaaagcttattagcaaggtcctctgcncttgactctgaggcatatagaatttaagca

SEQ ID NO: 16137 - DNA, 101 bp, rice(Oryza sativa)
  misc_feature (71): n=t or c
aacggcactctagatgccgcctaaacagtaaacaattaactcttaagtctctacagcgacaccgatgtacngatgtactcataataatatgcgtgaattca

SEQ ID NO: 16138 - DNA, 101 bp, rice(Oryza sativa)
  misc_feature (71): n=a or g
gcggcgttccttctcctcgccgtgctcggatggtatatatggtggaggaacaagatgagcaagaacggcangaaaaagaagggcaagagctccaccatgaa

SEQ ID NO: 16139 - DNA, 101 bp, rice(Oryza sativa)
  misc_feature (71): n=t or g
tgaactgagccaaaattcaaaagtctgcatatgagaacaataaaggaggccatctaccgattttggaccanggcggcccagcccatggttcggccgaaccg

SEQ ID NO: 16140 - DNA, 101 bp, rice(Oryza sativa)
  misc_feature (71): n=t or c
atgaggactcccaacatttgttacttcttctagtgtaactttcatgtcaacctctctgttgggaccctaanttctcctttgtgatggccaaaggggtcact

SEQ ID NO: 16141 - DNA, 101 bp, rice(Oryza sativa)
  misc_feature (71): n=a or g
cttttgtcctttcttaattaacacaacgatgccgaagtttgattttaccaatctcgacatggtaggccctntttagttcccgaaacataacttttcaagtt

SEQ ID NO: 16142 - DNA, 101 bp, rice(Oryza sativa)
  misc_feature (71): n=a or g
ccaaaagtaatcaattttgttgacaagcatcatgattagtacaaccatgtgtctatacttcacaacctccnttccagtttgtaacattttgggacgaagga

SEQ ID NO: 16143 - DNA, 101 bp, rice(Oryza sativa)
  misc_feature (71): n=a or g
atggcatggatctgcggtgacttcgcaaggaagaagatgcgagaagaaggaagaagtcggaaaaagggatnagatggatgaaaaacataacgacagtgaca

SEQ ID NO: 16144 - DNA, 101 bp, rice(Oryza sativa)
  misc_feature (71): n=t or c
gtttgggctccgtacggctgtgttcggattcttgtgatggtaactaatccgttttacacggaaaacggagnggtatattaacacgtaattaattaagtatt

SEQ ID NO: 16145 - DNA, 101 bp, rice(Oryza sativa)
  misc_feature (71): n=a or g
aagaaatgacagggaccgtgagagtgccatgaatgttccccacccagaagttatcggcgagagccaagagnaccgtgcgcaaagcccggatacgtggtggc

SEQ ID NO: 16146 - DNA, 101 bp, rice(Oryza sativa)
  misc_feature (71): n=a or g
ggttgcaagctcatttggtggtcttcttgggggtaagatgggtgatttccttgctctgcactatccgaatnctgggaggattgttttgtcacagatcagtg

SEQ ID NO: 16147 - DNA, 101 bp, rice(Oryza sativa)
  misc_feature (71): n=t or c
gcaatataaatagagccgatttggggctgattttttctaagtcctcattctcgacccctcactcctttccngcgtccctccccttccccctcccctccaca

SEQ ID NO: 16148 - DNA, 101 bp, rice(Oryza sativa)
  misc_feature (71): n=t or c
acccttaataaattcggtaggatgtccaattcggtaaatagaaagaaaaaaaaatctggcacttgagactnttgacgcgcgctaatttgttcggaaaatac

SEQ ID NO: 16149 - DNA, 101 bp, rice(Oryza sativa)
  misc_feature (71): n=a or g
gacgaagaagatgatgatgatgctgttgtgaggaggacagtgtcaggctgaggagaagacccctcctcgcntctccaggtcggcgtactctgcccttttcc

SEQ ID NO: 16150 - DNA, 101 bp, rice(Oryza sativa)
  misc_feature (71): n=a or g
tcgactggtatatactctatacgacgtcacggctgacgccttaaaggcaataataataatacattgatccnatgatccccatctatcactcacctatacag

SEQ ID NO: 16151 - DNA, 101 bp, rice(Oryza sativa)
  misc_feature (71): n=t or c
acaacatttttttagcatgagaaaataggagtaccttctgctctaatccaactttggagacaaatcaaagnttgtacagtctcactgctgagactactcct

SEQ ID NO: 16152 - DNA, 101 bp, rice(Oryza sativa)
  misc_feature (71): n=t or c
ttgttttagattatgatttgttatgatatggacctactacctagtataagttttttcccttttaccccatnataaatatttaacatatagaataagattcg

SEQ ID NO: 16153 - DNA, 101 bp, rice(Oryza sativa)
  misc_feature (71): n=t or c
gagcttggttacagctttgagcctacaggtttggtcagttattaaggcattgaaatttgaaaacgaccagnaaattaaacggcccaagttgtctcgctcta

SEQ ID NO: 16154 - DNA, 101 bp, rice(Oryza sativa)
  misc_feature (71): n=a or g
atgctcatgctgatcttactggtattaaggaagaaactaaggttctgtggcgcacaattacacgacagtcnatgtagtggtggaattgtggcctttagata

SEQ ID NO: 16155 - DNA, 101 bp, rice(Oryza sativa)
  misc_feature (71): n=a or c
catatccaccatccttcttttctctaaacaagaaacagaaaaaacaatatatgctcgatttttggactcantgtattcaagccaacttccaaactcatcaa

SEQ ID NO: 16156 - DNA, 101 bp, rice(Oryza sativa)
  misc_feature (71): n=t or c
gcggtttagatggcggttttggctgaaatggcacatacgtggctaatttgactgtcttcatctgatgtagngttgatgtggcgcttacgtggcaattcaat

SEQ ID NO: 16157 - DNA, 101 bp, rice(Oryza sativa)
  misc_feature (71): n=a or c
aaatctccttgttgcaaatatgtacaggcatggatccctttctgaagggacatacaggagcaaagaccaanaaaaggctcaattatgtaaatggttaaatg

SEQ ID NO: 16158 - DNA, 101 bp, rice(Oryza sativa)
  misc_feature (71): n=a or g
ccatattgaaagtttgcatatttttctagtgaggcatcacctggtcagtttgagacaatagaatccaatcnagtctgctgataggggaataaaccatcatg

SEQ ID NO: 16159 - DNA, 101 bp, rice(Oryza sativa)
  misc_feature (71): n=t or g
gaaaagcgggggagcccgcagctgcagctgcaactggcaaaaagaaaaaaaagataagctgggatgggtgngagtggggagggggaggagcttccagaact

SEQ ID NO: 16160 - DNA, 101 bp, rice(Oryza sativa)
  misc_feature (71): n=a or g
acttcagtaaaagaagcttgaattgaaatgcaaatttgtgaaaaaacatgcagacagaaactaagtgaacngcaagtcacctgcagatcaatttctccact

SEQ ID NO: 16161 - DNA, 101 bp, rice(Oryza sativa)
  misc_feature (71): n=t or c
atttatctccattaggaaccaacagggatggttcagccttatatttatcaagtcacttgcatcacttccancatccacacttgaggcatagacataattca

SEQ ID NO: 16162 - DNA, 101 bp, rice(Oryza sativa)
  misc_feature (71): n=t or c
cttgagacactagatgatcagatcgtttattaaacccatgcttatatattatttatcagatagtagcattnttttgctaccatcattcaagactccaagtt

SEQ ID NO: 16163 - DNA, 101 bp, rice(Oryza sativa)
  misc_feature (71): n=t or g
accatatggcaaattgaaatacttgaatgtaaattaaatttagatctcctttttgcccgcagcaacgcgcngggtgtttacttgtttatcactccccgaac

SEQ ID NO: 16164 - DNA, 101 bp, rice(Oryza sativa)
  misc_feature (71): n=t or c
tttcaagttgcgagttgcaaatagccgttggtgcagtccgtttataggtggccaaattggccccctgaccngacctacatgtcgggtcgtgctgtgccaac

SEQ ID NO: 16165 - DNA, 101 bp, rice(Oryza sativa)
  misc_feature (71): n=a or c
ttattttttaatgtaacgaaggaagtacaatataggaaatcactttgttgatcttgccggctctccacggnaaaaaaaaagaaaagaaaagaaaagaaatt

SEQ ID NO: 16166 - DNA, 101 bp, rice(Oryza sativa)
  misc_feature (71): n=t or g
aacatttgtaggaagagattttagccgagttctaactacttttagaggaactgtagggtatcttgcaccanagtggattagcggagttgctattactccaa

SEQ ID NO: 16167 - DNA, 101 bp, rice(Oryza sativa)
  misc_feature (71): n=a or g
gattgccttctgtcgggcggtttcttgggcattggggtttatggtgttaccgtgtgatttcttgcagagangagggatttgcctggcgaaatcgtgaatca

SEQ ID NO: 16168 - DNA, 101 bp, rice(Oryza sativa)
  misc_feature (71): n=t or g
tcctgtatcagaaaaataatgatggcaaactgacaatgcaacaccacgttggagcatgcacacaatatcanagataaaagtgacctaaaatgtgatacatg

SEQ ID NO: 16169 - DNA, 101 bp, rice(Oryza sativa)
  misc_feature (71): n=a or g
tatctcttgtagaaatttttatgatattttgatgaaatcgttaggggtttgtagagctaagcttggggctnaaaccctaatatgcaccagacttcccacta

SEQ ID NO: 16170 - DNA, 101 bp, rice(Oryza sativa)
  misc_feature (71): n=t or c
gatgaaaaggccagcttagatttgaaggtggaggccaagtacctgattagtttcgctgaccaggtgaagangcaaccttcgctgaaatacaggacagtaag

SEQ ID NO: 16171 - DNA, 101 bp, rice(Oryza sativa)
  misc_feature (71): n=a or c
taataaacacgttgatatcagtagcacaaaaatgcgtggcctacagctacagacaaagaccatttataatntgctgccccgtgcacgctttgctcctacca

SEQ ID NO: 16172 - DNA, 101 bp, rice(Oryza sativa)
  misc_feature (71): n=a or g
caaaaacatgggggttggcgggcgcaaaaaatcttgccgtctggttgacaatgtaactgcctatagttagngccacggccctgggttttttattttctata

SEQ ID NO: 16173 - DNA, 101 bp, rice(Oryza sativa)
  misc_feature (71): n=a or g
ccgaacgagccttcactcaactccgacgccaggaaaacctagatgtcttgttaagtcgttgccttagttcnttgttttagtttgcttgtttaagtttggtt

SEQ ID NO: 16174 - DNA, 101 bp, rice(Oryza sativa)
  misc_feature (71): n=t or c
ggagacaatggaaagacgagagggcaagatgtcattttatagtgaattattgggtctcgtagccatatcgngaggttaagcatagcgaagtacagtggacc

SEQ ID NO: 16175 - DNA, 101 bp, rice(Oryza sativa)
  misc_feature (71): n=t or g
tggagggcatggtagtcttttggtttattggttgacatgcctttgactttccaaaacaacaatctttttangacagagcgagtattaaacttctatggtgt

SEQ ID NO: 16176 - DNA, 101 bp, rice(Oryza sativa)
  misc_feature (71): n=a or c
caaatgatttcgtcaaggttacctggagaaggtttagctggctctgcgttcgtcatccggtgaattatcantggcatagccttcttctccactgcattttg

SEQ ID NO: 16177 - DNA, 101 bp, rice(Oryza sativa)
  misc_feature (71): n=t or c
ccatgatagcaaaacattcccccaatgtccaaaatacccctcctctattgtgtctggcatcctctcaatanaattacatattgacagtctaactctatgaa

SEQ ID NO: 16178 - DNA, 101 bp, rice(Oryza sativa)
  misc_feature (71): n=a or c
agaataacaaaaggcacggtaaatcacttccttgaattcaaaaccttgttgaaccagtagctgaattgcantttcaagtgcaaactaaaagaaatacatag

SEQ ID NO: 16179 - DNA, 101 bp, rice(Oryza sativa)
  misc_feature (71): n=a or g
aagcggcggacggcagccgggattccctggggaagaagatagaagggttagggaggaacataggcgaccgnagcggtgagaataccacgccggagaggaga

SEQ ID NO: 16180 - DNA, 101 bp, rice(Oryza sativa)
  misc_feature (71): n=t or c
gatgaaaaaaagaaaaaggaagcaaaatcatcacaattcatagggccaaatcggcgttgccccccaaatcngctggagcagtagagaggaggcattgcccc

SEQ ID NO: 16181 - DNA, 101 bp, rice(Oryza sativa)
  misc_feature (71): n=a or c
aatattacatgcttcaatgaatctggatacagaaagaatgtccagtgccaattggatacagaaagaatgtncagtgccaattgtacagaaaatctgcataa

SEQ ID NO: 16182 - DNA, 101 bp, rice(Oryza sativa)
  misc_feature (71): n=a or g
tacttcacgtaatctctagttttgctaggacagaccatcgacaactgcacattaattagggttcgtcaacntgtgcaatgctagtacatatctgagcaata

SEQ ID NO: 16183 - DNA, 101 bp, rice(Oryza sativa)
  misc_feature (71): n=a or g
aaaactttccccaatcttccacctcgagttctccggcaacacccttcaagctttccggcgatccgcagacncttccggcgactccaatctccgccaatgac

SEQ ID NO: 16184 - DNA, 101 bp, rice(Oryza sativa)
  misc_feature (71): n=t or g
atagctgaacatcaagctgcaggcccagcttacttgcaagggggtacttttccaaattatcgaactttgancaccgatgttcatccacttactcagggagt

SEQ ID NO: 16185 - DNA, 101 bp, rice(Oryza sativa)
  misc_feature (71): n=t or c
atctgagttttgctgctccggcatcctgccagtcgaactacccttggatgcagatcctgcacaaaattaanagcgtaaaaaaacatatgatatgaagaatt

SEQ ID NO: 16186 - DNA, 101 bp, rice(Oryza sativa)
  misc_feature (71): n=t or c
atatatactttgcaacttgcttgagatattccctggagccacatttttcacattatccactacagcagtanttatgctgacagtactactaaatgatccaa

SEQ ID NO: 16187 - DNA, 101 bp, rice(Oryza sativa)
  misc_feature (71): n=t or c
agagacctaggttttcttctgtaaaatctccagatctgctctgtcaacatggtgcgtggtgctcggactgnggaagaacctgtgttggaggaggtgcagcc

SEQ ID NO: 16188 - DNA, 101 bp, rice(Oryza sativa)
  misc_feature (71): n=a or c
atatgtcgcctacattatatatattatgtttgaaaaacatatataaacaaatacgtgcgcgtctctctctntatatatatatatagagctaagattacgtg

SEQ ID NO: 16189 - DNA, 101 bp, rice(Oryza sativa)
  misc_feature (71): n=t or g
aaaatcaagtacttttagtgcaaatggagttggagagtaccagaaacatccaatgaaagggacttccctantagtcaaaccaaagctgaaatctgcaaaaa

SEQ ID NO: 16190 - DNA, 101 bp, rice(Oryza sativa)
  misc_feature (71): n=a or g
gcacccgcatgcgaaaatctgatttttgcatgcgatgcgccacctgcatggaaaaacaactatttttgcanacacttttgggcagacggatggctcaaccg

SEQ ID NO: 16191 - DNA, 101 bp, rice(Oryza sativa)
  misc_feature (71): n=t or c
gttccgcaatactgaccccttggctcttcgtctgctagagcgtttactggcatttgatcctaaagatcggncttcagctgaagaagtaagctcaagagaaa

SEQ ID NO: 16192 - DNA, 101 bp, rice(Oryza sativa)
  misc_feature (71): n=a or g
cttggcccattggcaccgtcgatccgactcagagacccaatccaacgcagaagagctccctgtctctgatnaacttacatctcttgcttggatttggtgct

SEQ ID NO: 16193 - DNA, 101 bp, rice(Oryza sativa)
  misc_feature (71): n=t or c
gacagaacctccataccttccaaacttaacacaatcacaaaaaggccataaacatcatacctgcatatttntatagatacccttacaaagataatgtcgcg

SEQ ID NO: 16194 - DNA, 101 bp, rice(Oryza sativa)
  misc_feature (71): n=a or g
actacaaagctgaagtaagtgaaatgagagcttgtgagctgtgactgaccagaaagcagcgccctcccgcngaagcttcagctgcgcgcacttggggcatc

SEQ ID NO: 16195 - DNA, 101 bp, rice(Oryza sativa)
  misc_feature (71): n=a or c
ttctgttcacaaagagtgtaaatatgtgctagagactagtggcaatcctgtgcttaacttatgcttctttngtttcaaatcaagtggacttgagctagctg

SEQ ID NO: 16196 - DNA, 101 bp, rice(Oryza sativa)
  misc_feature (71): n=a or c
taaacttgtcttttgttctctgcaattctttcaaagcttctccaatatgcatgcgatctgctggagattcntttgagcaggaaactccaatctgcagaatt

SEQ ID NO: 16197 - DNA, 101 bp, rice(Oryza sativa)
  misc_feature (71): n=a or c
ctgtctcccctaccatcgtatttccccaccatggccatcttcgccactgcatcttcggcttcgaccgcgcngccctctcctccgcttccatgccaccgtcc

SEQ ID NO: 16198 - DNA, 101 bp, rice(Oryza sativa)
  misc_feature (71): n=t or c
tttccacttcatcatctgaacctacttaccgcttttgggttcagctgggctaaatatacttaactgcttangtaaccaccataaaataatttaattgcact

SEQ ID NO: 16199 - DNA, 101 bp, rice(Oryza sativa)
  misc_feature (71): n=t or g
gagccactaagcgatgtatatggagagagtgcagaagatgaagacgtgggaaagaacatctccggtatttncttcatggcacatggtgaatcggattcaga

SEQ ID NO: 16200 - DNA, 101 bp, rice(Oryza sativa)
  misc_feature (71): n=t or c
aagattgactcgactagttttaacctgtggtatccctaccccagcgataatgggttgattcggttaaacangttcgcactagaatggtttttacaaaaaaa

SEQ ID NO: 16201 - DNA, 101 bp, rice(Oryza sativa)
  misc_feature (71): n=t or c
tcgtttcaatttacctgtcgttttatatttggagtaacgccctttctagacccaacctaaaattttgcatnatatcacatcgaacgtttgaacacctacat

SEQ ID NO: 16202 - DNA, 101 bp, rice(Oryza sativa)
  misc_feature (71): n=a or g
aggatttcattgaaattatagagtggacatatttatcagctttctccgtgaagacatcaatcgtagtagcngttgaccgtgccgctgccgccgtggacagg

SEQ ID NO: 16203 - DNA, 101 bp, rice(Oryza sativa)
  misc_feature (71): n=t or c
actcatccaaactgtcacattagaatactagagctactaacaaacaaaaggctagcaaatgcaaattttcntgccaagcatgtatgtacagatggccaatg

SEQ ID NO: 16204 - DNA, 101 bp, rice(Oryza sativa)
  misc_feature (71): n=t or g
acatgcatcgagaattgctccctggacttcttgtcaatatgaggtgatcgtaacacagtatacaaggatcntgattcaggcaatccaatcttctgagcgta

SEQ ID NO: 16205 - DNA, 101 bp, rice(Oryza sativa)
  misc_feature (71): n=a or g
cgtcgccggcgtgctgatgccgctgctgttcgcgcagggggggatgcggctgaacgtgaaaaagatcaccnacgcctcgacgtgcgccctcctcgagacgt

SEQ ID NO: 16206 - DNA, 101 bp, rice(Oryza sativa)
  misc_feature (71): n=t or g
agttattccctaatagcccaaacgaacggaaccgaaatgagaaaagaacattgtgatctcggtaggatatnggagggtattctttactactacatctcatt

SEQ ID NO: 16207 - DNA, 101 bp, rice(Oryza sativa)
  misc_feature (71): n=t or c
gaggttgcttgctacggggaggtcgcgtcaccggcagcttcagtgtcctcttgatgaggtagatgtcgggngatgaagatggcttgtggccgagcatccag

SEQ ID NO: 16208 - DNA, 101 bp, rice(Oryza sativa)
  misc_feature (71): n=t or c
caccatatgttggccccacatgaacaaaagtccatttgaaccctctccttgaacagtacacccttggcccngctcgtcagtgactgtcaataatattctag

SEQ ID NO: 16209 - DNA, 101 bp, rice(Oryza sativa)
  misc_feature (71): n=t or c
ataagctgttcaattaatttggttcactcggccgtatgcaaaacaatgtctacactggcatgcatcaaagnattccacaaggacaagttaggaccatggac

SEQ ID NO: 16210 - DNA, 101 bp, rice(Oryza sativa)
  misc_feature (71): n=t or c
aatgtagtcatagtactcgcatcaatttcaacttaattgtagtaccagggaccagggacgatgacgacgangatggaggagggcgcgggattcgccccacg

SEQ ID NO: 16211 - DNA, 101 bp, rice(Oryza sativa)
  misc_feature (71): n=a or g
ttggagttcatggccaatggaagcttggacatgtgggttcatccaaagctacatcaaaatagtcccaaganaggtctgagcttaggacagatgataaggat

SEQ ID NO: 16212 - DNA, 101 bp, rice(Oryza sativa)
  misc_feature (71): n=a or c
gaagatgccatgaacgtctcattgtgaatgtgtcatcgaggagaagaaatcttataacaacccacccacanctcacacaacacacacaaagattaggaaaa

SEQ ID NO: 16213 - DNA, 101 bp, rice(Oryza sativa)
  misc_feature (71): n=t or c
aatattgacactgactgttgggctgtagagaatcccaacatcgttcccctctaagtgacaaggaatgagcngaggagcggtatttatccgaatttcttcgg

SEQ ID NO: 16214 - DNA, 101 bp, rice(Oryza sativa)
  misc_feature (71): n=a or g
aattgctttagccatagctgcatcttcatttggcaaaattgtttttggcttctttcctgatataacatttngaaaagtattaaataaccaaacaaaactat

SEQ ID NO: 16215 - DNA, 101 bp, rice(Oryza sativa)
  misc_feature (71): n=a or g
acagctgcatcatcaatcattagactttccagtcggaaccacatcccagaggcctcttgctgcagatatgnagataagctgcgggtgccaagtaccttcaa

SEQ ID NO: 16216 - DNA, 101 bp, rice(Oryza sativa)
  misc_feature (71): n=a or g
gaggccatcgaatggtactaagattgaggaaaaaaatgttgtgaaaatttttacaatgatagaggctgtcnaggttggccgtgcaccagagcgcacgccta

SEQ ID NO: 16217 - DNA, 101 bp, rice(Oryza sativa)
  misc_feature (71): n=t or c
cacttgcatagaatagccggagaataatcaaattgcccctccctttgtcgaattggaggtggattgctccngccttgactggatttgctgtcatttccaga

SEQ ID NO: 16218 - DNA, 101 bp, rice(Oryza sativa)
  misc_feature (71): n=t or c
aaaatgatctttttatagcacttaacagatggatgcaaccgaaaacttaacaacgatggtaactctagaanaaaagcacttgtacgatgacatttctaaag

SEQ ID NO: 16219 - DNA, 101 bp, rice(Oryza sativa)
  misc_feature (71): n=t or c
ttcttctttatactattgttactatagtctatagtccttccggtagtttgccaacctacctatcgcctaantttgttcctattatgaacctgtatttctct

SEQ ID NO: 16220 - DNA, 101 bp, rice(Oryza sativa)
  misc_feature (71): n=a or g
actccgaatacaaccatagtacatggattagtgctagacgcttttagacgcttttatgaagagaagagctntgaaacggtatattgtcaggacggtacaag

SEQ ID NO: 16221 - DNA, 101 bp, rice(Oryza sativa)
  misc_feature (71): n=t or c
gcctactatttctatccttcagcacagcaattctttcagcatagtcacatgacagctttcttgctgcctcnaactctctttgagcagcatcaacctctatt

SEQ ID NO: 16222 - DNA, 101 bp, rice(Oryza sativa)
  misc_feature (71): n=t or c
tactagtattaaaaaaaaacaggaataatagtacaaagatttatcagttgacacgagctgagtacaccacntcaccgggtagtctagcttgcctagcctaa

SEQ ID NO: 16223 - DNA, 101 bp, rice(Oryza sativa)
  misc_feature (71): n=a or c
tattgatgcaggaatttacgaattgaaggaatttgggtcgattcaaaatagttgcattcctgggctgaaancaagcctgaatgagcatgaagaaataatga

SEQ ID NO: 16224 - DNA, 101 bp, rice(Oryza sativa)
  misc_feature (71): n=a or g
ccaaggtaacgcaaatgttttgagttgcttatgctctcaggtaactttctcactgttccccgcaaaaaaanactttctcactgttgaaagattaaaaatca

SEQ ID NO: 16225 - DNA, 101 bp, rice(Oryza sativa)
  misc_feature (71): n=a or g
agtttgagcagtattttacaaggctcatgctttagcattgatgatgtcataaatctccgctctgttcaacntcggaagacgctttgctccctgcagtcagt

SEQ ID NO: 16226 - DNA, 101 bp, rice(Oryza sativa)
  misc_feature (71): n=a or g
ccggttgatagggtcgccacccctgcccgttccccctccccactctactccttcgttaccttgcactcctnccaccattgtagctgccttgatcccccggt

SEQ ID NO: 16227 - DNA, 101 bp, rice(Oryza sativa)
  misc_feature (71): n=t or g
tttttaagtaaaaacagtaggaaattaaggacaaattcttaggagtatcacgcggtgttttccaccaaatntgtttgcttgaggagcccggcggggatcga

SEQ ID NO: 16228 - DNA, 101 bp, rice(Oryza sativa)
  misc_feature (71): n=t or c
tcattttatcgaggtggtatccgaatcttcatactggatgttgatactctacctgataggtgaaggcttgntttgcaatgcatcctatttcctactactag

SEQ ID NO: 16229 - DNA, 101 bp, rice(Oryza sativa)
  misc_feature (71): n=t or c
tcaggcagaaggttagagtcttctgttgaatctaggaaagaaagtactgatgtagcatctgctgctgctcngaagactagttcacggatggaagtggcccc

SEQ ID NO: 16230 - DNA, 101 bp, rice(Oryza sativa)
  misc_feature (71): n=t or c
tactaccacccactctcgcccccacttcatttttcctttttttttccagatctgaatcaatccaccatccnagcccataaatcggtgacgcaccatggaga

SEQ ID NO: 16231 - DNA, 101 bp, rice(Oryza sativa)
  misc_feature (71): n=a or c
cgtttctggttactggttgctgctgaattagcggaactcactcgcacacgcggaatcctatgatttttagnttagcaatttactccatcatcattgagtag

SEQ ID NO: 16232 - DNA, 101 bp, rice(Oryza sativa)
  misc_feature (71): n=a or g
gcttaccgttaaaaatggatcattaattagcatcgtgcatatgcatcagcatcacagtcacagcatcgctntcgaattggtcgacgataaaatgggtcatc

SEQ ID NO: 16233 - DNA, 101 bp, rice(Oryza sativa)
  misc_feature (71): n=t or c
aattccacctgaagaatcgttattgaacgaaaatatggtactcggaacaagtctactataagctagcacgnatgcacaaacacgaagtcttattaacgaac

SEQ ID NO: 16234 - DNA, 101 bp, rice(Oryza sativa)
  misc_feature (71): n=t or c
gcaaatggtatggactatgggtagaactttccctttcttcatgacagttcttgtggacactggatacttanctagtcatgctgatcaaatggcctgatttg

SEQ ID NO: 16235 - DNA, 101 bp, rice(Oryza sativa)
  misc_feature (71): n=a or g
tcaggcattgccaaatttgcatcaaatccactcatcatttgtgatggacgctgaggattgtacatctgacnaccttttggtggaggatgccgaggaccaag

SEQ ID NO: 16236 - DNA, 101 bp, rice(Oryza sativa)
  misc_feature (71): n=t or c
cttcctgaatatttctgaactttctgaaaatgtttgtgtatgttaatcagtgtgcaagacggtggttcgangagagcgacacgggccacctggtaaacctg

SEQ ID NO: 16237 - DNA, 101 bp, rice(Oryza sativa)
  misc_feature (71): n=t or g
aatccaaggcatatggccatttccagcggtttctttctgtatcggtgcttagtgcgatagcacgctatttnttggtactttcccttgtaccatcatgcctg

SEQ ID NO: 16238 - DNA, 101 bp, rice(Oryza sativa)
  misc_feature (71): n=a or g
tgaaatttgttagttggtgcacacagtgtgtacaagagaagcatgtgtgcataggatatgtacccatggantgcaagaacttttcagtaaaatgcaagaat

SEQ ID NO: 16239 - DNA, 101 bp, rice(Oryza sativa)
  misc_feature (71): n=t or c
cttggacagggagggctccttcgatttctgtagtccatatctatgaatttctaaatcctgtgcgacagtanggtttttaataacctttttatatgaaccaa

SEQ ID NO: 16240 - DNA, 101 bp, rice(Oryza sativa)
  misc_feature (71): n=a or g
tagttcacttggtgttacatttgtattttttttcctttctatccgatgtgtcgaatgatgccaaaagactnaaatgcccttgggtccatatgtaagaggct

SEQ ID NO: 16241 - DNA, 101 bp, rice(Oryza sativa)
  misc_feature (71): n=t or g
ttggttattactatcttgcactgtgatgtttgcatgtgtgtttatttacactggatgagatgatgaggttnagaggtttgttcagaagctgtgtagtgtgt

SEQ ID NO: 16242 - DNA, 101 bp, rice(Oryza sativa)
  misc_feature (71): n=t or g
ttattctaggagtagggacaagaattatttttctttgcgtttttttctaagtttagtttaggtatcagcanatgccaagtttatgatatgatgacaaatgc

SEQ ID NO: 16243 - DNA, 101 bp, rice(Oryza sativa)
  misc_feature (71): n=a or c
taactttcctaaataaaaatgcactactaaattattctcttcgcttttaaataatttttatataattgatntaacactattcaaatatatcaaattcaaaa

SEQ ID NO: 16244 - DNA, 101 bp, rice(Oryza sativa)
  misc_feature (71): n=a or g
gcggccctagtacatcttcactttgtaagaatatgtttaagctcgttttccccaagacgctttccaatctnctaaacggtacgtattttacaaagtatttt

SEQ ID NO: 16245 - DNA, 101 bp, rice(Oryza sativa)
  misc_feature (71): n=t or c
ttagtttggaagccaattgctacggcctgcaacagcttaaaggcccatttaaatcgcagcattgagaaaangtaggaataggaaaaatgtaggattttgat

SEQ ID NO: 16246 - DNA, 101 bp, rice(Oryza sativa)
  misc_feature (71): n=a or g
tgtggatcattttggcccggttcacaccaaatagccaagttattatatcaaagtgagcaatttgtaagttnttgtatctatttgcactcaccacacaagtt

SEQ ID NO: 16247 - DNA, 101 bp, rice(Oryza sativa)
  misc_feature (71): n=t or g
agaatatagttatatatgtgaaaaacccatgtaggtttaaatatttttgtaggcagttgggttttactccntagttaactattctggagttacactatatg

SEQ ID NO: 16248 - DNA, 101 bp, rice(Oryza sativa)
  misc_feature (71): n=a or g
agcagaccgtcggtctcacgtccggtccgaagataactatacggaaccttttaccgggagccttactacantgttctctactaatagtagaaaataattta

SEQ ID NO: 16249 - DNA, 101 bp, rice(Oryza sativa)
  misc_feature (71): n=t or c
attagtgatcaataggtggaaccagtgcattttaagccattgtcttctcattgatccaagattttacacgngtggttgtacatttatggaagctaaattcc

SEQ ID NO: 16250 - DNA, 101 bp, rice(Oryza sativa)
  misc_feature (71): n=t or g
aaaatctaacctctccttgtacgaggaggattcgttttcaccccctcaattcaaatcttctccgtgtccgntttcaccgcctctccctccctccctcccgc

SEQ ID NO: 16251 - DNA, 101 bp, rice(Oryza sativa)
  misc_feature (71): n=t or c
gccgcgtttagtccgagtccgaggtggagcagcgtcctcaaggtggaacgacggcctcgagacgaagtgangacactggtggagaaaccatctttcgtcgg

SEQ ID NO: 16252 - DNA, 101 bp, rice(Oryza sativa)
  misc_feature (71): n=t or c
gccattgtatcaggtgtaatgtatgcaggaaagtccatactcaaatatgtatgtatccttaagtggtaccnatgtcaatgttatagatatgacaaaccatg

SEQ ID NO: 16253 - DNA, 101 bp, rice(Oryza sativa)
  misc_feature (71): n=a or g
aagtactaactgactgtaggcgaccaacatttgaaatatttttttatggcgcaccgtcgttgacagtttanattttttcaaggatgtccttgcatgatcag

SEQ ID NO: 16254 - DNA, 101 bp, rice(Oryza sativa)
  misc_feature (71): n=a or g
ttggcttattctttggctgtttaggccaaacgatagggttagaagattctgggtgatctacccaaattttngaacaatcagcaaagcttctgtttgttgca

SEQ ID NO: 16255 - DNA, 101 bp, rice(Oryza sativa)
  misc_feature (71): n=a or g
gaggatttctagttctgccccttcagcgtccattattcgttccaacacctgtagtggaaccagcaatgtcntgtagcatgataatatagttgtacaaacta

SEQ ID NO: 16256 - DNA, 101 bp, rice(Oryza sativa)
  misc_feature (71): n=a or g
gccgcttgcacccttagatgatggcctcgcaattgagcaggccttgaagtcactcatgaggaatattatanccatcctgagttctgcgaataataaaatgc

SEQ ID NO: 16257 - DNA, 101 bp, rice(Oryza sativa)
  misc_feature (71): n=a or g
ccctcttaatccttctctctatgctctccaacccacagctccaagaagtggacccccccatggctagaatngggtcacgcatggagctctagacccagacg

SEQ ID NO: 16258 - DNA, 101 bp, rice(Oryza sativa)
  misc_feature (71): n=t or c
cacagatcagaaaaagaaatcacatcacacagattggctgcacagatcagaaaaagaaatccacatcgcanagatcggccgcacacatcgcacagatcagg

SEQ ID NO: 16259 - DNA, 101 bp, rice(Oryza sativa)
  misc_feature (71): n=t or c
attgttgaaatatttggttttgagaatagaggagactaggcccccttttttttttcttaactccaaacttnaactttcttgttttccattagcacaccttt

SEQ ID NO: 16260 - DNA, 101 bp, rice(Oryza sativa)
  misc_feature (71): n=a or g
cccaggagcccctcccccctccccgcgacggcccaaacgaaagaaagcccaacagagactaggtttagtcngtagcagaggagagcctcagaggcgcaccg

SEQ ID NO: 16261 - DNA, 101 bp, rice(Oryza sativa)
  misc_feature (71): n=t or g
cgtcacaatgtgacattcgatggatctcagccatccaaaaacgaatccaacaattgctttgattgagcccncctgcagataaaaaaaatgagtaaatttca

SEQ ID NO: 16262 - DNA, 101 bp, rice(Oryza sativa)
  misc_feature (71): n=t or g
attaattggactgtgatatttttggtgcatacgttttttatatacagtaattgtttaaatctgtatttatnctcttcggccacatatgacgaactggacat

SEQ ID NO: 16263 - DNA, 101 bp, rice(Oryza sativa)
  misc_feature (71): n=t or c
atagtagccccctttgatgcaatctcctcggtgctggaagcgtctcccttgtccccttcatctatctctcngtttccctcttgatgcgacatcggatcact

SEQ ID NO: 16264 - DNA, 101 bp, rice(Oryza sativa)
  misc_feature (71): n=t or c
atgagaaaaatctgcaaacggatcggtgaacagttaatacttcattggcacaaattttgacaatttgactntttacaaaaaaaaactatttttacaaataa

SEQ ID NO: 16265 - DNA, 101 bp, rice(Oryza sativa)
  misc_feature (71): n=a or g
gccccaagctttccctccgcatgctgcacaagtcgtacaagctccgacgtacttcgccaaggctgctccgnctgcggccgtgcgcccaacccctcacatga

SEQ ID NO: 16266 - DNA, 101 bp, rice(Oryza sativa)
  misc_feature (71): n=a or g
tacataccattgcaggcccattccacctggatacgcgaaggtagagatagagctggtggaatgaacatacnaggatctcgagcttgacatccccggaggtg

SEQ ID NO: 16267 - DNA, 101 bp, rice(Oryza sativa)
  misc_feature (71): n=t or g
tggcgcgcgtaggcgtcccaggtgcggatgccgtcgacggcgtagatggtttggtcgaagatgagcaggtnccaccggagccacacctcccggcccagcgg

SEQ ID NO: 16268 - DNA, 101 bp, rice(Oryza sativa)
  misc_feature (71): n=t or c
ctagtaaattatatctataaacacaaagcacctgtcggttcgtggtgacggaggtttttttttctttttcntggttacaatctttcatggtgcaagccaaa

SEQ ID NO: 16269 - DNA, 101 bp, rice(Oryza sativa)
  misc_feature (71): n=t or c
cgaggaaccatctattttcgattttactcacctacccgagaaaacattgcactaggaaaatgcatgtcacnatgccatggagaaaagaaaacgagaagggc

SEQ ID NO: 16270 - DNA, 101 bp, rice(Oryza sativa)
  misc_feature (71): n=t or c
gatggtttcctactccgttgaggaaacgacaacaattgtgtgtcacagtattcctgcggcacacccttctntggtagaacctctttgtcagccgagtcact

SEQ ID NO: 16271 - DNA, 101 bp, rice(Oryza sativa)
  misc_feature (71): n=a or g
agcttaataaattttattaaggagggggggggggagtaaaaacattttacagatgctcagcaagtttgaancgtcttgggaccgcaagcggtgtcctaaac

SEQ ID NO: 16272 - DNA, 101 bp, rice(Oryza sativa)
  misc_feature (71): n=t or c
tgatttgaccatctgctttgagcagcccaacgttcttgaatttttaccaccgaatgatcaagatgatctanaaagaaacaaccaaatcacatccacagagc

SEQ ID NO: 16273 - DNA, 101 bp, rice(Oryza sativa)
  misc_feature (71): n=t or c
gctggaggggccgattgatttgagctttaatcaacgtggtagaaagcccgaagcgtatacaaatctctatntcatatcttttttaccgtaatctcgtgtat

SEQ ID NO: 16274 - DNA, 101 bp, rice(Oryza sativa)
  misc_feature (71): n=t or c
ggtgggagcggcgccagatggctgccattgccatccttgttgcccccttccgccaccacctccctcagatngtgcatgaggctgacttggctttcgagagg

SEQ ID NO: 16275 - DNA, 101 bp, rice(Oryza sativa)
  misc_feature (71): n=a or c
atgtgatcaattaagctggaagcattacactgttttacacaattggttgcgagggtgttctaaccccgatnatgctggtgtttaagattatattgagcaag

SEQ ID NO: 16276 - DNA, 101 bp, rice(Oryza sativa)
  misc_feature (71): n=a or c
gcaacaatatccttcaccaagtcctctctcgtgccaagaacccattcactgtataaaaagaacactagatnaattggatatactacatctgattttgaaca

SEQ ID NO: 16277 - DNA, 101 bp, rice(Oryza sativa)
  misc_feature (71): n=t or c
tcacatcatcaccgaaaataatttgagacttatgctccaaacaacaagaaatgcggaagacagcaagcagntagtctgcatcaagccaggctgcaacacag

SEQ ID NO: 16278 - DNA, 101 bp, rice(Oryza sativa)
  misc_feature (71): n=t or c
gttgatgctagtgcaactgcaacatactgttcagatggatgtcccaacgagctcaaaacaacttaggtggngcgtcgcgattcatcaataactcaaatgga

SEQ ID NO: 16279 - DNA, 101 bp, rice(Oryza sativa)
  misc_feature (71): n=t or c
aacttccggatttgataaagtaagagcattctaatgtttatattggtatgtgggggatgaataaaaaaaanaagctttagggtccctttgaatcgcaggaa

SEQ ID NO: 16280 - DNA, 101 bp, rice(Oryza sativa)
  misc_feature (71): n=t or c
ttttaatcatcgcatacataccttgcttgagtacaatgaatgcagttcgagtgttcacacttcatgacttnctttgtaacttcaagttaatcacagtcaat

SEQ ID NO: 16281 - DNA, 101 bp, rice(Oryza sativa)
  misc_feature (71): n=t or g
ctggataaagaatttatagctaagatttgattcggggacggagagtgtattttgcagatacatgcctattnctgtgtatttgatgctgtgtgtactacata

SEQ ID NO: 16282 - DNA, 101 bp, rice(Oryza sativa)
  misc_feature (71): n=a or g
taaatttacgagttagagctctaccaaacggacccttaatactatacctaacttgtagcttctaaaaattnacacatcatctagtgtcattttaatttatt

SEQ ID NO: 16283 - DNA, 101 bp, rice(Oryza sativa)
  misc_feature (71): n=t or c
ttatctaataaatattcaatctgagcataacaatgacaacttggtgcccatgagaaacaaataccacaagngtgtcaaccaaaagtaaaaataaagtcatt

SEQ ID NO: 16284 - DNA, 101 bp, rice(Oryza sativa)
  misc_feature (71): n=a or c
tccgtgccggacaataaggttggataagggttggctggctgtagggaagaaaggtcatgaaatcatctgtntttgttgtgtgtttgtatttgtatatggac

SEQ ID NO: 16285 - DNA, 101 bp, rice(Oryza sativa)
  misc_feature (71): n=a or g
ctaacacaaaggcccctgggacagctgaaacgtcatctaatgaatctgatgtcaaggcaaccaaggacaanggcacagatggggaattgaagcatcctaaa

SEQ ID NO: 16286 - DNA, 101 bp, rice(Oryza sativa)
  misc_feature (71): n=t or g
ttggtttaccagggcacaaccatctcactccaatagttaaattatctggtggacagaaggcccgtgttgtnttcacttcaatatcaatgtcacatccccac

SEQ ID NO: 16287 - DNA, 101 bp, rice(Oryza sativa)
  misc_feature (71): n=a or c
aaaggaccgaaatgaaaaggagaggaaaagaaaagaactggccaaacgggtgcttcccaaatgaatgacanaccatacactgttcaaaataaatgtaaatg

SEQ ID NO: 16288 - DNA, 101 bp, rice(Oryza sativa)
  misc_feature (71): n=t or g
aacattccatggtcaacccaacccacaaaaaaaagaaggttgatgcatgcacaccacaattgaagtcagcntgccatctaaacaggtgttacaacaagtta

SEQ ID NO: 16289 - DNA, 101 bp, rice(Oryza sativa)
  misc_feature (71): n=t or c
cacctgatggtcggctacatccggaggttgaaggtgagggtcagattgagagactaacttgtgcggtcaangttgcttttccacgctagcacgccaacaag

SEQ ID NO: 16290 - DNA, 101 bp, rice(Oryza sativa)
  misc_feature (71): n=a or g
caccactccactcgccacccatcgccgttgccactgctccagcgctgatgtagcttgcagaaggccgaagnggagaggaagatcaagaaagcgagaaggga

SEQ ID NO: 16291 - DNA, 101 bp, rice(Oryza sativa)
  misc_feature (71): n=t or g
atagacgtgaaccctttgacaaatgaaaaagatttcaaaccaaccttttattcggtggagcgagaagaganattctcctctcttttttttcgcttgtgact

SEQ ID NO: 16292 - DNA, 101 bp, rice(Oryza sativa)
  misc_feature (71): n=t or c
aagtaatagaatcaccatattgattcacatgtcctccagacataggttggttctttttgtagtttcactgngagccgattgacgagactgcactagactcg

SEQ ID NO: 16293 - DNA, 101 bp, rice(Oryza sativa)
  misc_feature (71): n=a or g
ctgagctggagcgaatgttggttcaacatgtctttccggagttcagtagtcatgttggacacttacgtgcnaaggtaacaagctataaattggtgtgcatt

SEQ ID NO: 16294 - DNA, 101 bp, rice(Oryza sativa)
  misc_feature (71): n=a or c
aggcatctttccaaaccgacaaaaccctaacgatacacactagtgtggctagaaaggcaggtgcgttcccncttgtgcaatacgcgtgccttcgcatgtgt

SEQ ID NO: 16295 - DNA, 101 bp, rice(Oryza sativa)
  misc_feature (71): n=a or c
gctgcctttggttttttgggatttgaggaaaattgggtaattcttaaggatttgagggatttgggtagtantattcacacctttggattggagatttgaag

SEQ ID NO: 16296 - DNA, 101 bp, rice(Oryza sativa)
  misc_feature (71): n=t or c
ggtatttttgctctccccaaattgcatatatagagtgtttccctttctctatttactactacctccgtttnaggttataagactttccagcattactcaca

SEQ ID NO: 16297 - DNA, 101 bp, rice(Oryza sativa)
  misc_feature (71): n=a or g
cacagcttatgcgtattctcaaaaaaacttgcaagcccatcgtacagtttcatggttgattactgaccacnagatcagaaacaggactacaggagtgtata

SEQ ID NO: 16298 - DNA, 101 bp, rice(Oryza sativa)
  misc_feature (71): n=t or c
taactagtgtcatttgaaaccatattggcagcaggccaacaatgcaatttatgtaccccatttgcatatanaggcccgtgcgtcaacaaactactagcttc

SEQ ID NO: 16299 - DNA, 101 bp, rice(Oryza sativa)
  misc_feature (71): n=a or g
agatgaagtagtatatagctagggtgggtggctatgatgatcggacgacgagggtgtggtggtgatgtgantgttgggattccacctcctcatcctgcgat

SEQ ID NO: 16300 - DNA, 101 bp, rice(Oryza sativa)
  misc_feature (71): n=a or g
aatcgaacatccctttattcccttcgtccaaaaatttagtagcctgggatgagataaaggctctatttggngagcttaacattctgagaatttgctagttg

SEQ ID NO: 16301 - DNA, 101 bp, rice(Oryza sativa)
  misc_feature (71): n=a or g
aaaaggccattttgtacgtactttcttctcggttgcaggacttgtaaatgttccacaatgagtcaaggggncaaagacatagcaattaatatatgcaagtc

SEQ ID NO: 16302 - DNA, 101 bp, rice(Oryza sativa)
  misc_feature (71): n=t or c
ctatatcgcgtgatacacccacaagccaacaacgcagtctcaacagcacactttgctatcgttctatatgntaacatagattggaaattatagtcgcgcac

SEQ ID NO: 16303 - DNA, 101 bp, rice(Oryza sativa)
  misc_feature (71): n=t or c
tcaccttttagctcaatgttcagagctaaaaacttgtaatatctaccgtgatataatccctgagccaatcnaggaagtactgctgtctgatcttaattaat

SEQ ID NO: 16304 - DNA, 101 bp, rice(Oryza sativa)
  misc_feature (71): n=a or g
ttggtaatacctctggttgcttcttacactggcattattattaacctactatgcactacttcatccattcnaaaatataagtatttttagaatagaggggt

SEQ ID NO: 16305 - DNA, 101 bp, rice(Oryza sativa)
  misc_feature (71): n=t or g
aggttggggaaggcggtgttggtggggaggccggcaatgtcggggaacttccacatgccgatgtagaggcnggtgagggtggagatgcggaggatggcggc

SEQ ID NO: 16306 - DNA, 101 bp, rice(Oryza sativa)
  misc_feature (71): n=t or g
ccacactgcaattatcatttcacaggatgaaactatggattttcacagggagaggaccaaaggcaaaaaanaaaacacttaattaaaaagcagtcatgctc

SEQ ID NO: 16307 - DNA, 101 bp, rice(Oryza sativa)
  misc_feature (71): n=t or g
ccacatattagcgatatgacatcgaatattcggtttcttgatgtggggctaaacaccacgtacttgcgctntgaacgccctcatactttattctcagcctt

SEQ ID NO: 16308 - DNA, 101 bp, rice(Oryza sativa)
  misc_feature (71): n=a or g
acatgacaggtcagcttatggaagtcgagaagcaggacatgtctggtgatgttgcatgcctggccattgcnccagttccagaggggagacagaggtcccga

SEQ ID NO: 16309 - DNA, 101 bp, rice(Oryza sativa)
  misc_feature (71): n=t or c
cattaggcccaggctgtggtccagcaggaggtaaatcatcttcaggtgggatgtttgcaaaatctccatcnagtacaaaaacagaaatagtccatgattca

SEQ ID NO: 16310 - DNA, 101 bp, rice(Oryza sativa)
  misc_feature (71): n=a or g
actccaaaattttaattgtatagtactattccgatcccattgtataacagttaggcctcctttaaaactangtgattcccagcgtcttgctacggggatta

SEQ ID NO: 16311 - DNA, 101 bp, rice(Oryza sativa)
  misc_feature (71): n=a or g
aacttgtgtggtccatataatcttgatagggttcatctgctcttgtccatgatgccttggactccttaacnaaccgggttcccttttgttaggcaccggtt

SEQ ID NO: 16312 - DNA, 101 bp, rice(Oryza sativa)
  misc_feature (71): n=a or g
catgcatgactgcatcgcggtgtctcgttgctctcatatctgcagtcagtttactactcctacatgaaagntcagctttcaacggcacgatgggctggttt

SEQ ID NO: 16313 - DNA, 101 bp, rice(Oryza sativa)
  misc_feature (71): n=a or g
agaccgcactactagaataccatgccacccacaagatgagcccaaggctgatattgattgtggagattatnggtaccccatacccatatggcgtgattatc

SEQ ID NO: 16314 - DNA, 101 bp, rice(Oryza sativa)
  misc_feature (71): n=t or c
tcagatacatactccagcaccacctgatgctcctagccgctacttccttttcaccccacctaccactgccnactgtagtggacccccgtttttataacagg

SEQ ID NO: 16315 - DNA, 101 bp, rice(Oryza sativa)
  misc_feature (71): n=a or c
agtttaattgtatttgtttaacaggaaatgggatttctaaatgatctcaatttaacaacagcatctgaagnagtatccgaccaacaaagcaacggaaaatt

SEQ ID NO: 16316 - DNA, 101 bp, rice(Oryza sativa)
  misc_feature (71): n=a or g
ctatttatttgacaagtactataatatactcacaggatttctttgaaagagagcatttgtttcccccatcnctctaagatgttcaacaagttccaaagcta

SEQ ID NO: 16317 - DNA, 101 bp, rice(Oryza sativa)
  misc_feature (71): n=t or g
tgtgacagcacagtgtaaaactgaaagaccaacaaatttatgcagctatatccactaattttttgaatgcncgtcagccaggtcgaaccgaaatttatttc

SEQ ID NO: 16318 - DNA, 101 bp, rice(Oryza sativa)
  misc_feature (71): n=a or g
agtatattcctagacaagagggcatcagactttaccaagtgagaaaacaagctctagtttcaagggacacnaagctttaattggtgatctttcagattttt

SEQ ID NO: 16319 - DNA, 101 bp, rice(Oryza sativa)
  misc_feature (71): n=t or c
cagctgtattgccggtcagagtcaccggtcgacgcgccgctataaataccgtcctcctccacatcactatntctccaacccccatcgccaccaccaccacc

SEQ ID NO: 16320 - DNA, 101 bp, rice(Oryza sativa)
  misc_feature (71): n=t or c
ttcaaatgattgtagaccatattgaatacaccacgtatcgcatttggttcaggtttacctgattagatagnttgtaaaacaaggtagcattatcttggtaa

SEQ ID NO: 16321 - DNA, 101 bp, rice(Oryza sativa)
  misc_feature (71): n=t or c
ggtcagcttcggagttggtgatgtgcttcggagcccttggtcggctctgaagcctttagtcggactcgatnatcggggtagctgttgccttcggtcattct

SEQ ID NO: 16322 - DNA, 101 bp, rice(Oryza sativa)
  misc_feature (71): n=t or g
tctgacacggtttttttgtcccaagcaacgatctcatgcactctctctggctagttgttccattgctgccnccagctagaagccatgcaagaagaggcaac

SEQ ID NO: 16323 - DNA, 101 bp, rice(Oryza sativa)
  misc_feature (71): n=t or c
tggcctcaatgtccttgcgttctcgtcttttggctaatcttaatttggctttttccagattgaattggtgntgctcaagataaacagctggagtaaggatg

SEQ ID NO: 16324 - DNA, 101 bp, rice(Oryza sativa)
  misc_feature (71): n=t or c
gggttctgaacttctgattcttcagaactgcaaaagtgagctttgaacagttcatcacctctcagctgcantctgaagattgagtattatggtcataaaac

SEQ ID NO: 16325 - DNA, 101 bp, rice(Oryza sativa)
  misc_feature (71): n=a or c
aatacaagtgattcctaatattggctgctattgtaccataacattagattatgataatttgctttgcaacnaacaagctcaattaatcgaaatttgtaatt

SEQ ID NO: 16326 - DNA, 101 bp, rice(Oryza sativa)
  misc_feature (71): n=a or g
tgttggcggtatagaatcaacatttaacagccgccaacactaagtgtggggggtttgttggcagctattanatgcaaattctatgccgccaatacctgcat

SEQ ID NO: 16327 - DNA, 101 bp, rice(Oryza sativa)
  misc_feature (71): n=t or c
taatcagaatttgctaagatttgcacctaagcgattcataacacacgctcatgatcagcaaatttctaacntcgctaaatttctacggagttgctaaaaat

SEQ ID NO: 16328 - DNA, 101 bp, rice(Oryza sativa)
  misc_feature (71): n=a or g
aagccatcgccagatctggccctcacaggtcacgaatgccatgaccgccgctgcatctaactgcacgcacncgcatacatcgagtcttagagcaagtttaa

SEQ ID NO: 16329 - DNA, 101 bp, rice(Oryza sativa)
  misc_feature (71): n=t or c
acaatcaaacagccagccagatggagattggggagtatctaatgccctggctggtacttggctgtacatanactcctgattggagagtacaacgtatcacg

SEQ ID NO: 16330 - DNA, 101 bp, rice(Oryza sativa)
  misc_feature (71): n=t or c
ggtcatgttcgtggcccatatatgaccgctgattagggaagttgatgggccacgtgaagtgctcagtcaancactacactggccaaggtcacctgtgacgg

SEQ ID NO: 16331 - DNA, 101 bp, rice(Oryza sativa)
  misc_feature (71): n=a or c
agttgatcaagtcttcacgacttgtttgtgattcttcaggatcacaatcatgggctattctttgctccccntgatccttgcaattcactaagtcgtctcat

SEQ ID NO: 16332 - DNA, 101 bp, rice(Oryza sativa)
  misc_feature (71): n=t or c
atggttgttcataacttttttgaaagcaatgtcagaaaaagcacaaaaaaacaattataactgatcagganggagctatgaggtcagcaataagacagatt

SEQ ID NO: 16333 - DNA, 101 bp, rice(Oryza sativa)
  misc_feature (71): n=t or c
acccttatattattcgtactatctctataatggcaaaggaacacaaattgtagagtccagaccagggtttnccaaaccgtcggggttgagtttaccgcgcc

SEQ ID NO: 16334 - DNA, 101 bp, rice(Oryza sativa)
  misc_feature (71): n=t or c
taccatttttaaaatttagttcttgacaaacgatagttttagttttatagcagtaccgttactaataatantacgatttcacgatgatgttactgccaaaa

SEQ ID NO: 16335 - DNA, 101 bp, rice(Oryza sativa)
  misc_feature (71): n=t or g
tttctgctacaaaaatatacgttcaaatgtctttattaacccacgtgtatcatgtatatatatgttcgggnttttttttttccttttttgatttgtgacca

SEQ ID NO: 16336 - DNA, 101 bp, rice(Oryza sativa)
  misc_feature (71): n=t or g
tttaattcaattttcctatgtgttggattgactagctttgacttttgaggctcttccaaacaaacccaagngacacatacgaatattattacctttttgta

SEQ ID NO: 16337 - DNA, 101 bp, rice(Oryza sativa)
  misc_feature (71): n=t or c
atactcagaaacaacataaacactccagatcaactcagcaagagtaaaaaatgaccatgcattagagcatntccaagagcctagccaaatggttctccaag

SEQ ID NO: 16338 - DNA, 101 bp, rice(Oryza sativa)
  misc_feature (71): n=t or c
aagcatttgagaaatctatttttaagagtatttgcttgatgggccaccttttgttactttcagtttcctantctgtgtaaacatctctatcatcaattcat

SEQ ID NO: 16339 - DNA, 101 bp, rice(Oryza sativa)
  misc_feature (71): n=a or g
agaaagtttgatgttacaaatacaaaccttctcgatgagtagaaactgtcatttgagtgtatgcgtgttcntgggtgtgcatgtgtgtgtgtaggcggggg

SEQ ID NO: 16340 - DNA, 101 bp, rice(Oryza sativa)
  misc_feature (71): n=t or c
atataacataacagcatgctattgtgatcacataactgtatgactccgtcattgaagccaacaagcacttntcattaaaaaaaaaactaacaagctaagct

SEQ ID NO: 16341 - DNA, 101 bp, rice(Oryza sativa)
  misc_feature (71): n=t or c
ccaccaacacaaacaccatgcatgcatcagcaatcagcaaccactctccttcgagttgggatctctcctgnaatgcatgtgcggtaagtgccaatgacatg

SEQ ID NO: 16342 - DNA, 101 bp, rice(Oryza sativa)
  misc_feature (71): n=t or c
agccttctatcattagttaggtgccacggagatatgtgctcccttcgtttcagtctataagacattttgantttagtcgatgtcaaactactccaggtttg

SEQ ID NO: 16343 - DNA, 101 bp, rice(Oryza sativa)
  misc_feature (71): n=a or g
aaagtcgatactaaattaatgaatcaacagatacttaaatggtttttgataacaaagtagctaccccacanttaattaattaggagcatctcgataggcaa

SEQ ID NO: 16344 - DNA, 101 bp, rice(Oryza sativa)
  misc_feature (71): n=a or g
ccaatgccattgatttcttttgtcctctgtccaccaatcttcgaaattttgtctggctagcagggaaagcnagcaggcaggttcagtggtcagtgcagaga

SEQ ID NO: 16345 - DNA, 101 bp, rice(Oryza sativa)
  misc_feature (71): n=a or g
gggctgatcaggacgtctttgacccgctgtgtcacgacatctgcagggagaactggaacacaagaaaaaanacaaaagtgagtcagatctcaaatttaaga

SEQ ID NO: 16346 - DNA, 101 bp, rice(Oryza sativa)
  misc_feature (71): n=t or c
cactattcccagtagtcataccatcaaaataatgcacatcaggtgaaaatctctagaactttgcataatangtggtcaccaatccacggaaccgcaccaaa

SEQ ID NO: 16347 - DNA, 101 bp, rice(Oryza sativa)
  misc_feature (71): n=t or c
cggcatacctcctcttgcatcaatgtcagttctcctagtctcggcgaaagttgaaggaaacgaagcacagnatagaaatcctcagttaaacaccacttacc

SEQ ID NO: 16348 - DNA, 101 bp, rice(Oryza sativa)
  misc_feature (71): n=a or g
aatatgcaaataaaacaagcagagtatctaactatagcaattttttttcaacaattgaaatcaacaacatnacataatattcatctctcaagttagaatta

SEQ ID NO: 16349 - DNA, 101 bp, rice(Oryza sativa)
  misc_feature (71): n=t or c
gaattatagccactcctagagccacttgcatcgtaaagaactcaaaatttagacccgtagccctagcctanatggctttccggggctcctcttatgagtag

SEQ ID NO: 16350 - DNA, 101 bp, rice(Oryza sativa)
  misc_feature (71): n=t or c
cgcatcatcagctctacaggagggatgtttggtcacttgactggctagccttggcagagcctcatgggttnatatctatcttctattatatacttaaaaat

SEQ ID NO: 16351 - DNA, 101 bp, rice(Oryza sativa)
  misc_feature (71): n=t or c
gtgcagacttaccgagtataggatggcgagcaagctgatgtcaaatcttagcttccatctggagaagtcgngctctgcgaccaccgcgacgacaaacgact

SEQ ID NO: 16352 - DNA, 101 bp, rice(Oryza sativa)
  misc_feature (71): n=t or c
gtaatatgactgtggcgcattctaggccgacaaatttagttgttgctgccagcaacaatcataatattttnagttctatgggtctggaaaatacctctttc

SEQ ID NO: 16353 - DNA, 101 bp, rice(Oryza sativa)
  misc_feature (71): n=a or g
ataattttcttgtagggtatccagcacaactgatgcgaatagcttcaagaacaccctgaaaggatgacccnttaggttatataatagtactggctttctct

SEQ ID NO: 16354 - DNA, 101 bp, rice(Oryza sativa)
  misc_feature (71): n=a or g
ataatctcctatattgtgggacggagaaagtttaagcaagattgtcaagatcggtatcctatgtagtatcnttttgctcaaagtagtatcgtatcgtagta

SEQ ID NO: 16355 - DNA, 101 bp, rice(Oryza sativa)
  misc_feature (71): n=a or g
gaaagagaattataacttatctgaccactcacaagtctacaagactcatatatatttataagaatgaggcncgtcgtgcttgttgggttacgaagttccta

SEQ ID NO: 16356 - DNA, 101 bp, rice(Oryza sativa)
  misc_feature (71): n=a or g
agggctagatgggggacctagtattggtccggaaacaattcggcccgtatttattattgagtacatcttcnagagtactcccttcgtcctaaaaaaaacaa

SEQ ID NO: 16357 - DNA, 101 bp, rice(Oryza sativa)
  misc_feature (71): n=t or c
aaggcagagccagtaatacaacacgaatcggtgttctcacctggagatcattggtaataatgtcaagaaancggaaatatttctggagcagatttgccttg

SEQ ID NO: 16358 - DNA, 101 bp, rice(Oryza sativa)
  misc_feature (71): n=a or g
aatataggggagttcaagtgatatcagaattcagaagcataggaaggtaacgttgagctatcacagctcgngtcaaaattctttcttgttccaatagcttg

SEQ ID NO: 16359 - DNA, 101 bp, rice(Oryza sativa)
  misc_feature (71): n=a or g
atattataaaaatgtgattactcatagctgcgggcaggcatgtgttaatttttaaatacttgggttcgtanagtatagccacaggaaaaacatagaggcta

SEQ ID NO: 16360 - DNA, 101 bp, rice(Oryza sativa)
  misc_feature (71): n=a or g
gttttcttttaaactgtactcgcagtatatgaacttacatggttggatgcacgtaggtataacaagttgtnaatagttcattttggtatagtaacttgact

SEQ ID NO: 16361 - DNA, 101 bp, rice(Oryza sativa)
  misc_feature (71): n=t or g
gtgggttggtagtcgaacggaccaacccattgccccttcgaatgtgatgaaaatggtggattaaattttgnattaaagtggcacgctttttaaactgctaa

SEQ ID NO: 16362 - DNA, 101 bp, rice(Oryza sativa)
  misc_feature (71): n=t or g
tcactcgtgtgtgatctcaagtggaagtgattagtgatccagttcttttggcagatatttgttggatcttnctaatttcaaccatgacgagagcccatgat

SEQ ID NO: 16363 - DNA, 101 bp, rice(Oryza sativa)
  misc_feature (71): n=t or c
aaatctcttatacagaaatgatgttaaagtattcttaagtgcgtgatcaatcattgcactctcggatggtntccacttgcttatcaaaatcatgccatttt

SEQ ID NO: 16364 - DNA, 101 bp, rice(Oryza sativa)
  misc_feature (71): n=a or c
tgtccctcacgagctcacgacctcagtatccaaggatgccacaaggtttggccttctactctcccttcccnttccctttatgatttttctctgttaactag

(The sequence listing continues in the following parts.)

What is claimed is:

1. A collection of marker nucleic acids for rice genotyping, wherein the collection of marker nucleic acids consists of 58,290 nucleotide sequences, wherein each of the nucleotide sequences is coupled to a bead and comprises a SNP and the nucleotide sequences thereof consist of SEQ ID NOs.1-58,290.

2. A rice whole genome breeding chip, wherein the rice whole genome breeding chip comprises 58,290 nucleotide sequences, wherein each of the nucleotide sequences is coupled to a bead and comprises a SNP and the nucleotide sequences consist of SEQ ID NOs.1-58,290.

3. A method comprising using the rice whole genome breeding chip according to claim 2 to identify a DNA fingerprint of a rice germplasm resource, wherein the method comprises:
   (1) extracting genomic DNA from a rice germ plasma resource;
   (2) applying the extracted genomic DNA to the chip;
   (3) detecting hybridization between the extracted genomic DNA and the nucleotide sequences on the chip to produce genotyping data;
   (4) analyzing the genotyping data; and
   (5) identifying the DNA fingerprint of the rice germplasm resource based on the genotyping data.

4. A method comprising using the rice whole genome breeding chip according to claim 2 to identify a genotype of a rice hybrid progeny, wherein the method comprises:
   (1) extracting genomic DNA from a sample obtained from a rice hybrid progeny;
   (2) applying the extracted genomic DNA to the chip;
   (3) detecting hybridization between the extracted genomic DNA and the nucleotide sequences on the chip to produce genotyping data;
   (4) analyzing the genotyping data; and (5) identifying the genotype of the rice hybrid progeny based on the genotyping data.

5. A method comprising using the rice whole genome breeding chip according to claim 2 to identify a rice variety, wherein the method comprises:
(1) extracting genomic DNA from a rice sample;
(2) applying the extracted genomic DNA to the chip;
(3) detecting hybridization between the extracted genomic DNA and the nucleotide sequences on the chip to produce genotyping data;
(4) analyzing the genotyping data; and
(5) identifying the rice variety based on the genotyping data.

6. A method comprising using the rice whole genome breeding chip according to claim 2 to identify a genetic background of a rice breeding material, wherein the method comprises:
(1) extracting genomic DNA from a rice breeding material;
(2) applying the extracted genomic DNA to the chip;
(3) detecting hybridization between the extracted genomic DNA and the nucleotide sequences on the chip to produce genotyping data;
(4) analyzing the genotyping data; and
(5) identifying the genetic background of the rice breeding material based on the genotyping data.

7. A method comprising using the rice whole genome breeding chip according to claim 2 to perform a rice genome-wide association study, wherein the method comprises:
(1) extracting genomic DNA from rice samples having a specific trait;
(2) applying the extracted genomic DNA to the chip;
(3) detecting hybridization between the extracted genomic DNA and the nucleotide sequences on the chip to produce genotyping data; and
(4) analyzing the genotyping data to detect an association between the genotype of the samples and the specific trait, thereby performing a genome wide association study.

* * * * *